United States Patent 10,706,955 (BIOINFORMATIC PROCESSES FOR DETERMINATION OF PEPTIDE BINDING) - sequence listing, part 6

SEQ ID NO: 193059 - protein, 9 aa, Mycobacterium bovis
QNDPRSTYK

SEQ ID NO: 193060 - protein, 5 aa, Mycobacterium bovis
QNPYL

SEQ ID NO: 193061 - protein, 10 aa, Mycobacterium bovis
QNRASGAEIG

SEQ ID NO: 193062 - protein, 13 aa, Mycobacterium bovis
QNSGTAFSGAVQS

SEQ ID NO: 193063 - protein, 10 aa, Mycobacterium bovis
QPAVGQDDRG

SEQ ID NO: 193064 - protein, 14 aa, Mycobacterium bovis
QPPAGSFSPGGHDA

SEQ ID NO: 193065 - protein, 17 aa, Mycobacterium bovis
QPTDPRTLPPDAPDDRK

SEQ ID NO: 193066 - protein, 12 aa, Mycobacterium bovis
QQGNPPDAPQLA

SEQ ID NO: 193067 - protein, 7 aa, Mycobacterium bovis
QQNSAGR

SEQ ID NO: 193068 - protein, 9 aa, Mycobacterium bovis
QRESAPVDV

SEQ ID NO: 193069 - protein, 18 aa, Mycobacterium bovis
QRNSKTAGASVGDLATDP

SEQ ID NO: 193070 - protein, 9 aa, Mycobacterium bovis
QRPDSETDW

SEQ ID NO: 193071 - protein, 4 aa, Mycobacterium bovis
QRPN

SEQ ID NO: 193072 - protein, 15 aa, Mycobacterium bovis
QRPQPTDPAGTPCPH

SEQ ID NO: 193073 - protein, 6 aa, Mycobacterium bovis
QRRDHR

SEQ ID NO: 193074 - protein, 5 aa, Mycobacterium bovis
QRRSL

SEQ ID NO: 193075 - protein, 5 aa, Mycobacterium bovis
QRSSI

SEQ ID NO: 193076 - protein, 16 aa, Mycobacterium bovis
QSAARREWGQLFAHAA

SEQ ID NO: 193077 - protein, 8 aa, Mycobacterium bovis
QSAETTRV

SEQ ID NO: 193078 - protein, 4 aa, Mycobacterium bovis
QSGK

SEQ ID NO: 193079 - protein, 10 aa, Mycobacterium bovis
QSIPGPSNLG

SEQ ID NO: 193080 - protein, 6 aa, Mycobacterium bovis
QSSNGP

SEQ ID NO: 193081 - protein, 17 aa, Mycobacterium bovis
QTAPTSPNNQHRAATSI

SEQ ID NO: 193082 - protein, 22 aa, Mycobacterium bovis
QTIERTDADERVDDGTGSDTPK

SEQ ID NO: 193083 - protein, 6 aa, Mycobacterium bovis
QTPTPP

SEQ ID NO: 193084 - protein, 9 aa, Mycobacterium bovis
QTRDLSNEA

SEQ ID NO: 193085 - protein, 8 aa, Mycobacterium bovis
QTSDEVTV

SEQ ID NO: 193086 - protein, 6 aa, Mycobacterium bovis
QTSESL

SEQ ID NO: 193087 - protein, 5 aa, Mycobacterium bovis
QTSKT

SEQ ID NO: 193088 - protein, 6 aa, Mycobacterium bovis
QVETDS

SEQ ID NO: 193089 - protein, 5 aa, Mycobacterium bovis
QVHNE

SEQ ID NO: 193090 - protein, 6 aa, Mycobacterium bovis
QVPPDR

SEQ ID NO: 193091 - protein, 5 aa, Mycobacterium bovis
QVSGI

SEQ ID NO: 193092 - protein, 11 aa, Mycobacterium bovis
QYEHGRDTAPV

SEQ ID NO: 193093 - protein, 10 aa, Mycobacterium bovis
RAAGEPGEHK

SEQ ID NO: 193094 - protein, 7 aa, Mycobacterium bovis
RAAQTDW

SEQ ID NO: 193095 - protein, 10 aa, Mycobacterium bovis
RAATTAPAGV

SEQ ID NO: 193096 - protein, 4 aa, Mycobacterium bovis
RADD

SEQ ID NO: 193097 - protein, 5 aa, Mycobacterium bovis
RADEA

SEQ ID NO: 193098 - protein, 6 aa, Mycobacterium bovis
RAEPSV

SEQ ID NO: 193099 - protein, 6 aa, Mycobacterium bovis
RAGDGV

SEQ ID NO: 193100 - protein, 7 aa, Mycobacterium bovis
RAGDREA

SEQ ID NO: 193101 - protein, 7 aa, Mycobacterium bovis
RAGGRRP

SEQ ID NO: 193102 - protein, 32 aa, Mycobacterium bovis
RAGTAGGAGRGPVGGIGGAGGVGGAGGAAGAV

SEQ ID NO: 193103 - protein, 12 aa, Mycobacterium bovis
RAIKQGTELAAR

SEQ ID NO: 193104 - protein, 8 aa, Mycobacterium bovis
RAPGSTLA

SEQ ID NO: 193105 - protein, 15 aa, Mycobacterium bovis
RASGPDSGGKARFVP

SEQ ID NO: 193106 - protein, 12 aa, Mycobacterium bovis
RASHDASEGKHN

SEQ ID NO: 193107 - protein, 9 aa, Mycobacterium bovis
RATGAAEAI

SEQ ID NO: 193108 - protein, 8 aa, Mycobacterium bovis
RAVPPYES

SEQ ID NO: 193109 - protein, 9 aa, Mycobacterium bovis
RDERTDNAG

SEQ ID NO: 193110 - protein, 12 aa, Mycobacterium bovis
RDESDRHGDGPL

SEQ ID NO: 193111 - protein, 8 aa, Mycobacterium bovis
RDGEWTTN

SEQ ID NO: 193112 - protein, 4 aa, Mycobacterium bovis
RDPN

SEQ ID NO: 193113 - protein, 6 aa, Mycobacterium bovis
RDPRDA

SEQ ID NO: 193114 - protein, 16 aa, Mycobacterium bovis
RDRDEQRPVLSRRTDD

SEQ ID NO: 193115 - protein, 5 aa, Mycobacterium bovis
RDSDE

SEQ ID NO: 193116 - protein, 5 aa, Mycobacterium bovis
RDTED

SEQ ID NO: 193117 - protein, 5 aa, Mycobacterium bovis
RDVAA

SEQ ID NO: 193118 - protein, 12 aa, Mycobacterium bovis
REAAATANRAGV

SEQ ID NO: 193119 - protein, 4 aa, Mycobacterium bovis
REEE

SEQ ID NO: 193120 - protein, 4 aa, Mycobacterium bovis
REEY

SEQ ID NO: 193121 - protein, 7 aa, Mycobacterium bovis
REGGHSR

SEQ ID NO: 193122 - protein, 8 aa, Mycobacterium bovis
RELRNNTA

SEQ ID NO: 193123 - protein, 4 aa, Mycobacterium bovis
REPP

SEQ ID NO: 193124 - protein, 5 aa, Mycobacterium bovis
RERPV

SEQ ID NO: 193125 - protein, 7 aa, Mycobacterium bovis
RETGYTR

SEQ ID NO: 193126 - protein, 6 aa, Mycobacterium bovis
RFPDPK

SEQ ID NO: 193127 - protein, 9 aa, Mycobacterium bovis
RGAPGGPQH

SEQ ID NO: 193128 - protein, 24 aa, Mycobacterium bovis
RGATAPRPADAASPSCGSSPSADS

SEQ ID NO: 193129 - protein, 7 aa, Mycobacterium bovis
RGDHPNH

SEQ ID NO: 193130 - protein, 9 aa, Mycobacterium bovis
RGDQKNASL

SEQ ID NO: 193131 - protein, 7 aa, Mycobacterium bovis
RGDTTPM

SEQ ID NO: 193132 - protein, 8 aa, Mycobacterium bovis
RGEQPGPM

SEQ ID NO: 193133 - protein, 4 aa, Mycobacterium bovis
RGGL

SEQ ID NO: 193134 - protein, 5 aa, Mycobacterium bovis
RGGVG

SEQ ID NO: 193135 - protein, 6 aa, Mycobacterium bovis
RGGVRG

SEQ ID NO: 193136 - protein, 35 aa, Mycobacterium bovis
RGHRNRTRRPRVSGRLGGPPHGQVGRAGRQNPRRR

SEQ ID NO: 193137 - protein, 13 aa, Mycobacterium bovis
RGSTATSSSETIT

SEQ ID NO: 193138 - protein, 12 aa, Mycobacterium bovis
RGTVNPDVETHP

SEQ ID NO: 193139 - protein, 8 aa, Mycobacterium bovis
RGWETDGG

SEQ ID NO: 193140 - protein, 5 aa, Mycobacterium bovis
RHGGT

SEQ ID NO: 193141 - protein, 6 aa, Mycobacterium bovis
RHPGTS

SEQ ID NO: 193142 - protein, 7 aa, Mycobacterium bovis
RITSPDE

SEQ ID NO: 193143 - protein, 7 aa, Mycobacterium bovis
RKDGVEA

SEQ ID NO: 193144 - protein, 6 aa, Mycobacterium bovis
RKEGNR

SEQ ID NO: 193145 - protein, 13 aa, Mycobacterium bovis
RKPKDLSGGQRQR

SEQ ID NO: 193146 - protein, 4 aa, Mycobacterium bovis
RKTK

SEQ ID NO: 193147 - protein, 8 aa, Mycobacterium bovis
RLADEGIG

SEQ ID NO: 193148 - protein, 6 aa, Mycobacterium bovis
RLATSS

SEQ ID NO: 193149 - protein, 29 aa, Mycobacterium bovis
RLDKPGGGLSGGSSSGCASHGQSPCNPTC

SEQ ID NO: 193150 - protein, 4 aa, Mycobacterium bovis
RLDP

SEQ ID NO: 193151 - protein, 12 aa, Mycobacterium bovis
RLGGSDEADHDR

SEQ ID NO: 193152 - protein, 6 aa, Mycobacterium bovis
RLSDSP

SEQ ID NO: 193153 - protein, 7 aa, Mycobacterium bovis
RNGTRLD

SEQ ID NO: 193154 - protein, 6 aa, Mycobacterium bovis
RNTPGV

SEQ ID NO: 193155 - protein, 7 aa, Mycobacterium bovis
RNTTRDE

SEQ ID NO: 193156 - protein, 4 aa, Mycobacterium bovis
RNTV

SEQ ID NO: 193157 - protein, 10 aa, Mycobacterium bovis
RPADTGPATI

SEQ ID NO: 193158 - protein, 5 aa, Mycobacterium bovis
RPDGQ

SEQ ID NO: 193159 - protein, 10 aa, Mycobacterium bovis
RPGAKTVTAL

SEQ ID NO: 193160 - protein, 12 aa, Mycobacterium bovis
RPGIGASTPHQY

SEQ ID NO: 193161 - protein, 8 aa, Mycobacterium bovis
RPGRRRPR

SEQ ID NO: 193162 - protein, 4 aa, Mycobacterium bovis
RPHP

SEQ ID NO: 193163 - protein, 33 aa, Mycobacterium bovis
RPKTPRGDGNLHPESPYARNASNVSSDPKPREG

SEQ ID NO: 193164 - protein, 26 aa, Mycobacterium bovis
RPPGCSPTPAPTTKSATALSATAHRN

SEQ ID NO: 193165 - protein, 19 aa, Mycobacterium bovis
RPPQVKSPHRGPLRTGRTH

SEQ ID NO: 193166 - protein, 4 aa, Mycobacterium bovis
RPPV

SEQ ID NO: 193167 - protein, 7 aa, Mycobacterium bovis
RPQSNHA

SEQ ID NO: 193168 - protein, 20 aa, Mycobacterium bovis
RPSGSPGPPRTSASWSPSGA

SEQ ID NO: 193169 - protein, 22 aa, Mycobacterium bovis
RPSHGGYGIPPNGMTTSITPSI

SEQ ID NO: 193170 - protein, 7 aa, Mycobacterium bovis
RPTSEAE

SEQ ID NO: 193171 - protein, 5 aa, Mycobacterium bovis
RQAEP

SEQ ID NO: 193172 - protein, 7 aa, Mycobacterium bovis
RQEDADA

SEQ ID NO: 193173 - protein, 9 aa, Mycobacterium bovis
RQLPGEGVT

SEQ ID NO: 193174 - protein, 4 aa, Mycobacterium bovis
RRAA

SEQ ID NO: 193175 - protein, 7 aa, Mycobacterium bovis
RRAPGPS

SEQ ID NO: 193176 - protein, 4 aa, Mycobacterium bovis
RREH

SEQ ID NO: 193177 - protein, 4 aa, Mycobacterium bovis
RREP

SEQ ID NO: 193178 - protein, 8 aa, Mycobacterium bovis
RRGARFST

SEQ ID NO: 193179 - protein, 5 aa, Mycobacterium bovis
RRGDR

SEQ ID NO: 193180 - protein, 9 aa, Mycobacterium bovis
RRGWGSGGA

SEQ ID NO: 193181 - protein, 9 aa, Mycobacterium bovis
RRKRMSKKK

SEQ ID NO: 193182 - protein, 9 aa, Mycobacterium bovis
RRLSPQDRR

SEQ ID NO: 193183 - protein, 12 aa, Mycobacterium bovis
RRNSRRDGQYRP

SEQ ID NO: 193184 - protein, 6 aa, Mycobacterium bovis
RRPVSV

SEQ ID NO: 193185 - protein, 9 aa, Mycobacterium bovis
RRRGGDPVS

SEQ ID NO: 193186 - protein, 17 aa, Mycobacterium bovis
RRRGRDSGHLGQPGPWG

SEQ ID NO: 193187 - protein, 5 aa, Mycobacterium bovis
RRRRA

SEQ ID NO: 193188 - protein, 6 aa, Mycobacterium bovis
RSAAEA

SEQ ID NO: 193189 - protein, 7 aa, Mycobacterium bovis
RSADDSH

SEQ ID NO: 193190 - protein, 12 aa, Mycobacterium bovis
RSDEQPKPTPGW

SEQ ID NO: 193191 - protein, 11 aa, Mycobacterium bovis
RSDGERSRRPR

SEQ ID NO: 193192 - protein, 5 aa, Mycobacterium bovis
RSGPL

SEQ ID NO: 193193 - protein, 14 aa, Mycobacterium bovis
RSGRDHSPASSGAG

SEQ ID NO: 193194 - protein, 9 aa, Mycobacterium bovis
RSHDGQLAT

SEQ ID NO: 193195 - protein, 6 aa, Mycobacterium bovis
RSNVDD

SEQ ID NO: 193196 - protein, 13 aa, Mycobacterium bovis
RSPDRDRAGQASI

SEQ ID NO: 193197 - protein, 7 aa, Mycobacterium bovis
RSQDPAV

SEQ ID NO: 193198 - protein, 7 aa, Mycobacterium bovis
RSRNSTD

SEQ ID NO: 193199 - protein, 6 aa, Mycobacterium bovis
RSSDTA

SEQ ID NO: 193200 - protein, 9 aa, Mycobacterium bovis
RSSGGDSGA

SEQ ID NO: 193201 - protein, 8 aa, Mycobacterium bovis
RSTDPDGR

SEQ ID NO: 193202 - protein, 7 aa, Mycobacterium bovis
RSTTPHH

SEQ ID NO: 193203 - protein, 4 aa, Mycobacterium bovis
RSVS

SEQ ID NO: 193204 - protein, 4 aa, Mycobacterium bovis
RSYR

SEQ ID NO: 193205 - protein, 6 aa, Mycobacterium bovis
RTDRNS

SEQ ID NO: 193206 - protein, 8 aa, Mycobacterium bovis
RTETPRTT

SEQ ID NO: 193207 - protein, 11 aa, Mycobacterium bovis
RTPAGGGDAHN

SEQ ID NO: 193208 - protein, 6 aa, Mycobacterium bovis
RTTDKP

SEQ ID NO: 193209 - protein, 12 aa, Mycobacterium bovis
RVAPAERCQTPQ

SEQ ID NO: 193210 - protein, 6 aa, Mycobacterium bovis
RVDQGR

SEQ ID NO: 193211 - protein, 11 aa, Mycobacterium bovis
RVGQPEPANMP

SEQ ID NO: 193212 - protein, 7 aa, Mycobacterium bovis
RVPDGED

SEQ ID NO: 193213 - protein, 10 aa, Mycobacterium bovis
RVTGLSGQRY

SEQ ID NO: 193214 - protein, 5 aa, Mycobacterium bovis
RVTPD

SEQ ID NO: 193215 - protein, 14 aa, Mycobacterium bovis
RYAPPPPYPAPDPF

SEQ ID NO: 193216 - protein, 6 aa, Mycobacterium bovis
RYPVSG

SEQ ID NO: 193217 - protein, 5 aa, Mycobacterium bovis
SAADH

SEQ ID NO: 193218 - protein, 9 aa, Mycobacterium bovis
SAAEPGAAG

SEQ ID NO: 193219 - protein, 4 aa, Mycobacterium bovis
SAAG

SEQ ID NO: 193220 - protein, 17 aa, Mycobacterium bovis
SAAPTDPSSSSTDSPVD

SEQ ID NO: 193221 - protein, 7 aa, Mycobacterium bovis
SADPTTI

SEQ ID NO: 193222 - protein, 15 aa, Mycobacterium bovis
SAETEAAAAGAAPAL

SEQ ID NO: 193223 - protein, 12 aa, Mycobacterium bovis
SAIEANPRQPRQ

SEQ ID NO: 193224 - protein, 5 aa, Mycobacterium bovis
SAMSK

SEQ ID NO: 193225 - protein, 8 aa, Mycobacterium bovis
SANRGPSV

SEQ ID NO: 193226 - protein, 7 aa, Mycobacterium bovis
SAPSASV

SEQ ID NO: 193227 - protein, 5 aa, Mycobacterium bovis
SAPVR

SEQ ID NO: 193228 - protein, 5 aa, Mycobacterium bovis
SARRG

SEQ ID NO: 193229 - protein, 12 aa, Mycobacterium bovis
SATTKSTTTTSC

SEQ ID NO: 193230 - protein, 9 aa, Mycobacterium bovis
SAVDDASER

SEQ ID NO: 193231 - protein, 6 aa, Mycobacterium bovis
SAVSQR

SEQ ID NO: 193232 - protein, 8 aa, Mycobacterium bovis
SCDGGLGK

SEQ ID NO: 193233 - protein, 7 aa, Mycobacterium bovis
SDAGVDS

SEQ ID NO: 193234 - protein, 5 aa, Mycobacterium bovis
SDDTS

SEQ ID NO: 193235 - protein, 8 aa, Mycobacterium bovis
SDGDFGGD

SEQ ID NO: 193236 - protein, 9 aa, Mycobacterium bovis
SDGSSAPAV

SEQ ID NO: 193237 - protein, 4 aa, Mycobacterium bovis
SDHG

SEQ ID NO: 193238 - protein, 8 aa, Mycobacterium bovis
SDNKPSDV

SEQ ID NO: 193239 - protein, 5 aa, Mycobacterium bovis
SDPEG

SEQ ID NO: 193240 - protein, 4 aa, Mycobacterium bovis
SDSL

SEQ ID NO: 193241 - protein, 37 aa, Mycobacterium bovis
SDTPETTTASRSADRSTNPKTAKHPKSATKPTVPTPA

SEQ ID NO: 193242 - protein, 5 aa, Mycobacterium bovis
SEAAD

SEQ ID NO: 193243 - protein, 4 aa, Mycobacterium bovis
SEDG

SEQ ID NO: 193244 - protein, 5 aa, Mycobacterium bovis
SEEQL

SEQ ID NO: 193245 - protein, 5 aa, Mycobacterium bovis
SEGDD

SEQ ID NO: 193246 - protein, 5 aa, Mycobacterium bovis
SEGGI

SEQ ID NO: 193247 - protein, 9 aa, Mycobacterium bovis
SEIAESGAA

SEQ ID NO: 193248 - protein, 8 aa, Mycobacterium bovis
SELPPPLH

SEQ ID NO: 193249 - protein, 4 aa, Mycobacterium bovis
SESL

SEQ ID NO: 193250 - protein, 12 aa, Mycobacterium bovis
SETSAEAAARHE

SEQ ID NO: 193251 - protein, 16 aa, Mycobacterium bovis
SFGSVTSGLAGQSWQG

SEQ ID NO: 193252 - protein, 13 aa, Mycobacterium bovis
SFSRGAREEAERI

SEQ ID NO: 193253 - protein, 5 aa, Mycobacterium bovis
SGAKD

SEQ ID NO: 193254 - protein, 4 aa, Mycobacterium bovis
SGAQ

SEQ ID NO: 193255 - protein, 23 aa, Mycobacterium bovis
SGATASGAAPLSAAELEKLFLAL

SEQ ID NO: 193256 - protein, 13 aa, Mycobacterium bovis
SGATSRFKRFRLS

SEQ ID NO: 193257 - protein, 5 aa, Mycobacterium bovis
SGDAL

SEQ ID NO: 193258 - protein, 6 aa, Mycobacterium bovis
SGDTPL

SEQ ID NO: 193259 - protein, 6 aa, Mycobacterium bovis
SGEYAA

SEQ ID NO: 193260 - protein, 7 aa, Mycobacterium bovis
SGGATVT

SEQ ID NO: 193261 - protein, 6 aa, Mycobacterium bovis
SGGGPY

SEQ ID NO: 193262 - protein, 26 aa, Mycobacterium bovis
SGGNGGSGGAGLTAGGDGGDGGNAGS

SEQ ID NO: 193263 - protein, 10 aa, Mycobacterium bovis
SGGSGGAGGF

SEQ ID NO: 193264 - protein, 24 aa, Mycobacterium bovis
SGGTGGSGGFGLDTGGAGGRGGDA

SEQ ID NO: 193265 - protein, 4 aa, Mycobacterium bovis
SGIP

SEQ ID NO: 193266 - protein, 7 aa, Mycobacterium bovis
SGLPNQT

SEQ ID NO: 193267 - protein, 6 aa, Mycobacterium bovis
SGSGSS

SEQ ID NO: 193268 - protein, 12 aa, Mycobacterium bovis
SGVGAKDRMPTP

SEQ ID NO: 193269 - protein, 5 aa, Mycobacterium bovis
SGYRY

SEQ ID NO: 193270 - protein, 11 aa, Mycobacterium bovis
SIARSEGKSVG

SEQ ID NO: 193271 - protein, 4 aa, Mycobacterium bovis
SIHN

SEQ ID NO: 193272 - protein, 9 aa, Mycobacterium bovis
SISGTAPSR

SEQ ID NO: 193273 - protein, 11 aa, Mycobacterium bovis
SKGEPLSDHSP

SEQ ID NO: 193274 - protein, 7 aa, Mycobacterium bovis
SKGGYEA

SEQ ID NO: 193275 - protein, 13 aa, Mycobacterium bovis
SKYPYTPDGNREF

SEQ ID NO: 193276 - protein, 6 aa, Mycobacterium bovis
SLDAEY

SEQ ID NO: 193277 - protein, 5 aa, Mycobacterium bovis
SLDAS

SEQ ID NO: 193278 - protein, 19 aa, Mycobacterium bovis
SLGRPDYRDDPSPAHQPGS

SEQ ID NO: 193279 - protein, 6 aa, Mycobacterium bovis
SLPPGV

SEQ ID NO: 193280 - protein, 8 aa, Mycobacterium bovis
SLSGTPAV

SEQ ID NO: 193281 - protein, 11 aa, Mycobacterium bovis
SMTTNGVSHSR

SEQ ID NO: 193282 - protein, 4 aa, Mycobacterium bovis
SNDG

SEQ ID NO: 193283 - protein, 6 aa, Mycobacterium bovis
SNGIGS

SEQ ID NO: 193284 - protein, 5 aa, Mycobacterium bovis
SNLHT

SEQ ID NO: 193285 - protein, 4 aa, Mycobacterium bovis
SNSD

SEQ ID NO: 193286 - protein, 9 aa, Mycobacterium bovis
SPASTPSEF

SEQ ID NO: 193287 - protein, 5 aa, Mycobacterium bovis
SPDLE

SEQ ID NO: 193288 - protein, 13 aa, Mycobacterium bovis
SPGFDATSPAKLG

SEQ ID NO: 193289 - protein, 10 aa, Mycobacterium bovis
SPGSRSDIGG

SEQ ID NO: 193290 - protein, 5 aa, Mycobacterium bovis
SPITK

SEQ ID NO: 193291 - protein, 7 aa, Mycobacterium bovis
SPKQFDG

SEQ ID NO: 193292 - protein, 20 aa, Mycobacterium bovis
SPLGGSASSLAAIPGASVPQ

SEQ ID NO: 193293 - protein, 8 aa, Mycobacterium bovis
SPNSPLGG

SEQ ID NO: 193294 - protein, 13 aa, Mycobacterium bovis
SPSEDAREMRQNS

SEQ ID NO: 193295 - protein, 18 aa, Mycobacterium bovis
SPSEKTRPGLAARPSTTC

SEQ ID NO: 193296 - protein, 13 aa, Mycobacterium bovis
SPSPSKRRTASRA

SEQ ID NO: 193297 - protein, 6 aa, Mycobacterium bovis
SPTWDP

SEQ ID NO: 193298 - protein, 11 aa, Mycobacterium bovis
SQGKAASYRAA

SEQ ID NO: 193299 - protein, 6 aa, Mycobacterium bovis
SQHAGS

SEQ ID NO: 193300 - protein, 4 aa, Mycobacterium bovis
SQSP

SEQ ID NO: 193301 - protein, 12 aa, Mycobacterium bovis
SRASEIAPNTTD

SEQ ID NO: 193302 - protein, 14 aa, Mycobacterium bovis
SRCSRAGAEALRQG

SEQ ID NO: 193303 - protein, 7 aa, Mycobacterium bovis
SRDAEAP

SEQ ID NO: 193304 - protein, 13 aa, Mycobacterium bovis
SREAARRTLNRPG

SEQ ID NO: 193305 - protein, 8 aa, Mycobacterium bovis
SRKVAEGR

SEQ ID NO: 193306 - protein, 13 aa, Mycobacterium bovis
SRQHRVPDHAPSR

SEQ ID NO: 193307 - protein, 12 aa, Mycobacterium bovis
SRSAGSSVRMGR

SEQ ID NO: 193308 - protein, 17 aa, Mycobacterium bovis
SRSPGLNESSHMSGRIP

SEQ ID NO: 193309 - protein, 5 aa, Mycobacterium bovis
SRSPV

SEQ ID NO: 193310 - protein, 8 aa, Mycobacterium bovis
SRSQLSPR

SEQ ID NO: 193311 - protein, 5 aa, Mycobacterium bovis
SRTTV

SEQ ID NO: 193312 - protein, 9 aa, Mycobacterium bovis
SSGPGPGSV

SEQ ID NO: 193313 - protein, 7 aa, Mycobacterium bovis
SSGREAD

SEQ ID NO: 193314 - protein, 49 aa, Mycobacterium bovis
SSGTPGEDGGNGGAGGAGGAGGAHAGDGGAGGAGGNGGAGGAGGNGAHG

SEQ ID NO: 193315 - protein, 5 aa, Mycobacterium bovis
SSPHP

SEQ ID NO: 193316 - protein, 9 aa, Mycobacterium bovis
SSPSASPKL

SEQ ID NO: 193317 - protein, 21 aa, Mycobacterium bovis
SSSRSRTPLRPPVAPSEGVAA

SEQ ID NO: 193318 - protein, 8 aa, Mycobacterium bovis
SSSTDPAI

SEQ ID NO: 193319 - protein, 8 aa, Mycobacterium bovis
SSTEQQTT

SEQ ID NO: 193320 - protein, 13 aa, Mycobacterium bovis
SSTGAPPKKVGNS

SEQ ID NO: 193321 - protein, 27 aa, Mycobacterium bovis
SSVSASVSASAATSSIRESQRQQSLTT

SEQ ID NO: 193322 - protein, 6 aa, Mycobacterium bovis
STGNGN

SEQ ID NO: 193323 - protein, 12 aa, Mycobacterium bovis
STHDTKRGEDVR

SEQ ID NO: 193324 - protein, 12 aa, Mycobacterium bovis
STLDPLRAELGG

SEQ ID NO: 193325 - protein, 35 aa, Mycobacterium bovis
STLGYGGNGGNGVNGGAGGTGGKAGVFGAPGQNGL

SEQ ID NO: 193326 - protein, 10 aa, Mycobacterium bovis
STNSAQLHTD

SEQ ID NO: 193327 - protein, 11 aa, Mycobacterium bovis
STPGRPQGRGK

SEQ ID NO: 193328 - protein, 7 aa, Mycobacterium bovis
STTTWSG

SEQ ID NO: 193329 - protein, 6 aa, Mycobacterium bovis
STVQDR

SEQ ID NO: 193330 - protein, 6 aa, Mycobacterium bovis
SVGHAG

SEQ ID NO: 193331 - protein, 6 aa, Mycobacterium bovis
SVMAPT

SEQ ID NO: 193332 - protein, 9 aa, Mycobacterium bovis
SVTSRNKVA

SEQ ID NO: 193333 - protein, 17 aa, Mycobacterium bovis
SWDPDRDAPGSAEPGDR

SEQ ID NO: 193334 - protein, 5 aa, Mycobacterium bovis
SWPNP

SEQ ID NO: 193335 - protein, 6 aa, Mycobacterium bovis
TAAHPC

SEQ ID NO: 193336 - protein, 12 aa, Mycobacterium bovis
TAANAAAAVPTS

SEQ ID NO: 193337 - protein, 5 aa, Mycobacterium bovis
TADQP

SEQ ID NO: 193338 - protein, 4 aa, Mycobacterium bovis
TAEF

SEQ ID NO: 193339 - protein, 11 aa, Mycobacterium bovis
TAGAQDARIEE

SEQ ID NO: 193340 - protein, 14 aa, Mycobacterium bovis
TAGGAGGAGGAGGL

SEQ ID NO: 193341 - protein, 5 aa, Mycobacterium bovis
TAGLQ

SEQ ID NO: 193342 - protein, 9 aa, Mycobacterium bovis
TAITPDEGA

SEQ ID NO: 193343 - protein, 9 aa, Mycobacterium bovis
TAKDPDGAP

SEQ ID NO: 193344 - protein, 16 aa, Mycobacterium bovis
TALRTPSTWMTRATAT

SEQ ID NO: 193345 - protein, 10 aa, Mycobacterium bovis
TAPAPQGPWS

SEQ ID NO: 193346 - protein, 12 aa, Mycobacterium bovis
TAPAVPNGQPVK

SEQ ID NO: 193347 - protein, 5 aa, Mycobacterium bovis
TARAQ

SEQ ID NO: 193348 - protein, 8 aa, Mycobacterium bovis
TARREAVA

SEQ ID NO: 193349 - protein, 4 aa, Mycobacterium bovis
TATG

SEQ ID NO: 193350 - protein, 8 aa, Mycobacterium bovis
TATTPAGR

SEQ ID NO: 193351 - protein, 11 aa, Mycobacterium bovis
TAVANRSGTEP

SEQ ID NO: 193352 - protein, 10 aa, Mycobacterium bovis
TDAERADHRE

SEQ ID NO: 193353 - protein, 6 aa, Mycobacterium bovis
TDKDWR

SEQ ID NO: 193354 - protein, 7 aa, Mycobacterium bovis
TDPGGEI

SEQ ID NO: 193355 - protein, 10 aa, Mycobacterium bovis
TDPNLSRPRV

SEQ ID NO: 193356 - protein, 7 aa, Mycobacterium bovis
TDTPSTI

SEQ ID NO: 193357 - protein, 7 aa, Mycobacterium bovis
TDTVGNP

SEQ ID NO: 193358 - protein, 4 aa, Mycobacterium bovis
TEAA

SEQ ID NO: 193359 - protein, 7 aa, Mycobacterium bovis
TEAAQSR

SEQ ID NO: 193360 - protein, 9 aa, Mycobacterium bovis
TEDSDGRTR

SEQ ID NO: 193361 - protein, 5 aa, Mycobacterium bovis
TEEAN

SEQ ID NO: 193362 - protein, 5 aa, Mycobacterium bovis
TEHRG

SEQ ID NO: 193363 - protein, 10 aa, Mycobacterium bovis
TEPTSPQDAW

SEQ ID NO: 193364 - protein, 6 aa, Mycobacterium bovis
TETDDR

SEQ ID NO: 193365 - protein, 9 aa, Mycobacterium bovis
TFPGASKAV

SEQ ID NO: 193366 - protein, 15 aa, Mycobacterium bovis
TGAGGTGGNGGTAGL

SEQ ID NO: 193367 - protein, 8 aa, Mycobacterium bovis
TGATARES

SEQ ID NO: 193368 - protein, 14 aa, Mycobacterium bovis
TGDFRRGSISENYR

SEQ ID NO: 193369 - protein, 14 aa, Mycobacterium bovis
TGGAGGAGGAGGNA

SEQ ID NO: 193370 - protein, 24 aa, Mycobacterium bovis
TGGTGGAGGVGTTGTGGDGGAGGA

SEQ ID NO: 193371 - protein, 5 aa, Mycobacterium bovis
TGGTQ

SEQ ID NO: 193372 - protein, 6 aa, Mycobacterium bovis
TGGVGK

SEQ ID NO: 193373 - protein, 14 aa, Mycobacterium bovis
TGKTPVSKDDAQQH

SEQ ID NO: 193374 - protein, 26 aa, Mycobacterium bovis
TGLTDQPDLSQLGDQANDTTGSSETV

SEQ ID NO: 193375 - protein, 10 aa, Mycobacterium bovis
TGPDSPNKTL

SEQ ID NO: 193376 - protein, 21 aa, Mycobacterium bovis
TGPERGEAATHSPVRWTGGRD

SEQ ID NO: 193377 - protein, 5 aa, Mycobacterium bovis
TGPEV

SEQ ID NO: 193378 - protein, 4 aa, Mycobacterium bovis
TGPT

SEQ ID NO: 193379 - protein, 8 aa, Mycobacterium bovis
TGPVGGEV

SEQ ID NO: 193380 - protein, 7 aa, Mycobacterium bovis
TGSTETG

SEQ ID NO: 193381 - protein, 5 aa, Mycobacterium bovis
TGSTG

SEQ ID NO: 193382 - protein, 10 aa, Mycobacterium bovis
TGSTPGAFDS

SEQ ID NO: 193383 - protein, 7 aa, Mycobacterium bovis
TGTGGAS

SEQ ID NO: 193384 - protein, 15 aa, Mycobacterium bovis
TGTPTLPNSGDDESA

SEQ ID NO: 193385 - protein, 4 aa, Mycobacterium bovis
THRR

SEQ ID NO: 193386 - protein, 9 aa, Mycobacterium bovis
THSTTPQLA

SEQ ID NO: 193387 - protein, 5 aa, Mycobacterium bovis
TKATG

SEQ ID NO: 193388 - protein, 7 aa, Mycobacterium bovis
TKDPEKF

SEQ ID NO: 193389 - protein, 8 aa, Mycobacterium bovis
TKKKESEI

SEQ ID NO: 193390 - protein, 7 aa, Mycobacterium bovis
TKLGETY

SEQ ID NO: 193391 - protein, 5 aa, Mycobacterium bovis
TMDPT

SEQ ID NO: 193392 - protein, 5 aa, Mycobacterium bovis
TNASR

SEQ ID NO: 193393 - protein, 12 aa, Mycobacterium bovis
TNATRHQHDAAA

SEQ ID NO: 193394 - protein, 15 aa, Mycobacterium bovis
TNQANPVPGDPTGDL

SEQ ID NO: 193395 - protein, 12 aa, Mycobacterium bovis
TNTGGGPTTNAN

SEQ ID NO: 193396 - protein, 5 aa, Mycobacterium bovis
TPAGR

SEQ ID NO: 193397 - protein, 10 aa, Mycobacterium bovis
TPATPPATLT

SEQ ID NO: 193398 - protein, 5 aa, Mycobacterium bovis
TPEHG

SEQ ID NO: 193399 - protein, 4 aa, Mycobacterium bovis
TPES

SEQ ID NO: 193400 - protein, 11 aa, Mycobacterium bovis
TPGHADFGGEV

SEQ ID NO: 193401 - protein, 5 aa, Mycobacterium bovis
TPGRA

SEQ ID NO: 193402 - protein, 7 aa, Mycobacterium bovis
TPLPPSR

SEQ ID NO: 193403 - protein, 5 aa, Mycobacterium bovis
TPPAE

SEQ ID NO: 193404 - protein, 10 aa, Mycobacterium bovis
TPQERADPKI

SEQ ID NO: 193405 - protein, 6 aa, Mycobacterium bovis
TPTSGF

SEQ ID NO: 193406 - protein, 5 aa, Mycobacterium bovis
TPTSK

SEQ ID NO: 193407 - protein, 4 aa, Mycobacterium bovis
TPTV

SEQ ID NO: 193408 - protein, 18 aa, Mycobacterium bovis
TPVANPQQVSVPEGGTVG

SEQ ID NO: 193409 - protein, 8 aa, Mycobacterium bovis
TQADVDAG

SEQ ID NO: 193410 - protein, 15 aa, Mycobacterium bovis
TQASVPPQGARKHPH

SEQ ID NO: 193411 - protein, 6 aa, Mycobacterium bovis
TQPQHR

SEQ ID NO: 193412 - protein, 13 aa, Mycobacterium bovis
TQSPYPGGGPIPE

SEQ ID NO: 193413 - protein, 5 aa, Mycobacterium bovis
TRDAV

SEQ ID NO: 193414 - protein, 5 aa, Mycobacterium bovis
TRFNA

SEQ ID NO: 193415 - protein, 20 aa, Mycobacterium bovis
TRGGDGQGAPFGADVPTPRL

SEQ ID NO: 193416 - protein, 17 aa, Mycobacterium bovis
TSAEAAQTQTRIALRSR

SEQ ID NO: 193417 - protein, 5 aa, Mycobacterium bovis
TSATD

SEQ ID NO: 193418 - protein, 5 aa, Mycobacterium bovis
TSDRC

SEQ ID NO: 193419 - protein, 5 aa, Mycobacterium bovis
TSEAA

SEQ ID NO: 193420 - protein, 4 aa, Mycobacterium bovis
TSGG

SEQ ID NO: 193421 - protein, 14 aa, Mycobacterium bovis
TSGGGAYAAAEAAA

SEQ ID NO: 193422 - protein, 6 aa, Mycobacterium bovis
TSPRAH

SEQ ID NO: 193423 - protein, 9 aa, Mycobacterium bovis
TSPTSWEQA

SEQ ID NO: 193424 - protein, 4 aa, Mycobacterium bovis
TSRY

SEQ ID NO: 193425 - protein, 8 aa, Mycobacterium bovis
TTAAQQTL

SEQ ID NO: 193426 - protein, 6 aa, Mycobacterium bovis
TTDAST

SEQ ID NO: 193427 - protein, 8 aa, Mycobacterium bovis
TTERNPVP

SEQ ID NO: 193428 - protein, 7 aa, Mycobacterium bovis
TTHRETP

SEQ ID NO: 193429 - protein, 14 aa, Mycobacterium bovis
TTKIEDKDGNPVDP

SEQ ID NO: 193430 - protein, 18 aa, Mycobacterium bovis
TTPERDRARRDRDHHPWS

SEQ ID NO: 193431 - protein, 5 aa, Mycobacterium bovis
TTPNS

SEQ ID NO: 193432 - protein, 5 aa, Mycobacterium bovis
TTPVT

SEQ ID NO: 193433 - protein, 7 aa, Mycobacterium bovis
TTSAKEA

SEQ ID NO: 193434 - protein, 5 aa, Mycobacterium bovis
TTTQA

SEQ ID NO: 193435 - protein, 6 aa, Mycobacterium bovis
TVASRP

SEQ ID NO: 193436 - protein, 4 aa, Mycobacterium bovis
TVDG

SEQ ID NO: 193437 - protein, 8 aa, Mycobacterium bovis
TVEGGESL

SEQ ID NO: 193438 - protein, 12 aa, Mycobacterium bovis
TVERSGLSADDV

SEQ ID NO: 193439 - protein, 5 aa, Mycobacterium bovis
TVPEH

SEQ ID NO: 193440 - protein, 12 aa, Mycobacterium bovis
TVQDSSPVAGQL

SEQ ID NO: 193441 - protein, 11 aa, Mycobacterium bovis
TVRARSDATAV

SEQ ID NO: 193442 - protein, 12 aa, Mycobacterium bovis
TVTSEANRARRV

SEQ ID NO: 193443 - protein, 4 aa, Mycobacterium bovis
TYPG

SEQ ID NO: 193444 - protein, 9 aa, Mycobacterium bovis
VAGAGRSTF

SEQ ID NO: 193445 - protein, 11 aa, Mycobacterium bovis
VAPTRGPDAIS

SEQ ID NO: 193446 - protein, 8 aa, Mycobacterium bovis
VARQTPQQ

SEQ ID NO: 193447 - protein, 6 aa, Mycobacterium bovis
VARTGL

SEQ ID NO: 193448 - protein, 36 aa, Mycobacterium bovis
VASGRVAGRRRSWSGPGPDIRDPQPLGKAARELAKK

SEQ ID NO: 193449 - protein, 11 aa, Mycobacterium bovis
VASTGSLAGIT

SEQ ID NO: 193450 - protein, 12 aa, Mycobacterium bovis
VDEAAQSEPLTP

SEQ ID NO: 193451 - protein, 10 aa, Mycobacterium bovis
VDHTGRYRGR

SEQ ID NO: 193452 - protein, 8 aa, Mycobacterium bovis
VDPGSIPD

SEQ ID NO: 193453 - protein, 4 aa, Mycobacterium bovis
VDRR

SEQ ID NO: 193454 - protein, 15 aa, Mycobacterium bovis
VDSAPAQRLGSTGSP

SEQ ID NO: 193455 - protein, 16 aa, Mycobacterium bovis
VEAPKAYAEAALSLLV

SEQ ID NO: 193456 - protein, 11 aa, Mycobacterium bovis
VEEASDTAAAN

SEQ ID NO: 193457 - protein, 7 aa, Mycobacterium bovis
VERGKAA

SEQ ID NO: 193458 - protein, 4 aa, Mycobacterium bovis
VERQ

SEQ ID NO: 193459 - protein, 14 aa, Mycobacterium bovis
VERSGDRSAPYAAP

SEQ ID NO: 193460 - protein, 8 aa, Mycobacterium bovis
VESPSQAA

SEQ ID NO: 193461 - protein, 7 aa, Mycobacterium bovis
VETKDQV

SEQ ID NO: 193462 - protein, 8 aa, Mycobacterium bovis
VGDDKDKA

SEQ ID NO: 193463 - protein, 11 aa, Mycobacterium bovis
VGDGQARIRTT

SEQ ID NO: 193464 - protein, 41 aa, Mycobacterium bovis
VGGAGGAGGNAAGLSGAGGAGGAGGFGETAGDGGAGGNAGL

SEQ ID NO: 193465 - protein, 7 aa, Mycobacterium bovis
VGGEPRR

SEQ ID NO: 193466 - protein, 14 aa, Mycobacterium bovis
VGKPAAQEGSEPWV

SEQ ID NO: 193467 - protein, 12 aa, Mycobacterium bovis
VGLGASARERNI

SEQ ID NO: 193468 - protein, 6 aa, Mycobacterium bovis
VGPGVT

SEQ ID NO: 193469 - protein, 4 aa, Mycobacterium bovis
VGPN

SEQ ID NO: 193470 - protein, 8 aa, Mycobacterium bovis
VKQYAGDL

SEQ ID NO: 193471 - protein, 14 aa, Mycobacterium bovis
VLPSKEGAHETREA

SEQ ID NO: 193472 - protein, 217 aa, Mycobacterium bovis
VNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHG

SEQ ID NO: 193473 - protein, 6 aa, Mycobacterium bovis
VNSGQA

SEQ ID NO: 193474 - protein, 9 aa, Mycobacterium bovis
VPDPGGAAF

SEQ ID NO: 193475 - protein, 4 aa, Mycobacterium bovis
VPEQ

SEQ ID NO: 193476 - protein, 14 aa, Mycobacterium bovis
VPGYHAPPDRTAGV

SEQ ID NO: 193477 - protein, 13 aa, Mycobacterium bovis
VPLSSGSFGDATG

SEQ ID NO: 193478 - protein, 5 aa, Mycobacterium bovis
VPPAV

SEQ ID NO: 193479 - protein, 12 aa, Mycobacterium bovis
VPRGPLAAASAA

SEQ ID NO: 193480 - protein, 4 aa, Mycobacterium bovis
VPTQ

SEQ ID NO: 193481 - protein, 28 aa, Mycobacterium bovis
VQKRSSYKESPGGRKEALRRSRATGTIT

SEQ ID NO: 193482 - protein, 7 aa, Mycobacterium bovis
VQTADGA

SEQ ID NO: 193483 - protein, 25 aa, Mycobacterium bovis
VRPGHGPIPTGRKPRGANDRAPLPK

SEQ ID NO: 193484 - protein, 9 aa, Mycobacterium bovis
VRPGSAEEV

SEQ ID NO: 193485 - protein, 10 aa, Mycobacterium bovis
VRPPTPSRRL

SEQ ID NO: 193486 - protein, 9 aa, Mycobacterium bovis
VRRDNTGYD

SEQ ID NO: 193487 - protein, 5 aa, Mycobacterium bovis
VSESV

SEQ ID NO: 193488 - protein, 8 aa, Mycobacterium bovis
VSETHDTK

SEQ ID NO: 193489 - protein, 8 aa, Mycobacterium bovis
VSKDNGQT

SEQ ID NO: 193490 - protein, 5 aa, Mycobacterium bovis
VSPGT

SEQ ID NO: 193491 - protein, 6 aa, Mycobacterium bovis
VSQPTI

SEQ ID NO: 193492 - protein, 10 aa, Mycobacterium bovis
VSRAAARKRA

SEQ ID NO: 193493 - protein, 11 aa, Mycobacterium bovis
VSSHDGPDAGR

SEQ ID NO: 193494 - protein, 13 aa, Mycobacterium bovis
VSSRRRKGRRTLS

SEQ ID NO: 193495 - protein, 11 aa, Mycobacterium bovis
VTAGERPGRGA

SEQ ID NO: 193496 - protein, 11 aa, Mycobacterium bovis
VTDDPADPSTI

SEQ ID NO: 193497 - protein, 8 aa, Mycobacterium bovis
VTGGSANY

SEQ ID NO: 193498 - protein, 7 aa, Mycobacterium bovis
VTGRGAG

SEQ ID NO: 193499 - protein, 9 aa, Mycobacterium bovis
VTKYRQGDR

SEQ ID NO: 193500 - protein, 7 aa, Mycobacterium bovis
VTRRGYG

SEQ ID NO: 193501 - protein, 20 aa, Mycobacterium bovis
VTSGDASNRYSGSPVRQPGF

SEQ ID NO: 193502 - protein, 7 aa, Mycobacterium bovis
VTSGQRR

SEQ ID NO: 193503 - protein, 6 aa, Mycobacterium bovis
VTTDPD

SEQ ID NO: 193504 - protein, 4 aa, Mycobacterium bovis
VVPP

SEQ ID NO: 193505 - protein, 13 aa, Mycobacterium bovis
WADGGPTSAHNGL

SEQ ID NO: 193506 - protein, 9 aa, Mycobacterium bovis
WKPPHPLSD

SEQ ID NO: 193507 - protein, 11 aa, Mycobacterium bovis
WLGPSSAGMAA

SEQ ID NO: 193508 - protein, 4 aa, Mycobacterium bovis
WQGV

SEQ ID NO: 193509 - protein, 22 aa, Mycobacterium bovis
WTGSGQRRWRRSPPTGRYRSNS

SEQ ID NO: 193510 - protein, 5 aa, Mycobacterium bovis
WTTDV

SEQ ID NO: 193511 - protein, 13 aa, Mycobacterium bovis
YAAATSQTKGLTF

SEQ ID NO: 193512 - protein, 16 aa, Mycobacterium bovis
YAEADPTADVEGYDAA

SEQ ID NO: 193513 - protein, 6 aa, Mycobacterium bovis
YAERAS

SEQ ID NO: 193514 - protein, 6 aa, Mycobacterium bovis
YAPGHE

SEQ ID NO: 193515 - protein, 252 aa, Mycobacterium bovis
YARPQEDPRGGPDPQGGSDPRGGYPPETGGYPPQPGYPRPRHPGQGDYPEQIGYPDQGGYPEQRGYPDQRGYQDQGRGYPDQGQGGYPPPYEQRPPVSPGPAAGYGAPGYDQGYRQSGGCGPSPGGGQPGYGGYGEYGRGPARHEEGSYVPSGPPGPPEQRPAYPDQGGYDQGYQQGATTYGRQDYGGGADYTRYTESPQVPGYAPQGGGYAEPAGRDYDYGQSGAPDYGQPAPGGYSGYGQGGYGSAGTSV

SEQ ID NO: 193516 - protein, 6 aa, Mycobacterium bovis
YERPKA

SEQ ID NO: 193517 - protein, 11 aa, Mycobacterium bovis
YESPPLPLGPD

SEQ ID NO: 193518 - protein, 10 aa, Mycobacterium bovis
YGETQAQSVS

SEQ ID NO: 193519 - protein, 7 aa, Mycobacterium bovis
YGNEAPK

SEQ ID NO: 193520 - protein, 10 aa, Mycobacterium bovis
YGQPGQTERA

SEQ ID NO: 193521 - protein, 10 aa, Mycobacterium bovis
YGSSASSSGV

SEQ ID NO: 193522 - protein, 6 aa, Mycobacterium bovis
YHQSTG

SEQ ID NO: 193523 - protein, 9 aa, Mycobacterium bovis
YKSSARPAL

SEQ ID NO: 193524 - protein, 13 aa, Mycobacterium bovis
YNADGSLRKPGQD

SEQ ID NO: 193525 - protein, 4 aa, Mycobacterium bovis
YNDA

SEQ ID NO: 193526 - protein, 7 aa, Mycobacterium bovis
YNTGSFN

SEQ ID NO: 193527 - protein, 8 aa, Mycobacterium bovis
YPATAEES

SEQ ID NO: 193528 - protein, 11 aa, Mycobacterium bovis
YPPGRGPHTSA

SEQ ID NO: 193529 - protein, 5 aa, Mycobacterium bovis
YPPPA

SEQ ID NO: 193530 - protein, 12 aa, Mycobacterium bovis
YPSALATDHHHG

SEQ ID NO: 193531 - protein, 5 aa, Mycobacterium bovis
YRDRG

SEQ ID NO: 193532 - protein, 7 aa, Mycobacterium bovis
YRNGERG

SEQ ID NO: 193533 - protein, 7 aa, Mycobacterium bovis
YSSPPRF

SEQ ID NO: 193534 - protein, 5 aa, Mycobacterium bovis
YTPTA

SEQ ID NO: 193535 - protein, 4 aa, Mycobacterium bovis
YTTD

SEQ ID NO: 193536 - protein, 22 aa, Mycobacterium bovis
AAAESAISAETEAAAAGAAPAL

SEQ ID NO: 193537 - protein, 6 aa, Mycobacterium bovis
AAAGAR

SEQ ID NO: 193538 - protein, 8 aa, Mycobacterium bovis
AAAGVGKG

SEQ ID NO: 193539 - protein, 7 aa, Mycobacterium bovis
AAASARR

SEQ ID NO: 193540 - protein, 16 aa, Mycobacterium bovis
AAASGLYRGQQRRRRP

SEQ ID NO: 193541 - protein, 4 aa, Mycobacterium bovis
AAAT

SEQ ID NO: 193542 - protein, 5 aa, Mycobacterium bovis
AAAVN

SEQ ID NO: 193543 - protein, 7 aa, Mycobacterium bovis
AADEVST

SEQ ID NO: 193544 - protein, 5 aa, Mycobacterium bovis
AADSG

SEQ ID NO: 193545 - protein, 6 aa, Mycobacterium bovis
AAEAET

SEQ ID NO: 193546 - protein, 8 aa, Mycobacterium bovis
AAEDEVST

SEQ ID NO: 193547 - protein, 4 aa, Mycobacterium bovis
AAEQ

SEQ ID NO: 193548 - protein, 12 aa, Mycobacterium bovis
AAGADPHSAIPG

SEQ ID NO: 193549 - protein, 17 aa, Mycobacterium bovis
AAGAGRRGQRTDPQPAV

SEQ ID NO: 193550 - protein, 14 aa, Mycobacterium bovis
AAGGAGGPGGAGGL

SEQ ID NO: 193551 - protein, 40 aa, Mycobacterium bovis
AAGGAGGSGGSSPDGGGGAGGIGGDGGTLFGSGGAGGVGG

SEQ ID NO: 193552 - protein, 8 aa, Mycobacterium bovis
AAGPGASA

SEQ ID NO: 193553 - protein, 7 aa, Mycobacterium bovis
AAGVGKG

SEQ ID NO: 193554 - protein, 14 aa, Mycobacterium bovis
AAGYQGTAKDSSHH

SEQ ID NO: 193555 - protein, 14 aa, Mycobacterium bovis
AAHPTTGDASLPDD

SEQ ID NO: 193556 - protein, 4 aa, Mycobacterium bovis
AAIP

SEQ ID NO: 193557 - protein, 8 aa, Mycobacterium bovis
AAKRGLAN

SEQ ID NO: 193558 - protein, 13 aa, Mycobacterium bovis
AAKSDGGRNNQAG

SEQ ID NO: 193559 - protein, 16 aa, Mycobacterium bovis
AALDDAADESANPVPR

SEQ ID NO: 193560 - protein, 7 aa, Mycobacterium bovis
AALDSEG

SEQ ID NO: 193561 - protein, 11 aa, Mycobacterium bovis
AANKQKQELDE

SEQ ID NO: 193562 - protein, 5 aa, Mycobacterium bovis
AANRE

SEQ ID NO: 193563 - protein, 4 aa, Mycobacterium bovis
AAPA

SEQ ID NO: 193564 - protein, 9 aa, Mycobacterium bovis
AAPAGRNWT

SEQ ID NO: 193565 - protein, 6 aa, Mycobacterium bovis
AAPPGP

SEQ ID NO: 193566 - protein, 4 aa, Mycobacterium bovis
AAPY

SEQ ID NO: 193567 - protein, 7 aa, Mycobacterium bovis
AAQGNYA

SEQ ID NO: 193568 - protein, 15 aa, Mycobacterium bovis
AAQTKQTATQARAAA

SEQ ID NO: 193569 - protein, 12 aa, Mycobacterium bovis
AARAAGASVQAK

SEQ ID NO: 193570 - protein, 55 aa, Mycobacterium bovis
AARGGSAPTPAAAAPAGAGGAGPAATRPAAQQTPAVPAAAAGSAIPGLPPGLPPG

SEQ ID NO: 193571 - protein, 7 aa, Mycobacterium bovis
AASASVG

SEQ ID NO: 193572 - protein, 7 aa, Mycobacterium bovis
AATADAG

SEQ ID NO: 193573 - protein, 7 aa, Mycobacterium bovis
AATRPNL

SEQ ID NO: 193574 - protein, 160 aa, Mycobacterium bovis
AATTGGAGGNGGAGGFASTGLGGPGGAGGPGGAGDFASGVGGVGGAGGDGGAGGVGGFGGQGGIGGEGRTGGNGGSGGDGGGGISLGGQGGNGGFGGAGGNGGIGTDAGGAGGAGGAGGNGGSSKSTTTGNAGSGGAGGNGGTGLNGAGGAGGAGGNAGV

SEQ ID NO: 193575 - protein, 13 aa, Mycobacterium bovis
AATTPDQPQPYGE

SEQ ID NO: 193576 - protein, 6 aa, Mycobacterium bovis
AAVDAG

SEQ ID NO: 193577 - protein, 4 aa, Mycobacterium bovis
ACEQ

SEQ ID NO: 193578 - protein, 10 aa, Mycobacterium bovis
ADAAGGDECG

SEQ ID NO: 193579 - protein, 6 aa, Mycobacterium bovis
ADASAL

SEQ ID NO: 193580 - protein, 9 aa, Mycobacterium bovis
ADDATGYQA

SEQ ID NO: 193581 - protein, 9 aa, Mycobacterium bovis
ADDRGEAKR

SEQ ID NO: 193582 - protein, 10 aa, Mycobacterium bovis
ADDSALTAEA

SEQ ID NO: 193583 - protein, 15 aa, Mycobacterium bovis
ADGDGGNRGRQSRVR

SEQ ID NO: 193584 - protein, 12 aa, Mycobacterium bovis
ADHSINRLRLRK

SEQ ID NO: 193585 - protein, 21 aa, Mycobacterium bovis
ADLGPEHRPSAASGPDTTEAD

SEQ ID NO: 193586 - protein, 16 aa, Mycobacterium bovis
ADPARGPGRYHRTGEP

SEQ ID NO: 193587 - protein, 9 aa, Mycobacterium bovis
ADPGAGNLA

SEQ ID NO: 193588 - protein, 5 aa, Mycobacterium bovis
ADRGS

SEQ ID NO: 193589 - protein, 6 aa, Mycobacterium bovis
ADRIQS

SEQ ID NO: 193590 - protein, 9 aa, Mycobacterium bovis
ADRSEPGHW

SEQ ID NO: 193591 - protein, 6 aa, Mycobacterium bovis
ADTALD

SEQ ID NO: 193592 - protein, 6 aa, Mycobacterium bovis
ADTIGA

SEQ ID NO: 193593 - protein, 10 aa, Mycobacterium bovis
ADWAGPTKER

SEQ ID NO: 193594 - protein, 4 aa, Mycobacterium bovis
ADWP

SEQ ID NO: 193595 - protein, 15 aa, Mycobacterium bovis
AEADPTADVEGYDAA

SEQ ID NO: 193596 - protein, 7 aa, Mycobacterium bovis
AEAHREY

SEQ ID NO: 193597 - protein, 10 aa, Mycobacterium bovis
AEDDCPPPGY

SEQ ID NO: 193598 - protein, 24 aa, Mycobacterium bovis
AEEASGAQLAPGTEPSPAPLGQPR

SEQ ID NO: 193599 - protein, 12 aa, Mycobacterium bovis
AEEIAADGTPAH

SEQ ID NO: 193600 - protein, 23 aa, Mycobacterium bovis
AEEMTGRHATTATSFSITDQSCA

SEQ ID NO: 193601 - protein, 5 aa, Mycobacterium bovis
AEGEP

SEQ ID NO: 193602 - protein, 8 aa, Mycobacterium bovis
AEGMEESQ

SEQ ID NO: 193603 - protein, 6 aa, Mycobacterium bovis
AEGRDA

SEQ ID NO: 193604 - protein, 16 aa, Mycobacterium bovis
AEIQRSDAEIPGKQRR

SEQ ID NO: 193605 - protein, 4 aa, Mycobacterium bovis
AELD

SEQ ID NO: 193606 - protein, 10 aa, Mycobacterium bovis
AELPQTSTAA

SEQ ID NO: 193607 - protein, 9 aa, Mycobacterium bovis
AEPAELDAD

SEQ ID NO: 193608 - protein, 36 aa, Mycobacterium bovis
AEPAGPAPTPTSPAPPAAPGSPVEPAGPAGPAGPAV

SEQ ID NO: 193609 - protein, 9 aa, Mycobacterium bovis
AEPHYRPSA

SEQ ID NO: 193610 - protein, 23 aa, Mycobacterium bovis
AEPTSHDPDSGGHFGGPSGWGGR

SEQ ID NO: 193611 - protein, 4 aa, Mycobacterium bovis
AERG

SEQ ID NO: 193612 - protein, 10 aa, Mycobacterium bovis
AESDDADAVA

SEQ ID NO: 193613 - protein, 6 aa, Mycobacterium bovis
AESLNA

SEQ ID NO: 193614 - protein, 9 aa, Mycobacterium bovis
AETGQPPTI

SEQ ID NO: 193615 - protein, 14 aa, Mycobacterium bovis
AETRARRRNAQNVA

SEQ ID NO: 193616 - protein, 27 aa, Mycobacterium bovis
AFGGDGGNGSDGVAAGSGGGTGGAGGG

SEQ ID NO: 193617 - protein, 4 aa, Mycobacterium bovis
AGAA

SEQ ID NO: 193618 - protein, 115 aa, Mycobacterium bovis
AGAGGQGGLGGQGGNGGGSTGGNGGLGGAGGGGGNAPDGGFGGNGGKGGQGGIGGGTQSATGLGGDGGDGGDGGNGGNSGAKAGGAGGKGQAGQPNSGTEPGFGGDGGLGGAGAT

SEQ ID NO: 193619 - protein, 4 aa, Mycobacterium bovis
AGAP

SEQ ID NO: 193620 - protein, 9 aa, Mycobacterium bovis
AGASGYAGG

SEQ ID NO: 193621 - protein, 14 aa, Mycobacterium bovis
AGDDEPDGDDTPPW

SEQ ID NO: 193622 - protein, 7 aa, Mycobacterium bovis
AGDDESN

SEQ ID NO: 193623 - protein, 6 aa, Mycobacterium bovis
AGDDGD

SEQ ID NO: 193624 - protein, 30 aa, Mycobacterium bovis
AGDGGAGGHGGDPGLGGAGGAGGGGGRRAA

SEQ ID NO: 193625 - protein, 5 aa, Mycobacterium bovis
AGEAV

SEQ ID NO: 193626 - protein, 4 aa, Mycobacterium bovis
AGEE

SEQ ID NO: 193627 - protein, 20 aa, Mycobacterium bovis
AGEPPSPEPAASKPPTPPMP

SEQ ID NO: 193628 - protein, 7 aa, Mycobacterium bovis
AGESGTM

SEQ ID NO: 193629 - protein, 25 aa, Mycobacterium bovis
AGGAGGLGGQGNHTGGHGGAGGSAG

SEQ ID NO: 193630 - protein, 24 aa, Mycobacterium bovis
AGGAGGSGGGGSVAGDGGAGGNAG

SEQ ID NO: 193631 - protein, 7 aa, Mycobacterium bovis
AGGDAEG

SEQ ID NO: 193632 - protein, 119 aa, Mycobacterium bovis
AGGDGSGTFNAQANKGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGG

SEQ ID NO: 193633 - protein, 25 aa, Mycobacterium bovis
AGGGAGGAGGSGNNVGGAGGAGGVG

SEQ ID NO: 193634 - protein, 7 aa, Mycobacterium bovis
AGGGLAS

SEQ ID NO: 193635 - protein, 14 aa, Mycobacterium bovis
AGGGTALDDVDGTD

SEQ ID NO: 193636 - protein, 12 aa, Mycobacterium bovis
AGGPGATGRSYS

SEQ ID NO: 193637 - protein, 7 aa, Mycobacterium bovis
AGGSELD

SEQ ID NO: 193638 - protein, 599 aa, Mycobacterium bovis
AGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGTGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGG

SEQ ID NO: 193639 - protein, 224 aa, Mycobacterium bovis
AGHGGNGGNGGNSGNSTGVAGLAGGAAGAGGNGGGTSSAAGHGGSGGNGGSGGSGGSGTTGGAGAAGGNGGAGAGGGSLSTGQSGGHGGSGGAGGNGGAGSAGNGGAGGAGGNGGAGGNGGGGDAGNAGSGGNGGKGGDGVGPGSTGGAGGKGGAGANGGSSNGNARGGNAGNGGHGGAGGSGDTGGAGGAGGQGGFGGTGGSGSGIGGGAGGNGGNGGAGGTG

SEQ ID NO: 193640 - protein, 11 aa, Mycobacterium bovis
AGIGDRCTEAT

SEQ ID NO: 193641 - protein, 14 aa, Mycobacterium bovis
AGIGGAGGNGGNAG

SEQ ID NO: 193642 - protein, 10 aa, Mycobacterium bovis
AGIQRAKRTR

SEQ ID NO: 193643 - protein, 5 aa, Mycobacterium bovis
AGKYA

SEQ ID NO: 193644 - protein, 5 aa, Mycobacterium bovis
AGLNL

SEQ ID NO: 193645 - protein, 8 aa, Mycobacterium bovis
AGMDTGGV

SEQ ID NO: 193646 - protein, 76 aa, Mycobacterium bovis
AGNGGTGGAGGNGGTGGAGAPGGAGGAGGKADIANSLGDNATVTGGNGGTGGDGGSALGTGGAGGAGGLGGHGGAG

SEQ ID NO: 193647 - protein, 6 aa, Mycobacterium bovis
AGNGRY

SEQ ID NO: 193648 - protein, 8 aa, Mycobacterium bovis
AGNPDYAP

SEQ ID NO: 193649 - protein, 54 aa, Mycobacterium bovis
AGPAPTPTESQLAPPRPPTPQTPTGAPQQPESPAPHVPSHGPHQPRRTAPAPPW

SEQ ID NO: 193650 - protein, 21 aa, Mycobacterium bovis
AGPGLDPRRNQSPAHEPHPAG

SEQ ID NO: 193651 - protein, 19 aa, Mycobacterium bovis
AGPLGSTSRAGHRSYGGVA

SEQ ID NO: 193652 - protein, 4 aa, Mycobacterium bovis
AGPT

SEQ ID NO: 193653 - protein, 6 aa, Mycobacterium bovis
AGPTEQ

SEQ ID NO: 193654 - protein, 7 aa, Mycobacterium bovis
AGRAKLD

SEQ ID NO: 193655 - protein, 12 aa, Mycobacterium bovis
AGRVRGQRWGPR

SEQ ID NO: 193656 - protein, 6 aa, Mycobacterium bovis
AGRWSP

SEQ ID NO: 193657 - protein, 17 aa, Mycobacterium bovis
AGSCASAETTADAPTQA

SEQ ID NO: 193658 - protein, 6 aa, Mycobacterium bovis
AGSEVS

SEQ ID NO: 193659 - protein, 8 aa, Mycobacterium bovis
AGSNRYAD

SEQ ID NO: 193660 - protein, 14 aa, Mycobacterium bovis
AGSPGAPETRANSA

SEQ ID NO: 193661 - protein, 13 aa, Mycobacterium bovis
AGSSAVVGAVVGP

SEQ ID NO: 193662 - protein, 7 aa, Mycobacterium bovis
AGSSQIQ

SEQ ID NO: 193663 - protein, 164 aa, Mycobacterium bovis
AGTNPTPIGTAAPGSDGVNQIGNGGNTDLTGGAGGDGNAGSTTVNGGNGGTGGAARNSSGGTGNSFGGAGGAGGDGANGGDGGAGGEALTEGGATAVSGAGGKGGNAEASGGAGGNGGKGGFAQATTSVTGGNGGNGGNGHDSNAPGGAGGSGGVGGDGGRGGL

SEQ ID NO: 193664 - protein, 5 aa, Mycobacterium bovis
AGTQF

SEQ ID NO: 193665 - protein, 9 aa, Mycobacterium bovis
AGTRGPLTD

SEQ ID NO: 193666 - protein, 6 aa, Mycobacterium bovis
AHPTGE

SEQ ID NO: 193667 - protein, 8 aa, Mycobacterium bovis
AIGETDEY

SEQ ID NO: 193668 - protein, 5 aa, Mycobacterium bovis
AIPDD

SEQ ID NO: 193669 - protein, 6 aa, Mycobacterium bovis
AISGGA

SEQ ID NO: 193670 - protein, 8 aa, Mycobacterium bovis
AITPDEGA

SEQ ID NO: 193671 - protein, 5 aa, Mycobacterium bovis
AKAAT

SEQ ID NO: 193672 - protein, 16 aa, Mycobacterium bovis
AKEGTDDQRARLLPGA

SEQ ID NO: 193673 - protein, 12 aa, Mycobacterium bovis
AKRRDATQLLEV

SEQ ID NO: 193674 - protein, 10 aa, Mycobacterium bovis
AKTDQSLGTS

SEQ ID NO: 193675 - protein, 7 aa, Mycobacterium bovis
AKTHADS

SEQ ID NO: 193676 - protein, 5 aa, Mycobacterium bovis
AKTNN

SEQ ID NO: 193677 - protein, 9 aa, Mycobacterium bovis
ALAQEKTGE

SEQ ID NO: 193678 - protein, 21 aa, Mycobacterium bovis
ALASAAPAGPAARAATAAPAG

SEQ ID NO: 193679 - protein, 5 aa, Mycobacterium bovis
ALEGD

SEQ ID NO: 193680 - protein, 17 aa, Mycobacterium bovis
ALGEPGEHSLPASTPIT

SEQ ID NO: 193681 - protein, 14 aa, Mycobacterium bovis
ALNEGSGSNPPRGV

SEQ ID NO: 193682 - protein, 5 aa, Mycobacterium bovis
ALPNL

SEQ ID NO: 193683 - protein, 16 aa, Mycobacterium bovis
AMRERSELARKGIARA

SEQ ID NO: 193684 - protein, 498 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGNGGNAGDGGNGGSGDFGGNTTSGASGSGGNGGNAGTAGSGGAGGTGGTGLSGGNGGNGGDGGNGAHGTV

SEQ ID NO: 193685 - protein, 510 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGDGGNGGNAGDGGNGGSGDFGGNTTSGASGSGGNGGNAGTAGSGGAGGTGGTGLSGGNGGNGGDGGNGAHGTV

SEQ ID NO: 193686 - protein, 510 aa, Mycobacterium bovis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNAGNNSTNAPVGGEGGAGGDGGAGGAGGAANGGTAGSQGTGGVGGNGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGDGGNGGNAGDGGNGGSGDFGGNTTSGASGSGGNGGNAGTAGSGGAGGTGGTGLSGGNGGNGGDGGNGAHGTV

SEQ ID NO: 193687 - protein, 14 aa, Mycobacterium bovis
ANGGVGGSGGNATL

SEQ ID NO: 193688 - protein, 6 aa, Mycobacterium bovis
ANGKSV

SEQ ID NO: 193689 - protein, 19 aa, Mycobacterium bovis
ANGNNGDVNFGGGNTGDFN

SEQ ID NO: 193690 - protein, 31 aa, Mycobacterium bovis
ANPAPGDNAARKTGRGGARQSPQSRVQRVAT

SEQ ID NO: 193691 - protein, 4 aa, Mycobacterium bovis
ANQR

SEQ ID NO: 193692 - protein, 21 aa, Mycobacterium bovis
ANSAAAAQTTAVAAAGADEVS

SEQ ID NO: 193693 - protein, 6 aa, Mycobacterium bovis
APDETT

SEQ ID NO: 193694 - protein, 8 aa, Mycobacterium bovis
APDGGPAQ

SEQ ID NO: 193695 - protein, 4 aa, Mycobacterium bovis
APDH

SEQ ID NO: 193696 - protein, 20 aa, Mycobacterium bovis
APDPVVSTTTPDDADAAAAG

SEQ ID NO: 193697 - protein, 5 aa, Mycobacterium bovis
APENV

SEQ ID NO: 193698 - protein, 12 aa, Mycobacterium bovis
APEYSSAQRALS

SEQ ID NO: 193699 - protein, 34 aa, Mycobacterium bovis
APGACNPDDQTPLVDDTPDADAVRRDTRSQAQRH

SEQ ID NO: 193700 - protein, 14 aa, Mycobacterium bovis
APGAIGGAGGPAGL

SEQ ID NO: 193701 - protein, 15 aa, Mycobacterium bovis
APGDDGDGLNPFAPD

SEQ ID NO: 193702 - protein, 14 aa, Mycobacterium bovis
APGSGGAAAAAKGE

SEQ ID NO: 193703 - protein, 4 aa, Mycobacterium bovis
APHS

SEQ ID NO: 193704 - protein, 10 aa, Mycobacterium bovis
APPLTDEQRT

SEQ ID NO: 193705 - protein, 17 aa, Mycobacterium bovis
APPPPPPPPPPPPPTPM

SEQ ID NO: 193706 - protein, 23 aa, Mycobacterium bovis
APPTEASAALEPALETPESPVET

SEQ ID NO: 193707 - protein, 12 aa, Mycobacterium bovis
APQLSSSDGRGP

SEQ ID NO: 193708 - protein, 7 aa, Mycobacterium bovis
APSSLPA

SEQ ID NO: 193709 - protein, 6 aa, Mycobacterium bovis
APTHRS

SEQ ID NO: 193710 - protein, 4 aa, Mycobacterium bovis
APVA

SEQ ID NO: 193711 - protein, 6 aa, Mycobacterium bovis
APVAGS

SEQ ID NO: 193712 - protein, 5 aa, Mycobacterium bovis
APVDP

SEQ ID NO: 193713 - protein, 6 aa, Mycobacterium bovis
AQAEQI

SEQ ID NO: 193714 - protein, 538 aa, Mycobacterium bovis
AQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGAGGTGGAGGDGVGGAGGGNGGHGGDAGDGGNGANGNNRSSGS

SEQ ID NO: 193715 - protein, 6 aa, Mycobacterium bovis
AQEAGN

SEQ ID NO: 193716 - protein, 19 aa, Mycobacterium bovis
AQEVSDDSPALAQPAVPNY

SEQ ID NO: 193717 - protein, 6 aa, Mycobacterium bovis
AQGEEI

SEQ ID NO: 193718 - protein, 7 aa, Mycobacterium bovis
AQGESMD

SEQ ID NO: 193719 - protein, 8 aa, Mycobacterium bovis
AQGPELAP

SEQ ID NO: 193720 - protein, 10 aa, Mycobacterium bovis
AQGYSDSQGI

SEQ ID NO: 193721 - protein, 8 aa, Mycobacterium bovis
AQQRESFG

SEQ ID NO: 193722 - protein, 15 aa, Mycobacterium bovis
AQRGAQCGQREKSCR

SEQ ID NO: 193723 - protein, 113 aa, Mycobacterium bovis
AQRLPAEGPAVKRGVGASAAKKVAKKAPAKKATKAAKKAATKAPAKKAATKAPAKKAVKATKSPAKKVTKAVKKTAVKASVRKAATKAPAKKAAAKRPATKAPAKKATARRGR

SEQ ID NO: 193724 - protein, 8 aa, Mycobacterium bovis
AQRRDPDA

SEQ ID NO: 193725 - protein, 10 aa, Mycobacterium bovis
AQRYQTENYR

SEQ ID NO: 193726 - protein, 14 aa, Mycobacterium bovis
AQTGPTAKLSSAPM

SEQ ID NO: 193727 - protein, 5 aa, Mycobacterium bovis
AQVPA

SEQ ID NO: 193728 - protein, 8 aa, Mycobacterium bovis
ARAAQTDW

SEQ ID NO: 193729 - protein, 17 aa, Mycobacterium bovis
ARARPRGSSAAHPSPHR

SEQ ID NO: 193730 - protein, 19 aa, Mycobacterium bovis
ARDAATAAASARQRGRGDA

SEQ ID NO: 193731 - protein, 52 aa, Mycobacterium bovis
ARDEGAGASPGQQPGGGVPAQAMDTGAGARPAASPLAAPVDPSTPAPSTTTT

SEQ ID NO: 193732 - protein, 4 aa, Mycobacterium bovis
ARER

SEQ ID NO: 193733 - protein, 28 aa, Mycobacterium bovis
ARESATRLGPPAGGLAAANTPNPSGAAI

SEQ ID NO: 193734 - protein, 12 aa, Mycobacterium bovis
ARGHRRDGSAGR

SEQ ID NO: 193735 - protein, 7 aa, Mycobacterium bovis
ARMPNNA

SEQ ID NO: 193736 - protein, 18 aa, Mycobacterium bovis
ARPRSSGIGWRGRISLPL

SEQ ID NO: 193737 - protein, 7 aa, Mycobacterium bovis
ARQTPQQ

SEQ ID NO: 193738 - protein, 6 aa, Mycobacterium bovis
ARRRRA

SEQ ID NO: 193739 - protein, 7 aa, Mycobacterium bovis
ARSPTEE

SEQ ID NO: 193740 - protein, 12 aa, Mycobacterium bovis
ARSREDHRTLGT

SEQ ID NO: 193741 - protein, 12 aa, Mycobacterium bovis
ARSSADPHPTTG

SEQ ID NO: 193742 - protein, 9 aa, Mycobacterium bovis
ARSTQHDAA

SEQ ID NO: 193743 - protein, 10 aa, Mycobacterium bovis
ARTQREQRAK

SEQ ID NO: 193744 - protein, 8 aa, Mycobacterium bovis
ASAAENYG

SEQ ID NO: 193745 - protein, 13 aa, Mycobacterium bovis
ASAEKPATEQAEP

SEQ ID NO: 193746 - protein, 10 aa, Mycobacterium bovis
ASAGSGADGA

SEQ ID NO: 193747 - protein, 7 aa, Mycobacterium bovis
ASAIQGN

SEQ ID NO: 193748 - protein, 4 aa, Mycobacterium bovis
ASDA

SEQ ID NO: 193749 - protein, 4 aa, Mycobacterium bovis
ASDP

SEQ ID NO: 193750 - protein, 6 aa, Mycobacterium bovis
ASDPEG

SEQ ID NO: 193751 - protein, 11 aa, Mycobacterium bovis
ASENPAELAPG

SEQ ID NO: 193752 - protein, 7 aa, Mycobacterium bovis
ASEQGRG

SEQ ID NO: 193753 - protein, 6 aa, Mycobacterium bovis
ASFNSV

SEQ ID NO: 193754 - protein, 27 aa, Mycobacterium bovis
ASFPPAPASANLPKPNGQTPPPTSDDL

SEQ ID NO: 193755 - protein, 26 aa, Mycobacterium bovis
ASGGAGGAGGSGGTGGAGGTGGAGGL

SEQ ID NO: 193756 - protein, 10 aa, Mycobacterium bovis
ASGGSGGFGG

SEQ ID NO: 193757 - protein, 7 aa, Mycobacterium bovis
ASGYAGG

SEQ ID NO: 193758 - protein, 7 aa, Mycobacterium bovis
ASLPSGG

SEQ ID NO: 193759 - protein, 5 aa, Mycobacterium bovis
ASPDG

SEQ ID NO: 193760 - protein, 15 aa, Mycobacterium bovis
ASQSDAPVGAPRQFR

SEQ ID NO: 193761 - protein, 13 aa, Mycobacterium bovis
ASRAVSASLARAN

SEQ ID NO: 193762 - protein, 7 aa, Mycobacterium bovis
ASRETVN

SEQ ID NO: 193763 - protein, 14 aa, Mycobacterium bovis
ASRTRLHASTDDVR

SEQ ID NO: 193764 - protein, 5 aa, Mycobacterium bovis
ASSIG

SEQ ID NO: 193765 - protein, 5 aa, Mycobacterium bovis
ASTEE

SEQ ID NO: 193766 - protein, 6 aa, Mycobacterium bovis
ATADQP

SEQ ID NO: 193767 - protein, 5 aa, Mycobacterium bovis
ATATP

SEQ ID NO: 193768 - protein, 12 aa, Mycobacterium bovis
ATDDAPAEPPRA

SEQ ID NO: 193769 - protein, 4 aa, Mycobacterium bovis
ATDM

SEQ ID NO: 193770 - protein, 7 aa, Mycobacterium bovis
ATDNPVG

SEQ ID NO: 193771 - protein, 6 aa, Mycobacterium bovis
ATDTGS

SEQ ID NO: 193772 - protein, 7 aa, Mycobacterium bovis
ATECKDR

SEQ ID NO: 193773 - protein, 22 aa, Mycobacterium bovis
ATEVTAATAGGAAPADKAVSVP

SEQ ID NO: 193774 - protein, 11 aa, Mycobacterium bovis
ATGATAPLGSH

SEQ ID NO: 193775 - protein, 15 aa, Mycobacterium bovis
ATGDFRRGSISENYR

SEQ ID NO: 193776 - protein, 27 aa, Mycobacterium bovis
ATGLTDQPDLSQLGDQANDTTGSSETV

SEQ ID NO: 193777 - protein, 5 aa, Mycobacterium bovis
ATGNK

SEQ ID NO: 193778 - protein, 8 aa, Mycobacterium bovis
ATGSTETG

SEQ ID NO: 193779 - protein, 16 aa, Mycobacterium bovis
ATKTNDVAGDGTTTAT

SEQ ID NO: 193780 - protein, 6 aa, Mycobacterium bovis
ATMDPT

SEQ ID NO: 193781 - protein, 10 aa, Mycobacterium bovis
ATPDKRSTTV

SEQ ID NO: 193782 - protein, 6 aa, Mycobacterium bovis
ATPEES

SEQ ID NO: 193783 - protein, 7 aa, Mycobacterium bovis
ATPGDGW

SEQ ID NO: 193784 - protein, 14 aa, Mycobacterium bovis
ATPGPYELSQTGGE

SEQ ID NO: 193785 - protein, 21 aa, Mycobacterium bovis
ATPPPAPPSLRRAPASTSPRL

SEQ ID NO: 193786 - protein, 10 aa, Mycobacterium bovis
ATRPPRPGRR

SEQ ID NO: 193787 - protein, 14 aa, Mycobacterium bovis
ATRSSGQDSAGYGR

SEQ ID NO: 193788 - protein, 7 aa, Mycobacterium bovis
ATSAKEA

SEQ ID NO: 193789 - protein, 8 aa, Mycobacterium bovis
ATSQRKID

SEQ ID NO: 193790 - protein, 5 aa, Mycobacterium bovis
ATSRY

SEQ ID NO: 193791 - protein, 10 aa, Mycobacterium bovis
ATSTPDGTPH

SEQ ID NO: 193792 - protein, 7 aa, Mycobacterium bovis
ATSTRFG

SEQ ID NO: 193793 - protein, 12 aa, Mycobacterium bovis
ATTGRSAAATAA

SEQ ID NO: 193794 - protein, 21 aa, Mycobacterium bovis
ATTPASPPETAPQAVPKSPSG

SEQ ID NO: 193795 - protein, 6 aa, Mycobacterium bovis
ATTPNS

SEQ ID NO: 193796 - protein, 4 aa, Mycobacterium bovis
AVGG

SEQ ID NO: 193797 - protein, 40 aa, Mycobacterium bovis
AVGGDGGNGGNGGHGGDGTTGGAGGKGGNGSSGAASGSGV

SEQ ID NO: 193798 - protein, 15 aa, Mycobacterium bovis
AVGVTQSARPGLDTE

SEQ ID NO: 193799 - protein, 8 aa, Mycobacterium bovis
AVPGTDTM

SEQ ID NO: 193800 - protein, 8 aa, Mycobacterium bovis
AVRGRGGL

SEQ ID NO: 193801 - protein, 15 aa, Mycobacterium bovis
AVSGNSGVDPDQAAR

SEQ ID NO: 193802 - protein, 18 aa, Mycobacterium bovis
AVTAGTAGAEVTADAVPV

SEQ ID NO: 193803 - protein, 6 aa, Mycobacterium bovis
AVTATN

SEQ ID NO: 193804 - protein, 13 aa, Mycobacterium bovis
AWGGSGSEAYQGV

SEQ ID NO: 193805 - protein, 12 aa, Mycobacterium bovis
CAQPQPGQSAPS

SEQ ID NO: 193806 - protein, 7 aa, Mycobacterium bovis
CESASGV

SEQ ID NO: 193807 - protein, 9 aa, Mycobacterium bovis
CGASRGRVA

SEQ ID NO: 193808 - protein, 8 aa, Mycobacterium bovis
CGDRSAAV

SEQ ID NO: 193809 - protein, 18 aa, Mycobacterium bovis
CGGPGAQIAAEGAENAGP

SEQ ID NO: 193810 - protein, 11 aa, Mycobacterium bovis
CNDQGDPPYQG

SEQ ID NO: 193811 - protein, 6 aa, Mycobacterium bovis
CPSSAI

SEQ ID NO: 193812 - protein, 7 aa, Mycobacterium bovis
CQNPPQL

SEQ ID NO: 193813 - protein, 11 aa, Mycobacterium bovis
CRGGGAVTSRD

SEQ ID NO: 193814 - protein, 22 aa, Mycobacterium bovis
CRNTTDHHHDDETTNITNQLVQ

SEQ ID NO: 193815 - protein, 6 aa, Mycobacterium bovis
CRSGPL

SEQ ID NO: 193816 - protein, 7 aa, Mycobacterium bovis
CSSGSEA

SEQ ID NO: 193817 - protein, 25 aa, Mycobacterium bovis
CTSPRSRNRSFGERLGRGETLQSAG

SEQ ID NO: 193818 - protein, 6 aa, Mycobacterium bovis
DAAESV

SEQ ID NO: 193819 - protein, 22 aa, Mycobacterium bovis
DAARRAAEGAAGVPAARRGRGL

SEQ ID NO: 193820 - protein, 8 aa, Mycobacterium bovis
DADAEDMG

SEQ ID NO: 193821 - protein, 6 aa, Mycobacterium bovis
DADPRK

SEQ ID NO: 193822 - protein, 10 aa, Mycobacterium bovis
DAEITTTAGP

SEQ ID NO: 193823 - protein, 5 aa, Mycobacterium bovis
DAEPV

SEQ ID NO: 193824 - protein, 6 aa, Mycobacterium bovis
DAEVPA

SEQ ID NO: 193825 - protein, 9 aa, Mycobacterium bovis
DAGETGGEG

SEQ ID NO: 193826 - protein, 15 aa, Mycobacterium bovis
DAGPKNVKTQIQGDE

SEQ ID NO: 193827 - protein, 6 aa, Mycobacterium bovis
DAGPTL

SEQ ID NO: 193828 - protein, 31 aa, Mycobacterium bovis
DAHRDESAGLDRGDPGQDVDRDLQRRVVGPM

SEQ ID NO: 193829 - protein, 5 aa, Mycobacterium bovis
DALEQ

SEQ ID NO: 193830 - protein, 7 aa, Mycobacterium bovis
DAPDEAP

SEQ ID NO: 193831 - protein, 12 aa, Mycobacterium bovis
DAPGRAPGRKSV

SEQ ID NO: 193832 - protein, 15 aa, Mycobacterium bovis
DAPHGSKQANTGGSI

SEQ ID NO: 193833 - protein, 8 aa, Mycobacterium bovis
DARPDRLP

SEQ ID NO: 193834 - protein, 11 aa, Mycobacterium bovis
DARPIRKGRLG

SEQ ID NO: 193835 - protein, 12 aa, Mycobacterium bovis
DASADGYVRGEG

SEQ ID NO: 193836 - protein, 7 aa, Mycobacterium bovis
DATATEL

SEQ ID NO: 193837 - protein, 10 aa, Mycobacterium bovis
DATDKDRTRV

SEQ ID NO: 193838 - protein, 10 aa, Mycobacterium bovis
DDGSGRTYQL

SEQ ID NO: 193839 - protein, 13 aa, Mycobacterium bovis
DDIPESGKMTGRS

SEQ ID NO: 193840 - protein, 7 aa, Mycobacterium bovis
DDKERAE

SEQ ID NO: 193841 - protein, 9 aa, Mycobacterium bovis
DDLDPRRRT

SEQ ID NO: 193842 - protein, 7 aa, Mycobacterium bovis
DDNQPRA

SEQ ID NO: 193843 - protein, 6 aa, Mycobacterium bovis
DDPEYP

SEQ ID NO: 193844 - protein, 7 aa, Mycobacterium bovis
DDVPDEV

SEQ ID NO: 193845 - protein, 6 aa, Mycobacterium bovis
DDVRAA

SEQ ID NO: 193846 - protein, 8 aa, Mycobacterium bovis
DDYTTTQA

SEQ ID NO: 193847 - protein, 8 aa, Mycobacterium bovis
DEKSASDM

SEQ ID NO: 193848 - protein, 8 aa, Mycobacterium bovis
DEPDAERF

SEQ ID NO: 193849 - protein, 8 aa, Mycobacterium bovis
DEPRPITS

SEQ ID NO: 193850 - protein, 7 aa, Mycobacterium bovis
DEQDREL

SEQ ID NO: 193851 - protein, 7 aa, Mycobacterium bovis
DERTRSH

SEQ ID NO: 193852 - protein, 14 aa, Mycobacterium bovis
DERVDDGTGSDTPK

SEQ ID NO: 193853 - protein, 7 aa, Mycobacterium bovis
DESQLPA

SEQ ID NO: 193854 - protein, 17 aa, Mycobacterium bovis
DGASQLRDASAAQRQQR

SEQ ID NO: 193855 - protein, 172 aa, Mycobacterium bovis
DGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNV

SEQ ID NO: 193856 - protein, 172 aa, Mycobacterium bovis
DGEPGGDGGDGGDGGWGRPGGQGGFGSTSGAHGKAGFSAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNV

SEQ ID NO: 193857 - protein, 7 aa, Mycobacterium bovis
DGFGSTE

SEQ ID NO: 193858 - protein, 76 aa, Mycobacterium bovis
DGGAGGAGGVGGTGGSGAPGGGGAGGDGGAANTDSAGSSRKAFGGDGGVGGDGASALGTGGEGGIGGQGGNGGAGG

SEQ ID NO: 193859 - protein, 6 aa, Mycobacterium bovis
DGGGAV

SEQ ID NO: 193860 - protein, 10 aa, Mycobacterium bovis
DGGKPTQVHR

SEQ ID NO: 193861 - protein, 43 aa, Mycobacterium bovis
DGGNGGAGGAGGIGGDGATGGPGEAAATLASRGLTAQTPRQNP

SEQ ID NO: 193862 - protein, 4 aa, Mycobacterium bovis
DGID

SEQ ID NO: 193863 - protein, 6 aa, Mycobacterium bovis
DGLPGV

SEQ ID NO: 193864 - protein, 10 aa, Mycobacterium bovis
DGPCTDDGEM

SEQ ID NO: 193865 - protein, 7 aa, Mycobacterium bovis
DGPPPGQ

SEQ ID NO: 193866 - protein, 12 aa, Mycobacterium bovis
DGRVPNPGEFAD

SEQ ID NO: 193867 - protein, 9 aa, Mycobacterium bovis
DGSLAPQQP

SEQ ID NO: 193868 - protein, 7 aa, Mycobacterium bovis
DGSREAG

SEQ ID NO: 193869 - protein, 12 aa, Mycobacterium bovis
DHRDGARGRGRG

SEQ ID NO: 193870 - protein, 8 aa, Mycobacterium bovis
DHRSYAGT

SEQ ID NO: 193871 - protein, 6 aa, Mycobacterium bovis
DIASEQ

SEQ ID NO: 193872 - protein, 5 aa, Mycobacterium bovis
DIGPR

SEQ ID NO: 193873 - protein, 16 aa, Mycobacterium bovis
DINTGGFNGGNVNTGF

SEQ ID NO: 193874 - protein, 6 aa, Mycobacterium bovis
DKENNV

SEQ ID NO: 193875 - protein, 19 aa, Mycobacterium bovis
DKGKQAAARITEATPGAEV

SEQ ID NO: 193876 - protein, 8 aa, Mycobacterium bovis
DKLPLGGG

SEQ ID NO: 193877 - protein, 4 aa, Mycobacterium bovis
DKNA

SEQ ID NO: 193878 - protein, 7 aa, Mycobacterium bovis
DKNAAAQ

SEQ ID NO: 193879 - protein, 7 aa, Mycobacterium bovis
DLTDSGR

SEQ ID NO: 193880 - protein, 12 aa, Mycobacterium bovis
DLVPEDRAGDHA

SEQ ID NO: 193881 - protein, 7 aa, Mycobacterium bovis
DNDDSVD

SEQ ID NO: 193882 - protein, 8 aa, Mycobacterium bovis
DNDDSVDA

SEQ ID NO: 193883 - protein, 12 aa, Mycobacterium bovis
DNDMHDGSIAQG

SEQ ID NO: 193884 - protein, 4 aa, Mycobacterium bovis
DNEH

SEQ ID NO: 193885 - protein, 12 aa, Mycobacterium bovis
DNLAGSPEIVPN

SEQ ID NO: 193886 - protein, 10 aa, Mycobacterium bovis
DNTPSGSTVA

SEQ ID NO: 193887 - protein, 13 aa, Mycobacterium bovis
DNYTGHVERGKAA

SEQ ID NO: 193888 - protein, 5 aa, Mycobacterium bovis
DPAFA

SEQ ID NO: 193889 - protein, 5 aa, Mycobacterium bovis
DPARR

SEQ ID NO: 193890 - protein, 9 aa, Mycobacterium bovis
DPDEDAGTA

SEQ ID NO: 193891 - protein, 8 aa, Mycobacterium bovis
DPDEPTYD

SEQ ID NO: 193892 - protein, 15 aa, Mycobacterium bovis
DPFSGIGKPEPLQGE

SEQ ID NO: 193893 - protein, 5 aa, Mycobacterium bovis
DPGAL

SEQ ID NO: 193894 - protein, 4 aa, Mycobacterium bovis
DPGF

SEQ ID NO: 193895 - protein, 6 aa, Mycobacterium bovis
DPIDAR

SEQ ID NO: 193896 - protein, 14 aa, Mycobacterium bovis
DPITDDDATNPLTE

SEQ ID NO: 193897 - protein, 11 aa, Mycobacterium bovis
DPRSREQRRAD

SEQ ID NO: 193898 - protein, 9 aa, Mycobacterium bovis
DPSADSTTT

SEQ ID NO: 193899 - protein, 26 aa, Mycobacterium bovis
DPSYRLKTTTAEQIASRADPWDPGSV

SEQ ID NO: 193900 - protein, 12 aa, Mycobacterium bovis
DPTSVADDFTRP

SEQ ID NO: 193901 - protein, 7 aa, Mycobacterium bovis
DPYAGTP

SEQ ID NO: 193902 - protein, 16 aa, Mycobacterium bovis
DQAGNADPMVREWRLM

SEQ ID NO: 193903 - protein, 6 aa, Mycobacterium bovis
DQDELA

SEQ ID NO: 193904 - protein, 6 aa, Mycobacterium bovis
DQENPL

SEQ ID NO: 193905 - protein, 4 aa, Mycobacterium bovis
DQPP

SEQ ID NO: 193906 - protein, 13 aa, Mycobacterium bovis
DQVESTAGSLQGQ

SEQ ID NO: 193907 - protein, 10 aa, Mycobacterium bovis
DRANATATRL

SEQ ID NO: 193908 - protein, 25 aa, Mycobacterium bovis
DRARPNGGGPISRPTSGWHQQPKTR

SEQ ID NO: 193909 - protein, 5 aa, Mycobacterium bovis
DRDNP

SEQ ID NO: 193910 - protein, 4 aa, Mycobacterium bovis
DREL

SEQ ID NO: 193911 - protein, 14 aa, Mycobacterium bovis
DRKPKDLSGGQRQR

SEQ ID NO: 193912 - protein, 4 aa, Mycobacterium bovis
DRNS

SEQ ID NO: 193913 - protein, 10 aa, Mycobacterium bovis
DRRGWGSGGA

SEQ ID NO: 193914 - protein, 10 aa, Mycobacterium bovis
DRVGRQSGAT

SEQ ID NO: 193915 - protein, 4 aa, Mycobacterium bovis
DSAA

SEQ ID NO: 193916 - protein, 5 aa, Mycobacterium bovis
DSAAA

SEQ ID NO: 193917 - protein, 7 aa, Mycobacterium bovis
DSERPLS

SEQ ID NO: 193918 - protein, 7 aa, Mycobacterium bovis
DSHGSSW

SEQ ID NO: 193919 - protein, 14 aa, Mycobacterium bovis
DSKYPYTPDGNREF

SEQ ID NO: 193920 - protein, 18 aa, Mycobacterium bovis
DSNDTSVAGGAAGADSRV

SEQ ID NO: 193921 - protein, 14 aa, Mycobacterium bovis
DSPRPRLPADHPGV

SEQ ID NO: 193922 - protein, 9 aa, Mycobacterium bovis
DSTSGFQNI

SEQ ID NO: 193923 - protein, 4 aa, Mycobacterium bovis
DSWD

SEQ ID NO: 193924 - protein, 5 aa, Mycobacterium bovis
DTAEF

SEQ ID NO: 193925 - protein, 5 aa, Mycobacterium bovis
DTEAA

SEQ ID NO: 193926 - protein, 7 aa, Mycobacterium bovis
DTEHPDE

SEQ ID NO: 193927 - protein, 6 aa, Mycobacterium bovis
DTENAY

SEQ ID NO: 193928 - protein, 9 aa, Mycobacterium bovis
DTPDGDEAL

SEQ ID NO: 193929 - protein, 5 aa, Mycobacterium bovis
DTPRS

SEQ ID NO: 193930 - protein, 16 aa, Mycobacterium bovis
DTPTGLTCPYTTPLDV

SEQ ID NO: 193931 - protein, 8 aa, Mycobacterium bovis
DTRDAATS

SEQ ID NO: 193932 - protein, 19 aa, Mycobacterium bovis
DVDPPGPAQAGRRRRAIAM

SEQ ID NO: 193933 - protein, 8 aa, Mycobacterium bovis
DVNPPGDE

SEQ ID NO: 193934 - protein, 35 aa, Mycobacterium bovis
DVNTGGFNPGSYNTGNFNTGNYNTGSFNAGNYNTG

SEQ ID NO: 193935 - protein, 6 aa, Mycobacterium bovis
DVSESV

SEQ ID NO: 193936 - protein, 6 aa, Mycobacterium bovis
DVSSQT

SEQ ID NO: 193937 - protein, 5 aa, Mycobacterium bovis
DWQGV

SEQ ID NO: 193938 - protein, 4 aa, Mycobacterium bovis
DYSV

SEQ ID NO: 193939 - protein, 7 aa, Mycobacterium bovis
EAASDID

SEQ ID NO: 193940 - protein, 12 aa, Mycobacterium bovis
EADSYSSPTPCD

SEQ ID NO: 193941 - protein, 8 aa, Mycobacterium bovis
EAEAQERF

SEQ ID NO: 193942 - protein, 4 aa, Mycobacterium bovis
EAEE

SEQ ID NO: 193943 - protein, 5 aa, Mycobacterium bovis
EAEGW

SEQ ID NO: 193944 - protein, 5 aa, Mycobacterium bovis
EAGGL

SEQ ID NO: 193945 - protein, 8 aa, Mycobacterium bovis
EAGKARWA

SEQ ID NO: 193946 - protein, 4 aa, Mycobacterium bovis
EAIG

SEQ ID NO: 193947 - protein, 4 aa, Mycobacterium bovis
EAPS

SEQ ID NO: 193948 - protein, 6 aa, Mycobacterium bovis
EAPTGW

SEQ ID NO: 193949 - protein, 5 aa, Mycobacterium bovis
EAPTH

SEQ ID NO: 193950 - protein, 7 aa, Mycobacterium bovis
EAQRERR

SEQ ID NO: 193951 - protein, 8 aa, Mycobacterium bovis
EAQRERRK

SEQ ID NO: 193952 - protein, 10 aa, Mycobacterium bovis
EAQRTHQALT

SEQ ID NO: 193953 - protein, 4 aa, Mycobacterium bovis
EARS

SEQ ID NO: 193954 - protein, 15 aa, Mycobacterium bovis
EATAGPAAPAASAPL

SEQ ID NO: 193955 - protein, 5 aa, Mycobacterium bovis
EATHR

SEQ ID NO: 193956 - protein, 4 aa, Mycobacterium bovis
EDAR

SEQ ID NO: 193957 - protein, 10 aa, Mycobacterium bovis
EDDGSSRNQI

SEQ ID NO: 193958 - protein, 10 aa, Mycobacterium bovis
EDDPRTLAQR

SEQ ID NO: 193959 - protein, 7 aa, Mycobacterium bovis
EDGREGD

SEQ ID NO: 193960 - protein, 7 aa, Mycobacterium bovis
EDKGMRD

SEQ ID NO: 193961 - protein, 7 aa, Mycobacterium bovis
EDRPALK

SEQ ID NO: 193962 - protein, 15 aa, Mycobacterium bovis
EDYDRVPADEPNPEQ

SEQ ID NO: 193963 - protein, 4 aa, Mycobacterium bovis
EEGE

SEQ ID NO: 193964 - protein, 4 aa, Mycobacterium bovis
EENA

SEQ ID NO: 193965 - protein, 4 aa, Mycobacterium bovis
EEPP

SEQ ID NO: 193966 - protein, 4 aa, Mycobacterium bovis
EEQL

SEQ ID NO: 193967 - protein, 9 aa, Mycobacterium bovis
EFGPSARTR

SEQ ID NO: 193968 - protein, 7 aa, Mycobacterium bovis
EFPNTRM

SEQ ID NO: 193969 - protein, 6 aa, Mycobacterium bovis
EGADLR

SEQ ID NO: 193970 - protein, 14 aa, Mycobacterium bovis
EGAGPPVRRAPART

SEQ ID NO: 193971 - protein, 7 aa, Mycobacterium bovis
EGEPGDR

SEQ ID NO: 193972 - protein, 9 aa, Mycobacterium bovis
EGIGGHESF

SEQ ID NO: 193973 - protein, 7 aa, Mycobacterium bovis
EGKQSLT

SEQ ID NO: 193974 - protein, 4 aa, Mycobacterium bovis
EGLQ

SEQ ID NO: 193975 - protein, 14 aa, Mycobacterium bovis
EGQSAVKTAKTIDQ

SEQ ID NO: 193976 - protein, 7 aa, Mycobacterium bovis
EGRPSTD

SEQ ID NO: 193977 - protein, 7 aa, Mycobacterium bovis
EHRQPRV

SEQ ID NO: 193978 - protein, 8 aa, Mycobacterium bovis
EIAESGAA

SEQ ID NO: 193979 - protein, 7 aa, Mycobacterium bovis
EIPLDDN

SEQ ID NO: 193980 - protein, 6 aa, Mycobacterium bovis
EIREEV

SEQ ID NO: 193981 - protein, 4 aa, Mycobacterium bovis
EKSY

SEQ ID NO: 193982 - protein, 6 aa, Mycobacterium bovis
ELAPSN

SEQ ID NO: 193983 - protein, 8 aa, Mycobacterium bovis
ELKAADSL

SEQ ID NO: 193984 - protein, 7 aa, Mycobacterium bovis
ELKSTGF

SEQ ID NO: 193985 - protein, 5 aa, Mycobacterium bovis
ENTRR

SEQ ID NO: 193986 - protein, 9 aa, Mycobacterium bovis
EPDGPPGVS

SEQ ID NO: 193987 - protein, 9 aa, Mycobacterium bovis
EPDSKSSKS

SEQ ID NO: 193988 - protein, 7 aa, Mycobacterium bovis
EPLPVPT

SEQ ID NO: 193989 - protein, 4 aa, Mycobacterium bovis
EPLT

SEQ ID NO: 193990 - protein, 6 aa, Mycobacterium bovis
EPNDGH

SEQ ID NO: 193991 - protein, 4 aa, Mycobacterium bovis
EPNE

SEQ ID NO: 193992 - protein, 15 aa, Mycobacterium bovis
EPPVEDGEYRQTPAE

SEQ ID NO: 193993 - protein, 9 aa, Mycobacterium bovis
EPSQHEELP

SEQ ID NO: 193994 - protein, 9 aa, Mycobacterium bovis
EPTGRNLNA

SEQ ID NO: 193995 - protein, 10 aa, Mycobacterium bovis
EQLASSDPGV

SEQ ID NO: 193996 - protein, 4 aa, Mycobacterium bovis
EQTV

SEQ ID NO: 193997 - protein, 6 aa, Mycobacterium bovis
EQVDGR

SEQ ID NO: 193998 - protein, 7 aa, Mycobacterium bovis
EQVPPDR

SEQ ID NO: 193999 - protein, 5 aa, Mycobacterium bovis
EQVRT

SEQ ID NO: 194000 - protein, 4 aa, Mycobacterium bovis
ERAS

SEQ ID NO: 194001 - protein, 9 aa, Mycobacterium bovis
ERAVPPYES

SEQ ID NO: 194002 - protein, 11 aa, Mycobacterium bovis
ERDGRTDPFGQ

SEQ ID NO: 194003 - protein, 4 aa, Mycobacterium bovis
ERGA

SEQ ID NO: 194004 - protein, 7 aa, Mycobacterium bovis
ERGYDGA

SEQ ID NO: 194005 - protein, 6 aa, Mycobacterium bovis
ERHGGT

SEQ ID NO: 194006 - protein, 4 aa, Mycobacterium bovis
ERLA

SEQ ID NO: 194007 - protein, 7 aa, Mycobacterium bovis
ERLGGDG

SEQ ID NO: 194008 - protein, 16 aa, Mycobacterium bovis
ERPHPYSTPGRKRGAQ

SEQ ID NO: 194009 - protein, 5 aa, Mycobacterium bovis
ERPKA

SEQ ID NO: 194010 - protein, 14 aa, Mycobacterium bovis
ERREALSSVQGEYG

SEQ ID NO: 194011 - protein, 5 aa, Mycobacterium bovis
ERRTT

SEQ ID NO: 194012 - protein, 5 aa, Mycobacterium bovis
ERVRP

SEQ ID NO: 194013 - protein, 16 aa, Mycobacterium bovis
ESDTPNKLRATPTRGS

SEQ ID NO: 194014 - protein, 22 aa, Mycobacterium bovis
ESEANANTGTCESSVSEAAPPK

SEQ ID NO: 194015 - protein, 10 aa, Mycobacterium bovis
ESEKDRRLAE

SEQ ID NO: 194016 - protein, 4 aa, Mycobacterium bovis
ESEL

SEQ ID NO: 194017 - protein, 11 aa, Mycobacterium bovis
ESGVPTFRDDK

SEQ ID NO: 194018 - protein, 25 aa, Mycobacterium bovis
ESLHESGTSDRADAAAHRDAIGSYT

SEQ ID NO: 194019 - protein, 34 aa, Mycobacterium bovis; identical to SEQ ID NO: 34018

SEQ ID NO: 194020 - protein, 7 aa, Mycobacterium bovis
ESNMAST

SEQ ID NO: 194021 - protein, 10 aa, Mycobacterium bovis
ESPRRSPRRQ

SEQ ID NO: 194022 - protein, 17 aa, Mycobacterium bovis
ESTAARVDYPAGRVRAE

SEQ ID NO: 194023 - protein, 15 aa, Mycobacterium bovis
ESTSWPGVTRPTNIG

SEQ ID NO: 194024 - protein, 8 aa, Mycobacterium bovis
ESVPLPDD

SEQ ID NO: 194025 - protein, 10 aa, Mycobacterium bovis
ETHGKPPTRR

SEQ ID NO: 194026 - protein, 8 aa, Mycobacterium bovis
ETHPSEPN

SEQ ID NO: 194027 - protein, 12 aa, Mycobacterium bovis
ETPDSGSVKVGE

SEQ ID NO: 194028 - protein, 7 aa, Mycobacterium bovis
ETPSQAA

SEQ ID NO: 194029 - protein, 9 aa, Mycobacterium bovis
EVQNGTDVG

SEQ ID NO: 194030 - protein, 7 aa, Mycobacterium bovis
EVSADGL

SEQ ID NO: 194031 - protein, 8 aa, Mycobacterium bovis
EVSADGLR

SEQ ID NO: 194032 - protein, 7 aa, Mycobacterium bovis
EVSQPTI

SEQ ID NO: 194033 - protein, 15 aa, Mycobacterium bovis
EVSSPDEGNCVGPTI

SEQ ID NO: 194034 - protein, 8 aa, Mycobacterium bovis
EYEPGQPG

SEQ ID NO: 194035 - protein, 7 aa, Mycobacterium bovis
FADQPNA

SEQ ID NO: 194036 - protein, 8 aa, Mycobacterium bovis
FANSGPAV

SEQ ID NO: 194037 - protein, 4 aa, Mycobacterium bovis
FAPG

SEQ ID NO: 194038 - protein, 17 aa, Mycobacterium bovis
FASTGTGGAGGTGGAGG

SEQ ID NO: 194039 - protein, 8 aa, Mycobacterium bovis
FDRGTRAA

SEQ ID NO: 194040 - protein, 9 aa, Mycobacterium bovis
FERTPNGGV

SEQ ID NO: 194041 - protein, 4 aa, Mycobacterium bovis
FEYP

SEQ ID NO: 194042 - protein, 8 aa, Mycobacterium bovis
FGGGNNGT

SEQ ID NO: 194043 - protein, 9 aa, Mycobacterium bovis
FGNTGTNNV

SEQ ID NO: 194044 - protein, 13 aa, Mycobacterium bovis
FGQTGGSGGAAGL

SEQ ID NO: 194045 - protein, 9 aa, Mycobacterium bovis
FGSSGEGLA

SEQ ID NO: 194046 - protein, 8 aa, Mycobacterium bovis
FGTQEGGA

SEQ ID NO: 194047 - protein, 7 aa, Mycobacterium bovis
FHPGGAT

SEQ ID NO: 194048 - protein, 6 aa, Mycobacterium bovis
FNKPGT

SEQ ID NO: 194049 - protein, 10 aa, Mycobacterium bovis
FNPTTKTQAA

SEQ ID NO: 194050 - protein, 13 aa, Mycobacterium bovis
FNTGFGNGGNTNF

SEQ ID NO: 194051 - protein, 16 aa, Mycobacterium bovis
FPEKKLAEPPPGSGLK

SEQ ID NO: 194052 - protein, 5 aa, Mycobacterium bovis
FPRGA

SEQ ID NO: 194053 - protein, 5 aa, Mycobacterium bovis
FREPP

SEQ ID NO: 194054 - protein, 203 aa, Mycobacterium bovis
FSNGSNGGTGGTGGVGGTGGDGGNAGTGAGDPGKGGTGGTGGSGGAGGSGGANFNGGTGGTGGTGGTGGKGGMGGIAGDGGPGGDGGNAGVGGKGGTNGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNG

SEQ ID NO: 194055 - protein, 11 aa, Mycobacterium bovis
FSNLGSGVSGF

SEQ ID NO: 194056 - protein, 9 aa, Mycobacterium bovis
FTRAPQNSV

SEQ ID NO: 194057 - protein, 8 aa, Mycobacterium bovis
GAAAKGDV

SEQ ID NO: 194058 - protein, 8 aa, Mycobacterium bovis
GAAGTAAQ

SEQ ID NO: 194059 - protein, 17 aa, Mycobacterium bovis
GAANAPAAAAQGAAQGL

SEQ ID NO: 194060 - protein, 6 aa, Mycobacterium bovis
GAARSA

SEQ ID NO: 194061 - protein, 13 aa, Mycobacterium bovis
GAATAAAAAQTTG

SEQ ID NO: 194062 - protein, 5 aa, Mycobacterium bovis
GAATD

SEQ ID NO: 194063 - protein, 8 aa, Mycobacterium bovis
GAAWTPAD

SEQ ID NO: 194064 - protein, 11 aa, Mycobacterium bovis
GADPELKSTGF

SEQ ID NO: 194065 - protein, 6 aa, Mycobacterium bovis
GAEPAQ

SEQ ID NO: 194066 - protein, 4 aa, Mycobacterium bovis
GAGA

SEQ ID NO: 194067 - protein, 11 aa, Mycobacterium bovis
GAGGAGGDSAV

SEQ ID NO: 194068 - protein, 9 aa, Mycobacterium bovis
GAGGGGSIG

SEQ ID NO: 194069 - protein, 9 aa, Mycobacterium bovis
GAGGNGGDA

SEQ ID NO: 194070 - protein, 69 aa, Mycobacterium bovis
GAGGQGGDGGAGGAGADADQPGATGGTGFAGGAGGAGGAGGSSGAGGTNGSGGAGGTGGQGGAGGAGIS

SEQ ID NO: 194071 - protein, 71 aa, Mycobacterium bovis
GAGGTGGSGGGGATTGGDGGAGGAGGFGRTTGGIGGTGGNAGLLNGSGGAGGAGGAAITGPGGTGGAGGIP

SEQ ID NO: 194072 - protein, 5 aa, Mycobacterium bovis
GAGLG

SEQ ID NO: 194073 - protein, 13 aa, Mycobacterium bovis
GAGNRAGDGFDGA

SEQ ID NO: 194074 - protein, 7 aa, Mycobacterium bovis
GAGPELE

SEQ ID NO: 194075 - protein, 15 aa, Mycobacterium bovis
GANAPASTNPLHTAQ

SEQ ID NO: 194076 - protein, 6 aa, Mycobacterium bovis
GAPATS

SEQ ID NO: 194077 - protein, 14 aa, Mycobacterium bovis
GAPDSGNGGTDHPT

SEQ ID NO: 194078 - protein, 4 aa, Mycobacterium bovis
GAPI

SEQ ID NO: 194079 - protein, 6 aa, Mycobacterium bovis
GAQPAT

SEQ ID NO: 194080 - protein, 17 aa, Mycobacterium bovis
GASADQSRGVADGKPAD

SEQ ID NO: 194081 - protein, 30 aa, Mycobacterium bovis
GASPAAPAQAAAAVGQAAAEAAAGDGMRSA

SEQ ID NO: 194082 - protein, 8 aa, Mycobacterium bovis
GASRETVN

SEQ ID NO: 194083 - protein, 4 aa, Mycobacterium bovis
GASS

SEQ ID NO: 194084 - protein, 13 aa, Mycobacterium bovis
GASSVRLVNQTGY

SEQ ID NO: 194085 - protein, 7 aa, Mycobacterium bovis
GATGGTQ

SEQ ID NO: 194086 - protein, 13 aa, Mycobacterium bovis
GATMPGGGATPAL

SEQ ID NO: 194087 - protein, 16 aa, Mycobacterium bovis
GCQGDPSAAELPDVGD

SEQ ID NO: 194088 - protein, 13 aa, Mycobacterium bovis
GDASGATSCPRGE

SEQ ID NO: 194089 - protein, 9 aa, Mycobacterium bovis
GDDLGKTAR

SEQ ID NO: 194090 - protein, 6 aa, Mycobacterium bovis
GDDPYG

SEQ ID NO: 194091 - protein, 26 aa, Mycobacterium bovis
GDGGAGGAGGAATTGTGGAGGAGGKA

SEQ ID NO: 194092 - protein, 27 aa, Mycobacterium bovis
GDGGAGGAGGAGEDGTTPGGNGGAGGV

SEQ ID NO: 194093 - protein, 87 aa, Mycobacterium bovis
GDGGAGGAGGMGSTGGTGGGGGFGGGTGGNGGNGHAGGAGGSGGTAGLLGSGGTGGDGGNGGLGAGSGAKGNGGNGGDGGKGGDAQL

SEQ ID NO: 194094 - protein, 64 aa, Mycobacterium bovis
GDGGNGGAGGQGGAAGGSPGGGGGVGGHGGAGGDAGMNGGGGTGGQGGNGAAGGAGWSPDSDLK

SEQ ID NO: 194095 - protein, 20 aa, Mycobacterium bovis
GDGNLGSGNVGSTNLGSGNF

SEQ ID NO: 194096 - protein, 6 aa, Mycobacterium bovis
GDGQIG

SEQ ID NO: 194097 - protein, 9 aa, Mycobacterium bovis
GDGSTNPIR

SEQ ID NO: 194098 - protein, 4 aa, Mycobacterium bovis
GDGT

SEQ ID NO: 194099 - protein, 21 aa, Mycobacterium bovis
GDHRPAPPETEAALVPVQATL

SEQ ID NO: 194100 - protein, 15 aa, Mycobacterium bovis
GDIGGAGGGVSGHRG

SEQ ID NO: 194101 - protein, 12 aa, Mycobacterium bovis
GDLDDRGRYRQS

SEQ ID NO: 194102 - protein, 9 aa, Mycobacterium bovis
GDLTGEAAQ

SEQ ID NO: 194103 - protein, 7 aa, Mycobacterium bovis
GDPATSG

SEQ ID NO: 194104 - protein, 11 aa, Mycobacterium bovis
GDQLPEKTYPL

SEQ ID NO: 194105 - protein, 14 aa, Mycobacterium bovis
GDSNTGFANAGNVN

SEQ ID NO: 194106 - protein, 6 aa, Mycobacterium bovis
GDSYRL

SEQ ID NO: 194107 - protein, 5 aa, Mycobacterium bovis
GDTRE

SEQ ID NO: 194108 - protein, 4 aa, Mycobacterium bovis
GDVH

SEQ ID NO: 194109 - protein, 41 aa, Mycobacterium bovis
GDVNTGIGSTVDQPGSVSGFGNTGTSVSGFNNSGNLTSGFG

SEQ ID NO: 194110 - protein, 10 aa, Mycobacterium bovis
GEAGADYNVG

SEQ ID NO: 194111 - protein, 4 aa, Mycobacterium bovis
GEDH

SEQ ID NO: 194112 - protein, 12 aa, Mycobacterium bovis
GEFSAHRNSGES

SEQ ID NO: 194113 - protein, 10 aa, Mycobacterium bovis
GELAGPDFGS

SEQ ID NO: 194114 - protein, 4 aa, Mycobacterium bovis
GENT

SEQ ID NO: 194115 - protein, 4 aa, Mycobacterium bovis
GEPN

SEQ ID NO: 194116 - protein, 53 aa, Mycobacterium bovis
GEPPPAPSRPSASPAEPPTRPAPQHSRRARRGHRYRTDTERNVGKVATGPSIQ

SEQ ID NO: 194117 - protein, 5 aa, Mycobacterium bovis
GEPTI

SEQ ID NO: 194118 - protein, 17 aa, Mycobacterium bovis
GEQAPGATPSGSPIVTV

SEQ ID NO: 194119 - protein, 15 aa, Mycobacterium bovis
GEQLGPSADPGDGPA

SEQ ID NO: 194120 - protein, 9 aa, Mycobacterium bovis
GETKLGETY

SEQ ID NO: 194121 - protein, 52 aa, Mycobacterium bovis
GFGGAGGAGGASDTGAGGNGGAGGKAGLYGNGGDGGAGGDGATSGKGGAGGN

SEQ ID NO: 194122 - protein, 9 aa, Mycobacterium bovis
GFGNNGNNN

SEQ ID NO: 194123 - protein, 10 aa, Mycobacterium bovis
GFGNTGSGNI

SEQ ID NO: 194124 - protein, 9 aa, Mycobacterium bovis
GGAGGAGGA

SEQ ID NO: 194125 - protein, 25 aa, Mycobacterium bovis
GGAGGAGGAVTGTGATGGSGGAGGG

SEQ ID NO: 194126 - protein, 26 aa, Mycobacterium bovis
GGAGGAGGSGGSGAAGGAGGAGGAGG

SEQ ID NO: 194127 - protein, 15 aa, Mycobacterium bovis
GGAGGAGGSSGIGGF

SEQ ID NO: 194128 - protein, 103 aa, Mycobacterium bovis
GGAGGTGGAGLAGANGVNPTPGPAASTGDSPADVSGIGDQTGGDGGTGGHGTAGTPTGGTGGDGATATAGSGKATGGAGGDGGTAAAGGGGGNGGDGGVAQGD

SEQ ID NO: 194129 - protein, 5 aa, Mycobacterium bovis
GGAGL

SEQ ID NO: 194130 - protein, 7 aa, Mycobacterium bovis
GGANYPR

SEQ ID NO: 194131 - protein, 12 aa, Mycobacterium bovis
GGASAAAAALPS

SEQ ID NO: 194132 - protein, 6 aa, Mycobacterium bovis
GGFATT

SEQ ID NO: 194133 - protein, 6 aa, Mycobacterium bovis
GGFEGA

SEQ ID NO: 194134 - protein, 12 aa, Mycobacterium bovis
GGFGGAGGGGAV

SEQ ID NO: 194135 - protein, 5 aa, Mycobacterium bovis
GGGDQ

SEQ ID NO: 194136 - protein, 13 aa, Mycobacterium bovis
GGGGTDVEPYSSQ

SEQ ID NO: 194137 - protein, 12 aa, Mycobacterium bovis
GGGGTGAGQEAL

SEQ ID NO: 194138 - protein, 4 aa, Mycobacterium bovis
GGGL

SEQ ID NO: 194139 - protein, 20 aa, Mycobacterium bovis
GGGTGGSGVSGGAGGDGGAG

SEQ ID NO: 194140 - protein, 6 aa, Mycobacterium bovis
GGIDSP

SEQ ID NO: 194141 - protein, 24 aa, Mycobacterium bovis
GGIGGAGGFGGFRGGEGGAGGAGG

SEQ ID NO: 194142 - protein, 6 aa, Mycobacterium bovis
GGMPPM

SEQ ID NO: 194143 - protein, 4 aa, Mycobacterium bovis
GGMR

SEQ ID NO: 194144 - protein, 4 aa, Mycobacterium bovis
GGNE

SEQ ID NO: 194145 - protein, 9 aa, Mycobacterium bovis
GGNGGSAGW

SEQ ID NO: 194146 - protein, 11 aa, Mycobacterium bovis
GGNGGVGGTSV

SEQ ID NO: 194147 - protein, 10 aa, Mycobacterium bovis
GGNNVGGANA

SEQ ID NO: 194148 - protein, 9 aa, Mycobacterium bovis
GGNSNSGSF

SEQ ID NO: 194149 - protein, 11 aa, Mycobacterium bovis
GGPGDSGAPVT

SEQ ID NO: 194150 - protein, 6 aa, Mycobacterium bovis
GGPRGG

SEQ ID NO: 194151 - protein, 4 aa, Mycobacterium bovis
GGTF

SEQ ID NO: 194152 - protein, 10 aa, Mycobacterium bovis
GGTTQADVDA

SEQ ID NO: 194153 - protein, 26 aa, Mycobacterium bovis
GGVGGTGGGAGSGGTGGVGGTGGAGG

SEQ ID NO: 194154 - protein, 5 aa, Mycobacterium bovis
GHDRG

SEQ ID NO: 194155 - protein, 12 aa, Mycobacterium bovis
GHTDRPAGSLDG

SEQ ID NO: 194156 - protein, 8 aa, Mycobacterium bovis
GIANPRER

SEQ ID NO: 194157 - protein, 25 aa, Mycobacterium bovis
GIGGNTGSFNSGNLNTGFGNAGDLN

SEQ ID NO: 194158 - protein, 13 aa, Mycobacterium bovis
GINDDTIEQAAEA

SEQ ID NO: 194159 - protein, 7 aa, Mycobacterium bovis
GINGTIP

SEQ ID NO: 194160 - protein, 10 aa, Mycobacterium bovis
GIPVDDPDGY

SEQ ID NO: 194161 - protein, 14 aa, Mycobacterium bovis
GITDNDPATATNRR

SEQ ID NO: 194162 - protein, 6 aa, Mycobacterium bovis
GKADTV

SEQ ID NO: 194163 - protein, 177 aa, Mycobacterium bovis
GKGGDGGNGDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFF

SEQ ID NO: 194164 - protein, 40 aa, Mycobacterium bovis
GKGGFGGDGGQGGPNGGGTVGTVAGGGGNGGVGGRGGDGV

SEQ ID NO: 194165 - protein, 4 aa, Mycobacterium bovis
GKLA

SEQ ID NO: 194166 - protein, 13 aa, Mycobacterium bovis
GKPAAQEGSEPWV

SEQ ID NO: 194167 - protein, 6 aa, Mycobacterium bovis
GKTQAK

SEQ ID NO: 194168 - protein, 16 aa, Mycobacterium bovis
GKVDKDWDADATKGIP

SEQ ID NO: 194169 - protein, 26 aa, Mycobacterium bovis
GLAGGAGGGGGQGFDTGGAGGPGGDA

SEQ ID NO: 194170 - protein, 12 aa, Mycobacterium bovis
GLAGGSGQAWQG

SEQ ID NO: 194171 - protein, 16 aa, Mycobacterium bovis
GLAPGPLLGDGQLHER

SEQ ID NO: 194172 - protein, 4 aa, Mycobacterium bovis
GLAT

SEQ ID NO: 194173 - protein, 7 aa, Mycobacterium bovis
GLEPASP

SEQ ID NO: 194174 - protein, 15 aa, Mycobacterium bovis
GLGDQTDIGPMRRRD

SEQ ID NO: 194175 - protein, 8 aa, Mycobacterium bovis
GLPSGEAA

SEQ ID NO: 194176 - protein, 11 aa, Mycobacterium bovis
GLQKTPKSLPP

SEQ ID NO: 194177 - protein, 25 aa, Mycobacterium bovis
GMAPPGSGTWPPRSCPKPPRSWTST

SEQ ID NO: 194178 - protein, 48 aa, Mycobacterium bovis
GMAPPGSGTWPPRSCPKPPRSWTSTTLASTSTTSPASSHPPSANTTVT

SEQ ID NO: 194179 - protein, 16 aa, Mycobacterium bovis
GNGADGTAANPNGQAG

SEQ ID NO: 194180 - protein, 11 aa, Mycobacterium bovis
GNGGAGGSGGS

SEQ ID NO: 194181 - protein, 84 aa, Mycobacterium bovis
GNGGEVGVGGKGGAGGVSANPALNGSAGANGTAPTSGGNGGNGGAGATPTVAGENGGAGGNGGHGGSVGNGGAGGAGGNGVAGT

SEQ ID NO: 194182 - protein, 46 aa, Mycobacterium bovis
GNGGNGAAGGPNQAGGAGGNAGLIGNGGAGGAGGVGAVGGNGGTGG

SEQ ID NO: 194183 - protein, 23 aa, Mycobacterium bovis
GNGGNGGNAGKAGGTAGAGGAGG

SEQ ID NO: 194184 - protein, 5 aa, Mycobacterium bovis
GNGQI

SEQ ID NO: 194185 - protein, 5 aa, Mycobacterium bovis
GNGYY

SEQ ID NO: 194186 - protein, 9 aa, Mycobacterium bovis
GNNSQKSRD

SEQ ID NO: 194187 - protein, 7 aa, Mycobacterium bovis
GNPKNIR

SEQ ID NO: 194188 - protein, 8 aa, Mycobacterium bovis
GNRLDTAG

SEQ ID NO: 194189 - protein, 7 aa, Mycobacterium bovis
GNSGNNN

SEQ ID NO: 194190 - protein, 9 aa, Mycobacterium bovis
GNTGSGNFG

SEQ ID NO: 194191 - protein, 39 aa, Mycobacterium bovis
GNTGSGNIGNNNIGNNNIGSGNTGTGNIGSGNTGSGNLG

SEQ ID NO: 194192 - protein, 13 aa, Mycobacterium bovis
GNVGFGNSGLGAG

SEQ ID NO: 194193 - protein, 38 aa, Mycobacterium bovis
GPAPITPPASAAPAVTAAPAERPEPAGPAERPAPEAPA

SEQ ID NO: 194194 - protein, 5 aa, Mycobacterium bovis
GPAVN

SEQ ID NO: 194195 - protein, 7 aa, Mycobacterium bovis
GPDPVAR

SEQ ID NO: 194196 - protein, 27 aa, Mycobacterium bovis
GPEPATSGKRAPLDESPRHEKLDGGAG

SEQ ID NO: 194197 - protein, 5 aa, Mycobacterium bovis
GPEVT

SEQ ID NO: 194198 - protein, 5 aa, Mycobacterium bovis
GPGAA

SEQ ID NO: 194199 - protein, 10 aa, Mycobacterium bovis
GPGGSLTGSA

SEQ ID NO: 194200 - protein, 17 aa, Mycobacterium bovis
GPGPGAGVDRPILEVPV

SEQ ID NO: 194201 - protein, 6 aa, Mycobacterium bovis
GPGVTE

SEQ ID NO: 194202 - protein, 9 aa, Mycobacterium bovis
GPIRPTSAA

SEQ ID NO: 194203 - protein, 4 aa, Mycobacterium bovis
GPIT

SEQ ID NO: 194204 - protein, 5 aa, Mycobacterium bovis
GPLPV

SEQ ID NO: 194205 - protein, 25 aa, Mycobacterium bovis
GPMAHGKKRRGHRSSGVAAGVTGPA

SEQ ID NO: 194206 - protein, 16 aa, Mycobacterium bovis
GPNEIPSVRTNPRARG

SEQ ID NO: 194207 - protein, 5 aa, Mycobacterium bovis
GPNLA

SEQ ID NO: 194208 - protein, 9 aa, Mycobacterium bovis
GPNQPPPGI

SEQ ID NO: 194209 - protein, 7 aa, Mycobacterium bovis
GPQRTPA

SEQ ID NO: 194210 - protein, 5 aa, Mycobacterium bovis
GPRHI

SEQ ID NO: 194211 - protein, 16 aa, Mycobacterium bovis
GPSDVVGRAGPDRAHT

SEQ ID NO: 194212 - protein, 22 aa, Mycobacterium bovis
GPSGDTWSWGPSDAAQRVTGSA

SEQ ID NO: 194213 - protein, 7 aa, Mycobacterium bovis
GPSRERS

SEQ ID NO: 194214 - protein, 5 aa, Mycobacterium bovis
GPSTT

SEQ ID NO: 194215 - protein, 7 aa, Mycobacterium bovis
GPTRHPV

SEQ ID NO: 194216 - protein, 7 aa, Mycobacterium bovis
GQAGGQA

SEQ ID NO: 194217 - protein, 8 aa, Mycobacterium bovis
GQFDPTTM

SEQ ID NO: 194218 - protein, 9 aa, Mycobacterium bovis
GQGRPDEYY

SEQ ID NO: 194219 - protein, 11 aa, Mycobacterium bovis
GQLAGTANELT

SEQ ID NO: 194220 - protein, 7 aa, Mycobacterium bovis
GQPAREV

SEQ ID NO: 194221 - protein, 4 aa, Mycobacterium bovis
GQRY

SEQ ID NO: 194222 - protein, 6 aa, Mycobacterium bovis
GQVHNE

SEQ ID NO: 194223 - protein, 12 aa, Mycobacterium bovis
GRAAAAGDELDT

SEQ ID NO: 194224 - protein, 26 aa, Mycobacterium bovis
GRADGAHPDVGEAAKPIHQYRDRDTF

SEQ ID NO: 194225 - protein, 7 aa, Mycobacterium bovis
GRAFTSG

SEQ ID NO: 194226 - protein, 8 aa, Mycobacterium bovis
GRAPRTDD

SEQ ID NO: 194227 - protein, 8 aa, Mycobacterium bovis
GRDPRAAA

SEQ ID NO: 194228 - protein, 10 aa, Mycobacterium bovis
GRGIPTGTCP

SEQ ID NO: 194229 - protein, 9 aa, Mycobacterium bovis
GRKGDGRIE

SEQ ID NO: 194230 - protein, 6 aa, Mycobacterium bovis
GRKPSR

SEQ ID NO: 194231 - protein, 7 aa, Mycobacterium bovis
GRNATTV

SEQ ID NO: 194232 - protein, 10 aa, Mycobacterium bovis
GRPEYPTPVG

SEQ ID NO: 194233 - protein, 14 aa, Mycobacterium bovis
GRQDKAKQTPCPGY

SEQ ID NO: 194234 - protein, 5 aa, Mycobacterium bovis
GRRAA

SEQ ID NO: 194235 - protein, 9 aa, Mycobacterium bovis
GRRRAGARV

SEQ ID NO: 194236 - protein, 17 aa, Mycobacterium bovis
GRRTRARRADRHHPAHR

SEQ ID NO: 194237 - protein, 19 aa, Mycobacterium bovis
GRSASKGIAGTSPGTSTRL

SEQ ID NO: 194238 - protein, 9 aa, Mycobacterium bovis
GRSGPEQAA

SEQ ID NO: 194239 - protein, 5 aa, Mycobacterium bovis
GRSNG

SEQ ID NO: 194240 - protein, 17 aa, Mycobacterium bovis
GRSPGRDSGGRKVPESP

SEQ ID NO: 194241 - protein, 7 aa, Mycobacterium bovis
GRVATAA

SEQ ID NO: 194242 - protein, 5 aa, Mycobacterium bovis
GRVSR

SEQ ID NO: 194243 - protein, 9 aa, Mycobacterium bovis
GSAARPRAV

SEQ ID NO: 194244 - protein, 6 aa, Mycobacterium bovis
GSDEQF

SEQ ID NO: 194245 - protein, 5 aa, Mycobacterium bovis
GSEDG

SEQ ID NO: 194246 - protein, 5 aa, Mycobacterium bovis
GSGAP

SEQ ID NO: 194247 - protein, 5 aa, Mycobacterium bovis
GSGNF

SEQ ID NO: 194248 - protein, 49 aa, Mycobacterium bovis
GSGNFGSQNLGSGNIGSTNVGSGNIGSTNVGSGNIGDTNFGNGNNGNFN

SEQ ID NO: 194249 - protein, 27 aa, Mycobacterium bovis
GSGNIGGTNVGSGNVGGTNLGSGNYGS

SEQ ID NO: 194250 - protein, 35 aa, Mycobacterium bovis
GSGNTGTGNAGSGNTGDYNPGSGNFGSGNFGSGNI

SEQ ID NO: 194251 - protein, 7 aa, Mycobacterium bovis
GSLAGGT

SEQ ID NO: 194252 - protein, 7 aa, Mycobacterium bovis
GSLPPGV

SEQ ID NO: 194253 - protein, 14 aa, Mycobacterium bovis
GSPGFDATSPAKLG

SEQ ID NO: 194254 - protein, 6 aa, Mycobacterium bovis
GSRAAT

SEQ ID NO: 194255 - protein, 4 aa, Mycobacterium bovis
GSTG

SEQ ID NO: 194256 - protein, 7 aa, Mycobacterium bovis
GSYRTDG

SEQ ID NO: 194257 - protein, 7 aa, Mycobacterium bovis
GTAAHPC

SEQ ID NO: 194258 - protein, 4 aa, Mycobacterium bovis
GTAD

SEQ ID NO: 194259 - protein, 41 aa, Mycobacterium bovis
GTAMPDTNVAPAYRSSVSASVSASAATSSIRESQRQQSLTT

SEQ ID NO: 194260 - protein, 16 aa, Mycobacterium bovis
GTAPTGATPARPSAER

SEQ ID NO: 194261 - protein, 5 aa, Mycobacterium bovis
GTATA

SEQ ID NO: 194262 - protein, 8 aa, Mycobacterium bovis
GTDARTRA

SEQ ID NO: 194263 - protein, 14 aa, Mycobacterium bovis
GTFGTNGAGGTGGL

SEQ ID NO: 194264 - protein, 16 aa, Mycobacterium bovis
GTGGKGGNGGNGGAGM

SEQ ID NO: 194265 - protein, 12 aa, Mycobacterium bovis
GTIGAQGESADG

SEQ ID NO: 194266 - protein, 19 aa, Mycobacterium bovis
GTPRRPLTSSNGLSTDMGG

SEQ ID NO: 194267 - protein, 4 aa, Mycobacterium bovis
GTPV

SEQ ID NO: 194268 - protein, 10 aa, Mycobacterium bovis
GTQPTGTENH

SEQ ID NO: 194269 - protein, 5 aa, Mycobacterium bovis
GTQVS

SEQ ID NO: 194270 - protein, 8 aa, Mycobacterium bovis
GTRAHSAR

SEQ ID NO: 194271 - protein, 7 aa, Mycobacterium bovis
GTRDGDL

SEQ ID NO: 194272 - protein, 9 aa, Mycobacterium bovis
GTTAAQQTL

SEQ ID NO: 194273 - protein, 15 aa, Mycobacterium bovis
GTTKIEDKDGNPVDP

SEQ ID NO: 194274 - protein, 26 aa, Mycobacterium bovis
GTYGPGYHSDSTRTYSIGEPDSDVAQ

SEQ ID NO: 194275 - protein, 9 aa, Mycobacterium bovis
GVAADAASL

SEQ ID NO: 194276 - protein, 8 aa, Mycobacterium bovis
GVEQPDKH

SEQ ID NO: 194277 - protein, 12 aa, Mycobacterium bovis
GVETHPPNRHES

SEQ ID NO: 194278 - protein, 7 aa, Mycobacterium bovis
GVGGAGG

SEQ ID NO: 194279 - protein, 9 aa, Mycobacterium bovis
GVNGRRKAG

SEQ ID NO: 194280 - protein, 5 aa, Mycobacterium bovis
GVPEI

SEQ ID NO: 194281 - protein, 10 aa, Mycobacterium bovis
GVPRDPDPLH

SEQ ID NO: 194282 - protein, 9 aa, Mycobacterium bovis
GVSSPGRHP

SEQ ID NO: 194283 - protein, 37 aa, Mycobacterium bovis
GVSTGAASGAGGRFGSKPTASGPAAAFGSKPASSALA

SEQ ID NO: 194284 - protein, 11 aa, Mycobacterium bovis
GVTAEQVDAAA

SEQ ID NO: 194285 - protein, 6 aa, Mycobacterium bovis
GVTSGR

SEQ ID NO: 194286 - protein, 5 aa, Mycobacterium bovis
GVVPP

SEQ ID NO: 194287 - protein, 19 aa, Mycobacterium bovis
GYDKSWADGRGASPADRRH

SEQ ID NO: 194288 - protein, 14 aa, Mycobacterium bovis
GYPTDHRAAQVGTE

SEQ ID NO: 194289 - protein, 5 aa, Mycobacterium bovis
GYQDL

SEQ ID NO: 194290 - protein, 5 aa, Mycobacterium bovis
GYTTD

SEQ ID NO: 194291 - protein, 19 aa, Mycobacterium bovis
GYTTTGSIDDAVASLRAAL

SEQ ID NO: 194292 - protein, 59 aa, Mycobacterium bovis
HAAAQPDSITAATTGGRRRKRAAPDLDATQKSLRPAAKGPKVKKVKPQKPKATKPPKVV

SEQ ID NO: 194293 - protein, 5 aa, Mycobacterium bovis
HADPA

SEQ ID NO: 194294 - protein, 6 aa, Mycobacterium bovis
HAEPKQ

SEQ ID NO: 194295 - protein, 11 aa, Mycobacterium bovis
HAPEASEEPES

SEQ ID NO: 194296 - protein, 6 aa, Mycobacterium bovis
HAPTDP

SEQ ID NO: 194297 - protein, 5 aa, Mycobacterium bovis
HARQA

SEQ ID NO: 194298 - protein, 16 aa, Mycobacterium bovis
HDGRTARVRGDEITST

SEQ ID NO: 194299 - protein, 6 aa, Mycobacterium bovis
HDKNGD

SEQ ID NO: 194300 - protein, 6 aa, Mycobacterium bovis
HDTVSG

SEQ ID NO: 194301 - protein, 8 aa, Mycobacterium bovis
HEDPSGPV

SEQ ID NO: 194302 - protein, 9 aa, Mycobacterium bovis
HEETEGTLG

SEQ ID NO: 194303 - protein, 6 aa, Mycobacterium bovis
HEHTGE

SEQ ID NO: 194304 - protein, 7 aa, Mycobacterium bovis
HERAGSG

SEQ ID NO: 194305 - protein, 6 aa, Mycobacterium bovis
HGDRFE

SEQ ID NO: 194306 - protein, 4 aa, Mycobacterium bovis
HGHT

SEQ ID NO: 194307 - protein, 7 aa, Mycobacterium bovis
HGKASGQ

SEQ ID NO: 194308 - protein, 26 aa, Mycobacterium bovis
HGNAGGVNVGSGNAGLANTGDFNSGG

SEQ ID NO: 194309 - protein, 16 aa, Mycobacterium bovis
HGPRRHGRRGILTACG

SEQ ID NO: 194310 - protein, 13 aa, Mycobacterium bovis
HGVPDSVARSGGL

SEQ ID NO: 194311 - protein, 14 aa, Mycobacterium bovis
HGYPVTDKARDGRW

SEQ ID NO: 194312 - protein, 25 aa, Mycobacterium bovis
HHRRQDRRRGGLGPGPAPSPSHRAG

SEQ ID NO: 194313 - protein, 4 aa, Mycobacterium bovis
HNVA

SEQ ID NO: 194314 - protein, 24 aa, Mycobacterium bovis
HPAAKRARAQPRRPVKRADETETV

SEQ ID NO: 194315 - protein, 5 aa, Mycobacterium bovis
HPDGF

SEQ ID NO: 194316 - protein, 9 aa, Mycobacterium bovis
HPDHPSRSA

SEQ ID NO: 194317 - protein, 5 aa, Mycobacterium bovis
HPGDL

SEQ ID NO: 194318 - protein, 7 aa, Mycobacterium bovis
HPKEEPS

SEQ ID NO: 194319 - protein, 5 aa, Mycobacterium bovis
HPRDL

SEQ ID NO: 194320 - protein, 12 aa, Mycobacterium bovis
HPRHQTRRGRAC

SEQ ID NO: 194321 - protein, 5 aa, Mycobacterium bovis
HPSIE

SEQ ID NO: 194322 - protein, 10 aa, Mycobacterium bovis
HQGERRAAYN

SEQ ID NO: 194323 - protein, 4 aa, Mycobacterium bovis
HQHS

SEQ ID NO: 194324 - protein, 5 aa, Mycobacterium bovis
HQSTG

SEQ ID NO: 194325 - protein, 5 aa, Mycobacterium bovis
HRKGD

SEQ ID NO: 194326 - protein, 10 aa, Mycobacterium bovis
HSDGSDGAEH

SEQ ID NO: 194327 - protein, 4 aa, Mycobacterium bovis
HSEW

SEQ ID NO: 194328 - protein, 6 aa, Mycobacterium bovis
HSGPEA

SEQ ID NO: 194329 - protein, 9 aa, Mycobacterium bovis
HSRSSGRFG

SEQ ID NO: 194330 - protein, 7 aa, Mycobacterium bovis
HTATDAA

SEQ ID NO: 194331 - protein, 9 aa, Mycobacterium bovis
HTKKKESEI

SEQ ID NO: 194332 - protein, 7 aa, Mycobacterium bovis
HTTRDTS

SEQ ID NO: 194333 - protein, 4 aa, Mycobacterium bovis
HTVA

SEQ ID NO: 194334 - protein, 4 aa, Mycobacterium bovis
HVTD

SEQ ID NO: 194335 - protein, 7 aa, Mycobacterium bovis
HVTPPQT

SEQ ID NO: 194336 - protein, 9 aa, Mycobacterium bovis
IAEPDTADR

SEQ ID NO: 194337 - protein, 42 aa, Mycobacterium bovis
IANSGNNLAGISNSGDDSSGAVNSGSQNSGAFNAGVGLSGFF

SEQ ID NO: 194338 - protein, 9 aa, Mycobacterium bovis
IAPAGPSAV

SEQ ID NO: 194339 - protein, 11 aa, Mycobacterium bovis
IATERAGKPVQ

SEQ ID NO: 194340 - protein, 6 aa, Mycobacterium bovis
IDESDQ

SEQ ID NO: 194341 - protein, 8 aa, Mycobacterium bovis
IDGAQQAS

SEQ ID NO: 194342 - protein, 41 aa, Mycobacterium bovis
IDPVQPGANPRNVQTPQSHPAQSTPTTTSTPPGKPRRQSTA

SEQ ID NO: 194343 - protein, 9 aa, Mycobacterium bovis
IDQTETPVV

SEQ ID NO: 194344 - protein, 14 aa, Mycobacterium bovis
IEPPEEVFAAPPSA

SEQ ID NO: 194345 - protein, 9 aa, Mycobacterium bovis
IERDDEGLA

SEQ ID NO: 194346 - protein, 4 aa, Mycobacterium bovis
IGGQ

SEQ ID NO: 194347 - protein, 11 aa, Mycobacterium bovis
IGGTGGTGGNR

SEQ ID NO: 194348 - protein, 23 aa, Mycobacterium bovis
IGNGGNGGAGGTGAAGGAGGNGG

SEQ ID NO: 194349 - protein, 17 aa, Mycobacterium bovis
IGNGGNGGNGGKGGTGL

SEQ ID NO: 194350 - protein, 23 aa, Mycobacterium bovis
IGNGGNGGSGGMGDAPGGTGVGG

SEQ ID NO: 194351 - protein, 33 aa, Mycobacterium bovis
IGNGGNGGSGGTSVATGGAGNGGAGGAGGGAGL

SEQ ID NO: 194352 - protein, 7 aa, Mycobacterium bovis
IGPDPSF

SEQ ID NO: 194353 - protein, 6 aa, Mycobacterium bovis
IGPGPH

SEQ ID NO: 194354 - protein, 7 aa, Mycobacterium bovis
IGPGYGA

SEQ ID NO: 194355 - protein, 6 aa, Mycobacterium bovis
IGPPVP

SEQ ID NO: 194356 - protein, 9 aa, Mycobacterium bovis
IGPSPAEAD

SEQ ID NO: 194357 - protein, 40 aa, Mycobacterium bovis
IGRKSATRKSKGAKGKSGKKSKKGTRGPTPPKVKSPFGVP

SEQ ID NO: 194358 - protein, 4 aa, Mycobacterium bovis
IGSG

SEQ ID NO: 194359 - protein, 15 aa, Mycobacterium bovis
IGVPPGSRGCANYTR

SEQ ID NO: 194360 - protein, 22 aa, Mycobacterium bovis
INGTGGAGGSRGQISGNPGTPG

SEQ ID NO: 194361 - protein, 6 aa, Mycobacterium bovis
IPAGPA

SEQ ID NO: 194362 - protein, 4 aa, Mycobacterium bovis
ISAR

SEQ ID NO: 194363 - protein, 19 aa, Mycobacterium bovis
ISEAGQAMASTEGNVTGMF

SEQ ID NO: 194364 - protein, 13 aa, Mycobacterium bovis
ISGDRKPSAHASY

SEQ ID NO: 194365 - protein, 5 aa, Mycobacterium bovis
ISPRS

SEQ ID NO: 194366 - protein, 22 aa, Mycobacterium bovis
ISQTAQQAAQSAQGGSGPMPAQ

SEQ ID NO: 194367 - protein, 11 aa, Mycobacterium bovis
ISTANGAAALP

SEQ ID NO: 194368 - protein, 8 aa, Mycobacterium bovis
ISTSSNTE

SEQ ID NO: 194369 - protein, 12 aa, Mycobacterium bovis
ITNPANRHAAER

SEQ ID NO: 194370 - protein, 8 aa, Mycobacterium bovis
ITSPKSGV

SEQ ID NO: 194371 - protein, 5 aa, Mycobacterium bovis
KACPD

SEQ ID NO: 194372 - protein, 12 aa, Mycobacterium bovis
KAEAPSGTAART

SEQ ID NO: 194373 - protein, 24 aa, Mycobacterium bovis
KAGNGGAGGNGGAAGNGGGGAAGD

SEQ ID NO: 194374 - protein, 9 aa, Mycobacterium bovis
KATAGTPRR

SEQ ID NO: 194375 - protein, 6 aa, Mycobacterium bovis
KATRDE

SEQ ID NO: 194376 - protein, 6 aa, Mycobacterium bovis
KDGIEE

SEQ ID NO: 194377 - protein, 22 aa, Mycobacterium bovis
KEGEAGEDEVGRAEKDLDKTTH

SEQ ID NO: 194378 - protein, 8 aa, Mycobacterium bovis
KGARYGPV

SEQ ID NO: 194379 - protein, 10 aa, Mycobacterium bovis
KGGAGKTTLT

SEQ ID NO: 194380 - protein, 7 aa, Mycobacterium bovis
KGPNGDL

SEQ ID NO: 194381 - protein, 17 aa, Mycobacterium bovis
KGRRGRSPARPNAPIGA

SEQ ID NO: 194382 - protein, 7 aa, Mycobacterium bovis
KHADRSI

SEQ ID NO: 194383 - protein, 7 aa, Mycobacterium bovis
KIAEDGE

SEQ ID NO: 194384 - protein, 5 aa, Mycobacterium bovis
KKKHG

SEQ ID NO: 194385 - protein, 6 aa, Mycobacterium bovis
KLTTAG

SEQ ID NO: 194386 - protein, 8 aa, Mycobacterium bovis
KNERGEAE

SEQ ID NO: 194387 - protein, 15 aa, Mycobacterium bovis
KPDCPSGAGNDERAA

SEQ ID NO: 194388 - protein, 5 aa, Mycobacterium bovis
KPDDV

SEQ ID NO: 194389 - protein, 6 aa, Mycobacterium bovis
KPEAID

SEQ ID NO: 194390 - protein, 7 aa, Mycobacterium bovis
KPGKPWR

SEQ ID NO: 194391 - protein, 10 aa, Mycobacterium bovis
KPHKSTVQKV

SEQ ID NO: 194392 - protein, 17 aa, Mycobacterium bovis
KPPSRFGYGTSGRRANV

SEQ ID NO: 194393 - protein, 8 aa, Mycobacterium bovis
KPRNAGLR

SEQ ID NO: 194394 - protein, 7 aa, Mycobacterium bovis
KPSPVTA

SEQ ID NO: 194395 - protein, 6 aa, Mycobacterium bovis
KPVPDK

SEQ ID NO: 194396 - protein, 8 aa, Mycobacterium bovis
KQEFPSSE

SEQ ID NO: 194397 - protein, 4 aa, Mycobacterium bovis
KQNV

SEQ ID NO: 194398 - protein, 13 aa, Mycobacterium bovis
KRAIKQGTELAAR

SEQ ID NO: 194399 - protein, 11 aa, Mycobacterium bovis
KRERGIDAPGP

SEQ ID NO: 194400 - protein, 6 aa, Mycobacterium bovis
KRLGTT

SEQ ID NO: 194401 - protein, 13 aa, Mycobacterium bovis
KRLPSTAQGAAAV

SEQ ID NO: 194402 - protein, 7 aa, Mycobacterium bovis
KRRPPGQ

SEQ ID NO: 194403 - protein, 7 aa, Mycobacterium bovis
KSAGKWP

SEQ ID NO: 194404 - protein, 8 aa, Mycobacterium bovis
KSSARPAL

SEQ ID NO: 194405 - protein, 7 aa, Mycobacterium bovis
KSTPAMT

SEQ ID NO: 194406 - protein, 19 aa, Mycobacterium bovis
KTAEREHTPTATATTPSVA

SEQ ID NO: 194407 - protein, 6 aa, Mycobacterium bovis
KTAGLQ

SEQ ID NO: 194408 - protein, 16 aa, Mycobacterium bovis
KTGYATNAPPITDIWG

SEQ ID NO: 194409 - protein, 5 aa, Mycobacterium bovis
KTNRA

SEQ ID NO: 194410 - protein, 6 aa, Mycobacterium bovis
KTPPEL

SEQ ID NO: 194411 - protein, 8 aa, Mycobacterium bovis
KTSDDDMD

SEQ ID NO: 194412 - protein, 4 aa, Mycobacterium bovis
KTSI

SEQ ID NO: 194413 - protein, 8 aa, Mycobacterium bovis
KTTDADIE

SEQ ID NO: 194414 - protein, 13 aa, Mycobacterium bovis
KTVTSEANRARRV

SEQ ID NO: 194415 - protein, 6 aa, Mycobacterium bovis
KVAQPS

SEQ ID NO: 194416 - protein, 5 aa, Mycobacterium bovis
LADAG

SEQ ID NO: 194417 - protein, 7 aa, Mycobacterium bovis
LADEGIG

SEQ ID NO: 194418 - protein, 9 aa, Mycobacterium bovis
LADGPEGSA

SEQ ID NO: 194419 - protein, 16 aa, Mycobacterium bovis
LAGESGADDLRRRRCR

SEQ ID NO: 194420 - protein, 11 aa, Mycobacterium bovis
LAGGDAQLPHG

SEQ ID NO: 194421 - protein, 9 aa, Mycobacterium bovis
LAGPTRGAP

SEQ ID NO: 194422 - protein, 22 aa, Mycobacterium bovis
LAGTPSQAAIEADTRSAGQRHH

SEQ ID NO: 194423 - protein, 11 aa, Mycobacterium bovis
LAKTPDDRTQI

SEQ ID NO: 194424 - protein, 6 aa, Mycobacterium bovis
LAPHGL

SEQ ID NO: 194425 - protein, 29 aa, Mycobacterium bovis
LAPPTRPAPTEPPPSPSPQRNSGRRAERR

SEQ ID NO: 194426 - protein, 5 aa, Mycobacterium bovis
LARDG

SEQ ID NO: 194427 - protein, 13 aa, Mycobacterium bovis
LATDPQARQRRER

SEQ ID NO: 194428 - protein, 6 aa, Mycobacterium bovis
LATEPD

SEQ ID NO: 194429 - protein, 7 aa, Mycobacterium bovis
LDESDRR

SEQ ID NO: 194430 - protein, 16 aa, Mycobacterium bovis
LDGSDRRNSGGGATRM

SEQ ID NO: 194431 - protein, 7 aa, Mycobacterium bovis
LDPELEP

SEQ ID NO: 194432 - protein, 7 aa, Mycobacterium bovis
LDPGKLP

SEQ ID NO: 194433 - protein, 4 aa, Mycobacterium bovis
LDSD

SEQ ID NO: 194434 - protein, 12 aa, Mycobacterium bovis
LDSRDQGAADRR

SEQ ID NO: 194435 - protein, 10 aa, Mycobacterium bovis
LDSSTADFNG

SEQ ID NO: 194436 - protein, 6 aa, Mycobacterium bovis
LERAEN

SEQ ID NO: 194437 - protein, 17 aa, Mycobacterium bovis
LERRQKSRQTRASRDAL

SEQ ID NO: 194438 - protein, 6 aa, Mycobacterium bovis
LETGDR

SEQ ID NO: 194439 - protein, 10 aa, Mycobacterium bovis
LFDPDSALRA

SEQ ID NO: 194440 - protein, 8 aa, Mycobacterium bovis
LGANGATL

SEQ ID NO: 194441 - protein, 6 aa, Mycobacterium bovis
LGESAA

SEQ ID NO: 194442 - protein, 8 aa, Mycobacterium bovis
LGGATETA

SEQ ID NO: 194443 - protein, 11 aa, Mycobacterium bovis
LGGGLGANSRH

SEQ ID NO: 194444 - protein, 15 aa, Mycobacterium bovis
LGGGNTGNANLGGGN

SEQ ID NO: 194445 - protein, 7 aa, Mycobacterium bovis
LGGRELG

SEQ ID NO: 194446 - protein, 5 aa, Mycobacterium bovis
LGGSN

SEQ ID NO: 194447 - protein, 27 aa, Mycobacterium bovis
LGNGGNGGNGGTGTSAGSPGAGGAGGS

SEQ ID NO: 194448 - protein, 179 aa, Mycobacterium bovis
LGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGKGGRGGTGGPGGAGPAGTTGSQGAGGNGGSGGTGGDPGDGGNGANGSV

SEQ ID NO: 194449 - protein, 4 aa, Mycobacterium bovis
LGPD

SEQ ID NO: 194450 - protein, 10 aa, Mycobacterium bovis
LGPDPDDEGD

SEQ ID NO: 194451 - protein, 10 aa, Mycobacterium bovis
LGRAASVGSL

SEQ ID NO: 194452 - protein, 4 aa, Mycobacterium bovis
LGRP

SEQ ID NO: 194453 - protein, 15 aa, Mycobacterium bovis
LGSATSSQLPSTSPS

SEQ ID NO: 194454 - protein, 4 aa, Mycobacterium bovis
LGTP

SEQ ID NO: 194455 - protein, 6 aa, Mycobacterium bovis
LGTTSR

SEQ ID NO: 194456 - protein, 7 aa, Mycobacterium bovis
LIGGQED

SEQ ID NO: 194457 - protein, 7 aa, Mycobacterium bovis
LKKDTAE

SEQ ID NO: 194458 - protein, 25 aa, Mycobacterium bovis
LNGDPKVDDGPSSDANLSAPLTPQQ

SEQ ID NO: 194459 - protein, 65 aa, Mycobacterium bovis
LNGGNGGIGGNGGSAAGTGGDGGKGGNGGAGANGQDFSASANGANGGQGGNGGNGGIGGKGGDAF

SEQ ID NO: 194460 - protein, 8 aa, Mycobacterium bovis
LNPSPLGY

SEQ ID NO: 194461 - protein, 17 aa, Mycobacterium bovis
LNSGTGNIGFGNSGNNN

SEQ ID NO: 194462 - protein, 11 aa, Mycobacterium bovis
LNVNGSSLAAG

SEQ ID NO: 194463 - protein, 12 aa, Mycobacterium bovis
LPASNRRLTDYD

SEQ ID NO: 194464 - protein, 12 aa, Mycobacterium bovis
LPATARDPRVEN

SEQ ID NO: 194465 - protein, 4 aa, Mycobacterium bovis
LPDD

SEQ ID NO: 194466 - protein, 4 aa, Mycobacterium bovis
LPDP

SEQ ID NO: 194467 - protein, 6 aa, Mycobacterium bovis
LPEEPW

SEQ ID NO: 194468 - protein, 5 aa, Mycobacterium bovis
LPEET

SEQ ID NO: 194469 - protein, 9 aa, Mycobacterium bovis
LPETRDAAK

SEQ ID NO: 194470 - protein, 98 aa, Mycobacterium bovis
LPGGGTVGNPGTGGNGGNGGNAGVGGTGGKAGTGSLTGLDGTDGITPNGGNGGNGGNGGKGGTAGNGSGAAGGNGGNGGSGLNGGDAGNGGNGGGALN

SEQ ID NO: 194471 - protein, 4 aa, Mycobacterium bovis
LPGP

SEQ ID NO: 194472 - protein, 15 aa, Mycobacterium bovis
LPKGYPVSSAPYGSA

SEQ ID NO: 194473 - protein, 8 aa, Mycobacterium bovis
LPKPNNQT

SEQ ID NO: 194474 - protein, 6 aa, Mycobacterium bovis
LPPAAN

SEQ ID NO: 194475 - protein, 10 aa, Mycobacterium bovis
LPPAVKARAS

SEQ ID NO: 194476 - protein, 8 aa, Mycobacterium bovis
LPPNPDTH

SEQ ID NO: 194477 - protein, 4 aa, Mycobacterium bovis
LPPQ

SEQ ID NO: 194478 - protein, 13 aa, Mycobacterium bovis
LPRRQDTSRRAAQ

SEQ ID NO: 194479 - protein, 16 aa, Mycobacterium bovis
LPSDTDLDTPGPQRSL

SEQ ID NO: 194480 - protein, 9 aa, Mycobacterium bovis
LRGPHRRRP

SEQ ID NO: 194481 - protein, 12 aa, Mycobacterium bovis
LRRGKDRRKVHY

SEQ ID NO: 194482 - protein, 6 aa, Mycobacterium bovis
LRSKPG

SEQ ID NO: 194483 - protein, 10 aa, Mycobacterium bovis
LRSTGDPRRV

SEQ ID NO: 194484 - protein, 7 aa, Mycobacterium bovis
LSAAAAK

SEQ ID NO: 194485 - protein, 6 aa, Mycobacterium bovis
LSDPRN

SEQ ID NO: 194486 - protein, 29 aa, Mycobacterium bovis
LSPPSQTTNPGGLAAQSAAVGSAAATAAV

SEQ ID NO: 194487 - protein, 20 aa, Mycobacterium bovis
LSRARGAAAEALTGYREPKP

SEQ ID NO: 194488 - protein, 11 aa, Mycobacterium bovis
LSSAEKGAAAS

SEQ ID NO: 194489 - protein, 8 aa, Mycobacterium bovis
LSSGREAD

SEQ ID NO: 194490 - protein, 13 aa, Mycobacterium bovis
LTAANAAAAVPTS

SEQ ID NO: 194491 - protein, 11 aa, Mycobacterium bovis
LTAFDSNRSGG

SEQ ID NO: 194492 - protein, 32 aa, Mycobacterium bovis
LTQAGANSGFGNLGTGNSGWGNSDPSGTGNSG

SEQ ID NO: 194493 - protein, 10 aa, Mycobacterium bovis
LTRTASNMNA

SEQ ID NO: 194494 - protein, 13 aa, Mycobacterium bovis
LTSDRTPERRRRG

SEQ ID NO: 194495 - protein, 10 aa, Mycobacterium bovis
LTSTAGPGCR

SEQ ID NO: 194496 - protein, 13 aa, Mycobacterium bovis
LTTGGPGAAGGDA

SEQ ID NO: 194497 - protein, 15 aa, Mycobacterium bovis
LVDPPSSLDCRVPFP

SEQ ID NO: 194498 - protein, 9 aa, Mycobacterium bovis
MASTDAAAQ

SEQ ID NO: 194499 - protein, 7 aa, Mycobacterium bovis
MEAPDDM

SEQ ID NO: 194500 - protein, 14 aa, Mycobacterium bovis
MEGSPERHNFPQSQ

SEQ ID NO: 194501 - protein, 9 aa, Mycobacterium bovis
MGTQPHPVG

SEQ ID NO: 194502 - protein, 5 aa, Mycobacterium bovis
MHGPA

SEQ ID NO: 194503 - protein, 5 aa, Mycobacterium bovis
MKTGD

SEQ ID NO: 194504 - protein, 10 aa, Mycobacterium bovis
MNTTTPARTA

SEQ ID NO: 194505 - protein, 6 aa, Mycobacterium bovis
MPDSSS

SEQ ID NO: 194506 - protein, 9 aa, Mycobacterium bovis
MPRGGPDAS

SEQ ID NO: 194507 - protein, 6 aa, Mycobacterium bovis
MSAGLG

SEQ ID NO: 194508 - protein, 39 aa, Mycobacterium bovis
MTANSPAGSPFGAAPSAPSHSTTTSGPPTAPTPTSPFGT

SEQ ID NO: 194509 - protein, 7 aa, Mycobacterium bovis
MTINGDP

SEQ ID NO: 194510 - protein, 16 aa, Mycobacterium bovis
MTPPTPTPEAAHNPTM

SEQ ID NO: 194511 - protein, 14 aa, Mycobacterium bovis
MTSDPGVAQRATAR

SEQ ID NO: 194512 - protein, 10 aa, Mycobacterium bovis
NAAAAVPTTG

SEQ ID NO: 194513 - protein, 13 aa, Mycobacterium bovis
NAAHGAASSEITP

SEQ ID NO: 194514 - protein, 9 aa, Mycobacterium bovis
NADGSAAQM

SEQ ID NO: 194515 - protein, 6 aa, Mycobacterium bovis
NADGTT

SEQ ID NO: 194516 - protein, 14 aa, Mycobacterium bovis
NAKNRPGAGFVPVP

SEQ ID NO: 194517 - protein, 8 aa, Mycobacterium bovis
NASAQDQL

SEQ ID NO: 194518 - protein, 6 aa, Mycobacterium bovis
NASDAL

SEQ ID NO: 194519 - protein, 9 aa, Mycobacterium bovis
NASDNNAGD

SEQ ID NO: 194520 - protein, 6 aa, Mycobacterium bovis
NCETPA

SEQ ID NO: 194521 - protein, 6 aa, Mycobacterium bovis
NDGAVV

SEQ ID NO: 194522 - protein, 4 aa, Mycobacterium bovis
NEGL

SEQ ID NO: 194523 - protein, 63 aa, Mycobacterium bovis
NETTGRDGDGGDGGYGGWGGAGGNGGAGGSAPAGEVGNRGVGGDGGDGGSGGDAGNGGLGGDG

SEQ ID NO: 194524 - protein, 13 aa, Mycobacterium bovis
NFNQGIANTGNNN

SEQ ID NO: 194525 - protein, 8 aa, Mycobacterium bovis
NFPPKRHK

SEQ ID NO: 194526 - protein, 16 aa, Mycobacterium bovis
NGANGAPGSGAPGGHG

SEQ ID NO: 194527 - protein, 5 aa, Mycobacterium bovis
NGDVD

SEQ ID NO: 194528 - protein, 4 aa, Mycobacterium bovis
NGEG

SEQ ID NO: 194529 - protein, 6 aa, Mycobacterium bovis
NGFSNG

SEQ ID NO: 194530 - protein, 17 aa, Mycobacterium bovis
NGGAGGFGANGGTGGNG

SEQ ID NO: 194531 - protein, 49 aa, Mycobacterium bovis
NGGAGGSGAAGVNGGAGGNGGAGGLIGNGGAGGAGGRASTGTGGAGGAA

SEQ ID NO: 194532 - protein, 125 aa, Mycobacterium bovis
NGGAGGVGGTAGAGGTGGSGGAGGAGGAGGGGTNSGPGAAFGGNGNTGGNGGNGGAPGALGGKGGSGGLIGRAGSDGGVGAGGAGGAGGAGGTGGEGGTGGDGKTTDGNPGMGGSPGSAGQPGQP

SEQ ID NO: 194533 - protein, 28 aa, Mycobacterium bovis
NGGGAGGAGGSGVSGGAGGEGGAGGAGG

SEQ ID NO: 194534 - protein, 10 aa, Mycobacterium bovis
NGGHTWPGGR

SEQ ID NO: 194535 - protein, 10 aa, Mycobacterium bovis
NGHTYTTHPG

SEQ ID NO: 194536 - protein, 4 aa, Mycobacterium bovis
NGKV

SEQ ID NO: 194537 - protein, 20 aa, Mycobacterium bovis
NGNIGLNGATGGIGSTTLTN

SEQ ID NO: 194538 - protein, 5 aa, Mycobacterium bovis
NGPLQ

SEQ ID NO: 194539 - protein, 4 aa, Mycobacterium bovis
NGRP

SEQ ID NO: 194540 - protein, 5 aa, Mycobacterium bovis
NGSDM

SEQ ID NO: 194541 - protein, 10 aa, Mycobacterium bovis
NGSGNGEPTG

SEQ ID NO: 194542 - protein, 9 aa, Mycobacterium bovis
NGTANGKAA

SEQ ID NO: 194543 - protein, 4 aa, Mycobacterium bovis
NGTG

SEQ ID NO: 194544 - protein, 13 aa, Mycobacterium bovis
NGTTVAAASSIEA

SEQ ID NO: 194545 - protein, 4 aa, Mycobacterium bovis
NGYT

SEQ ID NO: 194546 - protein, 6 aa, Mycobacterium bovis
NHGGVQ

SEQ ID NO: 194547 - protein, 11 aa, Mycobacterium bovis
NHRGHGTELGQ

SEQ ID NO: 194548 - protein, 4 aa, Mycobacterium bovis
NIAS

SEQ ID NO: 194549 - protein, 7 aa, Mycobacterium bovis
NIEEGGS

SEQ ID NO: 194550 - protein, 6 aa, Mycobacterium bovis
NKEQGA

SEQ ID NO: 194551 - protein, 10 aa, Mycobacterium bovis
NLTEAERTGL

SEQ ID NO: 194552 - protein, 4 aa, Mycobacterium bovis
NNAA

SEQ ID NO: 194553 - protein, 10 aa, Mycobacterium bovis
NPAAEQPAAT

SEQ ID NO: 194554 - protein, 12 aa, Mycobacterium bovis
NPEPTPLSGSAT

SEQ ID NO: 194555 - protein, 5 aa, Mycobacterium bovis
NPSRP

SEQ ID NO: 194556 - protein, 13 aa, Mycobacterium bovis
NPWDDSAHPLTDD

SEQ ID NO: 194557 - protein, 9 aa, Mycobacterium bovis
NRASGAEIG

SEQ ID NO: 194558 - protein, 8 aa, Mycobacterium bovis
NRGTDALI

SEQ ID NO: 194559 - protein, 13 aa, Mycobacterium bovis
NRQPLRPAQPPDL

SEQ ID NO: 194560 - protein, 8 aa, Mycobacterium bovis
NRRPTGQR

SEQ ID NO: 194561 - protein, 46 aa, Mycobacterium bovis
NSAAQARKAVGTGVRKKTPEPDSAEAPAAAAAPEEQVQPQRRRRPK

SEQ ID NO: 194562 - protein, 5 aa, Mycobacterium bovis
NSGQA

SEQ ID NO: 194563 - protein, 12 aa, Mycobacterium bovis
NSGTAFSGAVQS

SEQ ID NO: 194564 - protein, 5 aa, Mycobacterium bovis
NSGTN

SEQ ID NO: 194565 - protein, 12 aa, Mycobacterium bovis
NSMTTNGVSHSR

SEQ ID NO: 194566 - protein, 12 aa, Mycobacterium bovis
NTGFGSAGNGNV

SEQ ID NO: 194567 - protein, 14 aa, Mycobacterium bovis
NTGNGNSGFSNAGP

SEQ ID NO: 194568 - protein, 5 aa, Mycobacterium bovis
NTLTG

SEQ ID NO: 194569 - protein, 7 aa, Mycobacterium bovis
NVDPASD

SEQ ID NO: 194570 - protein, 5 aa, Mycobacterium bovis
NYSGI

SEQ ID NO: 194571 - protein, 16 aa, Mycobacterium bovis
PAAATAAVTPPALNTG

SEQ ID NO: 194572 - protein, 22 aa, Mycobacterium bovis
PAAPTAPAAPAAPADKAAPGVL

SEQ ID NO: 194573 - protein, 10 aa, Mycobacterium bovis
PADRQRRQRR

SEQ ID NO: 194574 - protein, 7 aa, Mycobacterium bovis
PADTAAR

SEQ ID NO: 194575 - protein, 17 aa, Mycobacterium bovis
PAGADEVSAQAATAFTS

SEQ ID NO: 194576 - protein, 20 aa, Mycobacterium bovis
PAGPPRVGQPSWNPQRASSM

SEQ ID NO: 194577 - protein, 26 aa, Mycobacterium bovis
PAGQRRRLPGKPAIDDRALAGASRSA

SEQ ID NO: 194578 - protein, 8 aa, Mycobacterium bovis
PAGSGGSV

SEQ ID NO: 194579 - protein, 8 aa, Mycobacterium bovis
PANDPNTA

SEQ ID NO: 194580 - protein, 11 aa, Mycobacterium bovis
PAPDRLEHDAD

SEQ ID NO: 194581 - protein, 16 aa, Mycobacterium bovis
PAPFEEPLPPEATDQW

SEQ ID NO: 194582 - protein, 5 aa, Mycobacterium bovis
PASTN

SEQ ID NO: 194583 - protein, 7 aa, Mycobacterium bovis
PATAPGG

SEQ ID NO: 194584 - protein, 7 aa, Mycobacterium bovis
PATAQGI

SEQ ID NO: 194585 - protein, 9 aa, Mycobacterium bovis
PATGETVPR

SEQ ID NO: 194586 - protein, 4 aa, Mycobacterium bovis
PATI

SEQ ID NO: 194587 - protein, 7 aa, Mycobacterium bovis
PATLPAT

SEQ ID NO: 194588 - protein, 7 aa, Mycobacterium bovis
PATLPES

SEQ ID NO: 194589 - protein, 7 aa, Mycobacterium bovis
PATWTEP

SEQ ID NO: 194590 - protein, 4 aa, Mycobacterium bovis
PAVE

SEQ ID NO: 194591 - protein, 9 aa, Mycobacterium bovis
PAVGQDDRG

SEQ ID NO: 194592 - protein, 27 aa, Mycobacterium bovis
PCRGHGAAGRRTAPGAGLPRRAQRGVC

SEQ ID NO: 194593 - protein, 16 aa, Mycobacterium bovis
PDAASRGVVDAPEDAL

SEQ ID NO: 194594 - protein, 7 aa, Mycobacterium bovis
PDAPTGC

SEQ ID NO: 194595 - protein, 5 aa, Mycobacterium bovis
PDAVE

SEQ ID NO: 194596 - protein, 5 aa, Mycobacterium bovis
PDAVG

SEQ ID NO: 194597 - protein, 5 aa, Mycobacterium bovis
PDGKE

SEQ ID NO: 194598 - protein, 7 aa, Mycobacterium bovis
PDPQYAP

SEQ ID NO: 194599 - protein, 5 aa, Mycobacterium bovis
PDPTE

SEQ ID NO: 194600 - protein, 6 aa, Mycobacterium bovis
PDRQRH

SEQ ID NO: 194601 - protein, 5 aa, Mycobacterium bovis
PDRSA

SEQ ID NO: 194602 - protein, 4 aa, Mycobacterium bovis
PDRV

SEQ ID NO: 194603 - protein, 8 aa, Mycobacterium bovis
PDSPPTDE

SEQ ID NO: 194604 - protein, 10 aa, Mycobacterium bovis
PEAAAGPHDA

SEQ ID NO: 194605 - protein, 4 aa, Mycobacterium bovis
PEAE

SEQ ID NO: 194606 - protein, 5 aa, Mycobacterium bovis
PEDEQ

SEQ ID NO: 194607 - protein, 4 aa, Mycobacterium bovis
PEDR

SEQ ID NO: 194608 - protein, 5 aa, Mycobacterium bovis
PEESQ

SEQ ID NO: 194609 - protein, 10 aa, Mycobacterium bovis
PEGACPGPFG

SEQ ID NO: 194610 - protein, 8 aa, Mycobacterium bovis
PEHGSAST

SEQ ID NO: 194611 - protein, 5 aa, Mycobacterium bovis
PEMPE

SEQ ID NO: 194612 - protein, 4 aa, Mycobacterium bovis
PEPG

SEQ ID NO: 194613 - protein, 7 aa, Mycobacterium bovis
PEPQPVN

SEQ ID NO: 194614 - protein, 7 aa, Mycobacterium bovis
PEPQPYP

SEQ ID NO: 194615 - protein, 4 aa, Mycobacterium bovis
PEPW

SEQ ID NO: 194616 - protein, 19 aa, Mycobacterium bovis
PEQQAENLTTGISAGTGNR

SEQ ID NO: 194617 - protein, 24 aa, Mycobacterium bovis
PERAPAARSLDAASTSRPCGPGWT

SEQ ID NO: 194618 - protein, 5 aa, Mycobacterium bovis
PERID

SEQ ID NO: 194619 - protein, 5 aa, Mycobacterium bovis
PESQL

SEQ ID NO: 194620 - protein, 7 aa, Mycobacterium bovis
PETGERT

SEQ ID NO: 194621 - protein, 12 aa, Mycobacterium bovis
PEVAANRAGRQA

SEQ ID NO: 194622 - protein, 36 aa, Mycobacterium bovis
PFSSPQQTTNPAGLAAQNAAVTQAATNSAGNTPTAL

SEQ ID NO: 194623 - protein, 19 aa, Mycobacterium bovis
PGAPTGGDDGDAPPGNSLR

SEQ ID NO: 194624 - protein, 5 aa, Mycobacterium bovis
PGATQ

SEQ ID NO: 194625 - protein, 45 aa, Mycobacterium bovis
PGEDGGNGGAGGAGGAGGAHAGDGGAGGAGGNGGAGGAGGNGAHG

SEQ ID NO: 194626 - protein, 10 aa, Mycobacterium bovis
PGETRRDPIQ

SEQ ID NO: 194627 - protein, 4 aa, Mycobacterium bovis
PGFG

SEQ ID NO: 194628 - protein, 11 aa, Mycobacterium bovis
PGPEDGSVPVP

SEQ ID NO: 194629 - protein, 4 aa, Mycobacterium bovis
PGPF

SEQ ID NO: 194630 - protein, 14 aa, Mycobacterium bovis
PGPNGPEPDPRTAP

SEQ ID NO: 194631 - protein, 9 aa, Mycobacterium bovis
PGPSFPSYG

SEQ ID NO: 194632 - protein, 14 aa, Mycobacterium bovis
PGRPPAAKADETRK

SEQ ID NO: 194633 - protein, 7 aa, Mycobacterium bovis
PGSHQDN

SEQ ID NO: 194634 - protein, 10 aa, Mycobacterium bovis
PGSSPRPYGG

SEQ ID NO: 194635 - protein, 9 aa, Mycobacterium bovis
PGTGSDNDY

SEQ ID NO: 194636 - protein, 10 aa, Mycobacterium bovis
PGVESNDGDA

SEQ ID NO: 194637 - protein, 7 aa, Mycobacterium bovis
PHAPADR

SEQ ID NO: 194638 - protein, 9 aa, Mycobacterium bovis
PHPAPPRLR

SEQ ID NO: 194639 - protein, 19 aa, Mycobacterium bovis
PHTDEGGERRNVPVSVVAA

SEQ ID NO: 194640 - protein, 4 aa, Mycobacterium bovis
PHTP

SEQ ID NO: 194641 - protein, 17 aa, Mycobacterium bovis
PIAPSLPTPVPHNEKPQ

SEQ ID NO: 194642 - protein, 9 aa, Mycobacterium bovis
PKPQNYPGL

SEQ ID NO: 194643 - protein, 5 aa, Mycobacterium bovis
PLGPD

SEQ ID NO: 194644 - protein, 7 aa, Mycobacterium bovis
PLPPTGP

SEQ ID NO: 194645 - protein, 4 aa, Mycobacterium bovis
PLSD

SEQ ID NO: 194646 - protein, 17 aa, Mycobacterium bovis
PLTDDQRTQVEEVTNEA

SEQ ID NO: 194647 - protein, 6 aa, Mycobacterium bovis
PNAAPH

SEQ ID NO: 194648 - protein, 9 aa, Mycobacterium bovis
PNNGFPGTS

SEQ ID NO: 194649 - protein, 10 aa, Mycobacterium bovis
PNNPTSTVVG

SEQ ID NO: 194650 - protein, 17 aa, Mycobacterium bovis
PPAVTEPPQPIPFSGPA

SEQ ID NO: 194651 - protein, 6 aa, Mycobacterium bovis
PPEINS

SEQ ID NO: 194652 - protein, 6 aa, Mycobacterium bovis
PPGAMP

SEQ ID NO: 194653 - protein, 5 aa, Mycobacterium bovis
PPKTD

SEQ ID NO: 194654 - protein, 6 aa, Mycobacterium bovis
PPLGQQ

SEQ ID NO: 194655 - protein, 8 aa, Mycobacterium bovis
PPNESRLR

SEQ ID NO: 194656 - protein, 7 aa, Mycobacterium bovis
PPPDEPN

SEQ ID NO: 194657 - protein, 4 aa, Mycobacterium bovis
PPPF

SEQ ID NO: 194658 - protein, 4 aa, Mycobacterium bovis
PPRL

SEQ ID NO: 194659 - protein, 14 aa, Mycobacterium bovis
PPSAIEANPRQPRQ

SEQ ID NO: 194660 - protein, 16 aa, Mycobacterium bovis
PPSRTKRARSRIRPPE

SEQ ID NO: 194661 - protein, 14 aa, Mycobacterium bovis
PPTEGKSTTNRDEG

SEQ ID NO: 194662 - protein, 12 aa, Mycobacterium bovis
PPTGHPLIPLGQ

SEQ ID NO: 194663 - protein, 4 aa, Mycobacterium bovis
PPTW

SEQ ID NO: 194664 - protein, 6 aa, Mycobacterium bovis
PPVATP

SEQ ID NO: 194665 - protein, 4 aa, Mycobacterium bovis
PQPG

SEQ ID NO: 194666 - protein, 5 aa, Mycobacterium bovis
PQRFR

SEQ ID NO: 194667 - protein, 9 aa, Mycobacterium bovis
PQRTGDPLQ

SEQ ID NO: 194668 - protein, 4 aa, Mycobacterium bovis
PQSV

SEQ ID NO: 194669 - protein, 5 aa, Mycobacterium bovis
PQTRV

SEQ ID NO: 194670 - protein, 7 aa, Mycobacterium bovis
PQVETDS

SEQ ID NO: 194671 - protein, 22 aa, Mycobacterium bovis
PQYSNPEPAGTATITGYRADND

SEQ ID NO: 194672 - protein, 5 aa, Mycobacterium bovis
PRGGV

SEQ ID NO: 194673 - protein, 6 aa, Mycobacterium bovis
PRNQAP

SEQ ID NO: 194674 - protein, 8 aa, Mycobacterium bovis
PRQEDADA

SEQ ID NO: 194675 - protein, 6 aa, Mycobacterium bovis
PRSPAD

SEQ ID NO: 194676 - protein, 4 aa, Mycobacterium bovis
PRSV

SEQ ID NO: 194677 - protein, 12 aa, Mycobacterium bovis
PRTTISPGTPTK

SEQ ID NO: 194678 - protein, 13 aa, Mycobacterium bovis
PSAAAQLADTTDQ

SEQ ID NO: 194679 - protein, 13 aa, Mycobacterium bovis
PSAIEANPRQPRQ

SEQ ID NO: 194680 - protein, 4 aa, Mycobacterium bovis
PSAL

SEQ ID NO: 194681 - protein, 5 aa, Mycobacterium bovis
PSGDD

SEQ ID NO: 194682 - protein, 10 aa, Mycobacterium bovis
PSGRALESRP

SEQ ID NO: 194683 - protein, 9 aa, Mycobacterium bovis
PSNAERGTK

SEQ ID NO: 194684 - protein, 10 aa, Mycobacterium bovis
PSPLSSGSAK

SEQ ID NO: 194685 - protein, 10 aa, Mycobacterium bovis
PSTDSIEPVQ

SEQ ID NO: 194686 - protein, 14 aa, Mycobacterium bovis
PSWATPSSTPVSAL

SEQ ID NO: 194687 - protein, 14 aa, Mycobacterium bovis
PTADGPLPKSRSPV

SEQ ID NO: 194688 - protein, 5 aa, Mycobacterium bovis
PTGRR

SEQ ID NO: 194689 - protein, 9 aa, Mycobacterium bovis
PTGSIKDRP

SEQ ID NO: 194690 - protein, 14 aa, Mycobacterium bovis
PTPGIGNTTTVPSS

SEQ ID NO: 194691 - protein, 4 aa, Mycobacterium bovis
PTRD

SEQ ID NO: 194692 - protein, 4 aa, Mycobacterium bovis
PTRG

SEQ ID NO: 194693 - protein, 7 aa, Mycobacterium bovis
PTSWEQA

SEQ ID NO: 194694 - protein, 5 aa, Mycobacterium bovis
PVTEK

SEQ ID NO: 194695 - protein, 19 aa, Mycobacterium bovis
PVTGQKLPGYETTWRVAVG

SEQ ID NO: 194696 - protein, 5 aa, Mycobacterium bovis
PWTTT

SEQ ID NO: 194697 - protein, 10 aa, Mycobacterium bovis
QAAVAQTGLT

SEQ ID NO: 194698 - protein, 9 aa, Mycobacterium bovis
QADAQSGKV

SEQ ID NO: 194699 - protein, 11 aa, Mycobacterium bovis
QADTAAARQAA

SEQ ID NO: 194700 - protein, 8 aa, Mycobacterium bovis
QAETSNGA

SEQ ID NO: 194701 - protein, 8 aa, Mycobacterium bovis
QAGSQYFP

SEQ ID NO: 194702 - protein, 5 aa, Mycobacterium bovis
QANPR

SEQ ID NO: 194703 - protein, 8 aa, Mycobacterium bovis
QAPDAPDW

SEQ ID NO: 194704 - protein, 5 aa, Mycobacterium bovis
QARPV

SEQ ID NO: 194705 - protein, 9 aa, Mycobacterium bovis
QARQQDQER

SEQ ID NO: 194706 - protein, 9 aa, Mycobacterium bovis
QASRDVSAA

SEQ ID NO: 194707 - protein, 11 aa, Mycobacterium bovis
QAYQAASAQAA

SEQ ID NO: 194708 - protein, 23 aa, Mycobacterium bovis
QDKGYAVPDYPADPNTDQEKAIK

SEQ ID NO: 194709 - protein, 13 aa, Mycobacterium bovis
QDLTRHTDTPSTI

SEQ ID NO: 194710 - protein, 4 aa, Mycobacterium bovis
QDPL

SEQ ID NO: 194711 - protein, 10 aa, Mycobacterium bovis
QDRPEGSRAT

SEQ ID NO: 194712 - protein, 7 aa, Mycobacterium bovis
QDRTGGF

SEQ ID NO: 194713 - protein, 114 aa, Mycobacterium bovis
QDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGRD

SEQ ID NO: 194714 - protein, 5 aa, Mycobacterium bovis
QEAGQ

SEQ ID NO: 194715 - protein, 8 aa, Mycobacterium bovis
QEGVSASA

SEQ ID NO: 194716 - protein, 4 aa, Mycobacterium bovis
QEPD

SEQ ID NO: 194717 - protein, 223 aa, Mycobacterium bovis
QGAGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGNGGAGGAGGTLAGHGGNGGKGVNGGQGGIGGAGERGADGAGPNANGANGENGGSGGNGGDGGAGGNGGAGGKAQAAGYTDGATGTGGDGGNGGDGGKAGDGGAGANGLNS

SEQ ID NO: 194718 - protein, 6 aa, Mycobacterium bovis
QGESMD

SEQ ID NO: 194719 - protein, 11 aa, Mycobacterium bovis
QGHPQRKDYPL

SEQ ID NO: 194720 - protein, 4 aa, Mycobacterium bovis
QGRG

SEQ ID NO: 194721 - protein, 9 aa, Mycobacterium bovis
QGRTTGNSC

SEQ ID NO: 194722 - protein, 13 aa, Mycobacterium bovis
QGSQLAQRECPRP

SEQ ID NO: 194723 - protein, 23 aa, Mycobacterium bovis
QHAPPQQVRQRTGIGQVGSDVDP

SEQ ID NO: 194724 - protein, 8 aa, Mycobacterium bovis
QHRAATSI

SEQ ID NO: 194725 - protein, 4 aa, Mycobacterium bovis
QKAN

SEQ ID NO: 194726 - protein, 14 aa, Mycobacterium bovis
QKYDPSRVMFSGLN

SEQ ID NO: 194727 - protein, 7 aa, Mycobacterium bovis
QLAGPTV

SEQ ID NO: 194728 - protein, 20 aa, Mycobacterium bovis
QLATGSWQGPASAAMTGAAA

SEQ ID NO: 194729 - protein, 18 aa, Mycobacterium bovis
QLDSTGPGQAYQPGDTVL

SEQ ID NO: 194730 - protein, 6 aa, Mycobacterium bovis
QLVETG

SEQ ID NO: 194731 - protein, 9 aa, Mycobacterium bovis
QNASPIAQT

SEQ ID NO: 194732 - protein, 15 aa, Mycobacterium bovis
QNDPRSTYKFGPEDY

SEQ ID NO: 194733 - protein, 27 aa, Mycobacterium bovis
QNLGAGPQREHRHRQGRRHGAQSQSGV

SEQ ID NO: 194734 - protein, 8 aa, Mycobacterium bovis
QPDADGVL

SEQ ID NO: 194735 - protein, 4 aa, Mycobacterium bovis
QPGV

SEQ ID NO: 194736 - protein, 13 aa, Mycobacterium bovis
QPPAPIAVSGTDS

SEQ ID NO: 194737 - protein, 6 aa, Mycobacterium bovis
QPPARY

SEQ ID NO: 194738 - protein, 4 aa, Mycobacterium bovis
QPRL

SEQ ID NO: 194739 - protein, 10 aa, Mycobacterium bovis
QPTAANDPIY

SEQ ID NO: 194740 - protein, 11 aa, Mycobacterium bovis
QQGNPPDAPQL

SEQ ID NO: 194741 - protein, 112 aa, Mycobacterium bovis
QRLPAEGPAVKRGVGASAAKKVAKKAPAKKATKAAKKAATKAPAKKAATKAPAKKAVKATKSPAKKVTKAVKKTAVKASVRKAATKAPAKKAAAKRPATKAPAKKATARRGR

SEQ ID NO: 194742 - protein, 121 aa, Mycobacterium bovis
QRLPAEGPAVKRGVGASAAKKVAKKAPAKKATKAAKKAATKAPARKAATKAPAKKAATKAPAKKAVKATKSPAKKVTKAVKKTAVKASVRKAATKAPAKKAAAKRPATKAPAKKATARRGR

SEQ ID NO: 194743 - protein, 19 aa, Mycobacterium bovis
QRNSKTAGASVGDLATDPD

SEQ ID NO: 194744 - protein, 9 aa, Mycobacterium bovis
QRPASPRLR

SEQ ID NO: 194745 - protein, 9 aa, Mycobacterium bovis
QRPDYSETD

SEQ ID NO: 194746 - protein, 6 aa, Mycobacterium bovis
QRPTPP

SEQ ID NO: 194747 - protein, 17 aa, Mycobacterium bovis
QRQPDHVDGSRDAGLGR

SEQ ID NO: 194748 - protein, 7 aa, Mycobacterium bovis
QRRPVSV

SEQ ID NO: 194749 - protein, 12 aa, Mycobacterium bovis
QRRQDEAMRPRT

SEQ ID NO: 194750 - protein, 20 aa, Mycobacterium bovis
QRRRPREPREQDAESHDLSS

SEQ ID NO: 194751 - protein, 6 aa, Mycobacterium bovis
QRSSIG

SEQ ID NO: 194752 - protein, 6 aa, Mycobacterium bovis
QSAAAE

SEQ ID NO: 194753 - protein, 7 aa, Mycobacterium bovis
QSAETTR

SEQ ID NO: 194754 - protein, 7 aa, Mycobacterium bovis
QSSNGPL

SEQ ID NO: 194755 - protein, 8 aa, Mycobacterium bovis
QTAELYPG

SEQ ID NO: 194756 - protein, 4 aa, Mycobacterium bovis
QTAL

SEQ ID NO: 194757 - protein, 4 aa, Mycobacterium bovis
QTDK

SEQ ID NO: 194758 - protein, 5 aa, Mycobacterium bovis
QTGEP

SEQ ID NO: 194759 - protein, 9 aa, Mycobacterium bovis
QTSDEVTVE

SEQ ID NO: 194760 - protein, 7 aa, Mycobacterium bovis
QTSESLA

SEQ ID NO: 194761 - protein, 6 aa, Mycobacterium bovis
QTSKTS

SEQ ID NO: 194762 - protein, 16 aa, Mycobacterium bovis
QVGNRALGDRPSQYLT

SEQ ID NO: 194763 - protein, 7 aa, Mycobacterium bovis
QVNPSGR

SEQ ID NO: 194764 - protein, 6 aa, Mycobacterium bovis
QVSGIA

SEQ ID NO: 194765 - protein, 5 aa, Mycobacterium bovis
QYDDY

SEQ ID NO: 194766 - protein, 12 aa, Mycobacterium bovis
QYEHGRDTAPVV

SEQ ID NO: 194767 - protein, 17 aa, Mycobacterium bovis
RAAASGLYRGQQRRRRP

SEQ ID NO: 194768 - protein, 18 aa, Mycobacterium bovis
RAAGAKAGISVKPGTPLE

SEQ ID NO: 194769 - protein, 9 aa, Mycobacterium bovis
RAATTAPAG

SEQ ID NO: 194770 - protein, 15 aa, Mycobacterium bovis
RAEQRRRGREAEEEL

SEQ ID NO: 194771 - protein, 10 aa, Mycobacterium bovis
RAGAEALRQG

SEQ ID NO: 194772 - protein, 7 aa, Mycobacterium bovis
RAGDGVR

SEQ ID NO: 194773 - protein, 4 aa, Mycobacterium bovis
RAGR

SEQ ID NO: 194774 - protein, 32 aa, Mycobacterium bovis
RAGTAGGAGGGPAGGIGGAGGVGGAGGAAGAV

SEQ ID NO: 194775 - protein, 33 aa, Mycobacterium bovis
RAGTAGGAGGGPAGGIGGAGGVGGAGGAAGAVT

SEQ ID NO: 194776 - protein, 32 aa, Mycobacterium bovis
RAGTAGGAGGGPAGGIGGTGGVGGAGGAAGAV

SEQ ID NO: 194777 - protein, 33 aa, Mycobacterium bovis
RAGTAGGAGRGPVGGIGGAGGVGGAGGAAGAVT

SEQ ID NO: 194778 - protein, 6 aa, Mycobacterium bovis
RAMTAR

SEQ ID NO: 194779 - protein, 18 aa, Mycobacterium bovis
RANGGSGSAANASREEQI

SEQ ID NO: 194780 - protein, 6 aa, Mycobacterium bovis
RAPGPS

SEQ ID NO: 194781 - protein, 9 aa, Mycobacterium bovis
RARDRGKPV

SEQ ID NO: 194782 - protein, 20 aa, Mycobacterium bovis
RARGGAHGAASDGMAHRIRF

SEQ ID NO: 194783 - protein, 17 aa, Mycobacterium bovis
RARPRGSSAAHPSPHRR

SEQ ID NO: 194784 - protein, 9 aa, Mycobacterium bovis
RARSDATAV

SEQ ID NO: 194785 - protein, 10 aa, Mycobacterium bovis
RASDRYNQEG

SEQ ID NO: 194786 - protein, 4 aa, Mycobacterium bovis
RAST

SEQ ID NO: 194787 - protein, 10 aa, Mycobacterium bovis
RATGAAEAIE

SEQ ID NO: 194788 - protein, 8 aa, Mycobacterium bovis
RATSTRFG

SEQ ID NO: 194789 - protein, 28 aa, Mycobacterium bovis
RCPPEGPSKGSSGGSSQGPPDGAAAGFG

SEQ ID NO: 194790 - protein, 6 aa, Mycobacterium bovis
RDAGLP

SEQ ID NO: 194791 - protein, 8 aa, Mycobacterium bovis
RDEAPADL

SEQ ID NO: 194792 - protein, 13 aa, Mycobacterium bovis
RDESDRHGDGPLD

SEQ ID NO: 194793 - protein, 6 aa, Mycobacterium bovis
RDGCPS

SEQ ID NO: 194794 - protein, 9 aa, Mycobacterium bovis
RDGQNRSSI

SEQ ID NO: 194795 - protein, 12 aa, Mycobacterium bovis
RDGRHDNKAPLT

SEQ ID NO: 194796 - protein, 4 aa, Mycobacterium bovis
RDNG

SEQ ID NO: 194797 - protein, 5 aa, Mycobacterium bovis
RDPNA

SEQ ID NO: 194798 - protein, 12 aa, Mycobacterium bovis
RDPTPPGGPHGI

SEQ ID NO: 194799 - protein, 28 aa, Mycobacterium bovis
RDQHPGPAHQRPSPPSRPRTAGNPWLAR

SEQ ID NO: 194800 - protein, 6 aa, Mycobacterium bovis
RDRREG

SEQ ID NO: 194801 - protein, 5 aa, Mycobacterium bovis
RDRRW

SEQ ID NO: 194802 - protein, 4 aa, Mycobacterium bovis
RDSD

SEQ ID NO: 194803 - protein, 6 aa, Mycobacterium bovis
RDTEDL

SEQ ID NO: 194804 - protein, 12 aa, Mycobacterium bovis
REAAGPGHRRRR

SEQ ID NO: 194805 - protein, 9 aa, Mycobacterium bovis
REAEDQGQG

SEQ ID NO: 194806 - protein, 5 aa, Mycobacterium bovis
REAEE

SEQ ID NO: 194807 - protein, 5 aa, Mycobacterium bovis
REEEA

SEQ ID NO: 194808 - protein, 7 aa, Mycobacterium bovis
RELRNNT

SEQ ID NO: 194809 - protein, 19 aa, Mycobacterium bovis
RESASQALPGLLERLPALL

SEQ ID NO: 194810 - protein, 4 aa, Mycobacterium bovis
RFNA

SEQ ID NO: 194811 - protein, 5 aa, Mycobacterium bovis
RFPPE

SEQ ID NO: 194812 - protein, 11 aa, Mycobacterium bovis
RGDPNGAAAGD

SEQ ID NO: 194813 - protein, 4 aa, Mycobacterium bovis
RGDR

SEQ ID NO: 194814 - protein, 9 aa, Mycobacterium bovis
RGEQPGPME

SEQ ID NO: 194815 - protein, 10 aa, Mycobacterium bovis
RGERSMKSPG

SEQ ID NO: 194816 - protein, 7 aa, Mycobacterium bovis
RGGVRGY

SEQ ID NO: 194817 - protein, 6 aa, Mycobacterium bovis
RGHNGE

SEQ ID NO: 194818 - protein, 8 aa, Mycobacterium bovis
RGHRGDRL

SEQ ID NO: 194819 - protein, 19 aa, Mycobacterium bovis
RGKQARDKRQDMARRDAQR

SEQ ID NO: 194820 - protein, 6 aa, Mycobacterium bovis
RGVKQE

SEQ ID NO: 194821 - protein, 6 aa, Mycobacterium bovis
RGYGYG

SEQ ID NO: 194822 - protein, 7 aa, Mycobacterium bovis
RHPGTSQ

SEQ ID NO: 194823 - protein, 10 aa, Mycobacterium bovis
RHPPTRQDEA

SEQ ID NO: 194824 - protein, 6 aa, Mycobacterium bovis
RKDGVE

SEQ ID NO: 194825 - protein, 7 aa, Mycobacterium bovis
RKKSDHL

SEQ ID NO: 194826 - protein, 7 aa, Mycobacterium bovis
RKPDGRV

SEQ ID NO: 194827 - protein, 6 aa, Mycobacterium bovis
RKPPIE

SEQ ID NO: 194828 - protein, 7 aa, Mycobacterium bovis
RKRQGAD

SEQ ID NO: 194829 - protein, 31 aa, Mycobacterium bovis; identical to SEQ ID NO: 155393

SEQ ID NO: 194830 - protein, 7 aa, Mycobacterium bovis
RLATSST

SEQ ID NO: 194831 - protein, 15 aa, Mycobacterium bovis
RLDKPGGGLSGGQQQ

SEQ ID NO: 194832 - protein, 16 aa, Mycobacterium bovis
RLESKKISKTQAVTSN

SEQ ID NO: 194833 - protein, 13 aa, Mycobacterium bovis
RLGGSDEADHDRV

SEQ ID NO: 194834 - protein, 5 aa, Mycobacterium bovis
RLRPP

SEQ ID NO: 194835 - protein, 7 aa, Mycobacterium bovis
RLSDSPF

SEQ ID NO: 194836 - protein, 9 aa, Mycobacterium bovis
RLSPASRHI

SEQ ID NO: 194837 - protein, 9 aa, Mycobacterium bovis
RLTGGDTIR

SEQ ID NO: 194838 - protein, 8 aa, Mycobacterium bovis
RMRPPRPA

SEQ ID NO: 194839 - protein, 6 aa, Mycobacterium bovis
RNHPGH

SEQ ID NO: 194840 - protein, 7 aa, Mycobacterium bovis
RNTPGVT

SEQ ID NO: 194841 - protein, 8 aa, Mycobacterium bovis
RNTSTGTT

SEQ ID NO: 194842 - protein, 10 aa, Mycobacterium bovis
RPAATPPGPL

SEQ ID NO: 194843 - protein, 10 aa, Mycobacterium bovis
RPDRDPRSCS

SEQ ID NO: 194844 - protein, 4 aa, Mycobacterium bovis
RPGR

SEQ ID NO: 194845 - protein, 9 aa, Mycobacterium bovis
RPGSGREAT

SEQ ID NO: 194846 - protein, 7 aa, Mycobacterium bovis
RPGTYNE

SEQ ID NO: 194847 - protein, 10 aa, Mycobacterium bovis
RPKTPPPADA

SEQ ID NO: 194848 - protein, 19 aa, Mycobacterium bovis
RPKTPRGDGNADGGQVGAG

SEQ ID NO: 194849 - protein, 9 aa, Mycobacterium bovis
RPRRGRPRA

SEQ ID NO: 194850 - protein, 8 aa, Mycobacterium bovis
RPSHGGYG

SEQ ID NO: 194851 - protein, 5 aa, Mycobacterium bovis
RPSVL

SEQ ID NO: 194852 - protein, 18 aa, Mycobacterium bovis
RPTAPSPSHTNTLGTAPN

SEQ ID NO: 194853 - protein, 7 aa, Mycobacterium bovis
RPTPGRA

SEQ ID NO: 194854 - protein, 4 aa, Mycobacterium bovis
RQAD

SEQ ID NO: 194855 - protein, 6 aa, Mycobacterium bovis
RQAGPI

SEQ ID NO: 194856 - protein, 10 aa, Mycobacterium bovis
RQLPGEGVTR

SEQ ID NO: 194857 - protein, 9 aa, Mycobacterium bovis
RQQDGRSIQ

SEQ ID NO: 194858 - protein, 17 aa, Mycobacterium bovis
RQRRAARQKAERGHPNW

SEQ ID NO: 194859 - protein, 5 aa, Mycobacterium bovis
RRADD

SEQ ID NO: 194860 - protein, 4 aa, Mycobacterium bovis
RRCA

SEQ ID NO: 194861 - protein, 26 aa, Mycobacterium bovis
RRCSATEDRAPATVATPSSADPTASR

SEQ ID NO: 194862 - protein, 4 aa, Mycobacterium bovis
RRDL

SEQ ID NO: 194863 - protein, 5 aa, Mycobacterium bovis
RREPY

SEQ ID NO: 194864 - protein, 9 aa, Mycobacterium bovis
RRGARFSTA

SEQ ID NO: 194865 - protein, 21 aa, Mycobacterium bovis
RRGRPGTPKQRPPTPGPILPT

SEQ ID NO: 194866 - protein, 14 aa, Mycobacterium bovis
RRGSTATSSSETIT

SEQ ID NO: 194867 - protein, 14 aa, Mycobacterium bovis
RRLTEANDSPAGEA

SEQ ID NO: 194868 - protein, 8 aa, Mycobacterium bovis
RRNPRGSY

SEQ ID NO: 194869 - protein, 9 aa, Mycobacterium bovis
RRPAEATGA

SEQ ID NO: 194870 - protein, 6 aa, Mycobacterium bovis
RRSASV

SEQ ID NO: 194871 - protein, 12 aa, Mycobacterium bovis
RRSVAPASGAVP

SEQ ID NO: 194872 - protein, 4 aa, Mycobacterium bovis
RRTL

SEQ ID NO: 194873 - protein, 20 aa, Mycobacterium bovis
RRVPRQRRQRINRQAPPRLR

SEQ ID NO: 194874 - protein, 5 aa, Mycobacterium bovis
RSDDG

SEQ ID NO: 194875 - protein, 12 aa, Mycobacterium bovis
RSDGERSRRPRE

SEQ ID NO: 194876 - protein, 11 aa, Mycobacterium bovis
RSDTGRGSRYD

SEQ ID NO: 194877 - protein, 9 aa, Mycobacterium bovis
RSGQASTIE

SEQ ID NO: 194878 - protein, 7 aa, Mycobacterium bovis
RSHDGQL

SEQ ID NO: 194879 - protein, 17 aa, Mycobacterium bovis
RSIRPSASSGSGKAKTV

SEQ ID NO: 194880 - protein, 5 aa, Mycobacterium bovis
RSLNA

SEQ ID NO: 194881 - protein, 5 aa, Mycobacterium bovis
RSLPE

SEQ ID NO: 194882 - protein, 5 aa, Mycobacterium bovis
RSQDP

SEQ ID NO: 194883 - protein, 8 aa, Mycobacterium bovis
RSQGNESA

SEQ ID NO: 194884 - protein, 8 aa, Mycobacterium bovis
RSRGGAHS

SEQ ID NO: 194885 - protein, 9 aa, Mycobacterium bovis
RSRKVAEGR

SEQ ID NO: 194886 - protein, 5 aa, Mycobacterium bovis
RSSDT

SEQ ID NO: 194887 - protein, 4 aa, Mycobacterium bovis
RSSM

SEQ ID NO: 194888 - protein, 12 aa, Mycobacterium bovis
RSTAEAWLSLLD

SEQ ID NO: 194889 - protein, 16 aa, Mycobacterium bovis
RSTSEQVHADLGVTPL

SEQ ID NO: 194890 - protein, 9 aa, Mycobacterium bovis
RSWRNTEPA

SEQ ID NO: 194891 - protein, 26 aa, Mycobacterium bovis
RTARPASAPPAVTEATAGTAVTVGTA

SEQ ID NO: 194892 - protein, 6 aa, Mycobacterium bovis
RTEADV

SEQ ID NO: 194893 - protein, 10 aa, Mycobacterium bovis
RTGPPQSTSW

SEQ ID NO: 194894 - protein, 9 aa, Mycobacterium bovis
RTGSGRCNR

SEQ ID NO: 194895 - protein, 6 aa, Mycobacterium bovis
RTKNNP

SEQ ID NO: 194896 - protein, 16 aa, Mycobacterium bovis
RTPKALPDGVSQATVG

SEQ ID NO: 194897 - protein, 5 aa, Mycobacterium bovis
RTPST

SEQ ID NO: 194898 - protein, 5 aa, Mycobacterium bovis
RTRAA

SEQ ID NO: 194899 - protein, 5 aa, Mycobacterium bovis
RTRYP

SEQ ID NO: 194900 - protein, 10 aa, Mycobacterium bovis
RVCTSSGSPM

SEQ ID NO: 194901 - protein, 13 aa, Mycobacterium bovis
RVDSDLDAQSPAA

SEQ ID NO: 194902 - protein, 6 aa, Mycobacterium bovis
RVPDGE

SEQ ID NO: 194903 - protein, 7 aa, Mycobacterium bovis
RVPGDDT

SEQ ID NO: 194904 - protein, 10 aa, Mycobacterium bovis
RWAPPYAEAG

SEQ ID NO: 194905 - protein, 14 aa, Mycobacterium bovis
RYAAATSQTKGLTF

SEQ ID NO: 194906 - protein, 15 aa, Mycobacterium bovis
RYAPPPPYPAPDPFE

SEQ ID NO: 194907 - protein, 5 aa, Mycobacterium bovis
RYEGD

SEQ ID NO: 194908 - protein, 21 aa, Mycobacterium bovis
SAAASRHRKPTHPTTIATSAQ

SEQ ID NO: 194909 - protein, 6 aa, Mycobacterium bovis
SAADHD

SEQ ID NO: 194910 - protein, 15 aa, Mycobacterium bovis
SAAEPGAAGRHASDR

SEQ ID NO: 194911 - protein, 6 aa, Mycobacterium bovis
SAAHSR

SEQ ID NO: 194912 - protein, 7 aa, Mycobacterium bovis
SADGGVP

SEQ ID NO: 194913 - protein, 5 aa, Mycobacterium bovis
SADGL

SEQ ID NO: 194914 - protein, 6 aa, Mycobacterium bovis
SADGYR

SEQ ID NO: 194915 - protein, 4 aa, Mycobacterium bovis
SAER

SEQ ID NO: 194916 - protein, 4 aa, Mycobacterium bovis
SAGD

SEQ ID NO: 194917 - protein, 18 aa, Mycobacterium bovis
SAGLRAAAAGSFEQASDH

SEQ ID NO: 194918 - protein, 11 aa, Mycobacterium bovis
SAGRAGSIGPM

SEQ ID NO: 194919 - protein, 5 aa, Mycobacterium bovis
SAIPA

SEQ ID NO: 194920 - protein, 25 aa, Mycobacterium bovis
SALDAQPDPHLSGDEPPSRPLTPET

SEQ ID NO: 194921 - protein, 4 aa, Mycobacterium bovis
SAMS

SEQ ID NO: 194922 - protein, 8 aa, Mycobacterium bovis
SANIGSSN

SEQ ID NO: 194923 - protein, 8 aa, Mycobacterium bovis
SANRDPSV

SEQ ID NO: 194924 - protein, 13 aa, Mycobacterium bovis
SAPLDSQAAAQVA

SEQ ID NO: 194925 - protein, 6 aa, Mycobacterium bovis
SAPPGY

SEQ ID NO: 194926 - protein, 8 aa, Mycobacterium bovis
SAPSASVD

SEQ ID NO: 194927 - protein, 5 aa, Mycobacterium bovis
SAPTF

SEQ ID NO: 194928 - protein, 26 aa, Mycobacterium bovis
SAQPSASPPAPTGGSNESTTQPAASW

SEQ ID NO: 194929 - protein, 4 aa, Mycobacterium bovis
SARN

SEQ ID NO: 194930 - protein, 6 aa, Mycobacterium bovis
SARRGT

SEQ ID NO: 194931 - protein, 7 aa, Mycobacterium bovis
SATDPHA

SEQ ID NO: 194932 - protein, 4 aa, Mycobacterium bovis
SAVM

SEQ ID NO: 194933 - protein, 6 aa, Mycobacterium bovis
SCAAGT

SEQ ID NO: 194934 - protein, 7 aa, Mycobacterium bovis
SDAPEYS

SEQ ID NO: 194935 - protein, 9 aa, Mycobacterium bovis
SDDDDRTRL

SEQ ID NO: 194936 - protein, 4 aa, Mycobacterium bovis
SDFD

SEQ ID NO: 194937 - protein, 9 aa, Mycobacterium bovis
SDGDFGGDL

SEQ ID NO: 194938 - protein, 6 aa, Mycobacterium bovis
SDGFGP

SEQ ID NO: 194939 - protein, 5 aa, Mycobacterium bovis
SDHGD

SEQ ID NO: 194940 - protein, 26 aa, Mycobacterium bovis
SDPDDGNSTPKNRPHGSNSLSTTQLH

SEQ ID NO: 194941 - protein, 11 aa, Mycobacterium bovis
SDPNDRASAEQ

SEQ ID NO: 194942 - protein, 6 aa, Mycobacterium bovis
SDSDVA

SEQ ID NO: 194943 - protein, 6 aa, Mycobacterium bovis
SDSGRA

SEQ ID NO: 194944 - protein, 10 aa, Mycobacterium bovis
SDSLNDKELR

SEQ ID NO: 194945 - protein, 37 aa, Mycobacterium bovis
SDTPETTTASRSADRSTNPKTAKHPKSAAKPTVPTPA

SEQ ID NO: 194946 - protein, 6 aa, Mycobacterium bovis
SEAADK

SEQ ID NO: 194947 - protein, 5 aa, Mycobacterium bovis
SEEVE

SEQ ID NO: 194948 - protein, 6 aa, Mycobacterium bovis
SEGKGL

SEQ ID NO: 194949 - protein, 10 aa, Mycobacterium bovis
SEKGDSGGPV

SEQ ID NO: 194950 - protein, 6 aa, Mycobacterium bovis
SEMSDE

SEQ ID NO: 194951 - protein, 5 aa, Mycobacterium bovis
SEPHD

SEQ ID NO: 194952 - protein, 7 aa, Mycobacterium bovis
SEPPLSA

SEQ ID NO: 194953 - protein, 4 aa, Mycobacterium bovis
SEQC

SEQ ID NO: 194954 - protein, 11 aa, Mycobacterium bovis
SEVTKYRQGDR

SEQ ID NO: 194955 - protein, 17 aa, Mycobacterium bovis
SFGSVTSGLAGQSWQGA

SEQ ID NO: 194956 - protein, 12 aa, Mycobacterium bovis
SFSRGARQEAER

SEQ ID NO: 194957 - protein, 35 aa, Mycobacterium bovis
SGAGLTTLDGTDVAEHGTPGLPGVPAGTDKRASGV

SEQ ID NO: 194958 - protein, 16 aa, Mycobacterium bovis
SGAHASYSGGPGETDY

SEQ ID NO: 194959 - protein, 6 aa, Mycobacterium bovis
SGAKDQ

SEQ ID NO: 194960 - protein, 6 aa, Mycobacterium bovis
SGDALS

SEQ ID NO: 194961 - protein, 15 aa, Mycobacterium bovis
SGDGNTGFGNAGDVN

SEQ ID NO: 194962 - protein, 14 aa, Mycobacterium bovis
SGDGNTGFGNAGNI

SEQ ID NO: 194963 - protein, 9 aa, Mycobacterium bovis
SGDGTDPRT

SEQ ID NO: 194964 - protein, 13 aa, Mycobacterium bovis
SGDPITDVNGGGQ

SEQ ID NO: 194965 - protein, 10 aa, Mycobacterium bovis
SGDTANEGTQ

SEQ ID NO: 194966 - protein, 7 aa, Mycobacterium bovis
SGDTPLL

SEQ ID NO: 194967 - protein, 6 aa, Mycobacterium bovis
SGESGL

SEQ ID NO: 194968 - protein, 7 aa, Mycobacterium bovis
SGEYAAS

SEQ ID NO: 194969 - protein, 8 aa, Mycobacterium bovis
SGFANTGT

SEQ ID NO: 194970 - protein, 10 aa, Mycobacterium bovis
SGFDAAAPSA

SEQ ID NO: 194971 - protein, 8 aa, Mycobacterium bovis
SGFGGGGH

SEQ ID NO: 194972 - protein, 49 aa, Mycobacterium bovis
SGGAGGAGGSGRTDLGGAGGAGGKAGLIGNGGNGGAGGAGGAGGPGGAA

SEQ ID NO: 194973 - protein, 30 aa, Mycobacterium bovis
SGGAGGSGGAAGTFGDTGNSGGAGGAGGKA

SEQ ID NO: 194974 - protein, 30 aa, Mycobacterium bovis
SGGAGGSGGAGGFANGSTGGAGGAGGGAGL

SEQ ID NO: 194975 - protein, 7 aa, Mycobacterium bovis
SGGGPRV

SEQ ID NO: 194976 - protein, 31 aa, Mycobacterium bovis
SGGSGNGRGDPGSGGSGGEGGEGGPSISVNV

SEQ ID NO: 194977 - protein, 24 aa, Mycobacterium bovis
SGGTGGSGGFGKDTGGAGGRGGDA

SEQ ID NO: 194978 - protein, 10 aa, Mycobacterium bovis
SGGVGGAGGF

SEQ ID NO: 194979 - protein, 6 aa, Mycobacterium bovis
SGHAAR

SEQ ID NO: 194980 - protein, 8 aa, Mycobacterium bovis
SGHQPDGY

SEQ ID NO: 194981 - protein, 7 aa, Mycobacterium bovis
SGIPAAT

SEQ ID NO: 194982 - protein, 13 aa, Mycobacterium bovis
SGISVGPSETVDA

SEQ ID NO: 194983 - protein, 5 aa, Mycobacterium bovis
SGITG

SEQ ID NO: 194984 - protein, 5 aa, Mycobacterium bovis
SGLNP

SEQ ID NO: 194985 - protein, 6 aa, Mycobacterium bovis
SGLTNG

SEQ ID NO: 194986 - protein, 50 aa, Mycobacterium bovis
SGNGGTGGGGGTAGAGGQGGNGNSGIDPGNGGQGADTGNAGNGGHGGSAA

SEQ ID NO: 194987 - protein, 18 aa, Mycobacterium bovis
SGNIGNTNFGNGNQGNLN

SEQ ID NO: 194988 - protein, 4 aa, Mycobacterium bovis
SGNM

SEQ ID NO: 194989 - protein, 8 aa, Mycobacterium bovis
SGNSNEGF

SEQ ID NO: 194990 - protein, 19 aa, Mycobacterium bovis
SGPHGADPHHGYSDRELRE

SEQ ID NO: 194991 - protein, 4 aa, Mycobacterium bovis
SGPY

SEQ ID NO: 194992 - protein, 13 aa, Mycobacterium bovis
SGQAVTASATDHP

SEQ ID NO: 194993 - protein, 6 aa, Mycobacterium bovis
SGTDSN

SEQ ID NO: 194994 - protein, 5 aa, Mycobacterium bovis
SGTGI

SEQ ID NO: 194995 - protein, 5 aa, Mycobacterium bovis
SGTVP

SEQ ID NO: 194996 - protein, 41 aa, Mycobacterium bovis
SGVASTGIANSGNASSGVANSGDNSSGAFNQGDNQAGFFGQ

SEQ ID NO: 194997 - protein, 10 aa, Mycobacterium bovis
SHPDQAIASG

SEQ ID NO: 194998 - protein, 5 aa, Mycobacterium bovis
SHQYP

SEQ ID NO: 194999 - protein, 54 aa, Mycobacterium bovis
SHRRPPSGSMRPRARGRGRTHARTRARSHGGTARRGGRRPCARDTGRRSRRHRR

SEQ ID NO: 195000 - protein, 6 aa, Mycobacterium bovis
SKSALR

SEQ ID NO: 195001 - protein, 5 aa, Mycobacterium bovis
SLDAE

SEQ ID NO: 195002 - protein, 4 aa, Mycobacterium bovis
SLNA

SEQ ID NO: 195003 - protein, 11 aa, Mycobacterium bovis
SLNTPADNDHQ

SEQ ID NO: 195004 - protein, 17 aa, Mycobacterium bovis
SMRTNSNQLRSYVAWTP

SEQ ID NO: 195005 - protein, 23 aa, Mycobacterium bovis
SMSPKDVDDLATQQDVDDGQSIE

SEQ ID NO: 195006 - protein, 7 aa, Mycobacterium bovis
SNDPTEL

SEQ ID NO: 195007 - protein, 7 aa, Mycobacterium bovis
SNGIGSD

SEQ ID NO: 195008 - protein, 6 aa, Mycobacterium bovis
SNMAST

SEQ ID NO: 195009 - protein, 5 aa, Mycobacterium bovis
SNPVA

SEQ ID NO: 195010 - protein, 6 aa, Mycobacterium bovis
SNVDTD

SEQ ID NO: 195011 - protein, 5 aa, Mycobacterium bovis
SPADQ

SEQ ID NO: 195012 - protein, 6 aa, Mycobacterium bovis
SPDEKY

SEQ ID NO: 195013 - protein, 11 aa, Mycobacterium bovis
SPHGVSAGGSR

SEQ ID NO: 195014 - protein, 4 aa, Mycobacterium bovis
SPHP

SEQ ID NO: 195015 - protein, 8 aa, Mycobacterium bovis
SPKQFDGV

SEQ ID NO: 195016 - protein, 18 aa, Mycobacterium bovis
SPLDPTSGDPLHPAPPRL

SEQ ID NO: 195017 - protein, 5 aa, Mycobacterium bovis
SPPML

SEQ ID NO: 195018 - protein, 5 aa, Mycobacterium bovis
SPRAH

SEQ ID NO: 195019 - protein, 14 aa, Mycobacterium bovis
SPSEDAREMRQNSP

SEQ ID NO: 195020 - protein, 4 aa, Mycobacterium bovis
SPSV

SEQ ID NO: 195021 - protein, 4 aa, Mycobacterium bovis
SPTD

SEQ ID NO: 195022 - protein, 17 aa, Mycobacterium bovis
SPTWDPRARGWWSEDPG

SEQ ID NO: 195023 - protein, 5 aa, Mycobacterium bovis
SQHAG

SEQ ID NO: 195024 - protein, 11 aa, Mycobacterium bovis
SQSIPGPSNLG

SEQ ID NO: 195025 - protein, 8 aa, Mycobacterium bovis
SRAAETAE

SEQ ID NO: 195026 - protein, 13 aa, Mycobacterium bovis
SRASEIAPNTTDG

SEQ ID NO: 195027 - protein, 13 aa, Mycobacterium bovis
SRDESARASDTDR

SEQ ID NO: 195028 - protein, 12 aa, Mycobacterium bovis
SREAARRTLNRP

SEQ ID NO: 195029 - protein, 6 aa, Mycobacterium bovis
SRETVN

SEQ ID NO: 195030 - protein, 6 aa, Mycobacterium bovis
SRGGVG

SEQ ID NO: 195031 - protein, 13 aa, Mycobacterium bovis
SRHPQQETTCRRV

SEQ ID NO: 195032 - protein, 9 aa, Mycobacterium bovis
SRKPGRKHQ

SEQ ID NO: 195033 - protein, 8 aa, Mycobacterium bovis
SRRREEGL

SEQ ID NO: 195034 - protein, 17 aa, Mycobacterium bovis
SRSPGLNESSHMSGRVP

SEQ ID NO: 195035 - protein, 11 aa, Mycobacterium bovis
SRSRASDDPEF

SEQ ID NO: 195036 - protein, 16 aa, Mycobacterium bovis
SRSSSTRLQTVSWCQR

SEQ ID NO: 195037 - protein, 19 aa, Mycobacterium bovis
SRVAARRRAGQRAESRQHP

SEQ ID NO: 195038 - protein, 9 aa, Mycobacterium bovis
SSDFKTGPA

SEQ ID NO: 195039 - protein, 6 aa, Mycobacterium bovis
SSDRAT

SEQ ID NO: 195040 - protein, 10 aa, Mycobacterium bovis
SSHDGPDAGR

SEQ ID NO: 195041 - protein, 19 aa, Mycobacterium bovis
SSPGKLPTAQGYYCTSIRC

SEQ ID NO: 195042 - protein, 14 aa, Mycobacterium bovis
SSQAQLDDDPHRSA

SEQ ID NO: 195043 - protein, 8 aa, Mycobacterium bovis
SSSDGRGP

SEQ ID NO: 195044 - protein, 9 aa, Mycobacterium bovis
SSSTDPAIA

SEQ ID NO: 195045 - protein, 75 aa, Mycobacterium bovis
SSSTSSGPPTAPTPTSPFGTAPMPPGPPPPGTVSPPLPPSAPAVGVGGPSVPAAGMPPAAAAATAPLSPQSLGQS

SEQ ID NO: 195046 - protein, 7 aa, Mycobacterium bovis
SSVGHAG

SEQ ID NO: 195047 - protein, 15 aa, Mycobacterium bovis
STAGGAGGAGGAGGL

SEQ ID NO: 195048 - protein, 8 aa, Mycobacterium bovis
STEQHGPH

SEQ ID NO: 195049 - protein, 8 aa, Mycobacterium bovis
STKPENVP

SEQ ID NO: 195050 - protein, 32 aa, Mycobacterium bovis
STLGYGGNGVNGGAGGTGGKAGVFGAPGQNGL

SEQ ID NO: 195051 - protein, 23 aa, Mycobacterium bovis
STPASNPAQPRPTREQNRRSGSC

SEQ ID NO: 195052 - protein, 5 aa, Mycobacterium bovis
STRSS

SEQ ID NO: 195053 - protein, 9 aa, Mycobacterium bovis
STSRQSDWG

SEQ ID NO: 195054 - protein, 8 aa, Mycobacterium bovis
STTGADSH

SEQ ID NO: 195055 - protein, 6 aa, Mycobacterium bovis
STTPHH

SEQ ID NO: 195056 - protein, 6 aa, Mycobacterium bovis
SVDPDR

SEQ ID NO: 195057 - protein, 11 aa, Mycobacterium bovis
SVGGQPSQATQ

SEQ ID NO: 195058 - protein, 5 aa, Mycobacterium bovis
SVGPT

SEQ ID NO: 195059 - protein, 7 aa, Mycobacterium bovis
SVMAPTA

SEQ ID NO: 195060 - protein, 18 aa, Mycobacterium bovis
SVNGHSDDSSGDAKQAAP

SEQ ID NO: 195061 - protein, 4 aa, Mycobacterium bovis
SVRS

SEQ ID NO: 195062 - protein, 13 aa, Mycobacterium bovis
SYPSALATDHHHG

SEQ ID NO: 195063 - protein, 14 aa, Mycobacterium bovis
TAATAATPGPAGMA

SEQ ID NO: 195064 - protein, 13 aa, Mycobacterium bovis
TACPKGVDPAGAI

SEQ ID NO: 195065 - protein, 11 aa, Mycobacterium bovis
TADAEEALGGA

SEQ ID NO: 195066 - protein, 9 aa, Mycobacterium bovis
TADPVAGSR

SEQ ID NO: 195067 - protein, 5 aa, Mycobacterium bovis
TADTH

SEQ ID NO: 195068 - protein, 6 aa, Mycobacterium bovis
TAGGDL

SEQ ID NO: 195069 - protein, 7 aa, Mycobacterium bovis
TAHPGVN

SEQ ID NO: 195070 - protein, 9 aa, Mycobacterium bovis
TANSGAGVL

SEQ ID NO: 195071 - protein, 19 aa, Mycobacterium bovis
TAPAGAATGVTSRADAHSQ

SEQ ID NO: 195072 - protein, 9 aa, Mycobacterium bovis
TAQQRTSLA

SEQ ID NO: 195073 - protein, 6 aa, Mycobacterium bovis
TARAQE

SEQ ID NO: 195074 - protein, 4 aa, Mycobacterium bovis
TARQ

SEQ ID NO: 195075 - protein, 13 aa, Mycobacterium bovis
TARRGPPTRGLPK

SEQ ID NO: 195076 - protein, 5 aa, Mycobacterium bovis
TATGL

SEQ ID NO: 195077 - protein, 6 aa, Mycobacterium bovis
TATGLT

SEQ ID NO: 195078 - protein, 12 aa, Mycobacterium bovis
TATTNPRHSDAH

SEQ ID NO: 195079 - protein, 10 aa, Mycobacterium bovis
TAVAHSGDDA

SEQ ID NO: 195080 - protein, 5 aa, Mycobacterium bovis
TCPVN

SEQ ID NO: 195081 - protein, 9 aa, Mycobacterium bovis
TDDSDGRTR

SEQ ID NO: 195082 - protein, 108 aa, Mycobacterium bovis
TDEPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALD

SEQ ID NO: 195083 - protein, 8 aa, Mycobacterium bovis
TDGDPVTA

SEQ ID NO: 195084 - protein, 4 aa, Mycobacterium bovis
TDGE

SEQ ID NO: 195085 - protein, 7 aa, Mycobacterium bovis
TDKDWRE

SEQ ID NO: 195086 - protein, 9 aa, Mycobacterium bovis
TDMTTGSRR

SEQ ID NO: 195087 - protein, 40 aa, Mycobacterium bovis
TDPNLSRPRVAATAAKSGANDPQPPEVAGQPPSSARPARR

SEQ ID NO: 195088 - protein, 26 aa, Mycobacterium bovis
TDPTDSCGGRDRPGQLPCAPLDYHRH

SEQ ID NO: 195089 - protein, 7 aa, Mycobacterium bovis
TDSVSPQ

SEQ ID NO: 195090 - protein, 6 aa, Mycobacterium bovis
TEADER

SEQ ID NO: 195091 - protein, 4 aa, Mycobacterium bovis
TEIG

SEQ ID NO: 195092 - protein, 9 aa, Mycobacterium bovis
TEPTSPQDA

SEQ ID NO: 195093 - protein, 15 aa, Mycobacterium bovis
TERFGPQPAQPAAGP

SEQ ID NO: 195094 - protein, 5 aa, Mycobacterium bovis
TESLG

SEQ ID NO: 195095 - protein, 4 aa, Mycobacterium bovis
TFAR

SEQ ID NO: 195096 - protein, 8 aa, Mycobacterium bovis
TGCSPDAA

SEQ ID NO: 195097 - protein, 7 aa, Mycobacterium bovis
TGDLPTI

SEQ ID NO: 195098 - protein, 8 aa, Mycobacterium bovis
TGETCGTV

SEQ ID NO: 195099 - protein, 12 aa, Mycobacterium bovis
TGFGNSGAGNTG

SEQ ID NO: 195100 - protein, 4 aa, Mycobacterium bovis
TGGG

SEQ ID NO: 195101 - protein, 27 aa, Mycobacterium bovis
TGKRIQAAGGAVRTRVGDRSRAAGRRA

SEQ ID NO: 195102 - protein, 15 aa, Mycobacterium bovis
TGKTPVSKDDAQQHA

SEQ ID NO: 195103 - protein, 8 aa, Mycobacterium bovis
TGLAKPAG

SEQ ID NO: 195104 - protein, 5 aa, Mycobacterium bovis
TGPAL

SEQ ID NO: 195105 - protein, 6 aa, Mycobacterium bovis
TGPEVT

SEQ ID NO: 195106 - protein, 11 aa, Mycobacterium bovis
TGRRTGADQRA

SEQ ID NO: 195107 - protein, 12 aa, Mycobacterium bovis
TGSITKIYLRAT

SEQ ID NO: 195108 - protein, 6 aa, Mycobacterium bovis
TGSRDY

SEQ ID NO: 195109 - protein, 9 aa, Mycobacterium bovis
TGTAGYAGG

SEQ ID NO: 195110 - protein, 4 aa, Mycobacterium bovis
TGTH

SEQ ID NO: 195111 - protein, 6 aa, Mycobacterium bovis
TGTSDQ

SEQ ID NO: 195112 - protein, 6 aa, Mycobacterium bovis
THPEPK

SEQ ID NO: 195113 - protein, 7 aa, Mycobacterium bovis
THPQDRA

SEQ ID NO: 195114 - protein, 6 aa, Mycobacterium bovis
THRETP

SEQ ID NO: 195115 - protein, 19 aa, Mycobacterium bovis
THRRRAAPTTLIPDGRTPG

SEQ ID NO: 195116 - protein, 11 aa, Mycobacterium bovis
TISTTAGPDGV

SEQ ID NO: 195117 - protein, 6 aa, Mycobacterium bovis
TKADLP

SEQ ID NO: 195118 - protein, 5 aa, Mycobacterium bovis
TKDQV

SEQ ID NO: 195119 - protein, 9 aa, Mycobacterium bovis
TKGRPGLGR

SEQ ID NO: 195120 - protein, 11 aa, Mycobacterium bovis
TKVDPAADPAV

SEQ ID NO: 195121 - protein, 23 aa, Mycobacterium bovis
TLASTSTTSPASSHPPSANTTVT

SEQ ID NO: 195122 - protein, 7 aa, Mycobacterium bovis
TLPPGRL

SEQ ID NO: 195123 - protein, 16 aa, Mycobacterium bovis
TNATRHQHDAAAAAVD

SEQ ID NO: 195124 - protein, 14 aa, Mycobacterium bovis
TNDDQGDQGDVQPA

SEQ ID NO: 195125 - protein, 21 aa, Mycobacterium bovis
TNPSPPGEDGRGRNTTIKERQ

SEQ ID NO: 195126 - protein, 4 aa, Mycobacterium bovis
TPAA

SEQ ID NO: 195127 - protein, 5 aa, Mycobacterium bovis
TPAAE

SEQ ID NO: 195128 - protein, 5 aa, Mycobacterium bovis
TPAFG

SEQ ID NO: 195129 - protein, 14 aa, Mycobacterium bovis
TPDPEPDPPATHAP

SEQ ID NO: 195130 - protein, 6 aa, Mycobacterium bovis
TPEHGN

SEQ ID NO: 195131 - protein, 12 aa, Mycobacterium bovis
TPGHADFGGEVE

SEQ ID NO: 195132 - protein, 4 aa, Mycobacterium bovis
TPIT

SEQ ID NO: 195133 - protein, 4 aa, Mycobacterium bovis
TPPA

SEQ ID NO: 195134 - protein, 9 aa, Mycobacterium bovis
TPQERADPK

SEQ ID NO: 195135 - protein, 4 aa, Mycobacterium bovis
TPRD

SEQ ID NO: 195136 - protein, 12 aa, Mycobacterium bovis
TPSPASDTDTVT

SEQ ID NO: 195137 - protein, 6 aa, Mycobacterium bovis
TPTRRF

SEQ ID NO: 195138 - protein, 6 aa, Mycobacterium bovis
TPTSKV

SEQ ID NO: 195139 - protein, 11 aa, Mycobacterium bovis
TPVTADSALNR

SEQ ID NO: 195140 - protein, 15 aa, Mycobacterium bovis
TQASVPPQGGRKHPH

SEQ ID NO: 195141 - protein, 5 aa, Mycobacterium bovis
TQPRH

SEQ ID NO: 195142 - protein, 14 aa, Mycobacterium bovis
TQSPYPGGGPIPEK

SEQ ID NO: 195143 - protein, 14 aa, Mycobacterium bovis
TQYTESGNALDQSM

SEQ ID NO: 195144 - protein, 6 aa, Mycobacterium bovis
TRAFDG

SEQ ID NO: 195145 - protein, 8 aa, Mycobacterium bovis
TRDLSNEA

SEQ ID NO: 195146 - protein, 9 aa, Mycobacterium bovis
TREQDPDRA

SEQ ID NO: 195147 - protein, 19 aa, Mycobacterium bovis
TRGGDGQGAPFGADVPTPR

SEQ ID NO: 195148 - protein, 6 aa, Mycobacterium bovis
TRNPGF

SEQ ID NO: 195149 - protein, 7 aa, Mycobacterium bovis
TRNRPGH

SEQ ID NO: 195150 - protein, 16 aa, Mycobacterium bovis
TRPRPPQGNQPPASRI

SEQ ID NO: 195151 - protein, 8 aa, Mycobacterium bovis
TRPSEPGV

SEQ ID NO: 195152 - protein, 8 aa, Mycobacterium bovis
TRPSGLPG

SEQ ID NO: 195153 - protein, 9 aa, Mycobacterium bovis
TRRDLPQSP

SEQ ID NO: 195154 - protein, 17 aa, Mycobacterium bovis
TSAEAAQTQTRIALKSR

SEQ ID NO: 195155 - protein, 8 aa, Mycobacterium bovis
TSAGAAAR

SEQ ID NO: 195156 - protein, 5 aa, Mycobacterium bovis
TSDGQ

SEQ ID NO: 195157 - protein, 7 aa, Mycobacterium bovis
TSEGAEA

SEQ ID NO: 195158 - protein, 5 aa, Mycobacterium bovis
TSESL

SEQ ID NO: 195159 - protein, 9 aa, Mycobacterium bovis
TSGDTIAAN

SEQ ID NO: 195160 - protein, 8 aa, Mycobacterium bovis
TSGQPDPD

SEQ ID NO: 195161 - protein, 10 aa, Mycobacterium bovis
TSGSPSEATS

SEQ ID NO: 195162 - protein, 10 aa, Mycobacterium bovis
TSNYREDSDT

SEQ ID NO: 195163 - protein, 15 aa, Mycobacterium bovis
TSPGEVAGEGSPDPF

SEQ ID NO: 195164 - protein, 14 aa, Mycobacterium bovis
TSPSPSKRRTASRA

SEQ ID NO: 195165 - protein, 4 aa, Mycobacterium bovis
TSQL

SEQ ID NO: 195166 - protein, 9 aa, Mycobacterium bovis
TSSSPGTLG

SEQ ID NO: 195167 - protein, 9 aa, Mycobacterium bovis
TSTATGREA

SEQ ID NO: 195168 - protein, 35 aa, Mycobacterium bovis
TSTGGSGGFGGNGAASAASGADGGAGGAGGNGGAG

SEQ ID NO: 195169 - protein, 17 aa, Mycobacterium bovis
TTALRTPSTWMTRATAT

SEQ ID NO: 195170 - protein, 9 aa, Mycobacterium bovis
TTATNTPFV

SEQ ID NO: 195171 - protein, 5 aa, Mycobacterium bovis
TTDAS

SEQ ID NO: 195172 - protein, 9 aa, Mycobacterium bovis
TTGAASNGC

SEQ ID NO: 195173 - protein, 10 aa, Mycobacterium bovis
TTKSRSNVDD

SEQ ID NO: 195174 - protein, 11 aa, Mycobacterium bovis
TTQLGETAAEL

SEQ ID NO: 195175 - protein, 6 aa, Mycobacterium bovis
TTQQAE

SEQ ID NO: 195176 - protein, 10 aa, Mycobacterium bovis
TTSAAARQLT

SEQ ID NO: 195177 - protein, 12 aa, Mycobacterium bovis
TTWQRESAPVDV

SEQ ID NO: 195178 - protein, 7 aa, Mycobacterium bovis
TVSPGAT

SEQ ID NO: 195179 - protein, 4 aa, Mycobacterium bovis
TVTD

SEQ ID NO: 195180 - protein, 12 aa, Mycobacterium bovis
TWPAPTAPTPVR

SEQ ID NO: 195181 - protein, 5 aa, Mycobacterium bovis
TYPGT

SEQ ID NO: 195182 - protein, 12 aa, Mycobacterium bovis
VADSTDDTIEVD

SEQ ID NO: 195183 - protein, 13 aa, Mycobacterium bovis
VANSRRRPVHPGQ

SEQ ID NO: 195184 - protein, 10 aa, Mycobacterium bovis
VAPRGGGHSY

SEQ ID NO: 195185 - protein, 11 aa, Mycobacterium bovis
VDADEVTAAAR

SEQ ID NO: 195186 - protein, 17 aa, Mycobacterium bovis
VDDLATQQDVDDGQSIE

SEQ ID NO: 195187 - protein, 11 aa, Mycobacterium bovis
VDDQSRARAAL

SEQ ID NO: 195188 - protein, 10 aa, Mycobacterium bovis
VDEQTGAESV

SEQ ID NO: 195189 - protein, 14 aa, Mycobacterium bovis
VDHATASVNPPPEV

SEQ ID NO: 195190 - protein, 18 aa, Mycobacterium bovis
VDRGPPARIAAAGSRRRG

SEQ ID NO: 195191 - protein, 7 aa, Mycobacterium bovis
VEATGSA

SEQ ID NO: 195192 - protein, 11 aa, Mycobacterium bovis
VEEGPPPPLPA

SEQ ID NO: 195193 - protein, 51 aa, Mycobacterium bovis
VEGEPPPAPDPAGPQPNEGLPPPGVSPPAESNLTVGPPSRPIQQARGGESL

SEQ ID NO: 195194 - protein, 7 aa, Mycobacterium bovis
VEGGESL

SEQ ID NO: 195195 - protein, 8 aa, Mycobacterium bovis
VEGGGNQD

SEQ ID NO: 195196 - protein, 4 aa, Mycobacterium bovis
VEPD

SEQ ID NO: 195197 - protein, 15 aa, Mycobacterium bovis
VERSGDRSAPYAAPR

SEQ ID NO: 195198 - protein, 15 aa, Mycobacterium bovis
VERVEPGRGRPGRPP

SEQ ID NO: 195199 - protein, 5 aa, Mycobacterium bovis
VETSR

SEQ ID NO: 195200 - protein, 10 aa, Mycobacterium bovis
VEVEGDPECQ

SEQ ID NO: 195201 - protein, 5 aa, Mycobacterium bovis
VGAPL

SEQ ID NO: 195202 - protein, 8 aa, Mycobacterium bovis
VGASTANG

SEQ ID NO: 195203 - protein, 9 aa, Mycobacterium bovis
VGDDKDKAA

SEQ ID NO: 195204 - protein, 10 aa, Mycobacterium bovis
VGDGGLPAEL

SEQ ID NO: 195205 - protein, 10 aa, Mycobacterium bovis
VGDGQARIRT

SEQ ID NO: 195206 - protein, 8 aa, Mycobacterium bovis
VGDPGGGA

SEQ ID NO: 195207 - protein, 5 aa, Mycobacterium bovis
VGEDA

SEQ ID NO: 195208 - protein, 38 aa, Mycobacterium bovis
VGGAGGNAAGLSGAGGAGGAGGFGETAGDGGAGGNAGL

SEQ ID NO: 195209 - protein, 7 aa, Mycobacterium bovis
VGGEPGS

SEQ ID NO: 195210 - protein, 6 aa, Mycobacterium bovis
VGKSGR

SEQ ID NO: 195211 - protein, 11 aa, Mycobacterium bovis
VGPGETVAPPV

SEQ ID NO: 195212 - protein, 5 aa, Mycobacterium bovis
VGPGV

SEQ ID NO: 195213 - protein, 4 aa, Mycobacterium bovis
VGRE

SEQ ID NO: 195214 - protein, 7 aa, Mycobacterium bovis
VKDGDDA

SEQ ID NO: 195215 - protein, 15 aa, Mycobacterium bovis
VNAGNLAAANPTTAV

SEQ ID NO: 195216 - protein, 8 aa, Mycobacterium bovis
VNAGSGIN

SEQ ID NO: 195217 - protein, 5 aa, Mycobacterium bovis
VNDKR

SEQ ID NO: 195218 - protein, 8 aa, Mycobacterium bovis
VNESRTAK

SEQ ID NO: 195219 - protein, 217 aa, Mycobacterium bovis
VNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGTGGTGGTGGDGGRGAHG

SEQ ID NO: 195220 - protein, 7 aa, Mycobacterium bovis
VPAYSGA

SEQ ID NO: 195221 - protein, 15 aa, Mycobacterium bovis
VPGYHAPPDRTAGVA

SEQ ID NO: 195222 - protein, 12 aa, Mycobacterium bovis
VPLSSGSFGDAT

SEQ ID NO: 195223 - protein, 4 aa, Mycobacterium bovis
VPND

SEQ ID NO: 195224 - protein, 12 aa, Mycobacterium bovis
VPPEPPPSKLSP

SEQ ID NO: 195225 - protein, 5 aa, Mycobacterium bovis
VPPGA

SEQ ID NO: 195226 - protein, 4 aa, Mycobacterium bovis
VPRE

SEQ ID NO: 195227 - protein, 11 aa, Mycobacterium bovis
VPRGPLAAASA

SEQ ID NO: 195228 - protein, 10 aa, Mycobacterium bovis
VPTARSDAPL

SEQ ID NO: 195229 - protein, 6 aa, Mycobacterium bovis
VPWDAD

SEQ ID NO: 195230 - protein, 13 aa, Mycobacterium bovis
VQEAAATANRAGV

SEQ ID NO: 195231 - protein, 28 aa, Mycobacterium bovis
VQKRSSYKKSPGGRKEALRRSRATGTIT

SEQ ID NO: 195232 - protein, 4 aa, Mycobacterium bovis
VQPG

SEQ ID NO: 195233 - protein, 6 aa, Mycobacterium bovis
VQTADG

SEQ ID NO: 195234 - protein, 4 aa, Mycobacterium bovis
VQTG

SEQ ID NO: 195235 - protein, 7 aa, Mycobacterium bovis
VQTRREH

SEQ ID NO: 195236 - protein, 11 aa, Mycobacterium bovis
VRPPTPSRRLP

SEQ ID NO: 195237 - protein, 12 aa, Mycobacterium bovis
VRTPAGGGDAHN

SEQ ID NO: 195238 - protein, 20 aa, Mycobacterium bovis
VSAEGGAAAVTGDDDSLDEH

SEQ ID NO: 195239 - protein, 4 aa, Mycobacterium bovis
VSAG

SEQ ID NO: 195240 - protein, 4 aa, Mycobacterium bovis
VSAS

SEQ ID NO: 195241 - protein, 10 aa, Mycobacterium bovis
VSDGSSAPAV

SEQ ID NO: 195242 - protein, 8 aa, Mycobacterium bovis
VSGERQGY

SEQ ID NO: 195243 - protein, 6 aa, Mycobacterium bovis
VSPGTL

SEQ ID NO: 195244 - protein, 11 aa, Mycobacterium bovis
VSRAAARKRAE

SEQ ID NO: 195245 - protein, 12 aa, Mycobacterium bovis
VTAGERPGRGGV

SEQ ID NO: 195246 - protein, 9 aa, Mycobacterium bovis
VTAGSTALT

SEQ ID NO: 195247 - protein, 18 aa, Mycobacterium bovis
VTAPNSEDGVARVLERWW

SEQ ID NO: 195248 - protein, 12 aa, Mycobacterium bovis
VTDDPADPSTIV

SEQ ID NO: 195249 - protein, 9 aa, Mycobacterium bovis
VTDNSGRER

SEQ ID NO: 195250 - protein, 5 aa, Mycobacterium bovis
VTGGH

SEQ ID NO: 195251 - protein, 13 aa, Mycobacterium bovis
VTGPADPAQQQCT

SEQ ID NO: 195252 - protein, 5 aa, Mycobacterium bovis
VTPAT

SEQ ID NO: 195253 - protein, 7 aa, Mycobacterium bovis
VVPPAAD

SEQ ID NO: 195254 - protein, 10 aa, Mycobacterium bovis
VYGADDPAAA

SEQ ID NO: 195255 - protein, 14 aa, Mycobacterium bovis
WADGGPTSAHNGLG

SEQ ID NO: 195256 - protein, 4 aa, Mycobacterium bovis
WGGP

SEQ ID NO: 195257 - protein, 23 aa, Mycobacterium bovis
WGNGRGRGCRCGRGDRGGDRRDR

SEQ ID NO: 195258 - protein, 9 aa, Mycobacterium bovis
WGPGESPGT

SEQ ID NO: 195259 - protein, 10 aa, Mycobacterium bovis
WGPLSAPKLE

SEQ ID NO: 195260 - protein, 8 aa, Mycobacterium bovis
WGRDPDTM

SEQ ID NO: 195261 - protein, 13 aa, Mycobacterium bovis
WKTRKNAKGDTEW

SEQ ID NO: 195262 - protein, 12 aa, Mycobacterium bovis
WLGPSSAGMAAA

SEQ ID NO: 195263 - protein, 5 aa, Mycobacterium bovis
WPGAG

SEQ ID NO: 195264 - protein, 9 aa, Mycobacterium bovis
WPLGPTHPS

SEQ ID NO: 195265 - protein, 4 aa, Mycobacterium bovis
WQPI

SEQ ID NO: 195266 - protein, 4 aa, Mycobacterium bovis
WSNP

SEQ ID NO: 195267 - protein, 4 aa, Mycobacterium bovis
WTTD

SEQ ID NO: 195268 - protein, 252 aa, Mycobacterium bovis
YARPQEDPRGGPDPQGGSDPRGGYPPETGGYPPQPGYPRPRHPGQGDYPEQIGYPDQGGYPEQRGYPDQRGHQDQGRGYPDQGQGGYPPPYEQRPPVSPGPAAGYGAPGYDQGYRQSGGCGPSPGGGQPGYGGYGEYGRGPARHEEGSYVPSGPPGPPEQRPAYPDQGGYDQGYQQGATTYGRQDYGGGADYTRYTESPQVPGYAPQGGGYAEPAGRDYDYGQSGAPDYGQPAPGGYSGYGQGGYGSAGTSV

SEQ ID NO: 195269 - protein, 8 aa, Mycobacterium bovis
YDATTGRV

SEQ ID NO: 195270 - protein, 4 aa, Mycobacterium bovis
YDES

SEQ ID NO: 195271 - protein, 5 aa, Mycobacterium bovis
YDPRS

SEQ ID NO: 195272 - protein, 8 aa, Mycobacterium bovis
YDQPATTV

SEQ ID NO: 195273 - protein, 8 aa, Mycobacterium bovis
YGDDGTRI

SEQ ID NO: 195274 - protein, 11 aa, Mycobacterium bovis
YGPVRGADDGR

SEQ ID NO: 195275 - protein, 9 aa, Mycobacterium bovis
YGQPGQTER

SEQ ID NO: 195276 - protein, 9 aa, Mycobacterium bovis
YGSSTSSSG

SEQ ID NO: 195277 - protein, 11 aa, Mycobacterium bovis
YNTGSFNAGSF

SEQ ID NO: 195278 - protein, 24 aa, Mycobacterium bovis
YPGNDPLRDARPIEQDDDQGAGSP

SEQ ID NO: 195279 - protein, 14 aa, Mycobacterium bovis
YPPPPGGPPPPADI

SEQ ID NO: 195280 - protein, 19 aa, Mycobacterium bovis
YPQAEAPKAYAEAALSLLV

SEQ ID NO: 195281 - protein, 7 aa, Mycobacterium bovis
YPRDAER

SEQ ID NO: 195282 - protein, 15 aa, Mycobacterium bovis
YPTGTTTSGNQKSHC

SEQ ID NO: 195283 - protein, 8 aa, Mycobacterium bovis
YQSDTESP

SEQ ID NO: 195284 - protein, 4 aa, Mycobacterium bovis
YRDT

SEQ ID NO: 195285 - protein, 6 aa, Mycobacterium bovis
YRNGER

SEQ ID NO: 195286 - protein, 37 aa, Mycobacterium bovis
YRRSRDGCDWGSRGDRGSRRDRGSRGDRGSRRDRGSR

SEQ ID NO: 195287 - protein, 8 aa, Mycobacterium bovis
YSGPGPNS

SEQ ID NO: 195288 - protein, 23 aa, Mycobacterium bovis
YSPAERPDRIPPTDPLGDHRRRH

SEQ ID NO: 195289 - protein, 4 aa, Mycobacterium bovis
YSPE

SEQ ID NO: 195290 - protein, 9 aa, Mycobacterium bovis
YSPNSPLGG

SEQ ID NO: 195291 - protein, 12 aa, Mycobacterium bovis
YSQIDDGAAGVF

SEQ ID NO: 195292 - protein, 17 aa, Mycobacterium bovis
YSRADEEQQQALSSQMG

SEQ ID NO: 195293 - protein, 8 aa, Mycobacterium bovis
YSSPQTDF

SEQ ID NO: 195294 - protein, 17 aa, Mycobacterium bovis
YTPNPNDAPGGPLVERA

SEQ ID NO: 195295 - protein, 23 aa, Mycobacterium bovis
AEDGAGWLAFFRDLVARGLSGVA

SEQ ID NO: 195296 - protein, 18 aa, Mycobacterium bovis
GIDVGGGLGPFTVFPDGY

SEQ ID NO: 195297 - protein, 24 aa, Mycobacterium bovis
MGAEADALCGAGYRERSDERSNQR

SEQ ID NO: 195298 - protein, 31 aa, Mycobacterium bovis
AIPKLRQGSYFPDWLLQRRKRAERALTSVVA

SEQ ID NO: 195299 - protein, 23 aa, Mycobacterium bovis
FTVFPDGYSLPAIPLGIDVGGGL

SEQ ID NO: 195300 - protein, 17 aa, Mycobacterium bovis
IEGRRYLGLEVLTRARA

SEQ ID NO: 195301 - protein, 20 aa, Mycobacterium bovis
DLLAFTAFPKQIWRQIWSNN

SEQ ID NO: 195302 - protein, 18 aa, Mycobacterium bovis
FPKQIWRQIWSNNPQERL

SEQ ID NO: 195303 - protein, 20 aa, Mycobacterium bovis
GRRYLGLEVLTRARAALTST

SEQ ID NO: 195304 - protein, 28 aa, Mycobacterium bovis
LMAATPKPSWPWVRTLLHSIYDQPDAES

SEQ ID NO: 195305 - protein, 23 aa, Mycobacterium bovis
LTSVVATCYLLGVSTRRMERLVE

SEQ ID NO: 195306 - protein, 20 aa, Mycobacterium bovis
AVTIPGFAINPFGLDVPLSG

SEQ ID NO: 195307 - protein, 27 aa, Mycobacterium bovis
GATLPAAAWQRCRTHYAANLMAATPKP

SEQ ID NO: 195308 - protein, 22 aa, Mycobacterium bovis
PGAAGRHGLDWVAIASAAEPGA

SEQ ID NO: 195309 - protein, 19 aa, Mycobacterium bovis
FSAASAFQSVVWGLTVGSW

SEQ ID NO: 195310 - protein, 29 aa, Mycobacterium bovis
KGGTGGAGMNSLDPLLAAQDGGQGGTGGT

SEQ ID NO: 195311 - protein, 24 aa, Mycobacterium bovis
PDELARYAQRVMDWLHPDGDLTDT

SEQ ID NO: 195312 - protein, 23 aa, Mycobacterium bovis
TPQARATFEAVLAKLAAPGATNP

SEQ ID NO: 195313 - protein, 27 aa, Mycobacterium bovis
AATSPLLAPINEFFLANTGRPLIGNGA

SEQ ID NO: 195314 - protein, 24 aa, Mycobacterium bovis
AAWFPSAEHLASWVRLCPGNHESA

SEQ ID NO: 195315 - protein, 17 aa, Mycobacterium bovis
AGPDRIAQILAELATLF

SEQ ID NO: 195316 - protein, 27 aa, Mycobacterium bovis
AGPFDNWPLGWGFDHFWGFPSGAAGQY

SEQ ID NO: 195317 - protein, 18 aa, Mycobacterium bovis
AGVGLAIGLFSPALLASA

SEQ ID NO: 195318 - protein, 22 aa, Mycobacterium bovis
AVGSLRSGECDLALAGGVTVNA

SEQ ID NO: 195319 - protein, 20 aa, Mycobacterium bovis
AVTIPGFAINPFGLNVPLSG

SEQ ID NO: 195320 - protein, 18 aa, Mycobacterium bovis
DAIQCADPFHVVAWATEA

SEQ ID NO: 195321 - protein, 24 aa, Mycobacterium bovis
DASLRLVAPGGVFLEMGKTDIRDP

SEQ ID NO: 195322 - protein, 27 aa, Mycobacterium bovis
DEQFSCWRIKLPHVEAAKFDAALQSHL

SEQ ID NO: 195323 - protein, 21 aa, Mycobacterium bovis
DEVFAHVAAVFGVDAEVAEDI

SEQ ID NO: 195324 - protein, 18 aa, Mycobacterium bovis
DGLYRLTPTTGRTHQLRV

SEQ ID NO: 195325 - protein, 24 aa, Mycobacterium bovis
DRDHIAGAIKLDWRTDLQDPVKRD

SEQ ID NO: 195326 - protein, 18 aa, Mycobacterium bovis
EALERAGIDPTGLRGSAT

SEQ ID NO: 195327 - protein, 23 aa, Mycobacterium bovis
ELTERPDLFPAWDSMSEAQKRLF

SEQ ID NO: 195328 - protein, 20 aa, Mycobacterium bovis
ESERRYLLCDATFEAWFERD

SEQ ID NO: 195329 - protein, 19 aa, Mycobacterium bovis
EVIAAAATDLASLESSIAA

SEQ ID NO: 195330 - protein, 22 aa, Mycobacterium bovis
FDDHHALMCRLHLAHLDQLDAM

SEQ ID NO: 195331 - protein, 18 aa, Mycobacterium bovis
FDDTVAWLAVACSKTAVC

SEQ ID NO: 195332 - protein, 25 aa, Mycobacterium bovis
FGLELIWGIEDCRNMSARLERDLLA

SEQ ID NO: 195333 - protein, 19 aa, Mycobacterium bovis
FGSVCEFPGPYPGYSAVRP

SEQ ID NO: 195334 - protein, 19 aa, Mycobacterium bovis
GMSRLSGYLTPQARATFEA

SEQ ID NO: 195335 - protein, 21 aa, Mycobacterium bovis
GRGSQWAGMGRQLLADEPAFA

SEQ ID NO: 195336 - protein, 17 aa, Mycobacterium bovis
HLHGLATQLMDWLHPDG

SEQ ID NO: 195337 - protein, 23 aa, Mycobacterium bovis
HPYRVRHLLDRYGSLISDVLAMA

SEQ ID NO: 195338 - protein, 18 aa, Mycobacterium bovis
IAQILAELATLFGDGVLR

SEQ ID NO: 195339 - protein, 17 aa, Mycobacterium bovis
LALPRLVRSRIVKRRGH

SEQ ID NO: 195340 - protein, 24 aa, Mycobacterium bovis
LAPHLVKPLPFLFPLTKRWWERPY

SEQ ID NO: 195341 - protein, 18 aa, Mycobacterium bovis
LTGAPWVGAASLSMVAAA

SEQ ID NO: 195342 - protein, 18 aa, Mycobacterium bovis
PAQRHFTRAGALRLSPGL

SEQ ID NO: 195343 - protein, 18 aa, Mycobacterium bovis
PIASELILPIAVAVQNRI

SEQ ID NO: 195344 - protein, 18 aa, Mycobacterium bovis
PTHGPTVVAVPWARHHAG

SEQ ID NO: 195345 - protein, 18 aa, Mycobacterium bovis
PVTIPGFAINPFGLDVPL

SEQ ID NO: 195346 - protein, 17 aa, Mycobacterium bovis
PVVPRREAGWAGPVVPW

SEQ ID NO: 195347 - protein, 19 aa, Mycobacterium bovis
QKRLFARQMEVFAGFSENA

SEQ ID NO: 195348 - protein, 31 aa, Mycobacterium bovis
RAGALRLSPGLKRSSLIGGIRYYDTVVDDAR

SEQ ID NO: 195349 - protein, 17 aa, Mycobacterium bovis
RAGVSSFGISGTNAHVI

SEQ ID NO: 195350 - protein, 19 aa, Mycobacterium bovis
RGAAWGAGVGLAIGLFSPA

SEQ ID NO: 195351 - protein, 19 aa, Mycobacterium bovis
RGITMGKQEFDGMSRISGL

SEQ ID NO: 195352 - protein, 23 aa, Mycobacterium bovis
RTEKSVMFVIPWGSHWIIGTTDT

SEQ ID NO: 195353 - protein, 28 aa, Mycobacterium bovis
RTRLPLPQRRFGGVVGRTMAESVGDWSI

SEQ ID NO: 195354 - protein, 18 aa, Mycobacterium bovis
RTRRAGVSSFGISGTNAH

SEQ ID NO: 195355 - protein, 17 aa, Mycobacterium bovis
RVNCPTHGPTVVAVPWA

SEQ ID NO: 195356 - protein, 25 aa, Mycobacterium bovis
SGVAVSPVTGLVFVTNFDSNTVSVI

SEQ ID NO: 195357 - protein, 18 aa, Mycobacterium bovis
SSLVALHMAVGSLRSGEC

SEQ ID NO: 195358 - protein, 24 aa, Mycobacterium bovis
SVACQEFITQLGRNFQVIYEQANA

SEQ ID NO: 195359 - protein, 24 aa, Mycobacterium bovis
TASKGKWDTLRAMGFDDDHISDSR

SEQ ID NO: 195360 - protein, 19 aa, Mycobacterium bovis
TAVCELMRIAWRTVGAIVA

SEQ ID NO: 195361 - protein, 17 aa, Mycobacterium bovis
TGNWGVFNSGSYNTGIG

SEQ ID NO: 195362 - protein, 23 aa, Mycobacterium bovis
TKRLASPAQRIMLYAKDRGCSRP

SEQ ID NO: 195363 - protein, 29 aa, Mycobacterium bovis
TMHMAGARHCARLRGAIVGKSKSDVIDAE

SEQ ID NO: 195364 - protein, 28 aa, Mycobacterium bovis
TPDRVDVVLRSKVDAAWHLHELTRDLDV

SEQ ID NO: 195365 - protein, 17 aa, Mycobacterium bovis
TQLSGILNRGAGISGVY

SEQ ID NO: 195366 - protein, 24 aa, Mycobacterium bovis
TYLARAPVAPGLALPRLVRSRIVK

SEQ ID NO: 195367 - protein, 21 aa, Mycobacterium bovis
VEMRNRLKSATGLSLSPTLIF

SEQ ID NO: 195368 - protein, 25 aa, Mycobacterium bovis
VQARPGCRPSLAELDSFVRSEIAGY

SEQ ID NO: 195369 - protein, 17 aa, Mycobacterium bovis
VRSRIVKRRGHLQAVCE

SEQ ID NO: 195370 - protein, 24 aa, Mycobacterium bovis
WPGPTGERADWWWYEPFQPQPPPI

SEQ ID NO: 195371 - protein, 22 aa, Mycobacterium bovis
YPGVRYRAFDLFEAGPDRIAQI

SEQ ID NO: 195372 - protein, 18 aa, Mycobacterium bovis
AADITVLCVVAAPEGIAA

SEQ ID NO: 195373 - protein, 18 aa, Mycobacterium bovis
AAMQGRIAMYHALGEGVS

SEQ ID NO: 195374 - protein, 25 aa, Mycobacterium bovis
AFQSVVWGLTVGSWIGSSAGLMVAA

SEQ ID NO: 195375 - protein, 19 aa, Mycobacterium bovis
AGEMLELAGIHGRDPAQTL

SEQ ID NO: 195376 - protein, 17 aa, Mycobacterium bovis
AHGKGHFNIEDWDAILA

SEQ ID NO: 195377 - protein, 21 aa, Mycobacterium bovis
ALYRVAFECAQDLAADSVVYA

SEQ ID NO: 195378 - protein, 17 aa, Mycobacterium bovis
ASVGSLSVPPAWAAANQ

SEQ ID NO: 195379 - protein, 26 aa, Mycobacterium bovis
ATLPAAAWQRCRTHYAANLMAATPKP

SEQ ID NO: 195380 - protein, 25 aa, Mycobacterium bovis
AVIPRTRLAFVGALGPWGPLATPDI

SEQ ID NO: 195381 - protein, 18 aa, Mycobacterium bovis
CALADAFELEEFGVVGHS

SEQ ID NO: 195382 - protein, 17 aa, Mycobacterium bovis
DAGDEWEAFLGKDDDLY

SEQ ID NO: 195383 - protein, 18 aa, Mycobacterium bovis
DAPCEPVPIRTPLAETVG

SEQ ID NO: 195384 - protein, 22 aa, Mycobacterium bovis
DCTGLLPLASVAAMQGRIAMYH

SEQ ID NO: 195385 - protein, 25 aa, Mycobacterium bovis
DEQMSALLMAIVWRGMDRGEIARWT

SEQ ID NO: 195386 - protein, 19 aa, Mycobacterium bovis
DGGFQLGRLAAILRDKRIP

SEQ ID NO: 195387 - protein, 21 aa, Mycobacterium bovis
DKRIPLELCPSSNVQTGAVAS

SEQ ID NO: 195388 - protein, 28 aa, Mycobacterium bovis
DRLGCGCGRADCAAGKRPAAPPVVIHLI

SEQ ID NO: 195389 - protein, 18 aa, Mycobacterium bovis
EHRSCAKAQALVAERGFE

SEQ ID NO: 195390 - protein, 17 aa, Mycobacterium bovis
EIARWTAAMLASGARLD

SEQ ID NO: 195391 - protein, 21 aa, Mycobacterium bovis
ELKPDPWLADVCREEMQRLGR

SEQ ID NO: 195392 - protein, 21 aa, Mycobacterium bovis
ELQTRMFACFAAGALAAGCEY

SEQ ID NO: 195393 - protein, 24 aa, Mycobacterium bovis
EPMTARFLSVVLRRIRGMRSDTRE

SEQ ID NO: 195394 - protein, 25 aa, Mycobacterium bovis
FGAARAELAGGWSIRDSPPQVRPLI

SEQ ID NO: 195395 - protein, 24 aa, Mycobacterium bovis
FRAALRELTLLLIYEATRDAPCEP

SEQ ID NO: 195396 - protein, 19 aa, Mycobacterium bovis
FVKIFCRRSTGVVIGGVVV

SEQ ID NO: 195397 - protein, 17 aa, Mycobacterium bovis
GADRLGCGCGRADCAAG

SEQ ID NO: 195398 - protein, 23 aa, Mycobacterium bovis
GDRDFWLQVGIDPIQIMTGTATF

SEQ ID NO: 195399 - protein, 17 aa, Mycobacterium bovis
GGNAGAGGTGFTQGADG

SEQ ID NO: 195400 - protein, 23 aa, Mycobacterium bovis
GGRLSDAAIDWVVKAYTDGRVAD

SEQ ID NO: 195401 - protein, 25 aa, Mycobacterium bovis
GLRTELRRAPHLGFHIDFDDAKISL

SEQ ID NO: 195402 - protein, 24 aa, Mycobacterium bovis
GSALLFPSLCHFSGGIPAPEADPP

SEQ ID NO: 195403 - protein, 19 aa, Mycobacterium bovis
GSGPLVVGVCAEYDALPGI

SEQ ID NO: 195404 - protein, 24 aa, Mycobacterium bovis
GVTRFKSEAAFACHAAVAPIPVWS

SEQ ID NO: 195405 - protein, 17 aa, Mycobacterium bovis
HAAVAPHLGVNAADAVT

SEQ ID NO: 195406 - protein, 17 aa, Mycobacterium bovis
HACGHNIIAASAVGTAL

SEQ ID NO: 195407 - protein, 21 aa, Mycobacterium bovis
HATAIMWAREQFGLELIWGIE

SEQ ID NO: 195408 - protein, 25 aa, Mycobacterium bovis
HDVAVVLGSGWLPAVAALGSPTTVL

SEQ ID NO: 195409 - protein, 20 aa, Mycobacterium bovis
HPFDLLARARFRVTVNTDNR

SEQ ID NO: 195410 - protein, 27 aa, Mycobacterium bovis
HTKRLASPAQRIMLFANDRGCTKPGCD

SEQ ID NO: 195411 - protein, 17 aa, Mycobacterium bovis
IGAHRVLVLAGRIHAYE

SEQ ID NO: 195412 - protein, 22 aa, Mycobacterium bovis
KPTAPYAAAVREWEKLERFVES

SEQ ID NO: 195413 - protein, 24 aa, Mycobacterium bovis
KRAALRCLKRRLARTVFQALRTVH

SEQ ID NO: 195414 - protein, 18 aa, Mycobacterium bovis
LAASRLRYARAMRERLPK

SEQ ID NO: 195415 - protein, 27 aa, Mycobacterium bovis
LEESFAERGVRLFKNARAASVTRTGAG

SEQ ID NO: 195416 - protein, 17 aa, Mycobacterium bovis
LLISRGAADITVLCVVA

SEQ ID NO: 195417 - protein, 26 aa, Mycobacterium bovis
LRDGTAMDRFRWLVAAQGGDLSKPLP

SEQ ID NO: 195418 - protein, 17 aa, Mycobacterium bovis
LSMGVQVIAGRGELIDS

SEQ ID NO: 195419 - protein, 20 aa, Mycobacterium bovis
LVKTFWGWRDQQLPDGTLIL

SEQ ID NO: 195420 - protein, 24 aa, Mycobacterium bovis
LVSTAAADAARIGSAINTANTAAA

SEQ ID NO: 195421 - protein, 17 aa, Mycobacterium bovis
MGVQVIAGRGELIDSTP

SEQ ID NO: 195422 - protein, 20 aa, Mycobacterium bovis
NAGAGGTGFTQGADGNAGNG

SEQ ID NO: 195423 - protein, 28 aa, Mycobacterium bovis
NARFTIHAGEAFGLPSIHEAIAFCGADR

SEQ ID NO: 195424 - protein, 18 aa, Mycobacterium bovis
PATVLDIAGQVGYDDLPA

SEQ ID NO: 195425 - protein, 18 aa, Mycobacterium bovis
PELAFAEHRSCAKAQALV

SEQ ID NO: 195426 - protein, 19 aa, Mycobacterium bovis
PELLACLQRLEVERRRQGA

SEQ ID NO: 195427 - protein, 21 aa, Mycobacterium bovis
PELPVGVRLIFQAAEELMPGG

SEQ ID NO: 195428 - protein, 18 aa, Mycobacterium bovis
PPAVAPWPGPTGERADWW

SEQ ID NO: 195429 - protein, 18 aa, Mycobacterium bovis
PVTIPGFAINPFGLNVPL

SEQ ID NO: 195430 - protein, 23 aa, Mycobacterium bovis
QAISALLLPLAIEHTLQYRRGVP

SEQ ID NO: 195431 - protein, 27 aa, Mycobacterium bovis
QLVALGELFAYRWSRCGGREEWVMDTM

SEQ ID NO: 195432 - protein, 23 aa, Mycobacterium bovis
QVEKEAFALLALQHPVSGELREI

SEQ ID NO: 195433 - protein, 27 aa, Mycobacterium bovis
RCYLDDRPIFLGRNGRISVFGSERALA

SEQ ID NO: 195434 - protein, 25 aa, Mycobacterium bovis
RFAPELHISCGLSFDDVVDTVLTGF

SEQ ID NO: 195435 - protein, 27 aa, Mycobacterium bovis
RLSLSAGDRYTLWAPRWRDAGDEWEAF

SEQ ID NO: 195436 - protein, 24 aa, Mycobacterium bovis
RLTKPPLLVPVLRAGLGMVDEAHA

SEQ ID NO: 195437 - protein, 17 aa, Mycobacterium bovis
RNFRDWPADVCALADAF

SEQ ID NO: 195438 - protein, 18 aa, Mycobacterium bovis
RRAAQVIADRTGIGEHDV

SEQ ID NO: 195439 - protein, 17 aa, Mycobacterium bovis
RRLARTVFQALRTVHQP

SEQ ID NO: 195440 - protein, 22 aa, Mycobacterium bovis
RTSAINRLRWLVHELDPERAPA

SEQ ID NO: 195441 - protein, 19 aa, Mycobacterium bovis
RWNSIAEVIGRSWDDVLAA

SEQ ID NO: 195442 - protein, 22 aa, Mycobacterium bovis
SCAKAQALVAERGFEITTAAGG

SEQ ID NO: 195443 - protein, 20 aa, Mycobacterium bovis
SELILPIAVAVQNRITVNEL

SEQ ID NO: 195444 - protein, 19 aa, Mycobacterium bovis
SPIRLRTVAATVFTRPEIA

SEQ ID NO: 195445 - protein, 17 aa, Mycobacterium bovis
TAGHATAIMWAREQFGL

SEQ ID NO: 195446 - protein, 17 aa, Mycobacterium bovis
TRDAPCEPVPIRTPLAE

SEQ ID NO: 195447 - protein, 17 aa, Mycobacterium bovis
TRKNAHGDTEWLPPPHL

SEQ ID NO: 195448 - protein, 18 aa, Mycobacterium bovis
TVAATVFTRPEIAAVGVP

SEQ ID NO: 195449 - protein, 19 aa, Mycobacterium bovis
VESLPLIASSIMSKKLAEG

SEQ ID NO: 195450 - protein, 26 aa, Mycobacterium bovis
VGLAAWRLGAGRSRPGARVQHGAGVR

SEQ ID NO: 195451 - protein, 18 aa, Mycobacterium bovis
VGVCAEYDALPGIGHACG

SEQ ID NO: 195452 - protein, 17 aa, Mycobacterium bovis
VQVIAGRGELIDSTPGL

SEQ ID NO: 195453 - protein, 18 aa, Mycobacterium bovis
VYVLSGLVDDFADGPDAV

SEQ ID NO: 195454 - protein, 17 aa, Mycobacterium bovis
WEAFLGKDDDLYGFESV

SEQ ID NO: 195455 - protein, 20 aa, Mycobacterium bovis
WPADVCALADAFELEEFGVV

SEQ ID NO: 195456 - protein, 17 aa, Mycobacterium bovis
WTAAMLASGARLDFTDL

SEQ ID NO: 195457 - protein, 17 aa, Mycobacterium bovis
AAADPAAVWATHFPSTD

SEQ ID NO: 195458 - protein, 17 aa, Mycobacterium bovis
AAAEVLAAAGFSVLLLP

SEQ ID NO: 195459 - protein, 17 aa, Mycobacterium bovis
AAGALAAGCEYEIDEAA

SEQ ID NO: 195460 - protein, 26 aa, Mycobacterium bovis
AAGNYAQRLFPGMRVKYVSTEEFTND

SEQ ID NO: 195461 - protein, 20 aa, Mycobacterium bovis
AAMVEKGRRVLLVDLDPQGC

SEQ ID NO: 195462 - protein, 22 aa, Mycobacterium bovis
AARPHVHPVRMIAGAAGLCAVA

SEQ ID NO: 195463 - protein, 20 aa, Mycobacterium bovis
AAYRRRLCRESAKARNVDRV

SEQ ID NO: 195464 - protein, 17 aa, Mycobacterium bovis
AGALVVLVDGELAWFLE

SEQ ID NO: 195465 - protein, 21 aa, Mycobacterium bovis
AGAPEVSGWLDGLRAAKRALV

SEQ ID NO: 195466 - protein, 17 aa, Mycobacterium bovis
AGGEQWCDAEVLRILRR

SEQ ID NO: 195467 - protein, 25 aa, Mycobacterium bovis
AGSGPMLAAAAAWDGLAAELGLAAE

SEQ ID NO: 195468 - protein, 17 aa, Mycobacterium bovis
AHAARPHVHPVRMIAGA

SEQ ID NO: 195469 - protein, 23 aa, Mycobacterium bovis
AHRRAHGLPAISLGWGLWDQASA

SEQ ID NO: 195470 - protein, 18 aa, Mycobacterium bovis
AIDAERWLAEHAATGEAD

SEQ ID NO: 195471 - protein, 18 aa, Mycobacterium bovis
AKQPKFEFNHVINNDDVA

SEQ ID NO: 195472 - protein, 20 aa, Mycobacterium bovis
ALEVSGRLLLAGSSRRLAWW

SEQ ID NO: 195473 - protein, 24 aa, Mycobacterium bovis
ALPEEFRMAVYYADVEGFPYKEIA

SEQ ID NO: 195474 - protein, 19 aa, Mycobacterium bovis
AMYLCRELTDLSLPKIGQA

SEQ ID NO: 195475 - protein, 24 aa, Mycobacterium bovis
ARVALRAGFAFVRRICEQDGTVFD

SEQ ID NO: 195476 - protein, 27 aa, Mycobacterium bovis
AVRPRSCAALPRILRDNGYVTGAFGKW

SEQ ID NO: 195477 - protein, 17 aa, Mycobacterium bovis
AVTEIRAALTALGMLDH

SEQ ID NO: 195478 - protein, 23 aa, Mycobacterium bovis
AYARRILGWRVASTMATSMVLDA

SEQ ID NO: 195479 - protein, 24 aa, Mycobacterium bovis
AYKTGRGSIRMRGVVEVEEDSRGR

SEQ ID NO: 195480 - protein, 22 aa, Mycobacterium bovis
CAREVAEVVAPVLGWTAADIDR

SEQ ID NO: 195481 - protein, 17 aa, Mycobacterium bovis
CGHMGPPADPECALDTL

SEQ ID NO: 195482 - protein, 24 aa, Mycobacterium bovis
CNRCPVTTECLSWALNTGQDSGVW

SEQ ID NO: 195483 - protein, 18 aa, Mycobacterium bovis
DACAHALLDAISRLPQIP

SEQ ID NO: 195484 - protein, 18 aa, Mycobacterium bovis
DAEFPKFRQLLPTEHTAV

SEQ ID NO: 195485 - protein, 20 aa, Mycobacterium bovis
DEFRASKIMLDRARNNDKIR

SEQ ID NO: 195486 - protein, 19 aa, Mycobacterium bovis
DGGQGWPAAALGPAQRAVA

SEQ ID NO: 195487 - protein, 23 aa, Mycobacterium bovis
DGVLRPLPVTTFDVRRAPAALRY

SEQ ID NO: 195488 - protein, 17 aa, Mycobacterium bovis
DGYEWSQVYEKSEPLGL

SEQ ID NO: 195489 - protein, 25 aa, Mycobacterium bovis
DLMRRLREDPPRRLAGFPATVTDIG

SEQ ID NO: 195490 - protein, 24 aa, Mycobacterium bovis
DLRTRVQTFLARRQLFDPALLAQA

SEQ ID NO: 195491 - protein, 17 aa, Mycobacterium bovis
DPLVVAWPARIRPDGRV

SEQ ID NO: 195492 - protein, 18 aa, Mycobacterium bovis
DPQGCLTFSLGQDPDKLP

SEQ ID NO: 195493 - protein, 17 aa, Mycobacterium bovis
DPSRRTSCLSGLGYPAS

SEQ ID NO: 195494 - protein, 25 aa, Mycobacterium bovis
DRCAVGIPTVSGWRMLSGDETGWLL

SEQ ID NO: 195495 - protein, 17 aa, Mycobacterium bovis
DRHPGWHALRKIAARIT

SEQ ID NO: 195496 - protein, 17 aa, Mycobacterium bovis
DRRRGRLVGALIVDDDS

SEQ ID NO: 195497 - protein, 24 aa, Mycobacterium bovis
DTRAGRRLWVYGRAGQGCRRCGTL

SEQ ID NO: 195498 - protein, 23 aa, Mycobacterium bovis
EAELKAALWELIWAGRVTGDTFA

SEQ ID NO: 195499 - protein, 25 aa, Mycobacterium bovis
EAPARAYNPLFIWGESGLGKTHLLH

SEQ ID NO: 195500 - protein, 21 aa, Mycobacterium bovis
EDAGRCQRGYFIESLGGAQFA

SEQ ID NO: 195501 - protein, 23 aa, Mycobacterium bovis
EDSRGRTSLVITELPYQVNHDNF

SEQ ID NO: 195502 - protein, 25 aa, Mycobacterium bovis
EDVELATARWVDWFNHRRLYQYCGD

SEQ ID NO: 195503 - protein, 17 aa, Mycobacterium bovis
EEVRNCFADMAKVAIAL

SEQ ID NO: 195504 - protein, 26 aa, Mycobacterium bovis
EFEKEAWLSMVMLEWGSCGQVATAVP

SEQ ID NO: 195505 - protein, 19 aa, Mycobacterium bovis
EGIAWRFRTGSPWRDLPAE

SEQ ID NO: 195506 - protein, 24 aa, Mycobacterium bovis
ELIEAIKLVALVADRGAQVRMEFA

SEQ ID NO: 195507 - protein, 21 aa, Mycobacterium bovis
ELRERAVRMVAEIRGQHDSEW

SEQ ID NO: 195508 - protein, 24 aa, Mycobacterium bovis
EPLQRPGRRRVLTIANQKGGVGKT

SEQ ID NO: 195509 - protein, 22 aa, Mycobacterium bovis
EQMWAADVAAMVGYHGGASAAA

SEQ ID NO: 195510 - protein, 20 aa, Mycobacterium bovis
EQQWLPRIAAHLGVASPVPV

SEQ ID NO: 195511 - protein, 19 aa, Mycobacterium bovis
ERIKALIGTKCRGDRAPEG

SEQ ID NO: 195512 - protein, 25 aa, Mycobacterium bovis
ETMVKAYAGFRSFRHGTNLKAWLYR

SEQ ID NO: 195513 - protein, 19 aa, Mycobacterium bovis
EVEIKRDGYEWSQVYEKSE

SEQ ID NO: 195514 - protein, 18 aa, Mycobacterium bovis
EVLDALQELTRLAVHQKT

SEQ ID NO: 195515 - protein, 22 aa, Mycobacterium bovis
EVLRILRRRSLAALRAQAEPVS

SEQ ID NO: 195516 - protein, 25 aa, Mycobacterium bovis
EVPGAMARLGVWSGDGLQLDLHQPT

SEQ ID NO: 195517 - protein, 20 aa, Mycobacterium bovis
FDKPYLLAMANAGPGTNGSQ

SEQ ID NO: 195518 - protein, 19 aa, Mycobacterium bovis
FRESAARALLLPRRHPGRR

SEQ ID NO: 195519 - protein, 20 aa, Mycobacterium bovis
FTAPHFASAWAHASNTPLQW

SEQ ID NO: 195520 - protein, 17 aa, Mycobacterium bovis
FVSGVLPTAPVSAVADP

SEQ ID NO: 195521 - protein, 21 aa, Mycobacterium bovis
FVWPRFRRRGLARGLLSTLAR

SEQ ID NO: 195522 - protein, 20 aa, Mycobacterium bovis
GAIGRHIHDPYALYDALAQE

SEQ ID NO: 195523 - protein, 18 aa, Mycobacterium bovis
GCRMGICQSCVVDLVEGH

SEQ ID NO: 195524 - protein, 23 aa, Mycobacterium bovis
GDPSVDLIIAWNLLSAPARAQFR

SEQ ID NO: 195525 - protein, 17 aa, Mycobacterium bovis
GDTEWLPPPHLDHGQPR

SEQ ID NO: 195526 - protein, 17 aa, Mycobacterium bovis
GDTFAPVRAVLGGAGTR

SEQ ID NO: 195527 - protein, 29 aa, Mycobacterium bovis
GEISRGVLFPKHRTDLLGCAVSVQRMLAG

SEQ ID NO: 195528 - protein, 23 aa, Mycobacterium bovis
GESFGARRRLALSTVGASGATAG

SEQ ID NO: 195529 - protein, 21 aa, Mycobacterium bovis
GGKVTAWRYIRAAVRAVLACT

SEQ ID NO: 195530 - protein, 20 aa, Mycobacterium bovis
GGLTPILCLTKTDLAPAEPF

SEQ ID NO: 195531 - protein, 24 aa, Mycobacterium bovis
GNTEVKSFVQKVCNEQLTHWFEAN

SEQ ID NO: 195532 - protein, 27 aa, Mycobacterium bovis
GPDELKARFSRPLAFGTAGLRGHLRGG

SEQ ID NO: 195533 - protein, 26 aa, Mycobacterium bovis
GQQVGPRVARRFGRVLLELGGNNAAI

SEQ ID NO: 195534 - protein, 17 aa, Mycobacterium bovis
GQVIGCGRTTRQINRRL

SEQ ID NO: 195535 - protein, 18 aa, Mycobacterium bovis
GRPDRRITAMRARELGRT

SEQ ID NO: 195536 - protein, 25 aa, Mycobacterium bovis
GRVRSQFTHCIDIAPTVLAAIGLPE

SEQ ID NO: 195537 - protein, 19 aa, Mycobacterium bovis
GRWGCVLGGRPDRRITAMR

SEQ ID NO: 195538 - protein, 24 aa, Mycobacterium bovis
GSDAWKAYMRRATNTVNYSSELPL

SEQ ID NO: 195539 - protein, 20 aa, Mycobacterium bovis
GSWLTMIRLAKCGPWHRGGW

SEQ ID NO: 195540 - protein, 22 aa, Mycobacterium bovis
HFFVCSTHDLILFFTTQGRVYR

SEQ ID NO: 195541 - protein, 18 aa, Mycobacterium bovis
HGDLSRFNILTAQGRLTG

SEQ ID NO: 195542 - protein, 23 aa, Mycobacterium bovis
HGGLRYLEQLEFGLVREALYERE

SEQ ID NO: 195543 - protein, 24 aa, Mycobacterium bovis
HGTNLKAWLYRILTNTYINSYRKK

SEQ ID NO: 195544 - protein, 19 aa, Mycobacterium bovis
HLEACPGCLRHYGLEERIK

SEQ ID NO: 195545 - protein, 18 aa, Mycobacterium bovis
HNPFRVFTSMLAIEDRRY

SEQ ID NO: 195546 - protein, 25 aa, Mycobacterium bovis
HPYFPRLRLELDKGLGWKAEVEAAL

SEQ ID NO: 195547 - protein, 23 aa, Mycobacterium bovis
HRDRTCVVPGCGATRGLHAHHIR

SEQ ID NO: 195548 - protein, 24 aa, Mycobacterium bovis
HRLLETWHPLGVVGVITAFNFPVA

SEQ ID NO: 195549 - protein, 19 aa, Mycobacterium bovis
HRVGFGSVCEFPGPYPGYS

SEQ ID NO: 195550 - protein, 24 aa, Mycobacterium bovis
HTNRGDIKIALFGNHAPKTVANFV

SEQ ID NO: 195551 - protein, 17 aa, Mycobacterium bovis
IAAALAVQGLKTLVIDL

SEQ ID NO: 195552 - protein, 17 aa, Mycobacterium bovis
IALRADMDALPMAERTG

SEQ ID NO: 195553 - protein, 20 aa, Mycobacterium bovis
IASNTLWPRTMVATAAVQNL

SEQ ID NO: 195554 - protein, 26 aa, Mycobacterium bovis
ICGPETLRSLYFLSSRVSGGSPHAIR

SEQ ID NO: 195555 - protein, 21 aa, Mycobacterium bovis
IDERALAIGLRVMVNIIEQAA

SEQ ID NO: 195556 - protein, 18 aa, Mycobacterium bovis
IDIAPTVLAAIGLPEPTH

SEQ ID NO: 195557 - protein, 23 aa, Mycobacterium bovis
IDIDARPAVLLVIPADTPDKLAV

SEQ ID NO: 195558 - protein, 24 aa, Mycobacterium bovis
IIGRIKDLLIVYGRNHSPDDIEAT

SEQ ID NO: 195559 - protein, 28 aa, Mycobacterium bovis
ILLEKKWLRPTAYMMAKYGMTLCALGIA

SEQ ID NO: 195560 - protein, 23 aa, Mycobacterium bovis
IQREVVARTGLRDCRVHGRTWDL

SEQ ID NO: 195561 - protein, 22 aa, Mycobacterium bovis
IRLAKCGPWHRGGWDPIPEGLT

SEQ ID NO: 195562 - protein, 26 aa, Mycobacterium bovis
ITEVPMKRFDLMNGIQVRGTYAVSQA

SEQ ID NO: 195563 - protein, 18 aa, Mycobacterium bovis
IVATETFAPILYVLTYDD

SEQ ID NO: 195564 - protein, 19 aa, Mycobacterium bovis
IVGAKGKAALLRELSDVVP

SEQ ID NO: 195565 - protein, 23 aa, Mycobacterium bovis
IVRRPAIAAVRAEYERVVRQRTA

SEQ ID NO: 195566 - protein, 25 aa, Mycobacterium bovis
KFADEFHPELQFDKPYLLAMANAGP

SEQ ID NO: 195567 - protein, 17 aa, Mycobacterium bovis
KHARRCVFWEVDPAILG

SEQ ID NO: 195568 - protein, 20 aa, Mycobacterium bovis
KIGQAFGRDHTTVMYAQRKI

SEQ ID NO: 195569 - protein, 18 aa, Mycobacterium bovis
KLSGKRIIIDPGRGGVDH

SEQ ID NO: 195570 - protein, 31 aa, Mycobacterium bovis
KPVLVDFWATWCGPCKMVAPVLEEIATERAT

SEQ ID NO: 195571 - protein, 17 aa, Mycobacterium bovis
KRIVGAKGKAALLRELS

SEQ ID NO: 195572 - protein, 24 aa, Mycobacterium bovis
KRWWERPYIAAGIFLYDRLGGAKS

SEQ ID NO: 195573 - protein, 18 aa, Mycobacterium bovis
KSLPAVLRVTARTSSGVI

SEQ ID NO: 195574 - protein, 26 aa, Mycobacterium bovis
KTGVWSRLMLDIARWRRRRREELAAL

SEQ ID NO: 195575 - protein, 17 aa, Mycobacterium bovis
KYGMTLCALGIAEEMRA

SEQ ID NO: 195576 - protein, 21 aa, Mycobacterium bovis
LAAAAARAGGAAVQAKAVAGA

SEQ ID NO: 195577 - protein, 18 aa, Mycobacterium bovis
LAAESFGLVTSGLAGGSG

SEQ ID NO: 195578 - protein, 17 aa, Mycobacterium bovis
LAARLLAALAARRDAEL

SEQ ID NO: 195579 - protein, 25 aa, Mycobacterium bovis
LAAVADLFAAFGMLPVGYYDLRTAE

SEQ ID NO: 195580 - protein, 17 aa, Mycobacterium bovis
LAIARPDLQVVLLEPLL

SEQ ID NO: 195581 - protein, 19 aa, Mycobacterium bovis
LAVGRRLRDRYGIDEKPTA

SEQ ID NO: 195582 - protein, 18 aa, Mycobacterium bovis
LDGSLGMRDARERGTDVV

SEQ ID NO: 195583 - protein, 19 aa, Mycobacterium bovis
LDKLTKWSMPLIRPNGRML

SEQ ID NO: 195584 - protein, 18 aa, Mycobacterium bovis
LEAVRKRPGMYIGSTGER

SEQ ID NO: 195585 - protein, 19 aa, Mycobacterium bovis
LELAVRCIVFAAAGTAGQR

SEQ ID NO: 195586 - protein, 18 aa, Mycobacterium bovis
LETLYLIDRIPAWSTNLS

SEQ ID NO: 195587 - protein, 18 aa, Mycobacterium bovis
LGFYTGLVDGHFGLQTHN

SEQ ID NO: 195588 - protein, 19 aa, Mycobacterium bovis
LHHTYSFLGVETYRQVSSE

SEQ ID NO: 195589 - protein, 23 aa, Mycobacterium bovis
LIDCGERWAVFNAGMGVDAEVVA

SEQ ID NO: 195590 - protein, 24 aa, Mycobacterium bovis
LLGALPFDVSRPAALMVPDGVLRA

SEQ ID NO: 195591 - protein, 17 aa, Mycobacterium bovis
LPGVLSRRIDPRNSTVL

SEQ ID NO: 195592 - protein, 19 aa, Mycobacterium bovis
LPQTVPLAFTSYAGMDIGR

SEQ ID NO: 195593 - protein, 17 aa, Mycobacterium bovis
LRAPITDALSRRLGHQI

SEQ ID NO: 195594 - protein, 17 aa, Mycobacterium bovis
LREFSAKAGRQVFKDYV

SEQ ID NO: 195595 - protein, 23 aa, Mycobacterium bovis
LSAGHARALLSLEAGPEAQEELA

SEQ ID NO: 195596 - protein, 18 aa, Mycobacterium bovis
LTRMPTVQVDIGYITNPH

SEQ ID NO: 195597 - protein, 18 aa, Mycobacterium bovis
LVGWRRHIHRYPELGRQE

SEQ ID NO: 195598 - protein, 19 aa, Mycobacterium bovis
MGRATSGVQGMRFNIDDRL

SEQ ID NO: 195599 - protein, 21 aa, Mycobacterium bovis
MLLMRAGREYALKRALAKFSD

SEQ ID NO: 195600 - protein, 31 aa, Mycobacterium bovis
MSRSSPRAGDGFIRLDVDGVVSYASPNALSA

SEQ ID NO: 195601 - protein, 20 aa, Mycobacterium bovis
NEIHAARCGIELAPDTNQQV

SEQ ID NO: 195602 - protein, 19 aa, Mycobacterium bovis
NELCFVSGVLPTAPVSAVA

SEQ ID NO: 195603 - protein, 20 aa, Mycobacterium bovis
NFNAGPALRFMSGNLCHQIE

SEQ ID NO: 195604 - protein, 26 aa, Mycobacterium bovis
PAEGFGWPWSVCRWVAGENPSAAEFV

SEQ ID NO: 195605 - protein, 17 aa, Mycobacterium bovis
PAPPRRKPIQMPGLQDV

SEQ ID NO: 195606 - protein, 21 aa, Mycobacterium bovis
PEGFLSTHLVAGVKPGTIVRL

SEQ ID NO: 195607 - protein, 19 aa, Mycobacterium bovis
PGDVISLGATSWRITEITH

SEQ ID NO: 195608 - protein, 24 aa, Mycobacterium bovis
PGILRVRFGEVEARGVALTPRGRE

SEQ ID NO: 195609 - protein, 20 aa, Mycobacterium bovis
PHPKLPGTVFTAAKELEEAG

SEQ ID NO: 195610 - protein, 29 aa, Mycobacterium bovis
PHSPMAGTGWLPGWRLTFGGEDIGWEGAL

SEQ ID NO: 195611 - protein, 22 aa, Mycobacterium bovis
PISEADLLWDLASRLEGRMAAI

SEQ ID NO: 195612 - protein, 20 aa, Mycobacterium bovis
PNRDPITGVHFVFVSNSSPW

SEQ ID NO: 195613 - protein, 19 aa, Mycobacterium bovis
PRIAAHLGVASPVPVGLGS

SEQ ID NO: 195614 - protein, 20 aa, Mycobacterium bovis
PRNSTVLVWGAVNAGMAANA

SEQ ID NO: 195615 - protein, 18 aa, Mycobacterium bovis
PTGTFTFAELLAHELSVE

SEQ ID NO: 195616 - protein, 21 aa, Mycobacterium bovis
PVEQRAAVVAVDMQGYSIADT

SEQ ID NO: 195617 - protein, 19 aa, Mycobacterium bovis
QAIGVAFGATVDRAPELLH

SEQ ID NO: 195618 - protein, 25 aa, Mycobacterium bovis
QEPTVLPSRFPNLLANGSGGIAVGM

SEQ ID NO: 195619 - protein, 19 aa, Mycobacterium bovis
QMDGSWRVGNRPVRVDHRA

SEQ ID NO: 195620 - protein, 24 aa, Mycobacterium bovis
QTVAALLRLQARRTSNAEGREALI

SEQ ID NO: 195621 - protein, 22 aa, Mycobacterium bovis
QTVWKRHHRWSLDGTCDEVFAH

SEQ ID NO: 195622 - protein, 17 aa, Mycobacterium bovis
QVVSIPTLILFKDGQPV

SEQ ID NO: 195623 - protein, 18 aa, Mycobacterium bovis
QYGKTWRTLAKLSLPDKY

SEQ ID NO: 195624 - protein, 21 aa, Mycobacterium bovis
RAGQGCRRCGTLIAYDTTDER

SEQ ID NO: 195625 - protein, 20 aa, Mycobacterium bovis
RALAKFSDRFDVVIIDCPPS

SEQ ID NO: 195626 - protein, 23 aa, Mycobacterium bovis
RALKEASYRLGARTLYHQFGAPL

SEQ ID NO: 195627 - protein, 22 aa, Mycobacterium bovis
RDFRSWACVDLELHPGRTVFVG

SEQ ID NO: 195628 - protein, 25 aa, Mycobacterium bovis
RGVSSCATCDGFFFRDQDIAVIGGG

SEQ ID NO: 195629 - protein, 17 aa, Mycobacterium bovis
RHLRAPITDALSRRLGH

SEQ ID NO: 195630 - protein, 17 aa, Mycobacterium bovis
RKGKIVVEFGSVDDLAR

SEQ ID NO: 195631 - protein, 23 aa, Mycobacterium bovis
RLLKLPIPVQRRVAAGVLSAGHA

SEQ ID NO: 195632 - protein, 25 aa, Mycobacterium bovis
RNVWSNAVIFCGHFPDGAEKFTKTD

SEQ ID NO: 195633 - protein, 18 aa, Mycobacterium bovis
RRHIHRYPELGRQEYATT

SEQ ID NO: 195634 - protein, 19 aa, Mycobacterium bovis
RRIDPRNSTVLVWGAVNAG

SEQ ID NO: 195635 - protein, 20 aa, Mycobacterium bovis
RRLAGFPATVTDIGDTLILT

SEQ ID NO: 195636 - protein, 17 aa, Mycobacterium bovis
RRLAWWTGALTLGVAKI

SEQ ID NO: 195637 - protein, 18 aa, Mycobacterium bovis
RRNDGVLVCVAQCRPNTG

SEQ ID NO: 195638 - protein, 18 aa, Mycobacterium bovis
RRQLGWSQQAPRLFHYRD

SEQ ID NO: 195639 - protein, 30 aa, Mycobacterium bovis
RRSPHSERLFCIPATIDLAGAEIELVSMVA

SEQ ID NO: 195640 - protein, 21 aa, Mycobacterium bovis
RSRPLITNMIRLLKLPIPVQR

SEQ ID NO: 195641 - protein, 21 aa, Mycobacterium bovis
RSVAGLVAWKMGCSSGNAHTI

SEQ ID NO: 195642 - protein, 17 aa, Mycobacterium bovis
RTLRLDQLIRYYVDHQL

SEQ ID NO: 195643 - protein, 17 aa, Mycobacterium bovis
RTVRPWFDRLLAADDPF

SEQ ID NO: 195644 - protein, 24 aa, Mycobacterium bovis
RVGLRIVIEIKRDAVAKVVINNLY

SEQ ID NO: 195645 - protein, 25 aa, Mycobacterium bovis
RVKGPDFPTAGLIVGSQGTADAYKT

SEQ ID NO: 195646 - protein, 25 aa, Mycobacterium bovis
RVLPLLGGLAVMFGDLPPLPTTARF

SEQ ID NO: 195647 - protein, 20 aa, Mycobacterium bovis
RVPPYAGPPMWFHGDLSRFN

SEQ ID NO: 195648 - protein, 18 aa, Mycobacterium bovis
RWSALPLPEPDSTLRAHY

SEQ ID NO: 195649 - protein, 18 aa, Mycobacterium bovis
SAKAGRQVFKDYVAFPAL

SEQ ID NO: 195650 - protein, 24 aa, Mycobacterium bovis
SATLFIKPGWGFSFDYQPGQYIGI

SEQ ID NO: 195651 - protein, 20 aa, Mycobacterium bovis
SDHRLILEGIAWRFRTGSPW

SEQ ID NO: 195652 - protein, 28 aa, Mycobacterium bovis
SGPFYDGAVFHRVIQGFMIQGGDPTGTG

SEQ ID NO: 195653 - protein, 25 aa, Mycobacterium bovis
SGTEPKLKCYLEIRCAVTGDLPAAR

SEQ ID NO: 195654 - protein, 21 aa, Mycobacterium bovis
SPFAASLLFGYVGAFMYEGDT

SEQ ID NO: 195655 - protein, 24 aa, Mycobacterium bovis
SRAIYKDGWWACARLDKAPWDLSP

SEQ ID NO: 195656 - protein, 27 aa, Mycobacterium bovis
SRRTSCLSGLGYPASTPVLGAQPIDID

SEQ ID NO: 195657 - protein, 19 aa, Mycobacterium bovis
SRSASIGYRASMDVTGPSE

SEQ ID NO: 195658 - protein, 24 aa, Mycobacterium bovis
SYIDYAMSVIVGRALPEVRDGLKP

SEQ ID NO: 195659 - protein, 21 aa, Mycobacterium bovis
TEARLTPLAMEMLREIDEETV

SEQ ID NO: 195660 - protein, 23 aa, Mycobacterium bovis
TEFAELRPRLVYDRDTGTLTARP

SEQ ID NO: 195661 - protein, 18 aa, Mycobacterium bovis
TFAPILYVLTYDDLDEAI

SEQ ID NO: 195662 - protein, 21 aa, Mycobacterium bovis
TFHYPGGLVDFVKHINRTKNA

SEQ ID NO: 195663 - protein, 25 aa, Mycobacterium bovis
TGQLRARFAAGLSAMYAAEVPAYGT

SEQ ID NO: 195664 - protein, 20 aa, Mycobacterium bovis
TGSTVRFWADPAVFETTEYD

SEQ ID NO: 195665 - protein, 23 aa, Mycobacterium bovis
THGHTEWLPPPHLDHGQPRTNTF

SEQ ID NO: 195666 - protein, 25 aa, Mycobacterium bovis
TLEDRLRTRFEWGLITDVQPPELET

SEQ ID NO: 195667 - protein, 18 aa, Mycobacterium bovis
TLTGFKWLARADANLPGT

SEQ ID NO: 195668 - protein, 25 aa, Mycobacterium bovis
TLVRMAQPWSLRYPLVDGQGNFGSP

SEQ ID NO: 195669 - protein, 26 aa, Mycobacterium bovis
TRDQRWKRYNIFNVVWNTILAIGFEW

SEQ ID NO: 195670 - protein, 19 aa, Mycobacterium bovis
TWDLLRLTRMPTVQVDIGY

SEQ ID NO: 195671 - protein, 24 aa, Mycobacterium bovis
VANADFMGGFALWVDEQRHLHHTY

SEQ ID NO: 195672 - protein, 17 aa, Mycobacterium bovis
VASTMATSMVLDAIEQA

SEQ ID NO: 195673 - protein, 22 aa, Mycobacterium bovis
VEHCIIDANFLMDVGFVVVAPH

SEQ ID NO: 195674 - protein, 17 aa, Mycobacterium bovis
VELMARIAQRRVRVAEA

SEQ ID NO: 195675 - protein, 19 aa, Mycobacterium bovis
VHGPLALAVGRRLRDRYGI

SEQ ID NO: 195676 - protein, 17 aa, Mycobacterium bovis
VIAELRRQLGWSQQAPR

SEQ ID NO: 195677 - protein, 24 aa, Mycobacterium bovis
VIIHGWLAFTFELCRQRIMDPSTD

SEQ ID NO: 195678 - protein, 21 aa, Mycobacterium bovis
VIKMVLAMRHELLPATLHVDV

SEQ ID NO: 195679 - protein, 24 aa, Mycobacterium bovis
VITAFNFPVAVWAWNTAVALVCGD

SEQ ID NO: 195680 - protein, 19 aa, Mycobacterium bovis
VKKAYQLLAPESRSASIGY

SEQ ID NO: 195681 - protein, 19 aa, Mycobacterium bovis
VNACLDRLRRAKAHPTAPL

SEQ ID NO: 195682 - protein, 17 aa, Mycobacterium bovis
VRALEAFGRTPAATDLQ

SEQ ID NO: 195683 - protein, 19 aa, Mycobacterium bovis
VRDGLKPVHRRVLYAMFDS

SEQ ID NO: 195684 - protein, 18 aa, Mycobacterium bovis
VRETMTFRAVPDALAVVA

SEQ ID NO: 195685 - protein, 18 aa, Mycobacterium bovis
VREVCDRYDLPYTTGSFL

SEQ ID NO: 195686 - protein, 20 aa, Mycobacterium bovis
VSLGKRKGKIVVEFGSVDDL

SEQ ID NO: 195687 - protein, 22 aa, Mycobacterium bovis
VSWSNPNDWWLVRLLGSITPTE

SEQ ID NO: 195688 - protein, 23 aa, Mycobacterium bovis
VVAAAPYAGWLAAAAARAGGAAV

SEQ ID NO: 195689 - protein, 26 aa, Mycobacterium bovis
VVAANRSAFVQLVLSNVFGQNAPAIA

SEQ ID NO: 195690 - protein, 34 aa, Mycobacterium bovis
VVGEWQLLADLSFADYLMWVRRNDGVLVCVAQCR

SEQ ID NO: 195691 - protein, 23 aa, Mycobacterium bovis
VWNTILAIGFEWGVALQHLEIGK

SEQ ID NO: 195692 - protein, 26 aa, Mycobacterium bovis
WKPSELTPLTALACQALLSRAAADVG

SEQ ID NO: 195693 - protein, 19 aa, Mycobacterium bovis
WLHRIVVNACLDRLRRAKA

SEQ ID NO: 195694 - protein, 21 aa, Mycobacterium bovis
WRSTPAPVRGALVARLGELLT

SEQ ID NO: 195695 - protein, 18 aa, Mycobacterium bovis
WRYIRAAVRAVLACTRRE

SEQ ID NO: 195696 - protein, 25 aa, Mycobacterium bovis
WSARELRGRILGVRRETEDSATLFI

SEQ ID NO: 195697 - protein, 19 aa, Mycobacterium bovis
WSLAGRSVFEHRAVVVGGD

SEQ ID NO: 195698 - protein, 26 aa, Mycobacterium bovis
WSLAVALRLAAYQLLRVDGGEPVLLL

SEQ ID NO: 195699 - protein, 19 aa, Mycobacterium bovis
WTNPDCRFESGLGVFATTS

SEQ ID NO: 195700 - protein, 18 aa, Mycobacterium bovis
WVNRFRWNRCTTGDTRAG

SEQ ID NO: 195701 - protein, 19 aa, Mycobacterium bovis
YGAALPWPASSADGTARPG

SEQ ID NO: 195702 - protein, 26 aa, Mycobacterium bovis
YIGIGLLVDGCWRWRSYSLTSSPAAS

SEQ ID NO: 195703 - protein, 18 aa, Mycobacterium bovis
YIQRAAGVRRCAGSVRVA

SEQ ID NO: 195704 - protein, 17 aa, Mycobacterium bovis
AAAAGARQVVILAAGLD

SEQ ID NO: 195705 - protein, 17 aa, Mycobacterium bovis
AAAAGELASIRSAINAA

SEQ ID NO: 195706 - protein, 18 aa, Mycobacterium bovis
AAAAPYVTWMSGTSAQAK

SEQ ID NO: 195707 - protein, 23 aa, Mycobacterium bovis
AAAAVPYVAWMRATAASAEQAAA

SEQ ID NO: 195708 - protein, 33 aa, Mycobacterium bovis
AAAAWPGVERTWLDGWLLRAGHGAVLAANSAVP

SEQ ID NO: 195709 - protein, 17 aa, Mycobacterium bovis
AAACWRPVLQGRDVVAM

SEQ ID NO: 195710 - protein, 19 aa, Mycobacterium bovis
AAADCLARAVLAGVLNAQP

SEQ ID NO: 195711 - protein, 26 aa, Mycobacterium bovis
AAADEIAELLLKWKKTPQRPVSLPLQ

SEQ ID NO: 195712 - protein, 32 aa, Mycobacterium bovis
AAADEVSTAVAALFSQHAQGYQAAAAQVAAFH

SEQ ID NO: 195713 - protein, 26 aa, Mycobacterium bovis
AAADEVSTAVAALFSSHAQAYQAASA

SEQ ID NO: 195714 - protein, 32 aa, Mycobacterium bovis
AAADEVSTQIAALFGAHARSYQTLSTQAAAFH

SEQ ID NO: 195715 - protein, 19 aa, Mycobacterium bovis
AAADRLCYSYFRSYGLDVT

SEQ ID NO: 195716 - protein, 25 aa, Mycobacterium bovis
AAAEAEYELMWAADVAAMAGYHSGA

SEQ ID NO: 195717 - protein, 24 aa, Mycobacterium bovis
AAAEAFGTAFAMTVPPSLVAANRS

SEQ ID NO: 195718 - protein, 18 aa, Mycobacterium bovis
AAAEAMYEQMWAADVAAM

SEQ ID NO: 195719 - protein, 19 aa, Mycobacterium bovis
AAAEFDYELMWAQDVAAML

SEQ ID NO: 195720 - protein, 26 aa, Mycobacterium bovis
AAAELGERCAFGLQLIAPRLPPFDVP

SEQ ID NO: 195721 - protein, 27 aa, Mycobacterium bovis
AAAELPRIAGMGFDVVYLPPIHPIGKV

SEQ ID NO: 195722 - protein, 20 aa, Mycobacterium bovis
AAAGKRARDVGVRIVYVVDT

SEQ ID NO: 195723 - protein, 26 aa, Mycobacterium bovis
AAAGKRCPPTAFISGRLPAPPAADVT

SEQ ID NO: 195724 - protein, 25 aa, Mycobacterium bovis
AAAGRAAPRLTVWVPVAVNPGAAAH

SEQ ID NO: 195725 - protein, 25 aa, Mycobacterium bovis
AAAGRPGPVPLALGPVHPGGPTLID

SEQ ID NO: 195726 - protein, 26 aa, Mycobacterium bovis
AAAHGGPHYLCLAIHAMVTDDSSRQI

SEQ ID NO: 195727 - protein, 17 aa, Mycobacterium bovis
AAAHPSLPRGALLQIAV

SEQ ID NO: 195728 - protein, 17 aa, Mycobacterium bovis
AAAHVAGALCLPDAAML

SEQ ID NO: 195729 - protein, 21 aa, Mycobacterium bovis
AAAILSARFGPSVLYGVPNFF

SEQ ID NO: 195730 - protein, 23 aa, Mycobacterium bovis
AAAKAAILASIAFHTRVTADDVY

SEQ ID NO: 195731 - protein, 20 aa, Mycobacterium bovis
AAAKAMGIDKLRVIHTGMDP

SEQ ID NO: 195732 - protein, 18 aa, Mycobacterium bovis
AAALALGTQGAWTGSQWL

SEQ ID NO: 195733 - protein, 18 aa, Mycobacterium bovis
AAALPGVVDIVAASRTVL

SEQ ID NO: 195734 - protein, 27 aa, Mycobacterium bovis
AAANSWVDVFAHWRRAQGLPVSAIAWG

SEQ ID NO: 195735 - protein, 18 aa, Mycobacterium bovis
AAAPLALLAPRARLAGAS

SEQ ID NO: 195736 - protein, 20 aa, Mycobacterium bovis
AAAPYAGWLSAAAARAAGAA

SEQ ID NO: 195737 - protein, 23 aa, Mycobacterium bovis
AAAQRLPFLPIRAGLGSSVPQFW

SEQ ID NO: 195738 - protein, 18 aa, Mycobacterium bovis
AAARARARYACFDHACAD

SEQ ID NO: 195739 - protein, 17 aa, Mycobacterium bovis
AAARYAANPERSIAEAH

SEQ ID NO: 195740 - protein, 24 aa, Mycobacterium bovis
AAASEFRDGLCFVDLAPIADPGMV

SEQ ID NO: 195741 - protein, 18 aa, Mycobacterium bovis
AAASRLAGAYGEHAAAEI

SEQ ID NO: 195742 - protein, 27 aa, Mycobacterium bovis
AAATAWGELAEELLASIASLGSVTSEL

SEQ ID NO: 195743 - protein, 18 aa, Mycobacterium bovis
AAATLDWLQAHGHDDQVR

SEQ ID NO: 195744 - protein, 19 aa, Mycobacterium bovis
AAAVLRFAATEVIPRLAGT

SEQ ID NO: 195745 - protein, 19 aa, Mycobacterium bovis
AAAWRRIRSQVRDWTDLEP

SEQ ID NO: 195746 - protein, 17 aa, Mycobacterium bovis
AACEFKNQVLVKIYNRK

SEQ ID NO: 195747 - protein, 25 aa, Mycobacterium bovis
AACGLRRLIPLYAMVETALAPPPSA

SEQ ID NO: 195748 - protein, 21 aa, Mycobacterium bovis
AADAFEAVRIIARASRVDVTL

SEQ ID NO: 195749 - protein, 31 aa, Mycobacterium bovis
AADALALAICHCWRAPTIARMAEATSRAEAR

SEQ ID NO: 195750 - protein, 24 aa, Mycobacterium bovis
AADDCGFATLWVGEHVVMVDRPAS

SEQ ID NO: 195751 - protein, 22 aa, Mycobacterium bovis
AADELSGLFVPTDVCDEDAVNG

SEQ ID NO: 195752 - protein, 46 aa, Mycobacterium bovis
AADEVSAAMAALFGAHAQEYQRLSAQAAGFHAQFVQALNAGVNSYA

SEQ ID NO: 195753 - protein, 25 aa, Mycobacterium bovis
AADEVSAAMAALFSGHAQAYQALSA

SEQ ID NO: 195754 - protein, 30 aa, Mycobacterium bovis
AADEVSAAVAALFGSYAQSYQAFGAQLSAF

SEQ ID NO: 195755 - protein, 25 aa, Mycobacterium bovis
AADEVSAGIAALFGAQAQSYQAVSA

SEQ ID NO: 195756 - protein, 23 aa, Mycobacterium bovis
AADEVSLLLATQFRTHAATYQTA

SEQ ID NO: 195757 - protein, 20 aa, Mycobacterium bovis
AADFRGWCGEAGFRSFEVIP

SEQ ID NO: 195758 - protein, 25 aa, Mycobacterium bovis
AADGKAKWSAPLGFLAQTPPALTPH

SEQ ID NO: 195759 - protein, 18 aa, Mycobacterium bovis
AADHVWLMSTASYPEMAT

SEQ ID NO: 195760 - protein, 26 aa, Mycobacterium bovis
AADLTNRSTIRWTLHQMVASGVVSVY

SEQ ID NO: 195761 - protein, 17 aa, Mycobacterium bovis
AADVAAMLGYHGEASAV

SEQ ID NO: 195762 - protein, 19 aa, Mycobacterium bovis
AAECRWIRENLGVDVPVHF

SEQ ID NO: 195763 - protein, 25 aa, Mycobacterium bovis
AAEDPRVAGLIARVQLPPSPAGAVQ

SEQ ID NO: 195764 - protein, 24 aa, Mycobacterium bovis
AAEGARLQLLLSRNEIDRAATILA

SEQ ID NO: 195765 - protein, 23 aa, Mycobacterium bovis
AAEGFPSLSCIVLNGGFQLHPAI

SEQ ID NO: 195766 - protein, 18 aa, Mycobacterium bovis
AAEHTQSYVRACHLVGYQ

SEQ ID NO: 195767 - protein, 26 aa, Mycobacterium bovis
AAEILVYGHVPFELVSYVCCYNTETM

SEQ ID NO: 195768 - protein, 17 aa, Mycobacterium bovis
AAELGMAAIYCRDDVGG

SEQ ID NO: 195769 - protein, 24 aa, Mycobacterium bovis
AAEPWEVAATIAFLASDYSSYLTG

SEQ ID NO: 195770 - protein, 17 aa, Mycobacterium bovis
AAERRRYVEVFAAGQGG

SEQ ID NO: 195771 - protein, 22 aa, Mycobacterium bovis
AAEVYKRSLAVFFLSEPPEGFD

SEQ ID NO: 195772 - protein, 20 aa, Mycobacterium bovis
AAFADPYCPTLRAAVTGLPG

SEQ ID NO: 195773 - protein, 18 aa, Mycobacterium bovis
AAFAGRPALLSEMTDDDV

SEQ ID NO: 195774 - protein, 18 aa, Mycobacterium bovis
AAFCDGYAVASGIDPRDS

SEQ ID NO: 195775 - protein, 18 aa, Mycobacterium bovis
AAFEISRDIIAISGDSAT

SEQ ID NO: 195776 - protein, 17 aa, Mycobacterium bovis
AAFEVSQTSRSAPCVLG

SEQ ID NO: 195777 - protein, 17 aa, Mycobacterium bovis
AAFQTVFHVHLHVLPRR

SEQ ID NO: 195778 - protein, 22 aa, Mycobacterium bovis
AAGARFSGGVFACAALAERELT

SEQ ID NO: 195779 - protein, 26 aa, Mycobacterium bovis
AAGDEVSAAIAALFSSHGQQYQAMSA

SEQ ID NO: 195780 - protein, 17 aa, Mycobacterium bovis
AAGEAMMRQALAQLTAA

SEQ ID NO: 195781 - protein, 29 aa, Mycobacterium bovis
AAGGLNWASLPLKLFAGGNAKFWDPADID

SEQ ID NO: 195782 - protein, 22 aa, Mycobacterium bovis
AAGHLPGAVSIPLDELAERLDE

SEQ ID NO: 195783 - protein, 18 aa, Mycobacterium bovis
AAGIGELTFFSKIHYGGG

SEQ ID NO: 195784 - protein, 20 aa, Mycobacterium bovis
AAGIPIRIGVNAGSLDKRFM

SEQ ID NO: 195785 - protein, 24 aa, Mycobacterium bovis
AAGLRSLLAYQWAHPGKQLLFMGQ

SEQ ID NO: 195786 - protein, 18 aa, Mycobacterium bovis
AAGLRVVATIDIGSSVRD

SEQ ID NO: 195787 - protein, 26 aa, Mycobacterium bovis
AAGLSRASSIGALSVPPSWAGQANLV

SEQ ID NO: 195788 - protein, 20 aa, Mycobacterium bovis
AAGLTRSFMAFLIDAYTEDE

SEQ ID NO: 195789 - protein, 18 aa, Mycobacterium bovis
AAGPTMGILAAGADEVSV

SEQ ID NO: 195790 - protein, 21 aa, Mycobacterium bovis
AAGRLRFTTDYDMAADFADVH

SEQ ID NO: 195791 - protein, 24 aa, Mycobacterium bovis
AAGRVAGLIGTIGIRVGGADLPSA

SEQ ID NO: 195792 - protein, 18 aa, Mycobacterium bovis
AAGTPPIYFGFGSTPVQT

SEQ ID NO: 195793 - protein, 23 aa, Mycobacterium bovis
AAGVCFPDLLLTKGEYQLKLTPP

SEQ ID NO: 195794 - protein, 23 aa, Mycobacterium bovis
AAGVRRLVLASSMVVYGQGRYDC

SEQ ID NO: 195795 - protein, 19 aa, Mycobacterium bovis
AAHCPAYFQLLVKALVLPG

SEQ ID NO: 195796 - protein, 23 aa, Mycobacterium bovis
AAHLVHPGDLVILIAYATMDDAR

SEQ ID NO: 195797 - protein, 17 aa, Mycobacterium bovis
AAHPCRRRSVARVGGYR

SEQ ID NO: 195798 - protein, 18 aa, Mycobacterium bovis
AAHTEYDTGLSLSAVCAL

SEQ ID NO: 195799 - protein, 17 aa, Mycobacterium bovis
AAIAVSRRVRTRWINFA

SEQ ID NO: 195800 - protein, 26 aa, Mycobacterium bovis
AAIDLQRYGLTWKWPDVDCAHPLDDG

SEQ ID NO: 195801 - protein, 17 aa, Mycobacterium bovis
AAIDSDAAWQAPANDAG

SEQ ID NO: 195802 - protein, 22 aa, Mycobacterium bovis
AAIEIKSAATLRGRDTRSISRL

SEQ ID NO: 195803 - protein, 18 aa, Mycobacterium bovis
AAILLGDLAQVWADDIVS

SEQ ID NO: 195804 - protein, 17 aa, Mycobacterium bovis
AAIQVMRAPAARNRAYA

SEQ ID NO: 195805 - protein, 17 aa, Mycobacterium bovis
AAIRLIYPREALWRPPV

SEQ ID NO: 195806 - protein, 22 aa, Mycobacterium bovis
AAKAEALKCAKGFRYYAENAEA

SEQ ID NO: 195807 - protein, 28 aa, Mycobacterium bovis
AAKGTFRLAFGIGDFRRDTGFGEDPATL

SEQ ID NO: 195808 - protein, 26 aa, Mycobacterium bovis
AAKPFVRWLTDLCVQLSEVERQIHEI

SEQ ID NO: 195809 - protein, 37 aa, Mycobacterium bovis
AAKQALTEAVLWPLQHPDTFARLGVEPPRGVLLYGPP

SEQ ID NO: 195810 - protein, 26 aa, Mycobacterium bovis
AAKRAFSEPVALNWAADGTDVDFGAL

SEQ ID NO: 195811 - protein, 27 aa, Mycobacterium bovis
AAKVERPDLVIGWWAAPTILEHGTPEQ

SEQ ID NO: 195812 - protein, 17 aa, Mycobacterium bovis
AAKVLEDLGWYVADNLP

SEQ ID NO: 195813 - protein, 27 aa, Mycobacterium bovis
AALAMELGCDAVLLASAVTRAADPPAM

SEQ ID NO: 195814 - protein, 17 aa, Mycobacterium bovis
AALARELVRAGTTFPTD

SEQ ID NO: 195815 - protein, 21 aa, Mycobacterium bovis
AALARRNSDVFQRMQEALNIS

SEQ ID NO: 195816 - protein, 23 aa, Mycobacterium bovis
AALARSRATLVLHLAAAQIDAIV

SEQ ID NO: 195817 - protein, 25 aa, Mycobacterium bovis
AALASRVRKAPGFALLGEKGQSRDL

SEQ ID NO: 195818 - protein, 18 aa, Mycobacterium bovis
AALDFGASFDGVRPHAIR

SEQ ID NO: 195819 - protein, 23 aa, Mycobacterium bovis
AALDIPILQGLCLTSPRDQWCAN

SEQ ID NO: 195820 - protein, 22 aa, Mycobacterium bovis
AALDRFGPPAGDPAWVVKDDRL

SEQ ID NO: 195821 - protein, 18 aa, Mycobacterium bovis
AALDYSALYPAGRLVDAP

SEQ ID NO: 195822 - protein, 23 aa, Mycobacterium bovis
AALEAHPAVLLFSHRSYIDGVVV

SEQ ID NO: 195823 - protein, 22 aa, Mycobacterium bovis
AALELIDWPVALVIATGHILAN

SEQ ID NO: 195824 - protein, 23 aa, Mycobacterium bovis
AALESLYEWMWAQDAAAMAGYYV

SEQ ID NO: 195825 - protein, 30 aa, Mycobacterium bovis
AALEVGRLSEWRATLIVRESACLDVEDRRA

SEQ ID NO: 195826 - protein, 20 aa, Mycobacterium bovis
AALGRYGRLDGVLVASGSNH

SEQ ID NO: 195827 - protein, 19 aa, Mycobacterium bovis
AALGSRLGGHIVQGHVDAT

SEQ ID NO: 195828 - protein, 23 aa, Mycobacterium bovis
AALLPTHCWFEGRGWGFQVYPAL

SEQ ID NO: 195829 - protein, 19 aa, Mycobacterium bovis
AALPDRPATSFVGGRLSGT

SEQ ID NO: 195830 - protein, 24 aa, Mycobacterium bovis
AALPEVACTVWSNLVMTAHLRPGQ

SEQ ID NO: 195831 - protein, 23 aa, Mycobacterium bovis
AALPGCQTLAVFVHALPNIEPER

SEQ ID NO: 195832 - protein, 18 aa, Mycobacterium bovis
AALPKLPSFSLTSTSITD

SEQ ID NO: 195833 - protein, 24 aa, Mycobacterium bovis
AALQRSDLLIALGTRFDDRVTGKL

SEQ ID NO: 195834 - protein, 21 aa, Mycobacterium bovis
AALRAALRASAARSLMNRMAE

SEQ ID NO: 195835 - protein, 20 aa, Mycobacterium bovis
AALREWRGPVLDDLRDFQFV

SEQ ID NO: 195836 - protein, 17 aa, Mycobacterium bovis
AALRNAGKFRRMSQMTW

SEQ ID NO: 195837 - protein, 25 aa, Mycobacterium bovis
AALRRRLLQRFAIEPLAPVRDAEDA

SEQ ID NO: 195838 - protein, 17 aa, Mycobacterium bovis
AALRRVELARPRSVVGK

SEQ ID NO: 195839 - protein, 17 aa, Mycobacterium bovis
AALRVNRSLVLPDPPRH

SEQ ID NO: 195840 - protein, 17 aa, Mycobacterium bovis
AALVGGWNLLAPGHWPM

SEQ ID NO: 195841 - protein, 18 aa, Mycobacterium bovis
AALWKAAGITSPIDEIDA

SEQ ID NO: 195842 - protein, 17 aa, Mycobacterium bovis
AALWRRALTLSGESPST

SEQ ID NO: 195843 - protein, 24 aa, Mycobacterium bovis
AAMAEAVAPYVAWMSAAAAQAEQA

SEQ ID NO: 195844 - protein, 26 aa, Mycobacterium bovis
AAMARTCVDAGWLLSLSGTVSFRNAR

SEQ ID NO: 195845 - protein, 19 aa, Mycobacterium bovis
AAMASRLVGAVLIGRDRAA

SEQ ID NO: 195846 - protein, 18 aa, Mycobacterium bovis
AAMLRRIRLTPAGPDTAD

SEQ ID NO: 195847 - protein, 25 aa, Mycobacterium bovis
AAMRLRPGERHWMAFRQLASDVDAN

SEQ ID NO: 195848 - protein, 18 aa, Mycobacterium bovis
AANALPLQKAQGVVSELA

SEQ ID NO: 195849 - protein, 24 aa, Mycobacterium bovis
AANASPMQAVLDVVNGPTQLLLGR

SEQ ID NO: 195850 - protein, 24 aa, Mycobacterium bovis
AANFRDIMITLGMFTHDALLGGEG

SEQ ID NO: 195851 - protein, 27 aa, Mycobacterium bovis
AANIRRLRRPDPYKGKGVRYEGEQIRR

SEQ ID NO: 195852 - protein, 26 aa, Mycobacterium bovis
AANRARLAAAIGLPGNRVVWMNQVHG

SEQ ID NO: 195853 - protein, 24 aa, Mycobacterium bovis
AANSWLDTFTHWRRAQDLPATSIA

SEQ ID NO: 195854 - protein, 20 aa, Mycobacterium bovis
AAPDLPCEVEVDSLEQLDAV

SEQ ID NO: 195855 - protein, 24 aa, Mycobacterium bovis
AAPDRKRLTLAHELGHLVLHSTNP

SEQ ID NO: 195856 - protein, 24 aa, Mycobacterium bovis
AAPESTCREFAGLVDDVVCATMPT

SEQ ID NO: 195857 - protein, 17 aa, Mycobacterium bovis
AAPGLGLVRVAAELGGD

SEQ ID NO: 195858 - protein, 22 aa, Mycobacterium bovis
AAPGSLLGGLPLAGAGGAGAGP

SEQ ID NO: 195859 - protein, 17 aa, Mycobacterium bovis
AAPKYAEAGIRAIDLTP

SEQ ID NO: 195860 - protein, 17 aa, Mycobacterium bovis
AAPSVGLMQPWRFIRIT

SEQ ID NO: 195861 - protein, 17 aa, Mycobacterium bovis
AAPTLGAGLDWKTSLQE

SEQ ID NO: 195862 - protein, 20 aa, Mycobacterium bovis
AAPYAAWLAAAAVQAEQTAA

SEQ ID NO: 195863 - protein, 17 aa, Mycobacterium bovis
AAPYVAWMSVTAVRAEQ

SEQ ID NO: 195864 - protein, 21 aa, Mycobacterium bovis
AAQAGRLGRYVRARPALDVVD

SEQ ID NO: 195865 - protein, 23 aa, Mycobacterium bovis
AAQASGIRYIGFRHEASAGNAAA

SEQ ID NO: 195866 - protein, 19 aa, Mycobacterium bovis
AAQCLAPGARLVFNAFLAN

SEQ ID NO: 195867 - protein, 22 aa, Mycobacterium bovis
AAQFPFDIIPTLLQGLATLSTQ

SEQ ID NO: 195868 - protein, 20 aa, Mycobacterium bovis
AAQGRAVYCWNVDEYEDIDF

SEQ ID NO: 195869 - protein, 25 aa, Mycobacterium bovis
AAQIRSIPTIMAFKNGKLLFNQAGA

SEQ ID NO: 195870 - protein, 25 aa, Mycobacterium bovis
AAQLGEPWRAVHVGDELPLAELTVR

SEQ ID NO: 195871 - protein, 25 aa, Mycobacterium bovis
AAQRAGLELLAFGGRFVEIGKADVY

SEQ ID NO: 195872 - protein, 23 aa, Mycobacterium bovis
AAQREFTRILGLLPDLHGEVDRW

SEQ ID NO: 195873 - protein, 24 aa, Mycobacterium bovis
AAQRLASCGAREVIVTNTLPIGED

SEQ ID NO: 195874 - protein, 31 aa, Mycobacterium bovis
AAQRRCGSPAWNLPVVFGPIAVTYNLNSVSS

SEQ ID NO: 195875 - protein, 22 aa, Mycobacterium bovis
AAQRRDMMWICRDGDRAKNHLL

SEQ ID NO: 195876 - protein, 19 aa, Mycobacterium bovis
AAQSWDLVRDGVFVGYQLD

SEQ ID NO: 195877 - protein, 17 aa, Mycobacterium bovis
AARAQIRDIRLLRTQAA

SEQ ID NO: 195878 - protein, 18 aa, Mycobacterium bovis
AARFPGPFIYTVHPSKIV

SEQ ID NO: 195879 - protein, 18 aa, Mycobacterium bovis
AARGRTGVLVGGRVTWED

SEQ ID NO: 195880 - protein, 21 aa, Mycobacterium bovis
AARHHRRSFVADRLGTGTAVL

SEQ ID NO: 195881 - protein, 26 aa, Mycobacterium bovis
AARIELRTGGAYRWTVTPGHSAAGTV

SEQ ID NO: 195882 - protein, 19 aa, Mycobacterium bovis
AARILLRSGKPVFLAANKV

SEQ ID NO: 195883 - protein, 25 aa, Mycobacterium bovis
AARKFGCGFAPSGWDSLTKHLQRKG

SEQ ID NO: 195884 - protein, 24 aa, Mycobacterium bovis
AARRADIAIVFAIRAEGEGFDSAD

SEQ ID NO: 195885 - protein, 18 aa, Mycobacterium bovis
AASCGLGHRKGRIAPGYD

SEQ ID NO: 195886 - protein, 18 aa, Mycobacterium bovis
AASDVVAWVRSQLAADGV

SEQ ID NO: 195887 - protein, 19 aa, Mycobacterium bovis
AASIMAIVADIERYPEWNE

SEQ ID NO: 195888 - protein, 22 aa, Mycobacterium bovis
AASLKGLVRVLAFEHPDMRTTL

SEQ ID NO: 195889 - protein, 19 aa, Mycobacterium bovis
AASPFGIDIGIGGAGGHGG

SEQ ID NO: 195890 - protein, 25 aa, Mycobacterium bovis
AASPKETWLRLLLIDAGLPVPTTQI

SEQ ID NO: 195891 - protein, 17 aa, Mycobacterium bovis
AASSLRKAKKLRVRLPL

SEQ ID NO: 195892 - protein, 19 aa, Mycobacterium bovis
AASVGSLSVPPAWAAANQA

SEQ ID NO: 195893 - protein, 22 aa, Mycobacterium bovis
AATEAHYAEMWAQDAAAMYGYA

SEQ ID NO: 195894 - protein, 25 aa, Mycobacterium bovis
AATFGVAYLTAWHSLCEVGRLSPGE

SEQ ID NO: 195895 - protein, 21 aa, Mycobacterium bovis
AATGKPSWFLFDGLVKHDLLT

SEQ ID NO: 195896 - protein, 26 aa, Mycobacterium bovis
AATIKRFADRFARFNLQERVIRPSYG

SEQ ID NO: 195897 - protein, 18 aa, Mycobacterium bovis
AATLERTGYSWGPLSLML

SEQ ID NO: 195898 - protein, 17 aa, Mycobacterium bovis
AATLGPWTLVLDECHHL

SEQ ID NO: 195899 - protein, 18 aa, Mycobacterium bovis
AATLRAGLRERLGVTVAV

SEQ ID NO: 195900 - protein, 21 aa, Mycobacterium bovis
AATQDPRAWAALPRAGAVIFA

SEQ ID NO: 195901 - protein, 17 aa, Mycobacterium bovis
AATRAGFEAGFEADPVL

SEQ ID NO: 195902 - protein, 23 aa, Mycobacterium bovis
AATRLPEAPALVVTADRIAISHR

SEQ ID NO: 195903 - protein, 18 aa, Mycobacterium bovis
AATSVHFVAPQSIDARLA

SEQ ID NO: 195904 - protein, 21 aa, Mycobacterium bovis
AAVAAAAPWLRDGDVVVVTSK

SEQ ID NO: 195905 - protein, 40 aa, Mycobacterium bovis
AAVAANREAFLALIRSNWLGLNAPWIAAVESLYEEYWAAD

SEQ ID NO: 195906 - protein, 21 aa, Mycobacterium bovis
AAVADRCSWRRWWPDLRLQVT

SEQ ID NO: 195907 - protein, 17 aa, Mycobacterium bovis
AAVATDLAGIGSTIGTA

SEQ ID NO: 195908 - protein, 19 aa, Mycobacterium bovis
AAVCGAGGDCGRCRRTLRA

SEQ ID NO: 195909 - protein, 19 aa, Mycobacterium bovis
AAVDSGYYPGQFQVGQTGK

SEQ ID NO: 195910 - protein, 25 aa, Mycobacterium bovis
AAVEEFRFHVGLARAAGNTMLDLFL

SEQ ID NO: 195911 - protein, 26 aa, Mycobacterium bovis
AAVGSDFIICYRLSMADYVAEGQSWD

SEQ ID NO: 195912 - protein, 19 aa, Mycobacterium bovis
AAVKGIMYEDVPGFCKSAT

SEQ ID NO: 195913 - protein, 18 aa, Mycobacterium bovis
AAVLFDIDGVLVLSWRAI

SEQ ID NO: 195914 - protein, 17 aa, Mycobacterium bovis
AAVLLHLGPGLGNGLAN

SEQ ID NO: 195915 - protein, 25 aa, Mycobacterium bovis
AAVNDLRLALGVMLEIGPRGPERLP

SEQ ID NO: 195916 - protein, 24 aa, Mycobacterium bovis
AAVNGFCVGGGIGLVGNSDVIVAS

SEQ ID NO: 195917 - protein, 17 aa, Mycobacterium bovis
AAVRAELAKRGWVPLPQ

SEQ ID NO: 195918 - protein, 18 aa, Mycobacterium bovis
AAVRAWLLSQRRIVTTYA

SEQ ID NO: 195919 - protein, 17 aa, Mycobacterium bovis
AAVRLQIDQPGRLDALN

SEQ ID NO: 195920 - protein, 18 aa, Mycobacterium bovis
AAVRRLGHAAGLRVTTGR

SEQ ID NO: 195921 - protein, 18 aa, Mycobacterium bovis
AAVSFGFGPLLLAGSDPL

SEQ ID NO: 195922 - protein, 19 aa, Mycobacterium bovis
AAVSSFGLGGTNAHVIIEQ

SEQ ID NO: 195923 - protein, 26 aa, Mycobacterium bovis
AAVTGLRYGNQVPLTYPFALTFPSVM

SEQ ID NO: 195924 - protein, 19 aa, Mycobacterium bovis
AAVVGRLRAVVCAPACAVD

SEQ ID NO: 195925 - protein, 30 aa, Mycobacterium bovis
AAYACASAWLDALVGWRRASGLPAAVINWG

SEQ ID NO: 195926 - protein, 17 aa, Mycobacterium bovis
AAYGEWMATPPPTWEDI

SEQ ID NO: 195927 - protein, 17 aa, Mycobacterium bovis
AAYGRYQPLGVILAVMP

SEQ ID NO: 195928 - protein, 25 aa, Mycobacterium bovis
AAYLARAGLRVRLLERLAQTGGAAV

SEQ ID NO: 195929 - protein, 26 aa, Mycobacterium bovis
AAYRQLRYFWSRVIADTGWQLLDSKF

SEQ ID NO: 195930 - protein, 20 aa, Mycobacterium bovis
ACADCGVTVDRMPRVETFGV

SEQ ID NO: 195931 - protein, 25 aa, Mycobacterium bovis
ACAEAFAEFVDWSLVDVLRGAPGAP

SEQ ID NO: 195932 - protein, 18 aa, Mycobacterium bovis
ACALVGRPQLVFLDEPTA

SEQ ID NO: 195933 - protein, 18 aa, Mycobacterium bovis
ACDLQRPAAVNQLQVVGE

SEQ ID NO: 195934 - protein, 24 aa, Mycobacterium bovis
ACDVPSLGWRVYRLVPADEAPGWE

SEQ ID NO: 195935 - protein, 26 aa, Mycobacterium bovis
ACERADAVLVLTEWREFIDLEPADLA

SEQ ID NO: 195936 - protein, 28 aa, Mycobacterium bovis
ACGAIELGIKWLSLYAFSTENWKRSPEE

SEQ ID NO: 195937 - protein, 19 aa, Mycobacterium bovis
ACGKMYTRRGTFLEHAGDF

SEQ ID NO: 195938 - protein, 31 aa, Mycobacterium bovis
ACGQRWPKMRISGPAVRWVMTGWQRLHFRFG

SEQ ID NO: 195939 - protein, 21 aa, Mycobacterium bovis
ACGTLRLADFDKIELSNLNRV

SEQ ID NO: 195940 - protein, 25 aa, Mycobacterium bovis
ACLSEARYGIVWGAMGAARSAWQCA

SEQ ID NO: 195941 - protein, 22 aa, Mycobacterium bovis
ACPSTWPWNLLGWPSINVPAGF

SEQ ID NO: 195942 - protein, 20 aa, Mycobacterium bovis
ACQGFITQLGRNFQVIYEQA

SEQ ID NO: 195943 - protein, 26 aa, Mycobacterium bovis
ACQKWPRRMRKMFLSLIQRQLPEGYD

SEQ ID NO: 195944 - protein, 19 aa, Mycobacterium bovis
ACRPHSGTDLLAGIGGTPE

SEQ ID NO: 195945 - protein, 28 aa, Mycobacterium bovis
ACRRWPKLMRRLLLWEVRRRLGRSVDMS

SEQ ID NO: 195946 - protein, 23 aa, Mycobacterium bovis
ACSGAHRAIVHFYNSTSILQRRV

SEQ ID NO: 195947 - protein, 21 aa, Mycobacterium bovis
ACSSGLTAVHMACRSLHEGES

SEQ ID NO: 195948 - protein, 25 aa, Mycobacterium bovis
ACSTLRLTDLLPYVGPDYLVPKPLH

SEQ ID NO: 195949 - protein, 17 aa, Mycobacterium bovis
ACTHCNQCMATIYRRTH

SEQ ID NO: 195950 - protein, 20 aa, Mycobacterium bovis
ACVLGECLTGAPPYRADSVE

SEQ ID NO: 195951 - protein, 17 aa, Mycobacterium bovis
ACVRATWLKVVPDQLGR

SEQ ID NO: 195952 - protein, 18 aa, Mycobacterium bovis
ADAARALDNFATRWRHGG

SEQ ID NO: 195953 - protein, 18 aa, Mycobacterium bovis
ADAARLAVRMENDGATAW

SEQ ID NO: 195954 - protein, 26 aa, Mycobacterium bovis
ADAARRFPVPIAMFAELIDGARMEID

SEQ ID NO: 195955 - protein, 24 aa, Mycobacterium bovis
ADAAWRAAFDHEQTCVAIIKHANP

SEQ ID NO: 195956 - protein, 21 aa, Mycobacterium bovis
ADADDAPAWWDGTVVEHIRVS

SEQ ID NO: 195957 - protein, 25 aa, Mycobacterium bovis
ADAEFPDAIVVPGFVDMHVHGGGGA

SEQ ID NO: 195958 - protein, 23 aa, Mycobacterium bovis
ADAGRFLTTIKHRLEEGAFEADL

SEQ ID NO: 195959 - protein, 25 aa, Mycobacterium bovis
ADAGSGRYMLRCRVGERIRVCDWLP

SEQ ID NO: 195960 - protein, 23 aa, Mycobacterium bovis
ADAKRLRSIRGREIGYVPQDPMT

SEQ ID NO: 195961 - protein, 24 aa, Mycobacterium bovis
ADALKADGIVGVRLNWRHHGEGGE

SEQ ID NO: 195962 - protein, 26 aa, Mycobacterium bovis
ADAPAAWRRYLEAGILIRDVGIPGYL

SEQ ID NO: 195963 - protein, 22 aa, Mycobacterium bovis
ADARLAQGHPVAWIHGTALRTE

SEQ ID NO: 195964 - protein, 21 aa, Mycobacterium bovis
ADARVGRLLFSTQLANAVITR

SEQ ID NO: 195965 - protein, 35 aa, Mycobacterium bovis
ADARWPSAGNWRYLADYAIGATLAYPERVEYNQDN

SEQ ID NO: 195966 - protein, 25 aa, Mycobacterium bovis
ADATLTRFLGIGVRTVLSQGSYLAR

SEQ ID NO: 195967 - protein, 19 aa, Mycobacterium bovis
ADAVARMAEFGRHVEELVA

SEQ ID NO: 195968 - protein, 19 aa, Mycobacterium bovis
ADDGQAYGFAAAFGAGPSC

SEQ ID NO: 195969 - protein, 20 aa, Mycobacterium bovis
ADDGYPVFVDALVNMRHTLA

SEQ ID NO: 195970 - protein, 23 aa, Mycobacterium bovis
ADDIRLRRMAVFDVLINNADRKG

SEQ ID NO: 195971 - protein, 17 aa, Mycobacterium bovis
ADDRFWLAVGRTRSNAY

SEQ ID NO: 195972 - protein, 24 aa, Mycobacterium bovis
ADDVPRGISFLLNRNRLNVAVSRA

SEQ ID NO: 195973 - protein, 19 aa, Mycobacterium bovis
ADEAPGWELVPGTDIANEH

SEQ ID NO: 195974 - protein, 19 aa, Mycobacterium bovis
ADEPIEFALRLSNAIAAEV

SEQ ID NO: 195975 - protein, 17 aa, Mycobacterium bovis
ADERAAGVLRAHGYPTD

SEQ ID NO: 195976 - protein, 23 aa, Mycobacterium bovis
ADERLRSGVPLGEVVDYLGIPAS

SEQ ID NO: 195977 - protein, 24 aa, Mycobacterium bovis
ADEVSAGIAALFSAHAQEYQALSA

SEQ ID NO: 195978 - protein, 18 aa, Mycobacterium bovis
ADFVPRVRAGLEALGVGK

SEQ ID NO: 195979 - protein, 30 aa, Mycobacterium bovis
ADGASNWYTEFARLAPLMEKDVHYEVDLRK

SEQ ID NO: 195980 - protein, 31 aa, Mycobacterium bovis
ADGDAALALLRAELRPGDVVLVKASNAAGLG

SEQ ID NO: 195981 - protein, 20 aa, Mycobacterium bovis
ADGDHWILNGAKCWITNGGK

SEQ ID NO: 195982 - protein, 26 aa, Mycobacterium bovis
ADGERRPGWVGLPLAGVQTRLVDDDG

SEQ ID NO: 195983 - protein, 25 aa, Mycobacterium bovis
ADGGRAVLVLSDWPAPQAPQSASGE

SEQ ID NO: 195984 - protein, 26 aa, Mycobacterium bovis
ADGKEIAGRLAARIGSGLLVDVVDVR

SEQ ID NO: 195985 - protein, 26 aa, Mycobacterium bovis
ADGLDDCFRLLAGGVRGAVQRQQTLR

SEQ ID NO: 195986 - protein, 21 aa, Mycobacterium bovis
ADGQTGLFCPLDEQIQQAARH

SEQ ID NO: 195987 - protein, 21 aa, Mycobacterium bovis
ADGRAAMLLHVSHAVTDGVGG

SEQ ID NO: 195988 - protein, 17 aa, Mycobacterium bovis
ADGRCKAFAAAADGTGW

SEQ ID NO: 195989 - protein, 18 aa, Mycobacterium bovis
ADGRGECEFIIRLLPDGV

SEQ ID NO: 195990 - protein, 19 aa, Mycobacterium bovis
ADGRRPRILIAKMGQDGHD

SEQ ID NO: 195991 - protein, 35 aa, Mycobacterium bovis
ADGSEYRGCYGLSVAALMKWHLPRLEVLVDAGADM

SEQ ID NO: 195992 - protein, 19 aa, Mycobacterium bovis
ADGSLRHPPVPAVWQDKSV

SEQ ID NO: 195993 - protein, 18 aa, Mycobacterium bovis
ADGSRIVVRGELFTAFVP

SEQ ID NO: 195994 - protein, 24 aa, Mycobacterium bovis
ADGSYSLTGHKWFTSAPMCDIFLV

SEQ ID NO: 195995 - protein, 25 aa, Mycobacterium bovis
ADGVMRWLEEHRRGVAMDSGVVPIV

SEQ ID NO: 195996 - protein, 26 aa, Mycobacterium bovis
ADHCLDLPGLFVWRRYHPSRPSGKAL

SEQ ID NO: 195997 - protein, 17 aa, Mycobacterium bovis
ADHRLPQGVTFIGQPLW

SEQ ID NO: 195998 - protein, 27 aa, Mycobacterium bovis
ADIARYNARCGRTFVLPNEQAAYDACI

SEQ ID NO: 195999 - protein, 21 aa, Mycobacterium bovis
ADIASAVAFLVSDAASWITGE

SEQ ID NO: 196000 - protein, 25 aa, Mycobacterium bovis
ADIDGLRYLDWLAAYSAVNLGHRNP

SEQ ID NO: 196001 - protein, 17 aa, Mycobacterium bovis
ADIDGVLRWADEARARL

SEQ ID NO: 196002 - protein, 23 aa, Mycobacterium bovis
ADIDKRGKISLILVADEDSTAAA

SEQ ID NO: 196003 - protein, 20 aa, Mycobacterium bovis
ADIGARCELLSGARVWPGVF

SEQ ID NO: 196004 - protein, 18 aa, Mycobacterium bovis
ADIGFWCSGSSDYLAGRA

SEQ ID NO: 196005 - protein, 24 aa, Mycobacterium bovis
ADILRPVADRLWYPLWDANIRLDH

SEQ ID NO: 196006 - protein, 17 aa, Mycobacterium bovis
ADIRESIHLRALGRQNP

SEQ ID NO: 196007 - protein, 20 aa, Mycobacterium bovis
ADIRFGSYRLFSLDAAPGPD

SEQ ID NO: 196008 - protein, 18 aa, Mycobacterium bovis
ADISGVYNTGALGLITSA

SEQ ID NO: 196009 - protein, 17 aa, Mycobacterium bovis
ADIWPVIDRDPAVRVVL

SEQ ID NO: 196010 - protein, 21 aa, Mycobacterium bovis
ADLALAGGCAVLLEPHACVAA

SEQ ID NO: 196011 - protein, 19 aa, Mycobacterium bovis
ADLARLGREGVLALSTAEA

SEQ ID NO: 196012 - protein, 18 aa, Mycobacterium bovis
ADLDRLGVEVLLDDRQAS

SEQ ID NO: 196013 - protein, 27 aa, Mycobacterium bovis
ADLFHARVALWFIREVFEVMRATPQHT

SEQ ID NO: 196014 - protein, 21 aa, Mycobacterium bovis
ADLGFPLSIHLEATYGVSAAA

SEQ ID NO: 196015 - protein, 25 aa, Mycobacterium bovis
ADLHAAPSQWSWRPWSLTVDVEPGP

SEQ ID NO: 196016 - protein, 19 aa, Mycobacterium bovis
ADLHMIGKDIIRFHAVYWP

SEQ ID NO: 196017 - protein, 17 aa, Mycobacterium bovis
ADLIEWRRKHEKHIERV

SEQ ID NO: 196018 - protein, 20 aa, Mycobacterium bovis
ADLLGKRLHRVLGPLAHVNL

SEQ ID NO: 196019 - protein, 21 aa, Mycobacterium bovis
ADLPEITHFVAGLGTTGTLMG

SEQ ID NO: 196020 - protein, 21 aa, Mycobacterium bovis
ADLPPAYIAVAGYDPLRDDGI

SEQ ID NO: 196021 - protein, 20 aa, Mycobacterium bovis
ADLQSWLVLITGYDAVSLQP

SEQ ID NO: 196022 - protein, 24 aa, Mycobacterium bovis
ADLRADWPTALGAAGFDPTQPTAW

SEQ ID NO: 196023 - protein, 26 aa, Mycobacterium bovis
ADLRAGLPDGEFFGAIAQLPGASGRI

SEQ ID NO: 196024 - protein, 23 aa, Mycobacterium bovis
ADLRDARLRLAADDLVSRRAERE

SEQ ID NO: 196025 - protein, 21 aa, Mycobacterium bovis
ADLRTDWPTPLTAAGFDPQRP

SEQ ID NO: 196026 - protein, 22 aa, Mycobacterium bovis
ADLSLLGKARKVVVTKDETTIV

SEQ ID NO: 196027 - protein, 30 aa, Mycobacterium bovis
ADLTFADAFTADFFATWGKLAAVRTPTIAA

SEQ ID NO: 196028 - protein, 23 aa, Mycobacterium bovis
ADMLGRAGGLLVDVAIDTVPRGY

SEQ ID NO: 196029 - protein, 20 aa, Mycobacterium bovis
ADMRRMRAAAAKLVETEISD

SEQ ID NO: 196030 - protein, 23 aa, Mycobacterium bovis
ADNPVLCDLILIRAALSPKTARL

SEQ ID NO: 196031 - protein, 29 aa, Mycobacterium bovis
ADPATISAFVVRISCHLRIQNQAADDDVK

SEQ ID NO: 196032 - protein, 17 aa, Mycobacterium bovis
ADPDLIIGRYIPNLVPR

SEQ ID NO: 196033 - protein, 25 aa, Mycobacterium bovis
ADPDRYAAEMAHIIGCEPAEVLRVS

SEQ ID NO: 196034 - protein, 25 aa, Mycobacterium bovis
ADPEVVRALDMLFILHADHEQNCST

SEQ ID NO: 196035 - protein, 18 aa, Mycobacterium bovis
ADPPDRPWNLLAGANALM

SEQ ID NO: 196036 - protein, 22 aa, Mycobacterium bovis
ADPRAPSLFIHRPDALARRIGR

SEQ ID NO: 196037 - protein, 21 aa, Mycobacterium bovis
ADPRVSAILDRPLQAVEHERT

SEQ ID NO: 196038 - protein, 18 aa, Mycobacterium bovis
ADPVSLQSAVGFSALGSE

SEQ ID NO: 196039 - protein, 17 aa, Mycobacterium bovis
ADPVSLQTAAGFSAQGV

SEQ ID NO: 196040 - protein, 19 aa, Mycobacterium bovis
ADQACTDWPVAAAEDDEAR

SEQ ID NO: 196041 - protein, 29 aa, Mycobacterium bovis
ADQARTIRIPVHMVEVINKLGRIQRELLQ

SEQ ID NO: 196042 - protein, 24 aa, Mycobacterium bovis
ADQPLDWFCSFSSAAALVGSPGQG

SEQ ID NO: 196043 - protein, 24 aa, Mycobacterium bovis
ADQRTRVFFCNSGAEANEAAFKLS

SEQ ID NO: 196044 - protein, 26 aa, Mycobacterium bovis
ADRAASYRAAGYWSGRTLDTVLSDAA

SEQ ID NO: 196045 - protein, 17 aa, Mycobacterium bovis
ADRASRVQPGFTIANHN

SEQ ID NO: 196046 - protein, 24 aa, Mycobacterium bovis
ADRGRTGVFSLDARQWFQSFPAVA

SEQ ID NO: 196047 - protein, 21 aa, Mycobacterium bovis
ADRKGGHILCGIDGQVYGVDH

SEQ ID NO: 196048 - protein, 19 aa, Mycobacterium bovis
ADRLYERLLGWLADIQQPR

SEQ ID NO: 196049 - protein, 22 aa, Mycobacterium bovis
ADRRADGELARYVTAKEPWFLD

SEQ ID NO: 196050 - protein, 23 aa, Mycobacterium bovis
ADRRYSAAITRLAPETDVRIVTY

SEQ ID NO: 196051 - protein, 26 aa, Mycobacterium bovis
ADRVAIWSPNTWHWVVACLAIHHAGA

SEQ ID NO: 196052 - protein, 31 aa, Mycobacterium bovis
ADSIVIGGGMCFTFLAAQGFSVGTSLLEDDM

SEQ ID NO: 196053 - protein, 18 aa, Mycobacterium bovis
ADSLGPVRVVVNCAGTGN

SEQ ID NO: 196054 - protein, 27 aa, Mycobacterium bovis
ADSLGWLRDFLRLHTGGLVVISHNVDL

SEQ ID NO: 196055 - protein, 18 aa, Mycobacterium bovis
ADSLSFVLDDAVLTADTV

SEQ ID NO: 196056 - protein, 25 aa, Mycobacterium bovis
ADSRGQFPGRYRLAVLEKLSRVSSR

SEQ ID NO: 196057 - protein, 21 aa, Mycobacterium bovis
ADSSRGALLIHGHLDVVPAEP

SEQ ID NO: 196058 - protein, 17 aa, Mycobacterium bovis
ADTAVDVVIPYDRGDLV

SEQ ID NO: 196059 - protein, 20 aa, Mycobacterium bovis
ADTGLRYTVYPGELSSSVGG

SEQ ID NO: 196060 - protein, 18 aa, Mycobacterium bovis
ADTHPSGGCSRHLAECPA

SEQ ID NO: 196061 - protein, 18 aa, Mycobacterium bovis
ADTLGYISLRGMVAASEQ

SEQ ID NO: 196062 - protein, 23 aa, Mycobacterium bovis
ADTPGLPKMGSFEVMNRTIDIAQ

SEQ ID NO: 196063 - protein, 18 aa, Mycobacterium bovis
ADTWISTDYLFWRDDDGD

SEQ ID NO: 196064 - protein, 19 aa, Mycobacterium bovis
ADVAHPVYLLYGVERTEDL

SEQ ID NO: 196065 - protein, 29 aa, Mycobacterium bovis
ADVALIVGVPMDFRLGFGGVFGSTTQLIV

SEQ ID NO: 196066 - protein, 22 aa, Mycobacterium bovis
ADVEASGLWPGKVVTEVSPAGD

SEQ ID NO: 196067 - protein, 23 aa, Mycobacterium bovis
ADVFELAGLLRRSGEVVAAREGH

SEQ ID NO: 196068 - protein, 19 aa, Mycobacterium bovis
ADVGYRWFASTNQTPMFAF

SEQ ID NO: 196069 - protein, 19 aa, Mycobacterium bovis
ADVHIAIELACPLVYGAAV

SEQ ID NO: 196070 - protein, 22 aa, Mycobacterium bovis
ADVLIAFGRFPIIDDREPQLGM

SEQ ID NO: 196071 - protein, 19 aa, Mycobacterium bovis
ADVLLAHLVLRPFLDAYHI

SEQ ID NO: 196072 - protein, 21 aa, Mycobacterium bovis
ADVPGLIPGASRGRGLGLDFL

SEQ ID NO: 196073 - protein, 18 aa, Mycobacterium bovis
ADVPVLLVCGHRAGRAAV

SEQ ID NO: 196074 - protein, 23 aa, Mycobacterium bovis
ADVRPEVVSFTFGAPPPDVVQRL

SEQ ID NO: 196075 - protein, 21 aa, Mycobacterium bovis
ADVRRELAIRAAVEAATVTDS

SEQ ID NO: 196076 - protein, 23 aa, Mycobacterium bovis
ADVSCLKALLEVRNEIVAAGHTP

SEQ ID NO: 196077 - protein, 17 aa, Mycobacterium bovis
ADVSIIFVPPTFAKDAI

SEQ ID NO: 196078 - protein, 23 aa, Mycobacterium bovis
ADVSLPVVRAFIHRIKERARGAE

SEQ ID NO: 196079 - protein, 20 aa, Mycobacterium bovis
ADVVARFLPYFTDVIVGDLR

SEQ ID NO: 196080 - protein, 22 aa, Mycobacterium bovis
ADVVSAWTGIPAGRLLEGETAK

SEQ ID NO: 196081 - protein, 19 aa, Mycobacterium bovis
ADVYLCGPVAMVDAARTWL

SEQ ID NO: 196082 - protein, 26 aa, Mycobacterium bovis
ADWAEMLMRMYIRWAEQHKYPVEVFD

SEQ ID NO: 196083 - protein, 30 aa, Mycobacterium bovis
ADWLSVKRLAGWLAAAGYCGRAPRPAHRCP

SEQ ID NO: 196084 - protein, 21 aa, Mycobacterium bovis
ADYRVCTPLPRVGEVEDVANL

SEQ ID NO: 196085 - protein, 26 aa, Mycobacterium bovis
AEAANASPLQSAMGAVSASAQTLLSR

SEQ ID NO: 196086 - protein, 19 aa, Mycobacterium bovis
AEAAPVMRAVASVLPGTGA

SEQ ID NO: 196087 - protein, 22 aa, Mycobacterium bovis
AEADLFYSDFVERVAEGRKMTT

SEQ ID NO: 196088 - protein, 19 aa, Mycobacterium bovis
AEAIWEMPPYTGWYQGAQA

SEQ ID NO: 196089 - protein, 25 aa, Mycobacterium bovis
AEAKARRGPLCLGIDPHPELLRGWD

SEQ ID NO: 196090 - protein, 29 aa, Mycobacterium bovis
AEAKLGYPLSRAHTAAIIWSDELDGDHSY

SEQ ID NO: 196091 - protein, 32 aa, Mycobacterium bovis
AEAKYAAKRVRRWMRRRYLLLEVPQLPGRGWV

SEQ ID NO: 196092 - protein, 19 aa, Mycobacterium bovis
AEALAPFGSPLASLAAAAE

SEQ ID NO: 196093 - protein, 17 aa, Mycobacterium bovis
AEALCAALEVVQQADTA

SEQ ID NO: 196094 - protein, 23 aa, Mycobacterium bovis
AEALTSLPGVGVWTAAETTQRVF

SEQ ID NO: 196095 - protein, 20 aa, Mycobacterium bovis
AEANAAFEEARRRFEASWNR

SEQ ID NO: 196096 - protein, 25 aa, Mycobacterium bovis
AEANRWCDSNGFGADDCFAKFISTL

SEQ ID NO: 196097 - protein, 21 aa, Mycobacterium bovis
AEAQGGLLPWAVREYEAQTGR

SEQ ID NO: 196098 - protein, 19 aa, Mycobacterium bovis
AEAQVEQQLLAAINAPTQA

SEQ ID NO: 196099 - protein, 17 aa, Mycobacterium bovis
AEARAILTAGLLGEEVP

SEQ ID NO: 196100 - protein, 19 aa, Mycobacterium bovis
AEASVPVFTVRLADHPSRD

SEQ ID NO: 196101 - protein, 19 aa, Mycobacterium bovis
AEAVLRAAALIGGLDNAAL

SEQ ID NO: 196102 - protein, 23 aa, Mycobacterium bovis
AECLLDRNALIMGYSGVYSSFLK

SEQ ID NO: 196103 - protein, 24 aa, Mycobacterium bovis
AEDDGILMGYGWHRGRDEGQLLLL

SEQ ID NO: 196104 - protein, 21 aa, Mycobacterium bovis
AEDPAREFLPTGGRVLAVFEP

SEQ ID NO: 196105 - protein, 23 aa, Mycobacterium bovis
AEEFFDLIWRLMRFDKHGPLDLI

SEQ ID NO: 196106 - protein, 23 aa, Mycobacterium bovis
AEELASWLSGLRGSRVVLRVPRR

SEQ ID NO: 196107 - protein, 18 aa, Mycobacterium bovis
AEELRYSVIREVLPTRRA

SEQ ID NO: 196108 - protein, 25 aa, Mycobacterium bovis
AEFAELRSAAPIWWNGQDPGKGGGF

SEQ ID NO: 196109 - protein, 18 aa, Mycobacterium bovis
AEFTRIAAGISVSKPRIP

SEQ ID NO: 196110 - protein, 19 aa, Mycobacterium bovis
AEGARLKDAFVYPETMPAW

SEQ ID NO: 196111 - protein, 18 aa, Mycobacterium bovis
AEGARPGWVGSSAGALSG

SEQ ID NO: 196112 - protein, 22 aa, Mycobacterium bovis
AEGDGGWDLTLRNMAKGYPHLT

SEQ ID NO: 196113 - protein, 24 aa, Mycobacterium bovis
AEGELYFPGSPVLSVRGSFAECVL

SEQ ID NO: 196114 - protein, 18 aa, Mycobacterium bovis
AEGLLRYLPPEAQDRLLD

SEQ ID NO: 196115 - protein, 26 aa, Mycobacterium bovis
AEGMGVPARRVTTCEEFADALRAAFA

SEQ ID NO: 196116 - protein, 23 aa, Mycobacterium bovis
AEGRGWHNARVIPYGPIELDPSA

SEQ ID NO: 196117 - protein, 17 aa, Mycobacterium bovis
AEGRKVLAREVDIRDDA

SEQ ID NO: 196118 - protein, 18 aa, Mycobacterium bovis
AEGRLRLPERVQRYLVGR

SEQ ID NO: 196119 - protein, 18 aa, Mycobacterium bovis
AEHAELELALADPALHSN

SEQ ID NO: 196120 - protein, 18 aa, Mycobacterium bovis
AEHLHVHVVPRWGGDANF

SEQ ID NO: 196121 - protein, 28 aa, Mycobacterium bovis
AEHLLAMLKARGSGQWASFSELVADCTA

SEQ ID NO: 196122 - protein, 19 aa, Mycobacterium bovis
AEHPRLGPVRNPWNTDYTA

SEQ ID NO: 196123 - protein, 24 aa, Mycobacterium bovis
AEHPSSGVAFVLGERLGRVDVSEL

SEQ ID NO: 196124 - protein, 18 aa, Mycobacterium bovis
AEHSFPYEIVAKMGEMGL

SEQ ID NO: 196125 - protein, 17 aa, Mycobacterium bovis
AEIAPQWHLRMQAAVQR

SEQ ID NO: 196126 - protein, 19 aa, Mycobacterium bovis
AEIAWLRAELDTAREVIRV

SEQ ID NO: 196127 - protein, 24 aa, Mycobacterium bovis
AEIDARLRLVVGRRGDLADQESLG

SEQ ID NO: 196128 - protein, 18 aa, Mycobacterium bovis
AEIDAVCELIDFWRFNVA

SEQ ID NO: 196129 - protein, 22 aa, Mycobacterium bovis
AEIDMRCLLIVGSSQTRWYSVD

SEQ ID NO: 196130 - protein, 25 aa, Mycobacterium bovis
AEIDNLRAAFTWSRGNGDIAAALQL

SEQ ID NO: 196131 - protein, 20 aa, Mycobacterium bovis
AEIEPALVIMLGEYPGRSMI

SEQ ID NO: 196132 - protein, 17 aa, Mycobacterium bovis
AEIGFPVRRRKDADTYA

SEQ ID NO: 196133 - protein, 17 aa, Mycobacterium bovis
AEIGRIPVDSIYSPVLK

SEQ ID NO: 196134 - protein, 20 aa, Mycobacterium bovis
AEIKRRLPSMYHQFKELAEV

SEQ ID NO: 196135 - protein, 19 aa, Mycobacterium bovis
AEIRALFRSSKVGLIAGCL

SEQ ID NO: 196136 - protein, 18 aa, Mycobacterium bovis
AEIVNAWNLQNHEVTAIV

SEQ ID NO: 196137 - protein, 17 aa, Mycobacterium bovis
AEIYRRSFAVIRAEADL

SEQ ID NO: 196138 - protein, 20 aa, Mycobacterium bovis
AEKLVRARLRREVLIDDGTD

SEQ ID NO: 196139 - protein, 18 aa, Mycobacterium bovis
AELAAAFEKFEKTVARAA

SEQ ID NO: 196140 - protein, 25 aa, Mycobacterium bovis
AELAAAGLHRIRWWTDEAGDFGLSL

SEQ ID NO: 196141 - protein, 18 aa, Mycobacterium bovis
AELAEAFHAAGRCTAEAN

SEQ ID NO: 196142 - protein, 17 aa, Mycobacterium bovis
AELARLAGRLDDATAQR

SEQ ID NO: 196143 - protein, 25 aa, Mycobacterium bovis
AELARSTGWTGLIVHGAVRDAAALR

SEQ ID NO: 196144 - protein, 26 aa, Mycobacterium bovis
AELAYFEVLHELKLIVDLMYEGGLAR

SEQ ID NO: 196145 - protein, 19 aa, Mycobacterium bovis
AELDAGVPARGLNGEAYRG

SEQ ID NO: 196146 - protein, 21 aa, Mycobacterium bovis
AELDFPVPSFAEFWRTGRLEL

SEQ ID NO: 196147 - protein, 17 aa, Mycobacterium bovis
AELEPDFQRAYKELAKQ

SEQ ID NO: 196148 - protein, 21 aa, Mycobacterium bovis
AELFWALRGGGGGNFGVTTSM

SEQ ID NO: 196149 - protein, 25 aa, Mycobacterium bovis
AELGAAMTRLACERASVGDDELAAK

SEQ ID NO: 196150 - protein, 22 aa, Mycobacterium bovis
AELGLPVVVRPSFTMGGLGSGI

SEQ ID NO: 196151 - protein, 18 aa, Mycobacterium bovis
AELGRRHELLSGLVPQIS

SEQ ID NO: 196152 - protein, 25 aa, Mycobacterium bovis
AELKKKPGIHAVHMAGGNKAEIAPT

SEQ ID NO: 196153 - protein, 21 aa, Mycobacterium bovis
AELLPELTLAQRWDLTASELA

SEQ ID NO: 196154 - protein, 19 aa, Mycobacterium bovis
AELLRACGDIDGLERVRFT

SEQ ID NO: 196155 - protein, 18 aa, Mycobacterium bovis
AELLRPLLELVPVHDVAF

SEQ ID NO: 196156 - protein, 17 aa, Mycobacterium bovis
AELLRRAKHSGLSDHQI

SEQ ID NO: 196157 - protein, 20 aa, Mycobacterium bovis
AELLSAVGALAEATRDGVVA

SEQ ID NO: 196158 - protein, 20 aa, Mycobacterium bovis
AELLVPHLAARFGRAARDIA

SEQ ID NO: 196159 - protein, 17 aa, Mycobacterium bovis
AELPALFSQLVAGPIRR

SEQ ID NO: 196160 - protein, 19 aa, Mycobacterium bovis
AELPEHIVIVGSGFIAAEF

SEQ ID NO: 196161 - protein, 20 aa, Mycobacterium bovis
AELPHRCVIDGEIIIATDHG

SEQ ID NO: 196162 - protein, 20 aa, Mycobacterium bovis
AELPLPVGLLKIDVEGLERA

SEQ ID NO: 196163 - protein, 17 aa, Mycobacterium bovis
AELRAKHGLIPEDEALR

SEQ ID NO: 196164 - protein, 19 aa, Mycobacterium bovis
AELRHRLESKIVMTRLADE

SEQ ID NO: 196165 - protein, 24 aa, Mycobacterium bovis
AELSRLRPLPFRLVLDGTEEIVAD

SEQ ID NO: 196166 - protein, 19 aa, Mycobacterium bovis
AELSRLSSPIGLDLGARTP

SEQ ID NO: 196167 - protein, 17 aa, Mycobacterium bovis
AELTWQLRGTAEARQVD

SEQ ID NO: 196168 - protein, 26 aa, Mycobacterium bovis
AELVARVKALLRRRGSTATSSSETIT

SEQ ID NO: 196169 - protein, 29 aa, Mycobacterium bovis
AELVELFKTEALHRLPVKSWDVRHAREAY

SEQ ID NO: 196170 - protein, 24 aa, Mycobacterium bovis
AELVTEHAWRIGVVAQSHATVENL

SEQ ID NO: 196171 - protein, 24 aa, Mycobacterium bovis
AEMARRIDVARVYAHHVVERQLAG

SEQ ID NO: 196172 - protein, 22 aa, Mycobacterium bovis
AEMHARISGLADYFALDELDAI

SEQ ID NO: 196173 - protein, 17 aa, Mycobacterium bovis
AEMLRRNGIPCDDVRKH

SEQ ID NO: 196174 - protein, 17 aa, Mycobacterium bovis
AEMLRWCHEAGIELATV

SEQ ID NO: 196175 - protein, 25 aa, Mycobacterium bovis
AEMRIDPFEMWTQGTNGLGITFYSF

SEQ ID NO: 196176 - protein, 17 aa, Mycobacterium bovis
AEMWAQDAAAMYGYAGS

SEQ ID NO: 196177 - protein, 20 aa, Mycobacterium bovis
AEMWSQDAMAMYGYAGASAA

SEQ ID NO: 196178 - protein, 22 aa, Mycobacterium bovis
AENMARLLIVTRERYHVFRHQQ

SEQ ID NO: 196179 - protein, 22 aa, Mycobacterium bovis
AEPCPMCAAASVLSGVRAIIFG

SEQ ID NO: 196180 - protein, 24 aa, Mycobacterium bovis
AEPEDFVGALIYLLSDASSFYTGQ

SEQ ID NO: 196181 - protein, 17 aa, Mycobacterium bovis
AEPGQVLGLTFTRKAAG

SEQ ID NO: 196182 - protein, 19 aa, Mycobacterium bovis
AEPGWARERGWPQFADRLL

SEQ ID NO: 196183 - protein, 21 aa, Mycobacterium bovis
AEPGWTMFMISHFHYDPVWWN

SEQ ID NO: 196184 - protein, 25 aa, Mycobacterium bovis
AEPLPRTLVWSAAWEMTREAELRAR

SEQ ID NO: 196185 - protein, 17 aa, Mycobacterium bovis
AEPPPNVDIRWSTADLR

SEQ ID NO: 196186 - protein, 17 aa, Mycobacterium bovis
AEPRYLIGRKILTPPAR

SEQ ID NO: 196187 - protein, 17 aa, Mycobacterium bovis
AEPRYRDRIPILIGGGG

SEQ ID NO: 196188 - protein, 25 aa, Mycobacterium bovis
AEPTARRILRHFGIEQHFEVIAGAS

SEQ ID NO: 196189 - protein, 20 aa, Mycobacterium bovis
AEPTAWLFGPEAHGLSAEIA

SEQ ID NO: 196190 - protein, 21 aa, Mycobacterium bovis
AEPTGVAAWQLARMNLARMTH

SEQ ID NO: 196191 - protein, 23 aa, Mycobacterium bovis
AEPVAVVGIGCRFPGDVDGPESF

SEQ ID NO: 196192 - protein, 21 aa, Mycobacterium bovis
AEPYLPLRAVRHLEKGRVVIF

SEQ ID NO: 196193 - protein, 25 aa, Mycobacterium bovis
AEQARFAMRMVRRPVHDPARYDQIW

SEQ ID NO: 196194 - protein, 22 aa, Mycobacterium bovis
AEQEYRPFRALIQAALRHAGAV

SEQ ID NO: 196195 - protein, 27 aa, Mycobacterium bovis
AEQFARVHLDACDRWSVGLSGGPDSLA

SEQ ID NO: 196196 - protein, 22 aa, Mycobacterium bovis
AEQLMPHWMLSLRAADMRRGGT

SEQ ID NO: 196197 - protein, 21 aa, Mycobacterium bovis
AEQRVALDLLLDESVGIVSLG

SEQ ID NO: 196198 - protein, 27 aa, Mycobacterium bovis
AEQVGPMLADWAKWGQARHNYFLRPSD

SEQ ID NO: 196199 - protein, 22 aa, Mycobacterium bovis
AEQVRLPSIYFAHRRKVFQRDG

SEQ ID NO: 196200 - protein, 20 aa, Mycobacterium bovis
AERALALMVNRVRNRVAFGR

SEQ ID NO: 196201 - protein, 19 aa, Mycobacterium bovis
AEREARLQRPLYVMPTKGI

SEQ ID NO: 196202 - protein, 21 aa, Mycobacterium bovis
AERIGALLFEVNRRFGTPVPP

SEQ ID NO: 196203 - protein, 18 aa, Mycobacterium bovis
AERIRRVAERIVATKKQG

SEQ ID NO: 196204 - protein, 28 aa, Mycobacterium bovis
AERLRAGGMGIPAFYTPAGVGTQVADGG

SEQ ID NO: 196205 - protein, 23 aa, Mycobacterium bovis
AERMRHGMYWSGDLAYRDSEGWI

SEQ ID NO: 196206 - protein, 25 aa, Mycobacterium bovis
AERREVWRLLASFRVQPATEVIARR

SEQ ID NO: 196207 - protein, 32 aa, Mycobacterium bovis
AERVNGRIPLPVDWRWPWGEALAVLENTATDV

SEQ ID NO: 196208 - protein, 19 aa, Mycobacterium bovis
AESCTAGLLAARLTDRPGS

SEQ ID NO: 196209 - protein, 23 aa, Mycobacterium bovis
AESFAAACLPYLSWLTQASADCA

SEQ ID NO: 196210 - protein, 19 aa, Mycobacterium bovis
AESGLRFSGTSPDGHLVEF

SEQ ID NO: 196211 - protein, 20 aa, Mycobacterium bovis
AESGRRVRINDLWIAAVAAS

SEQ ID NO: 196212 - protein, 20 aa, Mycobacterium bovis
AESIQHTWFGLSALAERVDA

SEQ ID NO: 196213 - protein, 27 aa, Mycobacterium bovis
AESPRETWLRLLLIRAGFPRPQTQIPV

SEQ ID NO: 196214 - protein, 17 aa, Mycobacterium bovis
AESQWFAAAGCNLVNMT

SEQ ID NO: 196215 - protein, 21 aa, Mycobacterium bovis
AESVAAWLLDHDRPAAVGLVG

SEQ ID NO: 196216 - protein, 22 aa, Mycobacterium bovis
AETALPRLLAALQHAGVTVHLD

SEQ ID NO: 196217 - protein, 21 aa, Mycobacterium bovis
AETARLEGFYESVRRRAGEVT

SEQ ID NO: 196218 - protein, 19 aa, Mycobacterium bovis
AETQPQGWVRLRGEAALVV

SEQ ID NO: 196219 - protein, 18 aa, Mycobacterium bovis
AETRRLLTEAPFGSRNPD

SEQ ID NO: 196220 - protein, 20 aa, Mycobacterium bovis
AETVGPRLGVKASGGIRTAA

SEQ ID NO: 196221 - protein, 19 aa, Mycobacterium bovis
AEVARRLHNKGAKLVLTDL

SEQ ID NO: 196222 - protein, 17 aa, Mycobacterium bovis
AEVDVWFANKIGGADWV

SEQ ID NO: 196223 - protein, 20 aa, Mycobacterium bovis
AEVFCAPEVVEYLRSATDRL

SEQ ID NO: 196224 - protein, 18 aa, Mycobacterium bovis
AEVGPRLFMLSSTSSDAL

SEQ ID NO: 196225 - protein, 25 aa, Mycobacterium bovis
AEVLGNWTGIPVFKLTEAETTRLLR

SEQ ID NO: 196226 - protein, 18 aa, Mycobacterium bovis
AEVRRIEHQVAHEVVAEV

SEQ ID NO: 196227 - protein, 20 aa, Mycobacterium bovis
AEVSGPLLRRKFRPSSAAML

SEQ ID NO: 196228 - protein, 19 aa, Mycobacterium bovis
AEVYLDLVRQVPCVTDVNV

SEQ ID NO: 196229 - protein, 34 aa, Mycobacterium bovis
AEWMNRPHLAAAWEYDWPASRWRQHLNAQLEGTY

SEQ ID NO: 196230 - protein, 19 aa, Mycobacterium bovis
AEYTRVVLINGPRQAGKTT

SEQ ID NO: 196231 - protein, 17 aa, Mycobacterium bovis
AFAEEYGLPIAIKAAHG

SEQ ID NO: 196232 - protein, 23 aa, Mycobacterium bovis
AFAGPRFLMRIAELEMHPLDTRD

SEQ ID NO: 196233 - protein, 19 aa, Mycobacterium bovis
AFANFGFPESHALSFASLV

SEQ ID NO: 196234 - protein, 17 aa, Mycobacterium bovis
AFAPMALAVAKRLHNQG

SEQ ID NO: 196235 - protein, 24 aa, Mycobacterium bovis
AFARAEQAVRCGIDIQDALRNSAK

SEQ ID NO: 196236 - protein, 20 aa, Mycobacterium bovis
AFATMGCLYPNRVFLGVGTG

SEQ ID NO: 196237 - protein, 32 aa, Mycobacterium bovis
AFCSAHPLAKVQVCSRLAATELYRRLREFELD

SEQ ID NO: 196238 - protein, 25 aa, Mycobacterium bovis
AFDRIDERLVVVGLDNTVTYKNGDP

SEQ ID NO: 196239 - protein, 26 aa, Mycobacterium bovis
AFEEARRRFEASWNRENGEHPINDSA

SEQ ID NO: 196240 - protein, 17 aa, Mycobacterium bovis
AFEGKWDGYRLLVEADH

SEQ ID NO: 196241 - protein, 21 aa, Mycobacterium bovis
AFERDRIPLGASVLLVSGRAS

SEQ ID NO: 196242 - protein, 19 aa, Mycobacterium bovis
AFFCVVDLHAITIPQDPEA

SEQ ID NO: 196243 - protein, 23 aa, Mycobacterium bovis
AFGASPRASLGIIAAARSLALVR

SEQ ID NO: 196244 - protein, 17 aa, Mycobacterium bovis
AFGASRFTGIDFSDEAV

SEQ ID NO: 196245 - protein, 18 aa, Mycobacterium bovis
AFGEMFARQGHLGAMPAT

SEQ ID NO: 196246 - protein, 20 aa, Mycobacterium bovis
AFGLARARSAEGDRVGAVRT

SEQ ID NO: 196247 - protein, 26 aa, Mycobacterium bovis
AFGLPSRLRLGVCVTDAGRRNPAVTA

SEQ ID NO: 196248 - protein, 21 aa, Mycobacterium bovis
AFGQRFPDRLFDVGIAEQHAM

SEQ ID NO: 196249 - protein, 17 aa, Mycobacterium bovis
AFHQQFVQTLAGGAGAY

SEQ ID NO: 196250 - protein, 29 aa, Mycobacterium bovis
AFHRPGPRLRYLLAVKACFAVFQTGTPDH

SEQ ID NO: 196251 - protein, 26 aa, Mycobacterium bovis
AFKVDFAIEGDVGWTNPDCRRAGTVH

SEQ ID NO: 196252 - protein, 19 aa, Mycobacterium bovis
AFLATRLGGQWGGAYGTMP

SEQ ID NO: 196253 - protein, 19 aa, Mycobacterium bovis
AFLPFPFDSVIAGGASMAY

SEQ ID NO: 196254 - protein, 18 aa, Mycobacterium bovis
AFPPMAVSVRLADDIDIS

SEQ ID NO: 196255 - protein, 22 aa, Mycobacterium bovis
AFPYVVVTGIAMTTALATDAET

SEQ ID NO: 196256 - protein, 29 aa, Mycobacterium bovis
AFQRIKEPFSRWASLLIHAGEPGAGTRMK

SEQ ID NO: 196257 - protein, 25 aa, Mycobacterium bovis
AFQSVVWGLTVGSWIGSSAGLMAAA

SEQ ID NO: 196258 - protein, 24 aa, Mycobacterium bovis
AFRVLRPGGELIFTDPMQADDVPD

SEQ ID NO: 196259 - protein, 19 aa, Mycobacterium bovis
AFSIVWDGQKLHGLNASGR

SEQ ID NO: 196260 - protein, 23 aa, Mycobacterium bovis
AFTAFPKAHWQKIWSTNPLERIN

SEQ ID NO: 196261 - protein, 24 aa, Mycobacterium bovis
AFTASPFRWLSWLSDSGATMTAAP

SEQ ID NO: 196262 - protein, 19 aa, Mycobacterium bovis
AFTGRPGMFVRASGMALPL

SEQ ID NO: 196263 - protein, 20 aa, Mycobacterium bovis
AFVRSRLAGYLEQMDRVVSR

SEQ ID NO: 196264 - protein, 17 aa, Mycobacterium bovis
AFWSFGGLFLVNSPEQR

SEQ ID NO: 196265 - protein, 19 aa, Mycobacterium bovis
AFYERLRELFAARKSITTF

SEQ ID NO: 196266 - protein, 23 aa, Mycobacterium bovis
AFYLQYFGCRPYFAERVGGFTMR

SEQ ID NO: 196267 - protein, 23 aa, Mycobacterium bovis
AFYQAEIFEIVWSLWNLSRTDID

SEQ ID NO: 196268 - protein, 25 aa, Mycobacterium bovis
AGAARRCPDRPGLIDELGTLTWRQL

SEQ ID NO: 196269 - protein, 18 aa, Mycobacterium bovis
AGADAIYPGYGFLSENPD

SEQ ID NO: 196270 - protein, 26 aa, Mycobacterium bovis
AGAFLRAGAINRILAYVAPILLGGPV

SEQ ID NO: 196271 - protein, 17 aa, Mycobacterium bovis
AGAGIVWAKVNTFGSTA

SEQ ID NO: 196272 - protein, 19 aa, Mycobacterium bovis
AGAITPFALLQLADRGQFF

SEQ ID NO: 196273 - protein, 24 aa, Mycobacterium bovis
AGALWERLTRAVGMDARDAVWQHP

SEQ ID NO: 196274 - protein, 19 aa, Mycobacterium bovis
AGAMPVLTLYGIPHRDCGS

SEQ ID NO: 196275 - protein, 19 aa, Mycobacterium bovis
AGAPAYYTICELLHRHGFA

SEQ ID NO: 196276 - protein, 24 aa, Mycobacterium bovis
AGAPVGCGFITWSLARQPQLLDLA

SEQ ID NO: 196277 - protein, 25 aa, Mycobacterium bovis
AGAQYKKLRDVLGLLRDAYCRHIGV

SEQ ID NO: 196278 - protein, 23 aa, Mycobacterium bovis
AGASFLRRDGSVWTTDKDGIIMA

SEQ ID NO: 196279 - protein, 24 aa, Mycobacterium bovis
AGATYRLVKRSGFVASSTYADMPL

SEQ ID NO: 196280 - protein, 17 aa, Mycobacterium bovis
AGAVHLNKGCYRGQETV

SEQ ID NO: 196281 - protein, 21 aa, Mycobacterium bovis
AGAVLKVIVESAVLLGQSNAH

SEQ ID NO: 196282 - protein, 20 aa, Mycobacterium bovis
AGAVQRLKVGSAKRFTNITR

SEQ ID NO: 196283 - protein, 17 aa, Mycobacterium bovis
AGDDEWCVISIRSDDEW

SEQ ID NO: 196284 - protein, 22 aa, Mycobacterium bovis
AGDFWGGAGSVACQEFITQLGR

SEQ ID NO: 196285 - protein, 25 aa, Mycobacterium bovis
AGDHAAICWPLLVGMAKAKYYLLTC

SEQ ID NO: 196286 - protein, 22 aa, Mycobacterium bovis
AGDKLWARMDIHSVDERFGADI

SEQ ID NO: 196287 - protein, 18 aa, Mycobacterium bovis
AGDLGDWGGPDALADLDP

SEQ ID NO: 196288 - protein, 17 aa, Mycobacterium bovis
AGDRARLAVTIGSRAHA

SEQ ID NO: 196289 - protein, 21 aa, Mycobacterium bovis
AGDSRLVAVLAELDDADTRAA

SEQ ID NO: 196290 - protein, 18 aa, Mycobacterium bovis
AGDTWAAIGVALGITRQA

SEQ ID NO: 196291 - protein, 22 aa, Mycobacterium bovis
AGDVRLLLPMPADWSYAEAAAI

SEQ ID NO: 196292 - protein, 22 aa, Mycobacterium bovis
AGEAILTGWRMLLDEGRLQDGE

SEQ ID NO: 196293 - protein, 20 aa, Mycobacterium bovis
AGELALLRLACEAADAALTD

SEQ ID NO: 196294 - protein, 20 aa, Mycobacterium bovis
AGERGLCAGGDVVAVYHSAR

SEQ ID NO: 196295 - protein, 18 aa, Mycobacterium bovis
AGETGCRIVLPEGADPFV

SEQ ID NO: 196296 - protein, 23 aa, Mycobacterium bovis
AGETLSALALRFYGDAELYRLIA

SEQ ID NO: 196297 - protein, 22 aa, Mycobacterium bovis
AGFEPIELVMGVSVYHVGFQFS

SEQ ID NO: 196298 - protein, 29 aa, Mycobacterium bovis
AGFGVLLPSWWDRRRKLGLVLSAYTPVDG

SEQ ID NO: 196299 - protein, 20 aa, Mycobacterium bovis
AGFHTLKLQTFLTAGPKEAR

SEQ ID NO: 196300 - protein, 21 aa, Mycobacterium bovis
AGFPLGWVHDVVWAPRPIGGP

SEQ ID NO: 196301 - protein, 17 aa, Mycobacterium bovis
AGFRSLGLDGFRLEITS

SEQ ID NO: 196302 - protein, 20 aa, Mycobacterium bovis
AGGAAGLWGAGGGGGNGGNG

SEQ ID NO: 196303 - protein, 24 aa, Mycobacterium bovis
AGGAGGAGGFGFGGAGGAGGLGGK

SEQ ID NO: 196304 - protein, 21 aa, Mycobacterium bovis
AGGAGGILWGNGGNGGSGAPG

SEQ ID NO: 196305 - protein, 25 aa, Mycobacterium bovis
AGGAGGNAGMLFGSGGGGGTGGFGF

SEQ ID NO: 196306 - protein, 24 aa, Mycobacterium bovis
AGGAGGNGGWLYGNGGPGGAAGLG

SEQ ID NO: 196307 - protein, 29 aa, Mycobacterium bovis
AGGAGGRGGKGIDGGFGGDGGNGGSNNGT

SEQ ID NO: 196308 - protein, 20 aa, Mycobacterium bovis
AGGAGGWLSGHSGAHGAMGS

SEQ ID NO: 196309 - protein, 25 aa, Mycobacterium bovis
AGGDCGRCRRTLRAIIAAARLNPTQ

SEQ ID NO: 196310 - protein, 25 aa, Mycobacterium bovis
AGGDGGRGGLLYGDGGAGGAGGNGS

SEQ ID NO: 196311 - protein, 17 aa, Mycobacterium bovis
AGGFGIPVGSGGAGGSR

SEQ ID NO: 196312 - protein, 24 aa, Mycobacterium bovis
AGGGARGLAHFGVYQELTEAGVVI

SEQ ID NO: 196313 - protein, 26 aa, Mycobacterium bovis
AGGGGRGMRVVHELSALPAEVEAARR

SEQ ID NO: 196314 - protein, 24 aa, Mycobacterium bovis
AGGHGGAGGLIWGNGGAGGNGGNG

SEQ ID NO: 196315 - protein, 24 aa, Mycobacterium bovis
AGGHSLLPMMKLRIANPEYLVDIN

SEQ ID NO: 196316 - protein, 19 aa, Mycobacterium bovis
AGGKADIANSLGDNATVTG

SEQ ID NO: 196317 - protein, 23 aa, Mycobacterium bovis
AGGKRFRPLFTVLSAQIGPQPDA

SEQ ID NO: 196318 - protein, 18 aa, Mycobacterium bovis
AGGLLIGNGGAGGVGGTA

SEQ ID NO: 196319 - protein, 19 aa, Mycobacterium bovis
AGGNARLIGDGGRGGNGGE

SEQ ID NO: 196320 - protein, 19 aa, Mycobacterium bovis
AGGNAYLFGSGGAGGQGGM

SEQ ID NO: 196321 - protein, 18 aa, Mycobacterium bovis
AGGRGVGSAENFSVVEAL

SEQ ID NO: 196322 - protein, 18 aa, Mycobacterium bovis
AGGSGGFLSGAAGVSGAD

SEQ ID NO: 196323 - protein, 19 aa, Mycobacterium bovis
AGGSLEIFLTPQLPAPLIQ

SEQ ID NO: 196324 - protein, 19 aa, Mycobacterium bovis
AGGSVRWDPTNGQGRVYYG

SEQ ID NO: 196325 - protein, 28 aa, Mycobacterium bovis
AGGTGGKGGDGFGVFGKGGAGGTGGRGG

SEQ ID NO: 196326 - protein, 17 aa, Mycobacterium bovis
AGGTLWVELTGMGVTWM

SEQ ID NO: 196327 - protein, 18 aa, Mycobacterium bovis
AGGVGGFGVHPALLDAVL

SEQ ID NO: 196328 - protein, 17 aa, Mycobacterium bovis
AGGYGLDPERIWTTVYF

SEQ ID NO: 196329 - protein, 25 aa, Mycobacterium bovis
AGHFELRPGQALVITVPVSDAPYLG

SEQ ID NO: 196330 - protein, 24 aa, Mycobacterium bovis
AGHGRSGFLLAPWTAEQIVSELVS

SEQ ID NO: 196331 - protein, 23 aa, Mycobacterium bovis
AGHPFAATGGRILAQTAKQLAEK

SEQ ID NO: 196332 - protein, 23 aa, Mycobacterium bovis
AGHSRWLSAEAMAARLNDVGVGR

SEQ ID NO: 196333 - protein, 19 aa, Mycobacterium bovis
AGHYGMCGRAYDPRFLFAW

SEQ ID NO: 196334 - protein, 17 aa, Mycobacterium bovis
AGIAAAVHAGRAGAQRG

SEQ ID NO: 196335 - protein, 25 aa, Mycobacterium bovis
AGIDDSWAALRWVGENAAELGGDPS

SEQ ID NO: 196336 - protein, 25 aa, Mycobacterium bovis
AGILDVLDNYAFVRTSGYLPGPHDV

SEQ ID NO: 196337 - protein, 18 aa, Mycobacterium bovis
AGIPLLAGAISKAVLPPI

SEQ ID NO: 196338 - protein, 18 aa, Mycobacterium bovis
AGIRRWLDSPSLMVADMF

SEQ ID NO: 196339 - protein, 19 aa, Mycobacterium bovis
AGITCAVLIPQGKIAMGKL

SEQ ID NO: 196340 - protein, 17 aa, Mycobacterium bovis
AGKRLAPHALEWDAAKH

SEQ ID NO: 196341 - protein, 24 aa, Mycobacterium bovis
AGKRLPVPLFPGFDTLGTLEYITK

SEQ ID NO: 196342 - protein, 17 aa, Mycobacterium bovis
AGLAGLANRIVDAVDSL

SEQ ID NO: 196343 - protein, 17 aa, Mycobacterium bovis
AGLAMLAPIWGYAPLLD

SEQ ID NO: 196344 - protein, 19 aa, Mycobacterium bovis
AGLDGYSAADCVALLREAA

SEQ ID NO: 196345 - protein, 25 aa, Mycobacterium bovis
AGLEAAKPFIAALCTAQQELADAAG

SEQ ID NO: 196346 - protein, 17 aa, Mycobacterium bovis
AGLELLYRMADFCRPDW

SEQ ID NO: 196347 - protein, 27 aa, Mycobacterium bovis
AGLEPDLKWERFITAVRLLAERLGVRQ

SEQ ID NO: 196348 - protein, 24 aa, Mycobacterium bovis
AGLGLRSGLSAGLAHAASAGLGQA

SEQ ID NO: 196349 - protein, 18 aa, Mycobacterium bovis
AGLKAIYLSGWQVAGDAN

SEQ ID NO: 196350 - protein, 27 aa, Mycobacterium bovis
AGLKTSRDAWCYNFSRGALEANIGRTI

SEQ ID NO: 196351 - protein, 18 aa, Mycobacterium bovis
AGLLDYPMHIGARCQSVC

SEQ ID NO: 196352 - protein, 18 aa, Mycobacterium bovis
AGLLRPPAAQRLVSALRS

SEQ ID NO: 196353 - protein, 17 aa, Mycobacterium bovis
AGLPRTMTFKVIKRQLS

SEQ ID NO: 196354 - protein, 24 aa, Mycobacterium bovis
AGLQARLGLDSGKWTHEQMARVAF

SEQ ID NO: 196355 - protein, 17 aa, Mycobacterium bovis
AGLRAAGRVAGLIGTIG

SEQ ID NO: 196356 - protein, 22 aa, Mycobacterium bovis
AGLRICARIAQARPLRDLLGSI

SEQ ID NO: 196357 - protein, 17 aa, Mycobacterium bovis
AGLTLALAADWRVSGDN

SEQ ID NO: 196358 - protein, 17 aa, Mycobacterium bovis
AGLVCAHTGGALPRTRP

SEQ ID NO: 196359 - protein, 17 aa, Mycobacterium bovis
AGLWEWAERLGDEVTLD

SEQ ID NO: 196360 - protein, 23 aa, Mycobacterium bovis
AGMARLAVIAAKVITGRKLSRRP

SEQ ID NO: 196361 - protein, 17 aa, Mycobacterium bovis
AGMEVCCGGILGMGETL

SEQ ID NO: 196362 - protein, 19 aa, Mycobacterium bovis
AGMHPWGKWGNDFTEYGVV

SEQ ID NO: 196363 - protein, 23 aa, Mycobacterium bovis
AGMPERLRLPTARPYPPVADQRG

SEQ ID NO: 196364 - protein, 24 aa, Mycobacterium bovis
AGMPGMPFGTMGGQGFGRAVPQYG

SEQ ID NO: 196365 - protein, 23 aa, Mycobacterium bovis
AGNGGSGGNGFDSFASGGTGGAG

SEQ ID NO: 196366 - protein, 18 aa, Mycobacterium bovis
AGNLVLMVQPPRGFGENP

SEQ ID NO: 196367 - protein, 25 aa, Mycobacterium bovis
AGNPEIRPAHLLMALLTQNDGIAAP

SEQ ID NO: 196368 - protein, 17 aa, Mycobacterium bovis
AGNWKRWYDNNIPIADQ

SEQ ID NO: 196369 - protein, 19 aa, Mycobacterium bovis
AGPADWALLGAALLGVGGS

SEQ ID NO: 196370 - protein, 24 aa, Mycobacterium bovis
AGPAYNTGSAWGYTPKGATGVPTR

SEQ ID NO: 196371 - protein, 18 aa, Mycobacterium bovis
AGPEIGVASTKTFLAQIA

SEQ ID NO: 196372 - protein, 29 aa, Mycobacterium bovis
AGPFGTTIAHGFMTLALLPRLQHQMYTVK

SEQ ID NO: 196373 - protein, 29 aa, Mycobacterium bovis
AGPGECVALLFERCAPAVVAMVAVLKTGA

SEQ ID NO: 196374 - protein, 24 aa, Mycobacterium bovis
AGPLPLQIICDMMGIPKADHQRIF

SEQ ID NO: 196375 - protein, 19 aa, Mycobacterium bovis
AGPRRAAVSSFGLSGTNAH

SEQ ID NO: 196376 - protein, 18 aa, Mycobacterium bovis
AGQACLAHALAHRGDTEA

SEQ ID NO: 196377 - protein, 19 aa, Mycobacterium bovis
AGQFCLANTIAVAPAATNL

SEQ ID NO: 196378 - protein, 28 aa, Mycobacterium bovis
AGQGCAITTRLVVPRARYEEAVAIAAAT

SEQ ID NO: 196379 - protein, 24 aa, Mycobacterium bovis
AGQIAHCLAELVTLDTPTVSILLG

SEQ ID NO: 196380 - protein, 18 aa, Mycobacterium bovis
AGQRFVIDVTVWIDLAEA

SEQ ID NO: 196381 - protein, 21 aa, Mycobacterium bovis
AGRDFTVDWVHLKLNDQAQRT

SEQ ID NO: 196382 - protein, 25 aa, Mycobacterium bovis
AGRGLRCIAPTWPLGAHPKPLRPGA

SEQ ID NO: 196383 - protein, 24 aa, Mycobacterium bovis
AGRHRCVGAAFAIMQIKAIFSVLL

SEQ ID NO: 196384 - protein, 24 aa, Mycobacterium bovis
AGRIGFPAIVGIIADVLHAADQWA

SEQ ID NO: 196385 - protein, 24 aa, Mycobacterium bovis
AGRIPVPVPGFGVWALDSLRRANH

SEQ ID NO: 196386 - protein, 25 aa, Mycobacterium bovis
AGRIVSFDAAGGWNIEEEGYQAVGS

SEQ ID NO: 196387 - protein, 19 aa, Mycobacterium bovis
AGRLHILEVQRLIRFMPKV

SEQ ID NO: 196388 - protein, 26 aa, Mycobacterium bovis
AGRTWHPHQVPAFLAAGYRCITFDNR

SEQ ID NO: 196389 - protein, 17 aa, Mycobacterium bovis
AGRVWVNCYHLYPAHAA

SEQ ID NO: 196390 - protein, 19 aa, Mycobacterium bovis
AGSALQIHGAIAFTWEHDL

SEQ ID NO: 196391 - protein, 17 aa, Mycobacterium bovis
AGSDAAWLRAELNNERG

SEQ ID NO: 196392 - protein, 19 aa, Mycobacterium bovis
AGSDPDWDARVALHRARRP

SEQ ID NO: 196393 - protein, 23 aa, Mycobacterium bovis
AGSEPMSAAAVAWDQLAMELASA

SEQ ID NO: 196394 - protein, 25 aa, Mycobacterium bovis
AGSGPMLAAAAAWDGLADELAVAAS

SEQ ID NO: 196395 - protein, 20 aa, Mycobacterium bovis
AGSLVLLAWGAANRDPRQYE

SEQ ID NO: 196396 - protein, 22 aa, Mycobacterium bovis
AGSNALGLFLGLGGSGGQGGDS

SEQ ID NO: 196397 - protein, 17 aa, Mycobacterium bovis
AGSNNWGLANLGVGNIG

SEQ ID NO: 196398 - protein, 18 aa, Mycobacterium bovis
AGSPEERAAVLGILAELL

SEQ ID NO: 196399 - protein, 25 aa, Mycobacterium bovis
AGSPGAVCRWCGRVDPTLRCVRCGS

SEQ ID NO: 196400 - protein, 20 aa, Mycobacterium bovis
AGSRATHIVVWATLDKSLGR

SEQ ID NO: 196401 - protein, 20 aa, Mycobacterium bovis
AGSVPVELNVSAGFDVTELP

SEQ ID NO: 196402 - protein, 19 aa, Mycobacterium bovis
AGTAVRSGAGAARVAGGSV

SEQ ID NO: 196403 - protein, 19 aa, Mycobacterium bovis
AGTGLAAISWGLAHERMSI

SEQ ID NO: 196404 - protein, 30 aa, Mycobacterium bovis
AGTGNSGNFGVDGEAGFSGGAGGNGGVGGA

SEQ ID NO: 196405 - protein, 17 aa, Mycobacterium bovis
AGTGNWGIGNSGAGNFG

SEQ ID NO: 196406 - protein, 19 aa, Mycobacterium bovis
AGTGVRFTPTLTFTLDTIS

SEQ ID NO: 196407 - protein, 41 aa, Mycobacterium bovis
AGTPRRYGVRWHYRLPVWSDFVEVHWSRWGEAYVTPVEPDL

SEQ ID NO: 196408 - protein, 19 aa, Mycobacterium bovis
AGTSGWWNQGHDVLAGAGS

SEQ ID NO: 196409 - protein, 30 aa, Mycobacterium bovis
AGTSISGFFNFGSLMSGFANFDDEVSGYLN

SEQ ID NO: 196410 - protein, 19 aa, Mycobacterium bovis
AGTTFPTDICEPVAVVGIG

SEQ ID NO: 196411 - protein, 24 aa, Mycobacterium bovis
AGTVARAFLRQALGVEVLSHVISI

SEQ ID NO: 196412 - protein, 17 aa, Mycobacterium bovis
AGTWVKAVAGIRLALSL

SEQ ID NO: 196413 - protein, 19 aa, Mycobacterium bovis
AGVAQCWHQLVGDTGEIVS

SEQ ID NO: 196414 - protein, 20 aa, Mycobacterium bovis
AGVARWTLDTAVAYAKVREQ

SEQ ID NO: 196415 - protein, 22 aa, Mycobacterium bovis
AGVGGAGGFALATTASGGAGGA

SEQ ID NO: 196416 - protein, 18 aa, Mycobacterium bovis
AGVKITWTPIEPTLPSID

SEQ ID NO: 196417 - protein, 25 aa, Mycobacterium bovis
AGVLKGEVKDVLLLDVTPLSLGIET

SEQ ID NO: 196418 - protein, 25 aa, Mycobacterium bovis
AGVLLRYVPLTAKRVTGIVSRGGSI

SEQ ID NO: 196419 - protein, 33 aa, Mycobacterium bovis
AGVMAGAVVSPVWPAPRALGLRAVAATATSASS

SEQ ID NO: 196420 - protein, 20 aa, Mycobacterium bovis
AGVPLKAPVAGIAMGLVSDD

SEQ ID NO: 196421 - protein, 26 aa, Mycobacterium bovis
AGVPYPSLKRMNPWKRFFHNQTKIDE

SEQ ID NO: 196422 - protein, 17 aa, Mycobacterium bovis
AGVRLLGCYHPSQQNMF

SEQ ID NO: 196423 - protein, 17 aa, Mycobacterium bovis
AGVSRVYLAGPEKALGD

SEQ ID NO: 196424 - protein, 20 aa, Mycobacterium bovis
AGVSSFGFGGTNAHVIVEEA

SEQ ID NO: 196425 - protein, 20 aa, Mycobacterium bovis
AGVVCPVHLGIMRGALQTWA

SEQ ID NO: 196426 - protein, 22 aa, Mycobacterium bovis
AGVVRLRFGLTDGQPRTLDEIG

SEQ ID NO: 196427 - protein, 26 aa, Mycobacterium bovis
AGVYPPCSAFEAWFVSAALDDAAFGR

SEQ ID NO: 196428 - protein, 26 aa, Mycobacterium bovis
AGWPNLAAELQLAFQQLLVGDYNAAV

SEQ ID NO: 196429 - protein, 17 aa, Mycobacterium bovis
AGYALAGRHVHVVTIND

SEQ ID NO: 196430 - protein, 25 aa, Mycobacterium bovis
AGYAYFAGRLGDWMRVDGENLGTAP

SEQ ID NO: 196431 - protein, 21 aa, Mycobacterium bovis
AGYEKWRIRFASTAWTSTWRR

SEQ ID NO: 196432 - protein, 17 aa, Mycobacterium bovis
AGYKVPRSLWFVDEVKR

SEQ ID NO: 196433 - protein, 24 aa, Mycobacterium bovis
AGYRGEIKVALINLDPAAPIVVHR

SEQ ID NO: 196434 - protein, 19 aa, Mycobacterium bovis
AGYRLGEMVQVESWSHEWR

SEQ ID NO: 196435 - protein, 17 aa, Mycobacterium bovis
AGYRRFLERRLRETFGF

SEQ ID NO: 196436 - protein, 20 aa, Mycobacterium bovis
AHAAIKRFLTVSTPGSHLIL

SEQ ID NO: 196437 - protein, 25 aa, Mycobacterium bovis
AHAAILPLYYLRRAGIAESDLQVIR

SEQ ID NO: 196438 - protein, 19 aa, Mycobacterium bovis
AHAGIPVTVVPGVTSAIAV

SEQ ID NO: 196439 - protein, 23 aa, Mycobacterium bovis
AHAIPGLRQALGLAEDGTDERAT

SEQ ID NO: 196440 - protein, 18 aa, Mycobacterium bovis
AHALAFAAEGARVVVNDI

SEQ ID NO: 196441 - protein, 20 aa, Mycobacterium bovis
AHATAWYGLHELARIRAGDT

SEQ ID NO: 196442 - protein, 21 aa, Mycobacterium bovis
AHDWGGPVAFIMMLRHPEKVT

SEQ ID NO: 196443 - protein, 18 aa, Mycobacterium bovis
AHFADGWNTFNLTLQGDV

SEQ ID NO: 196444 - protein, 26 aa, Mycobacterium bovis
AHGIDTVVVGWGYGRADFIDKTSTTV

SEQ ID NO: 196445 - protein, 17 aa, Mycobacterium bovis
AHGPYAVGITGEDAQLF

SEQ ID NO: 196446 - protein, 20 aa, Mycobacterium bovis
AHGRRRRARFFGRNVNVPLM

SEQ ID NO: 196447 - protein, 20 aa, Mycobacterium bovis
AHHRESFLYTNFEELCDIFA

SEQ ID NO: 196448 - protein, 27 aa, Mycobacterium bovis
AHLEHPKMPLVPLIDGWETVVEMEAAL

SEQ ID NO: 196449 - protein, 17 aa, Mycobacterium bovis
AHLPRAVRWHRYSLDNG

SEQ ID NO: 196450 - protein, 17 aa, Mycobacterium bovis
AHLRGGELTVRFRPNPE

SEQ ID NO: 196451 - protein, 24 aa, Mycobacterium bovis
AHLRNMAFYNFGLRLLKRARDADR

SEQ ID NO: 196452 - protein, 18 aa, Mycobacterium bovis
AHLRPELGGQGFGQVKLA

SEQ ID NO: 196453 - protein, 19 aa, Mycobacterium bovis
AHLTGNVAMGAFTIPQIDI

SEQ ID NO: 196454 - protein, 17 aa, Mycobacterium bovis
AHNRVHFPRAMFDEPLP

SEQ ID NO: 196455 - protein, 21 aa, Mycobacterium bovis
AHPAMKALVVCIELCSVNAVF

SEQ ID NO: 196456 - protein, 18 aa, Mycobacterium bovis
AHPEPLPPVSGLTIAVER

SEQ ID NO: 196457 - protein, 25 aa, Mycobacterium bovis
AHPQGRISLAIAHRPGERNGVADLC

SEQ ID NO: 196458 - protein, 18 aa, Mycobacterium bovis
AHQLELRASWTATTPDLG

SEQ ID NO: 196459 - protein, 27 aa, Mycobacterium bovis
AHRERLGLPGLRDWLRRQAKAGAGPPE

SEQ ID NO: 196460 - protein, 24 aa, Mycobacterium bovis
AHRFAEAVTAIWHGRVEIDRFNEL

SEQ ID NO: 196461 - protein, 30 aa, Mycobacterium bovis
AHSISPWGTWEWIGPPALGAVLPARGMAKL

SEQ ID NO: 196462 - protein, 25 aa, Mycobacterium bovis
AHSPKRLESELTWIEEHTGGKPYGV

SEQ ID NO: 196463 - protein, 23 aa, Mycobacterium bovis
AHTRPDQLVAMPALPTTPIGKID

SEQ ID NO: 196464 - protein, 18 aa, Mycobacterium bovis
AHTTRARQVLVATEVGML

SEQ ID NO: 196465 - protein, 25 aa, Mycobacterium bovis
AHVGIQLYVKRVFIMGDCDQLMPEY

SEQ ID NO: 196466 - protein, 20 aa, Mycobacterium bovis
AHWKAHKLDLAPVLHEPESA

SEQ ID NO: 196467 - protein, 25 aa, Mycobacterium bovis
AHYHKIHLYDAFGFTESRTVAPGRE

SEQ ID NO: 196468 - protein, 17 aa, Mycobacterium bovis
AIAQLNFANARRNPNAQ

SEQ ID NO: 196469 - protein, 18 aa, Mycobacterium bovis
AIAQTWWSERFIAVLEDI

SEQ ID NO: 196470 - protein, 25 aa, Mycobacterium bovis
AIARFKRLDGYDVRFLTGTDEHGLK

SEQ ID NO: 196471 - protein, 24 aa, Mycobacterium bovis
AIASCPPGRVEVVANYTAFLQLQR

SEQ ID NO: 196472 - protein, 24 aa, Mycobacterium bovis
AIAVAKRGATVFALARNGNALDEL

SEQ ID NO: 196473 - protein, 33 aa, Mycobacterium bovis
AIAYARARGLPVLGLCLGLQCIVIEAARSVGLT

SEQ ID NO: 196474 - protein, 25 aa, Mycobacterium bovis
AICSARTAAQFGIEPRVAMLSYSTG

SEQ ID NO: 196475 - protein, 17 aa, Mycobacterium bovis
AIDDTWLRTGDLGVYLD

SEQ ID NO: 196476 - protein, 28 aa, Mycobacterium bovis
AIDIPAIRPEFSANVAIDSFTVPSIPIP

SEQ ID NO: 196477 - protein, 31 aa, Mycobacterium bovis
AIDLELRYRGLRAPHKIKLGVSGCARECAEA

SEQ ID NO: 196478 - protein, 17 aa, Mycobacterium bovis
AIEDAWAATRWVAEHGR

SEQ ID NO: 196479 - protein, 33 aa, Mycobacterium bovis
AIEELRARFNLRYPLAHLRPFLSTHERDLTMGG

SEQ ID NO: 196480 - protein, 20 aa, Mycobacterium bovis
AIELGRLGGLGVLNGEGLIG

SEQ ID NO: 196481 - protein, 26 aa, Mycobacterium bovis
AIEVYPHPATVALFRLPRALKYKAKP

SEQ ID NO: 196482 - protein, 19 aa, Mycobacterium bovis
AIGCPLINIHHSFLPAFTG

SEQ ID NO: 196483 - protein, 19 aa, Mycobacterium bovis
AIGCVPWLSSEAVAETLLA

SEQ ID NO: 196484 - protein, 30 aa, Mycobacterium bovis
AIGMTIPYAALEIMKLRLTRSAYQQATGLA

SEQ ID NO: 196485 - protein, 17 aa, Mycobacterium bovis
AIGRPRVPVEVNHEPFV

SEQ ID NO: 196486 - protein, 22 aa, Mycobacterium bovis
AIHRRCRRGGDTVRSLIDCQVA

SEQ ID NO: 196487 - protein, 24 aa, Mycobacterium bovis
AIIDSLLRSCPRLTILTTSTEAIG

SEQ ID NO: 196488 - protein, 22 aa, Mycobacterium bovis
AILAGEAHFAIGYTEPEAGTDL

SEQ ID NO: 196489 - protein, 19 aa, Mycobacterium bovis
AILANRLSPALTFGGANLN

SEQ ID NO: 196490 - protein, 18 aa, Mycobacterium bovis
AILTAGLLGEEVPMPVLL

SEQ ID NO: 196491 - protein, 28 aa, Mycobacterium bovis
AINAPFLAALGRPLIGNGADGAPGTGAA

SEQ ID NO: 196492 - protein, 26 aa, Mycobacterium bovis
AINGHVRAGGFGLVGACDMVVAGPES

SEQ ID NO: 196493 - protein, 27 aa, Mycobacterium bovis
AIPGDLGDRFGFCIPDLAVWDNPSAND

SEQ ID NO: 196494 - protein, 19 aa, Mycobacterium bovis
AIQVPPNGLPVILGPDHPI

SEQ ID NO: 196495 - protein, 19 aa, Mycobacterium bovis
AIRADFPILKRIMRGGNPL

SEQ ID NO: 196496 - protein, 19 aa, Mycobacterium bovis
AIRAGDCDLALAGGVCVMG

SEQ ID NO: 196497 - protein, 17 aa, Mycobacterium bovis
AIRARRSLDSAAGWLAP

SEQ ID NO: 196498 - protein, 17 aa, Mycobacterium bovis
AIREWARRNGHNVSTRG

SEQ ID NO: 196499 - protein, 20 aa, Mycobacterium bovis
AIRVAGWIDKLGAVWVEGQL

SEQ ID NO: 196500 - protein, 28 aa, Mycobacterium bovis
AISDELWDLLPGYLIFRSIIPNRPPTQD

SEQ ID NO: 196501 - protein, 23 aa, Mycobacterium bovis
AITGCLIAGVPVVPVPADVGVTE

SEQ ID NO: 196502 - protein, 18 aa, Mycobacterium bovis
AITIGFDAGDGFLGRLRG

SEQ ID NO: 196503 - protein, 18 aa, Mycobacterium bovis
AITKVIWSEYFRRYTDLA

SEQ ID NO: 196504 - protein, 17 aa, Mycobacterium bovis
AITWPEIAASADGSVYV

SEQ ID NO: 196505 - protein, 17 aa, Mycobacterium bovis
AIVGNCYIEIMPMGTRV

SEQ ID NO: 196506 - protein, 19 aa, Mycobacterium bovis
AIYVGSLSVPQGWAEAAPV

SEQ ID NO: 196507 - protein, 19 aa, Mycobacterium bovis
AKAALRYADALIWTPAHLA

SEQ ID NO: 196508 - protein, 19 aa, Mycobacterium bovis
AKADARRKVRDGGEREMRQ

SEQ ID NO: 196509 - protein, 17 aa, Mycobacterium bovis
AKALRDFASQYGVPMEQ

SEQ ID NO: 196510 - protein, 21 aa, Mycobacterium bovis
AKALRSGGVVVVFPGGDYDAY

SEQ ID NO: 196511 - protein, 21 aa, Mycobacterium bovis
AKANEVALILVGHVTKDGAIA

SEQ ID NO: 196512 - protein, 22 aa, Mycobacterium bovis
AKARGANILARIMGASITSDGF

SEQ ID NO: 196513 - protein, 17 aa, Mycobacterium bovis
AKASLGQQVPHPSRLGN

SEQ ID NO: 196514 - protein, 27 aa, Mycobacterium bovis
AKDCIQVLGGIGCTWEHDAHLYLRRAH

SEQ ID NO: 196515 - protein, 17 aa, Mycobacterium bovis
AKDRGLWNLFLSAESGL

SEQ ID NO: 196516 - protein, 18 aa, Mycobacterium bovis
AKEALNFIDVQRVNASYR

SEQ ID NO: 196517 - protein, 29 aa, Mycobacterium bovis
AKEDYFKLGYRGARFAFGYGACPDLEDRA

SEQ ID NO: 196518 - protein, 18 aa, Mycobacterium bovis
AKEEVIHLVPDVNKERGP

SEQ ID NO: 196519 - protein, 19 aa, Mycobacterium bovis
AKEVISIAGRNIFPTEVEL

SEQ ID NO: 196520 - protein, 17 aa, Mycobacterium bovis
AKFASAVSKNPFVGEPI

SEQ ID NO: 196521 - protein, 23 aa, Mycobacterium bovis
AKFGLTEAIAAYSTRLKITPTRV

SEQ ID NO: 196522 - protein, 17 aa, Mycobacterium bovis
AKFLDKRGPGIQQLACR

SEQ ID NO: 196523 - protein, 26 aa, Mycobacterium bovis
AKFRPGPRRRLGVLVDHLVAGSKEAR

SEQ ID NO: 196524 - protein, 27 aa, Mycobacterium bovis
AKGESYPTAMLMVFKLHRDFDIAEALK

SEQ ID NO: 196525 - protein, 18 aa, Mycobacterium bovis
AKGGAAVFQMMGLCQILR

SEQ ID NO: 196526 - protein, 26 aa, Mycobacterium bovis
AKGHDTFCPVGPWIVTDLAPFDPADL

SEQ ID NO: 196527 - protein, 24 aa, Mycobacterium bovis
AKGLEFPVVFVTGWEDGMFPHMRA

SEQ ID NO: 196528 - protein, 24 aa, Mycobacterium bovis
AKKGLEFVRPVAVDLTYIPVVGHA

SEQ ID NO: 196529 - protein, 21 aa, Mycobacterium bovis
AKKPVVTDFCDFRTAEQRERA

SEQ ID NO: 196530 - protein, 19 aa, Mycobacterium bovis
AKLFDEWFPANKLVKLGLR

SEQ ID NO: 196531 - protein, 20 aa, Mycobacterium bovis
AKLGAWGVIASVQPNFDELW

SEQ ID NO: 196532 - protein, 18 aa, Mycobacterium bovis
AKLLHAFGECTVPRVTLV

SEQ ID NO: 196533 - protein, 17 aa, Mycobacterium bovis
AKLPFVRELCRDYQHID

SEQ ID NO: 196534 - protein, 20 aa, Mycobacterium bovis
AKLPTIAAYAYKKSVGQPFL

SEQ ID NO: 196535 - protein, 25 aa, Mycobacterium bovis
AKLQKRLTEELAWVRSGAKARQAKS

SEQ ID NO: 196536 - protein, 20 aa, Mycobacterium bovis
AKLRDELALVIKDLELACDK

SEQ ID NO: 196537 - protein, 17 aa, Mycobacterium bovis
AKLTEWLKLALDEPHLL

SEQ ID NO: 196538 - protein, 21 aa, Mycobacterium bovis
AKMFNCTGWKIGWACGPAELI

SEQ ID NO: 196539 - protein, 20 aa, Mycobacterium bovis
AKMLRLAVDEVFQMQSEARA

SEQ ID NO: 196540 - protein, 20 aa, Mycobacterium bovis
AKMRALRQLWARVAEVVGDP

SEQ ID NO: 196541 - protein, 22 aa, Mycobacterium bovis
AKNLPARPAVPVLSGVLLTGSD

SEQ ID NO: 196542 - protein, 28 aa, Mycobacterium bovis
AKPEYWLSQQGRLAHPMVLRPGDDHYRP

SEQ ID NO: 196543 - protein, 21 aa, Mycobacterium bovis
AKPGDLALLIGYGAGLSYAAQ

SEQ ID NO: 196544 - protein, 19 aa, Mycobacterium bovis
AKPGKTLCSIWDLTDWQGT

SEQ ID NO: 196545 - protein, 20 aa, Mycobacterium bovis
AKQAPGWRVSTSVDENHTHT

SEQ ID NO: 196546 - protein, 26 aa, Mycobacterium bovis
AKRASRLSAVVVRWSRARKRYERQGI

SEQ ID NO: 196547 - protein, 22 aa, Mycobacterium bovis
AKRTLAVAVYNHYKRIQAGEKG

SEQ ID NO: 196548 - protein, 17 aa, Mycobacterium bovis
AKSALDAVVSRWHAESS

SEQ ID NO: 196549 - protein, 30 aa, Mycobacterium bovis
AKSEYFTGTGLKGWINRWFYSVSGQVPIDR

SEQ ID NO: 196550 - protein, 18 aa, Mycobacterium bovis
AKSPRLRQAGTFADAALR

SEQ ID NO: 196551 - protein, 25 aa, Mycobacterium bovis
AKTAASRNKHGWVTVGDVGYLDDDG

SEQ ID NO: 196552 - protein, 22 aa, Mycobacterium bovis
AKTARRPRVIGVVSNGDTAAAP

SEQ ID NO: 196553 - protein, 18 aa, Mycobacterium bovis
AKVDGAWNLHELTRHLDV

SEQ ID NO: 196554 - protein, 23 aa, Mycobacterium bovis
AKVGYPIKWRDYSKLAIDRDDLY

SEQ ID NO: 196555 - protein, 24 aa, Mycobacterium bovis
AKVLSRYVDAIVWRTFGQERLDAM

SEQ ID NO: 196556 - protein, 21 aa, Mycobacterium bovis
AKVPTMAALLIKESVNQTVDA

SEQ ID NO: 196557 - protein, 23 aa, Mycobacterium bovis
AKVRPGVPVIFLDTGYHFVETIG

SEQ ID NO: 196558 - protein, 24 aa, Mycobacterium bovis
AKVVSERRLWLAVLRAQAELGVAV

SEQ ID NO: 196559 - protein, 24 aa, Mycobacterium bovis
AKYRRDKVGIVFQAFNLVSSLTAL

SEQ ID NO: 196560 - protein, 17 aa, Mycobacterium bovis
ALAADVGAEFVVVAGDV

SEQ ID NO: 196561 - protein, 30 aa, Mycobacterium bovis
ALAAEICDGWLPIFYSPRMAGMYNEWLDEG

SEQ ID NO: 196562 - protein, 19 aa, Mycobacterium bovis
ALAALLARHRSAEVDASYA

SEQ ID NO: 196563 - protein, 26 aa, Mycobacterium bovis
ALAARGFSHNDFRAVADLIAAALTAT

SEQ ID NO: 196564 - protein, 26 aa, Mycobacterium bovis
ALADHARLDFLAGLRVVPAELGGAAG

SEQ ID NO: 196565 - protein, 24 aa, Mycobacterium bovis
ALADPRRVPVWLPYIRGERTPFHE

SEQ ID NO: 196566 - protein, 22 aa, Mycobacterium bovis
ALAEAACRAFDALAARYDVVVA

SEQ ID NO: 196567 - protein, 23 aa, Mycobacterium bovis
ALAEPADLIARVRAQQSMLGADL

SEQ ID NO: 196568 - protein, 17 aa, Mycobacterium bovis
ALAEVFAEVGLPEGVLS

SEQ ID NO: 196569 - protein, 26 aa, Mycobacterium bovis
ALAGEYGGPCYARIDAPADREQKARL

SEQ ID NO: 196570 - protein, 35 aa, Mycobacterium bovis
ALAIPEIALTFGVDIPIHIPINIDAGVVTLQGFSI

SEQ ID NO: 196571 - protein, 25 aa, Mycobacterium bovis
ALAKLWAQSCEWEPVTPKSLRLLQV

SEQ ID NO: 196572 - protein, 22 aa, Mycobacterium bovis
ALAKQMLRHFGVLLDNALAAPD

SEQ ID NO: 196573 - protein, 23 aa, Mycobacterium bovis
ALALRAAEYGRTVVVLTIDPAKR

SEQ ID NO: 196574 - protein, 18 aa, Mycobacterium bovis
ALAPLAEFALHTPILGSE

SEQ ID NO: 196575 - protein, 21 aa, Mycobacterium bovis
ALAPRRTTLPGGLRVVTEFLP

SEQ ID NO: 196576 - protein, 19 aa, Mycobacterium bovis
ALAQCLRGGTPDEVAKLVL

SEQ ID NO: 196577 - protein, 24 aa, Mycobacterium bovis
ALAQLRPLPERLVMVGDRSHDVDG

SEQ ID NO: 196578 - protein, 19 aa, Mycobacterium bovis
ALARAGFHTLKLQTFLTAG

SEQ ID NO: 196579 - protein, 25 aa, Mycobacterium bovis
ALARELADAILIRKVDWVDEITRVH

SEQ ID NO: 196580 - protein, 18 aa, Mycobacterium bovis
ALARLGMFAPALSYLEEP

SEQ ID NO: 196581 - protein, 24 aa, Mycobacterium bovis
ALARRAALRPGDTVLVLGAAGGVG

SEQ ID NO: 196582 - protein, 20 aa, Mycobacterium bovis
ALARRGCVYVSVNYRLGALG

SEQ ID NO: 196583 - protein, 20 aa, Mycobacterium bovis
ALARRVSPTPVRLADERLTT

SEQ ID NO: 196584 - protein, 26 aa, Mycobacterium bovis
ALARVHPRATGIVLMLGDQPQVAPAT

SEQ ID NO: 196585 - protein, 17 aa, Mycobacterium bovis
ALATLVVNAIRKTLKAV

SEQ ID NO: 196586 - protein, 20 aa, Mycobacterium bovis
ALCSPTRQALLTGRNHHSAG

SEQ ID NO: 196587 - protein, 22 aa, Mycobacterium bovis
ALCVGMCGQLIYVNRAAEVVAA

SEQ ID NO: 196588 - protein, 20 aa, Mycobacterium bovis
ALDASLLLVVLTRFLPPDDP

SEQ ID NO: 196589 - protein, 17 aa, Mycobacterium bovis
ALDHPLLVERPEPKRAG

SEQ ID NO: 196590 - protein, 26 aa, Mycobacterium bovis
ALDIYRIGQNVAWRRWTDIAFGLTSD

SEQ ID NO: 196591 - protein, 23 aa, Mycobacterium bovis
ALDKRLGADFELLDFDCGHMVPQ

SEQ ID NO: 196592 - protein, 22 aa, Mycobacterium bovis
ALDMAYKLVAYDGSGRTKFSSG

SEQ ID NO: 196593 - protein, 20 aa, Mycobacterium bovis
ALDQRIGLRYAMPPMTDTNT

SEQ ID NO: 196594 - protein, 25 aa, Mycobacterium bovis
ALDRLRPMLDRALTVLIDAPEPLPA

SEQ ID NO: 196595 - protein, 26 aa, Mycobacterium bovis
ALDRNALHEVVGWWAKLPVTGMQPVQ

SEQ ID NO: 196596 - protein, 24 aa, Mycobacterium bovis
ALDTFTLRVGRPIGPMLAQTATSV

SEQ ID NO: 196597 - protein, 32 aa, Mycobacterium bovis
ALDVYRVGQNVAWQRWTEIAFGLTTDPQELHE

SEQ ID NO: 196598 - protein, 19 aa, Mycobacterium bovis
ALDYEIWDDGWTVVTKDRK

SEQ ID NO: 196599 - protein, 19 aa, Mycobacterium bovis
ALEDGYRVFTELTPHPLLT

SEQ ID NO: 196600 - protein, 23 aa, Mycobacterium bovis
ALEEAWETAGLRGCGRAVKVQAP

SEQ ID NO: 196601 - protein, 18 aa, Mycobacterium bovis
ALEHRGFESLFLAEHTHI

SEQ ID NO: 196602 - protein, 27 aa, Mycobacterium bovis
ALELDWYEHLGLCPKGEAEALLRSGAT

SEQ ID NO: 196603 - protein, 25 aa, Mycobacterium bovis
ALELMRRVGLRPTKLTNAWVPFVVA

SEQ ID NO: 196604 - protein, 17 aa, Mycobacterium bovis
ALELTWRSLGEIGNLSS

SEQ ID NO: 196605 - protein, 19 aa, Mycobacterium bovis
ALESLPRGLALQISLDSAT

SEQ ID NO: 196606 - protein, 19 aa, Mycobacterium bovis
ALEVLQSWLGADRAATLVV

SEQ ID NO: 196607 - protein, 27 aa, Mycobacterium bovis
ALGAACWDARRWLGRPGLDDRASADLL

SEQ ID NO: 196608 - protein, 20 aa, Mycobacterium bovis
ALGAEGIRVDTRCELRAGVQ

SEQ ID NO: 196609 - protein, 22 aa, Mycobacterium bovis
ALGAEVRWASCNIFSTQDHAAA

SEQ ID NO: 196610 - protein, 23 aa, Mycobacterium bovis
ALGAGARAAHLVDWADDIDSAWL

SEQ ID NO: 196611 - protein, 24 aa, Mycobacterium bovis
ALGDCYSALTWLASLPAVDPARVA

SEQ ID NO: 196612 - protein, 23 aa, Mycobacterium bovis
ALGDLPLIYPFLVNDPGEGTQAK

SEQ ID NO: 196613 - protein, 19 aa, Mycobacterium bovis
ALGDMGLVPAMTVKCAVAL

SEQ ID NO: 196614 - protein, 29 aa, Mycobacterium bovis
ALGEIRAIWRINELLNWQVASAGEDINMA

SEQ ID NO: 196615 - protein, 24 aa, Mycobacterium bovis
ALGERLRVLDGWRERGHGDFRDIR

SEQ ID NO: 196616 - protein, 17 aa, Mycobacterium bovis
ALGLMKAVLALQHGVVP

SEQ ID NO: 196617 - protein, 20 aa, Mycobacterium bovis
ALGLSRAWDKATLRIVSKAR

SEQ ID NO: 196618 - protein, 19 aa, Mycobacterium bovis
ALGNARRALVESLCYAGQR

SEQ ID NO: 196619 - protein, 24 aa, Mycobacterium bovis
ALGNEIVAFVLKNATRFGMQDVIW

SEQ ID NO: 196620 - protein, 18 aa, Mycobacterium bovis
ALGRRRPDIAVTILRLAN

SEQ ID NO: 196621 - protein, 19 aa, Mycobacterium bovis
ALHAWSDVDVSEWPGIDWP

SEQ ID NO: 196622 - protein, 17 aa, Mycobacterium bovis
ALHLARRGIEVEIFTRA

SEQ ID NO: 196623 - protein, 17 aa, Mycobacterium bovis
ALHRRGPHRVLRGDLAF

SEQ ID NO: 196624 - protein, 18 aa, Mycobacterium bovis
ALHRVGVSVWERYTGPYT

SEQ ID NO: 196625 - protein, 18 aa, Mycobacterium bovis
ALIALAMLALGGRRPALP

SEQ ID NO: 196626 - protein, 24 aa, Mycobacterium bovis
ALIARWLAEPGVRIVGVSNDAAGL

SEQ ID NO: 196627 - protein, 18 aa, Mycobacterium bovis
ALIDRRGYVLIVSSLAAF

SEQ ID NO: 196628 - protein, 18 aa, Mycobacterium bovis
ALIEIRLCNERATPMPIP

SEQ ID NO: 196629 - protein, 17 aa, Mycobacterium bovis
ALIGYAQKRRDIVAITA

SEQ ID NO: 196630 - protein, 25 aa, Mycobacterium bovis
ALINRYATVCGMTGTALAAGEQLRQ

SEQ ID NO: 196631 - protein, 17 aa, Mycobacterium bovis
ALKAFRTGGIDVLVATD

SEQ ID NO: 196632 - protein, 22 aa, Mycobacterium bovis
ALKNPEFDATLVTRAFSGRYAR

SEQ ID NO: 196633 - protein, 18 aa, Mycobacterium bovis
ALLAGLGLQCAARVTAVE

SEQ ID NO: 196634 - protein, 17 aa, Mycobacterium bovis
ALLAKRGFDPVLGARPL

SEQ ID NO: 196635 - protein, 17 aa, Mycobacterium bovis
ALLALADAGVRGRVLHA

SEQ ID NO: 196636 - protein, 19 aa, Mycobacterium bovis
ALLALYRWRGPLINAGVGG

SEQ ID NO: 196637 - protein, 18 aa, Mycobacterium bovis
ALLDACFQSVGAHPDSQS

SEQ ID NO: 196638 - protein, 24 aa, Mycobacterium bovis
ALLDIAARIAVPVVVSSALDSAVG

SEQ ID NO: 196639 - protein, 32 aa, Mycobacterium bovis
ALLEVRDLLFARLLQYRAFKHVAEMFAELEAT

SEQ ID NO: 196640 - protein, 18 aa, Mycobacterium bovis
ALLFPALCTPTGDPPAPE

SEQ ID NO: 196641 - protein, 24 aa, Mycobacterium bovis
ALLFPQPRCQVITGVGDFDPAIRR

SEQ ID NO: 196642 - protein, 27 aa, Mycobacterium bovis
ALLFTAGLWSVWKSYRSAPPLLSCTVI

SEQ ID NO: 196643 - protein, 23 aa, Mycobacterium bovis
ALLGDARWLASIATPGRDEVGEA

SEQ ID NO: 196644 - protein, 18 aa, Mycobacterium bovis
ALLHHARCPVAIIHSGNG

SEQ ID NO: 196645 - protein, 26 aa, Mycobacterium bovis
ALLLRGSPCAIGWVAGWLSAEFPARV

SEQ ID NO: 196646 - protein, 23 aa, Mycobacterium bovis
ALLNFPGCAVVISHDRWFLDRTC

SEQ ID NO: 196647 - protein, 24 aa, Mycobacterium bovis
ALLREFDAKLGRGPAVAVDDELMA

SEQ ID NO: 196648 - protein, 25 aa, Mycobacterium bovis
ALLRRIGLAAAKYWVCKRSTAHAAE

SEQ ID NO: 196649 - protein, 17 aa, Mycobacterium bovis
ALMFARRRGVLVANAVG

SEQ ID NO: 196650 - protein, 26 aa, Mycobacterium bovis
ALMRSCTGWPSGVWIDQPRRTAPDGS

SEQ ID NO: 196651 - protein, 37 aa, Mycobacterium bovis
ALMSGNFSNGILWRGNYEGLFSYSYSLDVPRITILDA

SEQ ID NO: 196652 - protein, 24 aa, Mycobacterium bovis
ALNNTRFWAPLSLTAEQKHSIDDP

SEQ ID NO: 196653 - protein, 24 aa, Mycobacterium bovis
ALNRSCRCWFGMTPRQYRAYGGVS

SEQ ID NO: 196654 - protein, 19 aa, Mycobacterium bovis
ALPAIVARFAVGRPVRAVW

SEQ ID NO: 196655 - protein, 25 aa, Mycobacterium bovis
ALPARSRSALGWIIERYRVTTDKAS

SEQ ID NO: 196656 - protein, 24 aa, Mycobacterium bovis
ALPAWVYIDHRVMPGRPRPGYLPR

SEQ ID NO: 196657 - protein, 17 aa, Mycobacterium bovis
ALPEYAKDIKLNLSSIT

SEQ ID NO: 196658 - protein, 18 aa, Mycobacterium bovis
ALPLFELGYDVAHVGFDQ

SEQ ID NO: 196659 - protein, 18 aa, Mycobacterium bovis
ALPLLRPQQVIMLGRPTL

SEQ ID NO: 196660 - protein, 29 aa, Mycobacterium bovis
ALPRPGDEAELFRAIALALERPLDPDRPL

SEQ ID NO: 196661 - protein, 20 aa, Mycobacterium bovis
ALPSRYGQAVAESDVQPLGR

SEQ ID NO: 196662 - protein, 18 aa, Mycobacterium bovis
ALQHSYPGLARVIKEHAN

SEQ ID NO: 196663 - protein, 24 aa, Mycobacterium bovis
ALQKMSFEVAWRILQATPVTATGL

SEQ ID NO: 196664 - protein, 19 aa, Mycobacterium bovis
ALQKYHWVEKINHVHTGGN

SEQ ID NO: 196665 - protein, 23 aa, Mycobacterium bovis
ALQRGMPVLGICRGTQVLNVALG

SEQ ID NO: 196666 - protein, 17 aa, Mycobacterium bovis
ALQRLAAGLGVPHPDTE

SEQ ID NO: 196667 - protein, 21 aa, Mycobacterium bovis
ALRAICPWEGFTDAYRDLAFP

SEQ ID NO: 196668 - protein, 19 aa, Mycobacterium bovis
ALRAKQCWTEPRAWETLQR

SEQ ID NO: 196669 - protein, 17 aa, Mycobacterium bovis
ALRDAGVDWRHVQLVAG

SEQ ID NO: 196670 - protein, 17 aa, Mycobacterium bovis
ALRDVMSAVEFRDMAET

SEQ ID NO: 196671 - protein, 27 aa, Mycobacterium bovis
ALRHRGSLRRFVPFDVDASVLSATATA

SEQ ID NO: 196672 - protein, 21 aa, Mycobacterium bovis
ALRLGKPLQFHVGFGDRDADL

SEQ ID NO: 196673 - protein, 19 aa, Mycobacterium bovis
ALRLPELDLAAGMDSAREW

SEQ ID NO: 196674 - protein, 23 aa, Mycobacterium bovis
ALRRAARADGWMHGGGDPDELDR

SEQ ID NO: 196675 - protein, 19 aa, Mycobacterium bovis
ALRSLCFDVLAVGEPGESS

SEQ ID NO: 196676 - protein, 17 aa, Mycobacterium bovis
ALSDFVRRCTWLEHHPE

SEQ ID NO: 196677 - protein, 18 aa, Mycobacterium bovis
ALSETLRRRRASGGPAEQ

SEQ ID NO: 196678 - protein, 17 aa, Mycobacterium bovis
ALSGYSCPPDVRIRANI

SEQ ID NO: 196679 - protein, 25 aa, Mycobacterium bovis
ALSPRAGQAGYLWQSITRGLRVTPI

SEQ ID NO: 196680 - protein, 19 aa, Mycobacterium bovis
ALSTLRDIYGAALGYQVDA

SEQ ID NO: 196681 - protein, 20 aa, Mycobacterium bovis
ALTRAAAFIHHLPVDQVFTL

SEQ ID NO: 196682 - protein, 24 aa, Mycobacterium bovis
ALTRAQSQVVAWWAPTFDEVNGGL

SEQ ID NO: 196683 - protein, 26 aa, Mycobacterium bovis
ALTRIPRVGVDWSQTTSFDEDTTAML

SEQ ID NO: 196684 - protein, 17 aa, Mycobacterium bovis
ALTRPRHPDDWTEIDSA

SEQ ID NO: 196685 - protein, 24 aa, Mycobacterium bovis
ALVAANRALVAWLAGSNVFGQNTP

SEQ ID NO: 196686 - protein, 26 aa, Mycobacterium bovis
ALVAANRARLVALAVSNLLGQNTPAI

SEQ ID NO: 196687 - protein, 24 aa, Mycobacterium bovis
ALVGAGLDRKDIRTTRVTVAPQYS

SEQ ID NO: 196688 - protein, 17 aa, Mycobacterium bovis
ALVGRVEIIELWPFSQG

SEQ ID NO: 196689 - protein, 26 aa, Mycobacterium bovis
ALVNSWSAAFARYGRTVGQVLLTAHD

SEQ ID NO: 196690 - protein, 19 aa, Mycobacterium bovis
ALVRAGFLAGDALRVLAGT

SEQ ID NO: 196691 - protein, 18 aa, Mycobacterium bovis
ALVRTGVAVAVPFGMVGL

SEQ ID NO: 196692 - protein, 22 aa, Mycobacterium bovis
ALWTALKTLYPVGITADSLTRK

SEQ ID NO: 196693 - protein, 27 aa, Mycobacterium bovis
ALYMDRYPLVSAISRPLIVKHLVAAAR

SEQ ID NO: 196694 - protein, 21 aa, Mycobacterium bovis
AMAFDEMFDAQGIVRGPYKGI

SEQ ID NO: 196695 - protein, 28 aa, Mycobacterium bovis
AMDPRQRLALELTWELLEDAFVVPETLR

SEQ ID NO: 196696 - protein, 32 aa, Mycobacterium bovis
AMEAVGGPSTWRMGGAINCGKAQPGQVAAVSH

SEQ ID NO: 196697 - protein, 22 aa, Mycobacterium bovis
AMFDLWFPAALGARAVITTEDE

SEQ ID NO: 196698 - protein, 20 aa, Mycobacterium bovis
AMFNELWAGFDPDEVPIGSV

SEQ ID NO: 196699 - protein, 27 aa, Mycobacterium bovis
AMFPARAFDALAAWVRAAAAKNMVDGR

SEQ ID NO: 196700 - protein, 17 aa, Mycobacterium bovis
AMFPHAIGLSAGMSNDL

SEQ ID NO: 196701 - protein, 21 aa, Mycobacterium bovis
AMGARATAFVVGFGAPAETPA

SEQ ID NO: 196702 - protein, 20 aa, Mycobacterium bovis
AMGFSAALDGCFKIHQLNHA

SEQ ID NO: 196703 - protein, 27 aa, Mycobacterium bovis
AMIDVIRFWLGLGIDGFRLDAVPYLFE

SEQ ID NO: 196704 - protein, 20 aa, Mycobacterium bovis
AMLGWPLRTFECTVPPGRLG

SEQ ID NO: 196705 - protein, 26 aa, Mycobacterium bovis
AMLMASQRTVICWAMGLTQHAHAVAT

SEQ ID NO: 196706 - protein, 20 aa, Mycobacterium bovis
AMLPGGRRRALLTGTVAVVG

SEQ ID NO: 196707 - protein, 17 aa, Mycobacterium bovis
AMLQRLDGLDVDRLTDI

SEQ ID NO: 196708 - protein, 19 aa, Mycobacterium bovis
AMPHLSGPLAGVGVGGQAG

SEQ ID NO: 196709 - protein, 27 aa, Mycobacterium bovis
AMPNRLVRSLQRWRPFGLPPHRWRLAP

SEQ ID NO: 196710 - protein, 17 aa, Mycobacterium bovis
AMPWQWVGQELPQFSSA

SEQ ID NO: 196711 - protein, 21 aa, Mycobacterium bovis
AMSAKSDWAALPFDERAAVFL

SEQ ID NO: 196712 - protein, 19 aa, Mycobacterium bovis
AMSGIYRRQLALIRASPAV

SEQ ID NO: 196713 - protein, 20 aa, Mycobacterium bovis
AMSVGPWQGIAAWDVSTGEP

SEQ ID NO: 196714 - protein, 23 aa, Mycobacterium bovis
AMVAAAQPYLAWLTYTAEAAAHA

SEQ ID NO: 196715 - protein, 18 aa, Mycobacterium bovis
AMVSGGWNQAPSALLGGG

SEQ ID NO: 196716 - protein, 18 aa, Mycobacterium bovis
AMVTDRRVLLTLPISHVY

SEQ ID NO: 196717 - protein, 22 aa, Mycobacterium bovis
ANAEALVPITALLPAGADDVSA

SEQ ID NO: 196718 - protein, 20 aa, Mycobacterium bovis
ANAFVLRGGVPVFVDIRPDT

SEQ ID NO: 196719 - protein, 20 aa, Mycobacterium bovis
ANAGDYGTGAFITGSMNNGL

SEQ ID NO: 196720 - protein, 23 aa, Mycobacterium bovis
ANAQRGLSEAVVRDISAKKNEPD

SEQ ID NO: 196721 - protein, 22 aa, Mycobacterium bovis
ANASNARRIWAHAGVDDRVVCV

SEQ ID NO: 196722 - protein, 17 aa, Mycobacterium bovis
ANAVTVFFDGATLHALI

SEQ ID NO: 196723 - protein, 20 aa, Mycobacterium bovis
ANEALYDWNYQRQLLSIRLA

SEQ ID NO: 196724 - protein, 19 aa, Mycobacterium bovis
ANFRDVMIALGLYPDPDAV

SEQ ID NO: 196725 - protein, 26 aa, Mycobacterium bovis
ANGGAGGAGGWLFGNGGAGGNGGIGG

SEQ ID NO: 196726 - protein, 27 aa, Mycobacterium bovis
ANGGAGGNGGWLYGNGGLGGNGGAATQ

SEQ ID NO: 196727 - protein, 17 aa, Mycobacterium bovis
ANGISAFMVHKDDEGFT

SEQ ID NO: 196728 - protein, 22 aa, Mycobacterium bovis
ANHTTGWVRMDFVVPSRGLIGW

SEQ ID NO: 196729 - protein, 18 aa, Mycobacterium bovis
ANIAGWPMAKAFAVAPKM

SEQ ID NO: 196730 - protein, 23 aa, Mycobacterium bovis
ANIEKYLGWSRRQIDLHNQGLRN

SEQ ID NO: 196731 - protein, 30 aa, Mycobacterium bovis
ANIGGLSVPHSWNLPPAVRQVAAMFPGATP

SEQ ID NO: 196732 - protein, 19 aa, Mycobacterium bovis
ANIGSIMGIGFPPWTGGSA

SEQ ID NO: 196733 - protein, 18 aa, Mycobacterium bovis
ANKIFIEKAVDLGVQALA

SEQ ID NO: 196734 - protein, 18 aa, Mycobacterium bovis
ANKIGGADWVEWGGCGMV

SEQ ID NO: 196735 - protein, 22 aa, Mycobacterium bovis
ANLAGLFLDNTGNLTLNFGVAN

SEQ ID NO: 196736 - protein, 32 aa, Mycobacterium bovis
ANLKCLCRLHHLLATFCGWRAQQLPDGTVIWT

SEQ ID NO: 196737 - protein, 19 aa, Mycobacterium bovis
ANLLGQMALGSMTGGALGA

SEQ ID NO: 196738 - protein, 33 aa, Mycobacterium bovis
ANLNFFPMGAWAKRTGAIFIRRQTKDIPVYRFV

SEQ ID NO: 196739 - protein, 17 aa, Mycobacterium bovis
ANLRHTVRFDRAVESAI

SEQ ID NO: 196740 - protein, 18 aa, Mycobacterium bovis
ANLTTLFFGPTGIPLPPP

SEQ ID NO: 196741 - protein, 23 aa, Mycobacterium bovis
ANMAPDLFAGILAQVPFVDPLTT

SEQ ID NO: 196742 - protein, 21 aa, Mycobacterium bovis
ANNPLRLGGCLNSESAEKAAR

SEQ ID NO: 196743 - protein, 20 aa, Mycobacterium bovis
ANNSGFWNTAFAGIGNSGLQ

SEQ ID NO: 196744 - protein, 22 aa, Mycobacterium bovis
ANPAVWMYAGGAGFAQILYHLG

SEQ ID NO: 196745 - protein, 17 aa, Mycobacterium bovis
ANPRASRTVPFVSKATA

SEQ ID NO: 196746 - protein, 26 aa, Mycobacterium bovis
ANPRTRSGIMALELLDGTPDWDRFRT

SEQ ID NO: 196747 - protein, 25 aa, Mycobacterium bovis
ANPTPKGCVFEYVYLARPDSTIAGR

SEQ ID NO: 196748 - protein, 18 aa, Mycobacterium bovis
ANRARRVAAAQAKAKKAA

SEQ ID NO: 196749 - protein, 22 aa, Mycobacterium bovis
ANRGRLRSLVASNLLGQNAPAI

SEQ ID NO: 196750 - protein, 20 aa, Mycobacterium bovis
ANRLAHWFRQAGLREDDVVA

SEQ ID NO: 196751 - protein, 18 aa, Mycobacterium bovis
ANRLGLIDPDAWAFVWVV

SEQ ID NO: 196752 - protein, 24 aa, Mycobacterium bovis
ANRRRFPVEIIRRSRAAVGSDFII

SEQ ID NO: 196753 - protein, 23 aa, Mycobacterium bovis
ANRSGLISLVISNLFGQNAPAIA

SEQ ID NO: 196754 - protein, 24 aa, Mycobacterium bovis
ANSEPRTGLSMGEHAAVTAKQMGI

SEQ ID NO: 196755 - protein, 18 aa, Mycobacterium bovis
ANSLLLRRLQAERPGDAV

SEQ ID NO: 196756 - protein, 17 aa, Mycobacterium bovis
ANTLVRTPHGWRADNTD

SEQ ID NO: 196757 - protein, 19 aa, Mycobacterium bovis
ANVGVWVRTDEQWRWLAHT

SEQ ID NO: 196758 - protein, 24 aa, Mycobacterium bovis
ANYRRNKVGIVFQAFNLVPSLTAV

SEQ ID NO: 196759 - protein, 27 aa, Mycobacterium bovis
ANYYARVCVDLLKPRKAQPLLPGIGKT

SEQ ID NO: 196760 - protein, 17 aa, Mycobacterium bovis
APAAEWFGERGWTAVAT

SEQ ID NO: 196761 - protein, 20 aa, Mycobacterium bovis
APALLWIHAGGYVMGTAQQD

SEQ ID NO: 196762 - protein, 17 aa, Mycobacterium bovis
APATGWCTSLRLPRDHY

SEQ ID NO: 196763 - protein, 23 aa, Mycobacterium bovis
APAVRRLAERGAPEIQAYDPVFF

SEQ ID NO: 196764 - protein, 21 aa, Mycobacterium bovis
APCAHVRQLLSTRIDEVRAQI

SEQ ID NO: 196765 - protein, 26 aa, Mycobacterium bovis
APDAGLRLARRFAHLTYRGEIELDTR

SEQ ID NO: 196766 - protein, 20 aa, Mycobacterium bovis
APDASGYWPAPAVANYALSG

SEQ ID NO: 196767 - protein, 20 aa, Mycobacterium bovis
APDFRLFWDNAYAVHTLTLD

SEQ ID NO: 196768 - protein, 19 aa, Mycobacterium bovis
APDGIRMLVEAARRIDEAR

SEQ ID NO: 196769 - protein, 25 aa, Mycobacterium bovis
APDIPRERFSALTRLDHNRAISQLA

SEQ ID NO: 196770 - protein, 21 aa, Mycobacterium bovis
APDLRGRISMASMAAAEMGHY

SEQ ID NO: 196771 - protein, 20 aa, Mycobacterium bovis
APDRNLAMELVRVTEAGAMA

SEQ ID NO: 196772 - protein, 20 aa, Mycobacterium bovis
APDRPRIGEILGAFDDKIAA

SEQ ID NO: 196773 - protein, 26 aa, Mycobacterium bovis
APDSLCGVRVFFPDPWPKARHHKRRL

SEQ ID NO: 196774 - protein, 24 aa, Mycobacterium bovis
APDVIRLAPPLIIAEAQLDGFVAA

SEQ ID NO: 196775 - protein, 25 aa, Mycobacterium bovis
APEIYRAPLSYPYRDGLLDKQLATN

SEQ ID NO: 196776 - protein, 18 aa, Mycobacterium bovis
APFSLSWMTAVGERTNRL

SEQ ID NO: 196777 - protein, 17 aa, Mycobacterium bovis
APGALRWLPIDPVSNAG

SEQ ID NO: 196778 - protein, 26 aa, Mycobacterium bovis
APGESRLRLLGFERVELEPGQTRRVR

SEQ ID NO: 196779 - protein, 26 aa, Mycobacterium bovis
APGGIGVNTGTGWAYGGNGGNGGDGG

SEQ ID NO: 196780 - protein, 20 aa, Mycobacterium bovis
APGGVAYACSFRITEAVYFV

SEQ ID NO: 196781 - protein, 23 aa, Mycobacterium bovis
APGHMLGGLPLGHSVNAGSGINN

SEQ ID NO: 196782 - protein, 20 aa, Mycobacterium bovis
APGLGGRGGLLLGLPGANGT

SEQ ID NO: 196783 - protein, 19 aa, Mycobacterium bovis
APGLLSWRDIARVMSENPA

SEQ ID NO: 196784 - protein, 18 aa, Mycobacterium bovis
APGSFSWHVLTALADDVQ

SEQ ID NO: 196785 - protein, 20 aa, Mycobacterium bovis
APGSRVALGALGSRLDHEQL

SEQ ID NO: 196786 - protein, 17 aa, Mycobacterium bovis
APGTNWKSNPNAMRTIA

SEQ ID NO: 196787 - protein, 24 aa, Mycobacterium bovis
APHHTRPTRFVWLQTPAIRARLLD

SEQ ID NO: 196788 - protein, 23 aa, Mycobacterium bovis
APHKRTGIDVALALLTPIVGQEF

SEQ ID NO: 196789 - protein, 17 aa, Mycobacterium bovis
APICLTWELTYACNLAC

SEQ ID NO: 196790 - protein, 17 aa, Mycobacterium bovis
APIPSLLAVAGVHHHLV

SEQ ID NO: 196791 - protein, 18 aa, Mycobacterium bovis
APITLRGGQLVAFDSSSG

SEQ ID NO: 196792 - protein, 17 aa, Mycobacterium bovis
APKDRDIAMVFQSYALY

SEQ ID NO: 196793 - protein, 23 aa, Mycobacterium bovis
APLDARIGWRRATLAVCEALLAN

SEQ ID NO: 196794 - protein, 17 aa, Mycobacterium bovis
APLDRRLLLGMLAELPA

SEQ ID NO: 196795 - protein, 18 aa, Mycobacterium bovis
APLFPLVVVVHADVELRV

SEQ ID NO: 196796 - protein, 26 aa, Mycobacterium bovis
APLHTDLKEFGRWAADRIAEAIEFEG

SEQ ID NO: 196797 - protein, 28 aa, Mycobacterium bovis
APLQPFQATAVIPVIGPVTVTLEGTPAG

SEQ ID NO: 196798 - protein, 18 aa, Mycobacterium bovis
APLRPEERQTTVVDHAEA

SEQ ID NO: 196799 - protein, 18 aa, Mycobacterium bovis
APMIGGLGYVLAPGPAAY

SEQ ID NO: 196800 - protein, 18 aa, Mycobacterium bovis
APMPAPRAILAAAVEGAQ

SEQ ID NO: 196801 - protein, 22 aa, Mycobacterium bovis
APNARPPVCKIMDYGKYKYEAA

SEQ ID NO: 196802 - protein, 19 aa, Mycobacterium bovis
APNFAYALLAKRLRRQAKP

SEQ ID NO: 196803 - protein, 34 aa, Mycobacterium bovis
APNRIEGWMPFGRVFETLAWGRRHVVMGANQVDR

SEQ ID NO: 196804 - protein, 24 aa, Mycobacterium bovis
APNVWALGDVASWRDPMGHQARVE

SEQ ID NO: 196805 - protein, 18 aa, Mycobacterium bovis
APPDVREFVLGKLNSGEW

SEQ ID NO: 196806 - protein, 23 aa, Mycobacterium bovis
APPHGGIAFGWDRTTALLAGMDS

SEQ ID NO: 196807 - protein, 25 aa, Mycobacterium bovis
APPPDVVQRLSALGLLVSITVTSVY

SEQ ID NO: 196808 - protein, 20 aa, Mycobacterium bovis
APPYPPSILLTGIIVNKLGQ

SEQ ID NO: 196809 - protein, 17 aa, Mycobacterium bovis
APRAHFEIPDDLGPGRQ

SEQ ID NO: 196810 - protein, 19 aa, Mycobacterium bovis
APRDELIAFFVASDVMLVT

SEQ ID NO: 196811 - protein, 18 aa, Mycobacterium bovis
APRLARLVDGIAPRTHAA

SEQ ID NO: 196812 - protein, 25 aa, Mycobacterium bovis
APRRFIRDLYEAISQLAFLPFPFDS

SEQ ID NO: 196813 - protein, 26 aa, Mycobacterium bovis
APSNRRSTVGGVWCRRRPNWVSRPRD

SEQ ID NO: 196814 - protein, 20 aa, Mycobacterium bovis
APTHIAAAFDVSRQTFRLQR

SEQ ID NO: 196815 - protein, 18 aa, Mycobacterium bovis
APTLSGFWHWAVANLPAN

SEQ ID NO: 196816 - protein, 18 aa, Mycobacterium bovis
APTTGLLAAGADEVSAAI

SEQ ID NO: 196817 - protein, 19 aa, Mycobacterium bovis
APVLDRLIAFTGRQPTAGH

SEQ ID NO: 196818 - protein, 19 aa, Mycobacterium bovis
APVVVGWPVGQLYANMTEW

SEQ ID NO: 196819 - protein, 17 aa, Mycobacterium bovis
APYTGSAIAQHWMYEGK

SEQ ID NO: 196820 - protein, 26 aa, Mycobacterium bovis
APYVSSRWRPVFARLPFDEAVLLTKA

SEQ ID NO: 196821 - protein, 23 aa, Mycobacterium bovis
AQAAAFHDRFVQLLNAGGGSYAS

SEQ ID NO: 196822 - protein, 24 aa, Mycobacterium bovis
AQAALFHDRFVQILQEGAAAYAMA

SEQ ID NO: 196823 - protein, 19 aa, Mycobacterium bovis
AQAFGKIRPVTSMVEVTAL

SEQ ID NO: 196824 - protein, 22 aa, Mycobacterium bovis
AQAPDGLSCFLLPRVLPDGTRN

SEQ ID NO: 196825 - protein, 28 aa, Mycobacterium bovis
AQAPKGIVMPARLPNRIHPFVQEIVPVQ

SEQ ID NO: 196826 - protein, 20 aa, Mycobacterium bovis
AQARAARPQFVVKDEAFTTV

SEQ ID NO: 196827 - protein, 18 aa, Mycobacterium bovis
AQARRIAEEIGYPVLVRP

SEQ ID NO: 196828 - protein, 17 aa, Mycobacterium bovis
AQDWLHNRVPALDGQRF

SEQ ID NO: 196829 - protein, 27 aa, Mycobacterium bovis
AQEGHPGHGPRYLWTRTVAGRGTKGRQ

SEQ ID NO: 196830 - protein, 18 aa, Mycobacterium bovis
AQFIRYEKPRSWLNSGGL

SEQ ID NO: 196831 - protein, 27 aa, Mycobacterium bovis
AQGRTPLPFYVWRAFARYSPVLPAGRL

SEQ ID NO: 196832 - protein, 21 aa, Mycobacterium bovis
AQGTSRWLVAVRMVSEGVDVP

SEQ ID NO: 196833 - protein, 18 aa, Mycobacterium bovis
AQGYSRVRVDGVVHPLTD

SEQ ID NO: 196834 - protein, 18 aa, Mycobacterium bovis
AQIAHEFTYGRWDCDLAT

SEQ ID NO: 196835 - protein, 17 aa, Mycobacterium bovis
AQIILSVGVRVVDVPVQ

SEQ ID NO: 196836 - protein, 25 aa, Mycobacterium bovis
AQIRPGQYVRLHWARPRSRLPGQGV

SEQ ID NO: 196837 - protein, 27 aa, Mycobacterium bovis
AQIYAWRKGIKTLYYIRLRQMALEGTE

SEQ ID NO: 196838 - protein, 19 aa, Mycobacterium bovis
AQLAPLVFEGTSFGGALMT

SEQ ID NO: 196839 - protein, 19 aa, Mycobacterium bovis
AQLASWQPALPNINLGVGN

SEQ ID NO: 196840 - protein, 17 aa, Mycobacterium bovis
AQLCGYGPIPAAVARTM

SEQ ID NO: 196841 - protein, 17 aa, Mycobacterium bovis
AQLPSGWMVTAAKFEVE

SEQ ID NO: 196842 - protein, 19 aa, Mycobacterium bovis
AQLQRRLGTTTVYVTHDQT

SEQ ID NO: 196843 - protein, 17 aa, Mycobacterium bovis
AQLRAKALWLRSRRRGV

SEQ ID NO: 196844 - protein, 23 aa, Mycobacterium bovis
AQLRKAGLVISDRRGMHVFHRVH

SEQ ID NO: 196845 - protein, 18 aa, Mycobacterium bovis
AQLRSYWARPLPATIVMR

SEQ ID NO: 196846 - protein, 25 aa, Mycobacterium bovis
AQLSGLRLGKVISISEASGAAPTHE

SEQ ID NO: 196847 - protein, 17 aa, Mycobacterium bovis
AQLWPPHVPAMLVAGCD

SEQ ID NO: 196848 - protein, 21 aa, Mycobacterium bovis
AQMDWSFGEVIAYASRGVTLT

SEQ ID NO: 196849 - protein, 18 aa, Mycobacterium bovis
AQNGRYGPYLKRGNDSRS

SEQ ID NO: 196850 - protein, 20 aa, Mycobacterium bovis
AQNVRLPWRVDKTDYVLHLI

SEQ ID NO: 196851 - protein, 17 aa, Mycobacterium bovis
AQPRAGASTAWVPSPTA

SEQ ID NO: 196852 - protein, 19 aa, Mycobacterium bovis
AQPYFAEAIELARAINDEW

SEQ ID NO: 196853 - protein, 19 aa, Mycobacterium bovis
AQQIEWSKVHLFWGDERYV

SEQ ID NO: 196854 - protein, 26 aa, Mycobacterium bovis
AQQYDAVWRWIDWPERRGRTDTGIDL

SEQ ID NO: 196855 - protein, 20 aa, Mycobacterium bovis
AQRALHRVVTLLAAGRPVLT

SEQ ID NO: 196856 - protein, 20 aa, Mycobacterium bovis
AQRAWAEGRFDREISPIQAP

SEQ ID NO: 196857 - protein, 18 aa, Mycobacterium bovis
AQRLPGYLVPAAVVVIDA

SEQ ID NO: 196858 - protein, 27 aa, Mycobacterium bovis
AQRLRPCTRFGQRLRLRPFDLGAPKWV

SEQ ID NO: 196859 - protein, 19 aa, Mycobacterium bovis
AQRMVPRGRGHVINVASLA

SEQ ID NO: 196860 - protein, 19 aa, Mycobacterium bovis
AQRPAVFIFNHRNQVDPVI

SEQ ID NO: 196861 - protein, 20 aa, Mycobacterium bovis
AQRPELWNLYNGRHHKGEHI

SEQ ID NO: 196862 - protein, 17 aa, Mycobacterium bovis
AQRRCCAAVHGGRVVWA

SEQ ID NO: 196863 - protein, 18 aa, Mycobacterium bovis
AQRRTVEGLNRVEAAHDN

SEQ ID NO: 196864 - protein, 27 aa, Mycobacterium bovis
AQSPKETWLRLLLINAGFPRPSTQIPL

SEQ ID NO: 196865 - protein, 27 aa, Mycobacterium bovis
AQSPKETWLRLLLIRAGFPRPQTQIAV

SEQ ID NO: 196866 - protein, 24 aa, Mycobacterium bovis
AQTLLGRPLIGNGADGAPGTGQPG

SEQ ID NO: 196867 - protein, 17 aa, Mycobacterium bovis
AQVGLGFTAVIEAEVGA

SEQ ID NO: 196868 - protein, 18 aa, Mycobacterium bovis
AQVLRGKYLVDVQSVTKV

SEQ ID NO: 196869 - protein, 17 aa, Mycobacterium bovis
AQVRQWLAAHLPAADLR

SEQ ID NO: 196870 - protein, 19 aa, Mycobacterium bovis
AQVSLAQMEYMLPRLRGWG

SEQ ID NO: 196871 - protein, 22 aa, Mycobacterium bovis
AQVTEFDGGVLVNWDVREGVFA

SEQ ID NO: 196872 - protein, 21 aa, Mycobacterium bovis
AQVYRRARGCPGLGMRVQDRG

SEQ ID NO: 196873 - protein, 19 aa, Mycobacterium bovis
AQYERAWGTIEALKEKDEA

SEQ ID NO: 196874 - protein, 26 aa, Mycobacterium bovis
AQYPRVDPALLLNCMLLAATERSVTG

SEQ ID NO: 196875 - protein, 19 aa, Mycobacterium bovis
AQYRIRLGGTWKKPGTSDI

SEQ ID NO: 196876 - protein, 27 aa, Mycobacterium bovis
ARAACSASPVAPGWAVPPVAGVMAGAV

SEQ ID NO: 196877 - protein, 19 aa, Mycobacterium bovis
ARAALTRAIHKLPIKARII

SEQ ID NO: 196878 - protein, 20 aa, Mycobacterium bovis
ARAAPLVAILWGRDASTLKP

SEQ ID NO: 196879 - protein, 21 aa, Mycobacterium bovis
ARADEALPFAAIAVGAALVRD

SEQ ID NO: 196880 - protein, 17 aa, Mycobacterium bovis
ARAFDALDALVASAAAR

SEQ ID NO: 196881 - protein, 18 aa, Mycobacterium bovis
ARAFFDFAAQHHIEVTTP

SEQ ID NO: 196882 - protein, 19 aa, Mycobacterium bovis
ARAFSGVKIACVGESTADR

SEQ ID NO: 196883 - protein, 20 aa, Mycobacterium bovis
ARAFVNRPLVLLADEPTGNL

SEQ ID NO: 196884 - protein, 17 aa, Mycobacterium bovis
ARAGRAAADYAARHQKS

SEQ ID NO: 196885 - protein, 23 aa, Mycobacterium bovis
ARAGSRAAPLLRLPDVRALLDAQ

SEQ ID NO: 196886 - protein, 21 aa, Mycobacterium bovis
ARAHGADMLLLIVAALEQSVL

SEQ ID NO: 196887 - protein, 17 aa, Mycobacterium bovis
ARALGVTLFDTAEIYGL

SEQ ID NO: 196888 - protein, 24 aa, Mycobacterium bovis
ARALIAVRGLHRFAAAEGLAELDV

SEQ ID NO: 196889 - protein, 17 aa, Mycobacterium bovis
ARALRPGGRLVLTSISD

SEQ ID NO: 196890 - protein, 18 aa, Mycobacterium bovis
ARALTLAARFQSALDGTL

SEQ ID NO: 196891 - protein, 22 aa, Mycobacterium bovis
ARALTPPALVARVVEALRDGYA

SEQ ID NO: 196892 - protein, 24 aa, Mycobacterium bovis
ARAMGMRNRVTWRVTKWDPPHEVA

SEQ ID NO: 196893 - protein, 24 aa, Mycobacterium bovis
ARANSDLTGLVAMFKGILDAEPTY

SEQ ID NO: 196894 - protein, 24 aa, Mycobacterium bovis
ARAPELHRSPVFAVAVVRETVGDR

SEQ ID NO: 196895 - protein, 27 aa, Mycobacterium bovis
ARAQAGALPALFSGLARRPRRRQIDDT

SEQ ID NO: 196896 - protein, 22 aa, Mycobacterium bovis
ARARDGGIPLTARMVFEHPVLC

SEQ ID NO: 196897 - protein, 28 aa, Mycobacterium bovis
ARARRLYASRGWLPWHGPTSVLAPTGPV

SEQ ID NO: 196898 - protein, 21 aa, Mycobacterium bovis
ARATQPLSVFFFDILHRDGTD

SEQ ID NO: 196899 - protein, 18 aa, Mycobacterium bovis
ARCAQFSTLLGVPMESMI

SEQ ID NO: 196900 - protein, 18 aa, Mycobacterium bovis
ARCELDVVYVFRPGDEGR

SEQ ID NO: 196901 - protein, 18 aa, Mycobacterium bovis
ARCMIAAGALVVAGTQIP

SEQ ID NO: 196902 - protein, 19 aa, Mycobacterium bovis
ARCNAIAAAVLMPADVVRA

SEQ ID NO: 196903 - protein, 21 aa, Mycobacterium bovis
ARDAGAMAYLVKPFSISDLIP

SEQ ID NO: 196904 - protein, 25 aa, Mycobacterium bovis
ARDFAAEAAFVFAMIAVDLSRLAED

SEQ ID NO: 196905 - protein, 21 aa, Mycobacterium bovis
ARDRGATMIFTRTKRTAQKVA

SEQ ID NO: 196906 - protein, 18 aa, Mycobacterium bovis
ARDSAPSLVFLDELDALA

SEQ ID NO: 196907 - protein, 25 aa, Mycobacterium bovis
ARDWAPKVHGAWELHEATSGQPLDW

SEQ ID NO: 196908 - protein, 19 aa, Mycobacterium bovis
AREAAWRVLDQRPFDVQVM

SEQ ID NO: 196909 - protein, 20 aa, Mycobacterium bovis
AREALIKTDIFGSAADVEKL

SEQ ID NO: 196910 - protein, 17 aa, Mycobacterium bovis
AREGFPAGTGWDQIPDD

SEQ ID NO: 196911 - protein, 23 aa, Mycobacterium bovis
AREGRFGPYVTEILPEPAADAAA

SEQ ID NO: 196912 - protein, 26 aa, Mycobacterium bovis
AREKLFPLICRYAVAYHVVFIPSAEV

SEQ ID NO: 196913 - protein, 21 aa, Mycobacterium bovis
ARELSNLVELARRTAAADDPL

SEQ ID NO: 196914 - protein, 18 aa, Mycobacterium bovis
AREPLYFNGARMVGNYPM

SEQ ID NO: 196915 - protein, 19 aa, Mycobacterium bovis
ARERLTFDEAVGLQWALVA

SEQ ID NO: 196916 - protein, 19 aa, Mycobacterium bovis
ARESLDWLDAHLGRAPALR

SEQ ID NO: 196917 - protein, 33 aa, Mycobacterium bovis; identical to SEQ ID NO: 78145

SEQ ID NO: 196918 - protein, 20 aa, Mycobacterium bovis
ARFGPSVLYGVPNFFARVID

SEQ ID NO: 196919 - protein, 19 aa, Mycobacterium bovis
ARFIGGMLACIAIAIHELT

SEQ ID NO: 196920 - protein, 22 aa, Mycobacterium bovis
ARFIGGVLACCGLAEHELTGTT

SEQ ID NO: 196921 - protein, 17 aa, Mycobacterium bovis
ARFLVYPAMKALTLDIA

SEQ ID NO: 196922 - protein, 25 aa, Mycobacterium bovis
ARFPDAVRYSVRFAKPVLLPATAGL

SEQ ID NO: 196923 - protein, 19 aa, Mycobacterium bovis
ARFVDFLERVVVQRTIDRH

SEQ ID NO: 196924 - protein, 19 aa, Mycobacterium bovis
ARFVRECARVLRGSGLLMV

SEQ ID NO: 196925 - protein, 26 aa, Mycobacterium bovis
ARFVRLCDAFGIPLVVVVDVPGYLPG

SEQ ID NO: 196926 - protein, 29 aa, Mycobacterium bovis
ARGFPVTDFNVSLPWTKMVVLNPGVQTES

SEQ ID NO: 196927 - protein, 24 aa, Mycobacterium bovis
ARGGKLAGILAEVAQPFVVLGVGL

SEQ ID NO: 196928 - protein, 19 aa, Mycobacterium bovis
ARGGSFVRISFAGPSGDIE

SEQ ID NO: 196929 - protein, 21 aa, Mycobacterium bovis
ARGKLTPRERIELLVDPDSPF

SEQ ID NO: 196930 - protein, 25 aa, Mycobacterium bovis
ARGLVRLRAVLPLIDGGAESPQETW

SEQ ID NO: 196931 - protein, 26 aa, Mycobacterium bovis
ARGSGLLPRMEPFVGELIGRGLADAG

SEQ ID NO: 196932 - protein, 21 aa, Mycobacterium bovis
ARGVPVAAPWDARRARELDDV

SEQ ID NO: 196933 - protein, 18 aa, Mycobacterium bovis
ARHLEVERKFDVIESTVS

SEQ ID NO: 196934 - protein, 21 aa, Mycobacterium bovis
ARHRARRLAGRVVHDATCSIG

SEQ ID NO: 196935 - protein, 19 aa, Mycobacterium bovis
ARHSSGLSVQTFLRGIHVV

SEQ ID NO: 196936 - protein, 17 aa, Mycobacterium bovis
ARHTGGTFVFRIEDTDA

SEQ ID NO: 196937 - protein, 23 aa, Mycobacterium bovis
ARHVSAVLGRRVGPSTGTNLWGA

SEQ ID NO: 196938 - protein, 18 aa, Mycobacterium bovis
ARHWRRALAGAGLVAVSW

SEQ ID NO: 196939 - protein, 20 aa, Mycobacterium bovis
ARIAFLIRFGTGVLPEPKTV

SEQ ID NO: 196940 - protein, 21 aa, Mycobacterium bovis
ARIAGRPAAVLLHLGPGLGNG

SEQ ID NO: 196941 - protein, 17 aa, Mycobacterium bovis
ARIDLGYEQLRVGVEYD

SEQ ID NO: 196942 - protein, 17 aa, Mycobacterium bovis
ARIDSLAARNSKLMETL

SEQ ID NO: 196943 - protein, 18 aa, Mycobacterium bovis
ARIGREAMLDQIVNDALP

SEQ ID NO: 196944 - protein, 17 aa, Mycobacterium bovis
ARIKFPTPAACGRTPLV

SEQ ID NO: 196945 - protein, 26 aa, Mycobacterium bovis
ARINNERIRLGIALPAAVAADLLAPR

SEQ ID NO: 196946 - protein, 23 aa, Mycobacterium bovis
ARIRRFAHPVLLERSRAAELATA

SEQ ID NO: 196947 - protein, 20 aa, Mycobacterium bovis
ARISVRSVLHRHYLDVLRPL

SEQ ID NO: 196948 - protein, 26 aa, Mycobacterium bovis
ARIVKALGGRGVFGVELMINGDEVYF

SEQ ID NO: 196949 - protein, 25 aa, Mycobacterium bovis
ARKAGYEVLERVGLDPKVATRYPAQ

SEQ ID NO: 196950 - protein, 20 aa, Mycobacterium bovis
ARKFDCEAWIPTQGAYRELT

SEQ ID NO: 196951 - protein, 17 aa, Mycobacterium bovis
ARKGTGHPAGEQPRDGV

SEQ ID NO: 196952 - protein, 20 aa, Mycobacterium bovis
ARKKPPFGIGQIGKSFRNEI

SEQ ID NO: 196953 - protein, 19 aa, Mycobacterium bovis
ARKLWGLRGYAEVGTPEIA

SEQ ID NO: 196954 - protein, 19 aa, Mycobacterium bovis
ARKTRYVDHGWPTTDPDDH

SEQ ID NO: 196955 - protein, 17 aa, Mycobacterium bovis
ARKVAAWGADAMIVQGG

SEQ ID NO: 196956 - protein, 19 aa, Mycobacterium bovis
ARLACGRVGDGLRGFRASL

SEQ ID NO: 196957 - protein, 24 aa, Mycobacterium bovis
ARLAERRPAAALCEIVSPDNPVQM

SEQ ID NO: 196958 - protein, 20 aa, Mycobacterium bovis
ARLASCRDALLPLLMSGIDG

SEQ ID NO: 196959 - protein, 26 aa, Mycobacterium bovis
ARLGHFYRGAGLTIYEGYGLSETSGG

SEQ ID NO: 196960 - protein, 17 aa, Mycobacterium bovis
ARLHRWRTATALPAGPA

SEQ ID NO: 196961 - protein, 21 aa, Mycobacterium bovis
ARLLRLLGFDTRWSSAADDPT

SEQ ID NO: 196962 - protein, 19 aa, Mycobacterium bovis
ARLPFVGIAEAYVLNAFRR

SEQ ID NO: 196963 - protein, 19 aa, Mycobacterium bovis
ARLPGRAAGALLFTCNGRG

SEQ ID NO: 196964 - protein, 20 aa, Mycobacterium bovis
ARLPSIALRAARSALQSGAP

SEQ ID NO: 196965 - protein, 21 aa, Mycobacterium bovis
ARLRADRALVAFPEIRSISYF

SEQ ID NO: 196966 - protein, 19 aa, Mycobacterium bovis
ARLRDSPVRVVTCRQSGVG

SEQ ID NO: 196967 - protein, 23 aa, Mycobacterium bovis
ARLRPAPLRNPRFVVDVNLGQLA

SEQ ID NO: 196968 - protein, 19 aa, Mycobacterium bovis
ARLRVILRRAGKGNKEPRN

SEQ ID NO: 196969 - protein, 18 aa, Mycobacterium bovis
ARLSDGVLGVRAEYLAAA

SEQ ID NO: 196970 - protein, 19 aa, Mycobacterium bovis
ARLSRRGRRLGLTDTNNGL

SEQ ID NO: 196971 - protein, 20 aa, Mycobacterium bovis
ARLTILEVMAEAIDRPDEMS

SEQ ID NO: 196972 - protein, 17 aa, Mycobacterium bovis
ARLVRALGVVDEADLRP

SEQ ID NO: 196973 - protein, 19 aa, Mycobacterium bovis
ARLVVKLPNRWPLTDAAGV

SEQ ID NO: 196974 - protein, 21 aa, Mycobacterium bovis
ARLWFSPAPTRAFAPSRIRAA

SEQ ID NO: 196975 - protein, 22 aa, Mycobacterium bovis
ARLWPDGLLALLEPRIGRRAAN

SEQ ID NO: 196976 - protein, 18 aa, Mycobacterium bovis
ARLYLCTDARRERGDLAQ

SEQ ID NO: 196977 - protein, 20 aa, Mycobacterium bovis
ARMLRTAWTDEWDRPDSPDP

SEQ ID NO: 196978 - protein, 20 aa, Mycobacterium bovis
ARPADIGWAAAFLASDAASY

SEQ ID NO: 196979 - protein, 22 aa, Mycobacterium bovis
ARPAETVRGWLRRFAERVEAVR

SEQ ID NO: 196980 - protein, 22 aa, Mycobacterium bovis
ARPAGLPGSLATEFTLDLNPPE

SEQ ID NO: 196981 - protein, 18 aa, Mycobacterium bovis
ARPDLPPTPWLIPESAGL

SEQ ID NO: 196982 - protein, 21 aa, Mycobacterium bovis
ARPDTAPALALAARSSASFPL

SEQ ID NO: 196983 - protein, 19 aa, Mycobacterium bovis
ARPGARRSREDFEICATAQ

SEQ ID NO: 196984 - protein, 19 aa, Mycobacterium bovis
ARPGNPLQRTDPAADAAKA

SEQ ID NO: 196985 - protein, 22 aa, Mycobacterium bovis
ARPGRIGIRARQMFDGYRFQRG

SEQ ID NO: 196986 - protein, 19 aa, Mycobacterium bovis
ARPGVCLTTSGPGFLNGLP

SEQ ID NO: 196987 - protein, 19 aa, Mycobacterium bovis
ARPIRKGRLGKPVEFGYKA

SEQ ID NO: 196988 - protein, 18 aa, Mycobacterium bovis
ARPRYIRIAADLPSTATH

SEQ ID NO: 196989 - protein, 25 aa, Mycobacterium bovis
ARPTGAFGRLLGRIWRAETADVNRI

SEQ ID NO: 196990 - protein, 17 aa, Mycobacterium bovis
ARQAGAVGLVVTTDWTF

SEQ ID NO: 196991 - protein, 19 aa, Mycobacterium bovis
ARQALRLFDDLRLEHGRLD

SEQ ID NO: 196992 - protein, 17 aa, Mycobacterium bovis
ARQHHVFPPGWSRCRAP

SEQ ID NO: 196993 - protein, 20 aa, Mycobacterium bovis
ARQLLDGLLLVSGNDAANTL

SEQ ID NO: 196994 - protein, 18 aa, Mycobacterium bovis
ARQLPGRLVGVSVDSDGT

SEQ ID NO: 196995 - protein, 17 aa, Mycobacterium bovis
ARQPISVIPTGSIALDV

SEQ ID NO: 196996 - protein, 19 aa, Mycobacterium bovis
ARQQLLALREEVDRLGQPP

SEQ ID NO: 196997 - protein, 26 aa, Mycobacterium bovis
ARQRAHAAWLWSRRRAVVAGNSAAAL

SEQ ID NO: 196998 - protein, 27 aa, Mycobacterium bovis
ARQRRFGVSYWTVFDEWAGRASAMRDI

SEQ ID NO: 196999 - protein, 23 aa, Mycobacterium bovis
ARQRYWGEPFPIVYDSDGRPHAL

SEQ ID NO: 197000 - protein, 25 aa, Mycobacterium bovis
ARRAPELAGRGHLVRLWALPDGPDG

SEQ ID NO: 197001 - protein, 28 aa, Mycobacterium bovis
ARRDGVACYPARFQLVLAANPCPCAPAD

SEQ ID NO: 197002 - protein, 20 aa, Mycobacterium bovis
ARRFARDDYDILLIGHEGHE

SEQ ID NO: 197003 - protein, 22 aa, Mycobacterium bovis
ARRFLPGATILKASVGPMDNNA

SEQ ID NO: 197004 - protein, 18 aa, Mycobacterium bovis
ARRGPGRVPDGIDVHLLP

SEQ ID NO: 197005 - protein, 20 aa, Mycobacterium bovis
ARRIGRWRFVTLHHQVDTSR

SEQ ID NO: 197006 - protein, 33 aa, Mycobacterium bovis
ARRLKASGIDTVFTLSGGHLFSIYDGCREEGIR

SEQ ID NO: 197007 - protein, 19 aa, Mycobacterium bovis
ARRNMPILAVHTGEGKGKS

SEQ ID NO: 197008 - protein, 18 aa, Mycobacterium bovis
ARRRGISVLGDRPPMVSV

SEQ ID NO: 197009 - protein, 19 aa, Mycobacterium bovis
ARRRRLMVDLYKRVLDGVA

SEQ ID NO: 197010 - protein, 29 aa, Mycobacterium bovis
ARRVGRPRIRLAYRLTPRRVLGQRRAGGV

SEQ ID NO: 197011 - protein, 20 aa, Mycobacterium bovis
ARSADLCRRELLSRRDQLTA

SEQ ID NO: 197012 - protein, 17 aa, Mycobacterium bovis
ARSAEIERDRRLPDELV

SEQ ID NO: 197013 - protein, 17 aa, Mycobacterium bovis
ARSCIILVFHRVADNPG

SEQ ID NO: 197014 - protein, 20 aa, Mycobacterium bovis
ARSGGTLVGYAGISRLGRTP

SEQ ID NO: 197015 - protein, 23 aa, Mycobacterium bovis
ARSLVSEVLEFLATAGTNYNKTV

SEQ ID NO: 197016 - protein, 22 aa, Mycobacterium bovis
ARSNHGTCANQCPIVDAGDRVE

SEQ ID NO: 197017 - protein, 21 aa, Mycobacterium bovis
ARSPLGRKLGRRWHRETVYGV

SEQ ID NO: 197018 - protein, 17 aa, Mycobacterium bovis
ARSRLAGVMPDSSSRLV

SEQ ID NO: 197019 - protein, 18 aa, Mycobacterium bovis
ARSRRWRAGCGVRTDSSL

SEQ ID NO: 197020 - protein, 17 aa, Mycobacterium bovis
ARSVAGCSFPIERLRQV

SEQ ID NO: 197021 - protein, 27 aa, Mycobacterium bovis
ARSVTGIAPAGGWTRWSPVKFEVIAKF

SEQ ID NO: 197022 - protein, 27 aa, Mycobacterium bovis
ARSWAETLWRMSVSIAGAVCTAAARAV

SEQ ID NO: 197023 - protein, 19 aa, Mycobacterium bovis
ARTCSAGVFKRHRQIDRPC

SEQ ID NO: 197024 - protein, 20 aa, Mycobacterium bovis
ARTHAIGQIVPGKVTKLVPF

SEQ ID NO: 197025 - protein, 29 aa, Mycobacterium bovis
ARTPRCGLCPLDWCAWRHAGYPPSDGPPR

SEQ ID NO: 197026 - protein, 21 aa, Mycobacterium bovis
ARTQQLLGWYSRVVTNLDEYY

SEQ ID NO: 197027 - protein, 21 aa, Mycobacterium bovis
ARTRIRPHFFPFTEPSAEVDV

SEQ ID NO: 197028 - protein, 17 aa, Mycobacterium bovis
ARTVIDFAARRVNPPVY

SEQ ID NO: 197029 - protein, 17 aa, Mycobacterium bovis
ARVAALEANQADYRAVL

SEQ ID NO: 197030 - protein, 18 aa, Mycobacterium bovis
ARVAECLAAIEAPLVITP

SEQ ID NO: 197031 - protein, 23 aa, Mycobacterium bovis
ARVAELLDIVGLRHGDASRYPAE

SEQ ID NO: 197032 - protein, 25 aa, Mycobacterium bovis
ARVASAAAVLADWMSGPGAAAPLAD

SEQ ID NO: 197033 - protein, 19 aa, Mycobacterium bovis
ARVDGRTVGVVANQPMHMS

SEQ ID NO: 197034 - protein, 23 aa, Mycobacterium bovis
ARVDQLPLIWQRLVDGGMESGHA

SEQ ID NO: 197035 - protein, 24 aa, Mycobacterium bovis
ARVGELRALVAPADAVFLDAAIES

SEQ ID NO: 197036 - protein, 25 aa, Mycobacterium bovis
ARVGFSVALGEHLACGPQAIRARLA

SEQ ID NO: 197037 - protein, 18 aa, Mycobacterium bovis
ARVGNVLYRDFQPVAVLD

SEQ ID NO: 197038 - protein, 23 aa, Mycobacterium bovis
ARVICRRSKLMTRIAGAGAMGSV

SEQ ID NO: 197039 - protein, 22 aa, Mycobacterium bovis
ARVLQALLARWDHHPRVDLVTT

SEQ ID NO: 197040 - protein, 27 aa, Mycobacterium bovis
ARVLRPGGRLGLVWNTRDERLGWVREL

SEQ ID NO: 197041 - protein, 18 aa, Mycobacterium bovis
ARVPERFRGDVEPVDAVA

SEQ ID NO: 197042 - protein, 25 aa, Mycobacterium bovis
ARVSESPWALMHFMVRLPEVGVAGE

SEQ ID NO: 197043 - protein, 19 aa, Mycobacterium bovis
ARVSTPLHWEEVPGCDPAV

SEQ ID NO: 197044 - protein, 23 aa, Mycobacterium bovis
ARVVSMPCLEWFEAQPYEYRDAV

SEQ ID NO: 197045 - protein, 21 aa, Mycobacterium bovis
ARWPELRALLTEAFASHDRDH

SEQ ID NO: 197046 - protein, 25 aa, Mycobacterium bovis
ARYAELNTAIGTNWFPGTTPEVVSY

SEQ ID NO: 197047 - protein, 18 aa, Mycobacterium bovis
ARYDYLVNMCDEMGVVTP

SEQ ID NO: 197048 - protein, 19 aa, Mycobacterium bovis
ARYRRAVRARGHFPNEQSA

SEQ ID NO: 197049 - protein, 27 aa, Mycobacterium bovis
ARYTWPRFVCALPKEFFAAVRAELAKR

SEQ ID NO: 197050 - protein, 19 aa, Mycobacterium bovis
ARYVPQRVVEHLPERVITA

SEQ ID NO: 197051 - protein, 22 aa, Mycobacterium bovis
ARYVWEVPYYPQYYIPLADVRM

SEQ ID NO: 197052 - protein, 17 aa, Mycobacterium bovis
ARYWHSYWSKFSDKGYY

SEQ ID NO: 197053 - protein, 18 aa, Mycobacterium bovis
ASAEGAWIADIDGLRYLD

SEQ ID NO: 197054 - protein, 21 aa, Mycobacterium bovis
ASAGHIYAVIGLKDTTTGDTL

SEQ ID NO: 197055 - protein, 18 aa, Mycobacterium bovis
ASALLTCVARDPDPANVG

SEQ ID NO: 197056 - protein, 26 aa, Mycobacterium bovis
ASARASQTWRYPAFFHAMLDAGVYPP

SEQ ID NO: 197057 - protein, 21 aa, Mycobacterium bovis
ASARCLAAYVYAAAGEGESTT

SEQ ID NO: 197058 - protein, 24 aa, Mycobacterium bovis
ASASELRDGLCFVDLAPITESGIV

SEQ ID NO: 197059 - protein, 23 aa, Mycobacterium bovis
ASASRWRIVSRYLPVGVAPEQGL

SEQ ID NO: 197060 - protein, 17 aa, Mycobacterium bovis
ASATFPWYQLGRQAHVQ

SEQ ID NO: 197061 - protein, 23 aa, Mycobacterium bovis
ASATIDAARDWLLGTPADDWVSM

SEQ ID NO: 197062 - protein, 17 aa, Mycobacterium bovis
ASAVHYGLACRELEAAD

SEQ ID NO: 197063 - protein, 23 aa, Mycobacterium bovis
ASAWEIWGALLGGGRLVIVPESV

SEQ ID NO: 197064 - protein, 18 aa, Mycobacterium bovis
ASAWVGIGTPDFVEVPID

SEQ ID NO: 197065 - protein, 18 aa, Mycobacterium bovis
ASCGSDFGAVVDVIDTRT

SEQ ID NO: 197066 - protein, 24 aa, Mycobacterium bovis
ASDFWGGAGSAACQGFITQLGRNF

SEQ ID NO: 197067 - protein, 21 aa, Mycobacterium bovis
ASDLPGFVLHVEICEDMFVPM

SEQ ID NO: 197068 - protein, 17 aa, Mycobacterium bovis
ASDLSLAVMRLSRQLRF

SEQ ID NO: 197069 - protein, 34 aa, Mycobacterium bovis
ASEAISGMNAVAGWRGAPRPVLARELLPERALMG

SEQ ID NO: 197070 - protein, 18 aa, Mycobacterium bovis
ASECGWATPSAFIDTYRQ

SEQ ID NO: 197071 - protein, 22 aa, Mycobacterium bovis
ASEIKRKGVLIGDTVVIRKAGD

SEQ ID NO: 197072 - protein, 24 aa, Mycobacterium bovis
ASELHCAAMSFGSVTSGLVVGWWQ

SEQ ID NO: 197073 - protein, 19 aa, Mycobacterium bovis
ASELVRFELLAGVRESELA

SEQ ID NO: 197074 - protein, 20 aa, Mycobacterium bovis
ASFDIPWLVIRALSDLAGAD

SEQ ID NO: 197075 - protein, 18 aa, Mycobacterium bovis
ASFGPWADLVPHLDDLVA

SEQ ID NO: 197076 - protein, 25 aa, Mycobacterium bovis
ASFVDDFVLYWGFLALAQVRSGRRT

SEQ ID NO: 197077 - protein, 25 aa, Mycobacterium bovis
ASGDPRGGMKQVLGASRLRRDRVQA

SEQ ID NO: 197078 - protein, 23 aa, Mycobacterium bovis
ASGELIATVAMPPRVPRAVDADT

SEQ ID NO: 197079 - protein, 23 aa, Mycobacterium bovis
ASGFYAKWLPKLVFGEGQLPTTY

SEQ ID NO: 197080 - protein, 28 aa, Mycobacterium bovis
ASGGKGGTGGWLWGSGGAGGAGGSGGGS

SEQ ID NO: 197081 - protein, 20 aa, Mycobacterium bovis
ASGIPGDWALYDVDGKNGEH

SEQ ID NO: 197082 - protein, 17 aa, Mycobacterium bovis
ASGLPMGGDLEFADELT

SEQ ID NO: 197083 - protein, 20 aa, Mycobacterium bovis
ASGPRLTAYVAGGPQPPPVA

SEQ ID NO: 197084 - protein, 17 aa, Mycobacterium bovis
ASGVRMLLDAAKQVSGI

SEQ ID NO: 197085 - protein, 19 aa, Mycobacterium bovis
ASHNGMWDLSMLGIVPGIR

SEQ ID NO: 197086 - protein, 19 aa, Mycobacterium bovis
ASHQDRGWAVIDVETSGFR

SEQ ID NO: 197087 - protein, 18 aa, Mycobacterium bovis
ASHSIASYVGALAFTEQR

SEQ ID NO: 197088 - protein, 18 aa, Mycobacterium bovis
ASIAGLFLTTEAVVADKP

SEQ ID NO: 197089 - protein, 18 aa, Mycobacterium bovis
ASIARKLGALTVGVVTRP

SEQ ID NO: 197090 - protein, 18 aa, Mycobacterium bovis
ASIDLCRAKHRLPGLQFV

SEQ ID NO: 197091 - protein, 22 aa, Mycobacterium bovis
ASIDPEWSRPPGSITDDHVFDA

SEQ ID NO: 197092 - protein, 19 aa, Mycobacterium bovis
ASIGDAWAADVVVKVAPPT

SEQ ID NO: 197093 - protein, 26 aa, Mycobacterium bovis
ASIPVKRLRQAGVLDLLLALANETET

SEQ ID NO: 197094 - protein, 27 aa, Mycobacterium bovis
ASIQRTGRCVVMHEGPRSLGYGAGLAA

SEQ ID NO: 197095 - protein, 33 aa, Mycobacterium bovis
ASKADTPDGVWSRMKFEGGVHRVQRVPVTESQG

SEQ ID NO: 197096 - protein, 25 aa, Mycobacterium bovis
ASKNPKEHFDFFPLTVDVEERMYAA

SEQ ID NO: 197097 - protein, 21 aa, Mycobacterium bovis
ASLDRWLARWQPRYPDVRVQS

SEQ ID NO: 197098 - protein, 20 aa, Mycobacterium bovis
ASLGGFNFGGATIGHNNVGI

SEQ ID NO: 197099 - protein, 17 aa, Mycobacterium bovis
ASLKQAERVKALALAGG

SEQ ID NO: 197100 - protein, 18 aa, Mycobacterium bovis
ASLLTPAMLGAHYRLGRH

SEQ ID NO: 197101 - protein, 19 aa, Mycobacterium bovis
ASLPARLSAAQVWSQCHSY

SEQ ID NO: 197102 - protein, 25 aa, Mycobacterium bovis
ASLPPEFRAAVVLCDIEGLSYEEIG

SEQ ID NO: 197103 - protein, 17 aa, Mycobacterium bovis
ASMGGMIAQIFAARFAQ

SEQ ID NO: 197104 - protein, 23 aa, Mycobacterium bovis
ASNAGGLFLNWVDRVIGPGDPAL

SEQ ID NO: 197105 - protein, 19 aa, Mycobacterium bovis
ASNTHRWFGAYGVTKSAVD

SEQ ID NO: 197106 - protein, 27 aa, Mycobacterium bovis
ASPGYPCYRNILSALGCEVVEIPCGPQ

SEQ ID NO: 197107 - protein, 25 aa, Mycobacterium bovis
ASQLMGVVMARYIVRIEPFASLPAE

SEQ ID NO: 197108 - protein, 17 aa, Mycobacterium bovis
ASQWRRLGGTFPTNSQL

SEQ ID NO: 197109 - protein, 25 aa, Mycobacterium bovis
ASQYKDVILGLVFLKYVSDAYDERR

SEQ ID NO: 197110 - protein, 24 aa, Mycobacterium bovis
ASRALAAAVGISWTSELLTVTGVD

SEQ ID NO: 197111 - protein, 21 aa, Mycobacterium bovis
ASRGHARGCGPLRQVVSRRVA

SEQ ID NO: 197112 - protein, 17 aa, Mycobacterium bovis
ASRGMGGDGGTGGAGGN

SEQ ID NO: 197113 - protein, 18 aa, Mycobacterium bovis
ASRLRIAADGIDWPTTGR

SEQ ID NO: 197114 - protein, 23 aa, Mycobacterium bovis
ASRWPRAGALGPLIRDPDGSVYP

SEQ ID NO: 197115 - protein, 18 aa, Mycobacterium bovis
ASRYPYSRDGVIAVPAQA

SEQ ID NO: 197116 - protein, 27 aa, Mycobacterium bovis
ASSGLGLQCARALLRRDASWHVVLAVR

SEQ ID NO: 197117 - protein, 24 aa, Mycobacterium bovis
ASSSRAGLGYEVIVSRLDDEANIA

SEQ ID NO: 197118 - protein, 29 aa, Mycobacterium bovis
ASTETRLPFCWRGVSLHAGGAGRVRARFA

SEQ ID NO: 197119 - protein, 19 aa, Mycobacterium bovis
ASTKVQSWDIFKCVRQVLD

SEQ ID NO: 197120 - protein, 24 aa, Mycobacterium bovis
ASTPLFFAQAIGRFVRSRRPGETA

SEQ ID NO: 197121 - protein, 29 aa, Mycobacterium bovis
ASVESSVLRWARESCGLTEVAAARKLGLP

SEQ ID NO: 197122 - protein, 23 aa, Mycobacterium bovis
ASVGKLSVPPVWSGPLPGSVTPG

SEQ ID NO: 197123 - protein, 19 aa, Mycobacterium bovis
ASVGSPWLADTWRDRFEQM

SEQ ID NO: 197124 - protein, 23 aa, Mycobacterium bovis
ASVLKQLVAYVGLERFLAGLRDY

SEQ ID NO: 197125 - protein, 18 aa, Mycobacterium bovis
ASVLSRPVAKIMSTTVAT

SEQ ID NO: 197126 - protein, 23 aa, Mycobacterium bovis
ASVPRWLQRPARLVIQSVLGRVR

SEQ ID NO: 197127 - protein, 25 aa, Mycobacterium bovis
ASVSCAIQNLWLAARSEGLGMGWVS

SEQ ID NO: 197128 - protein, 28 aa, Mycobacterium bovis
ASVTAGLAGQAWQGPAALAMAAAAAPYA

SEQ ID NO: 197129 - protein, 24 aa, Mycobacterium bovis
ASVVGRLSVPASWSTAAPATAAGA

SEQ ID NO: 197130 - protein, 20 aa, Mycobacterium bovis
ASWLPASLLTPAMLGAHYRL

SEQ ID NO: 197131 - protein, 27 aa, Mycobacterium bovis
ASYAMPDVHWGYGFPIGGVAATDVDND

SEQ ID NO: 197132 - protein, 23 aa, Mycobacterium bovis
ATAAFGRGECYVERYLDKPRHVE

SEQ ID NO: 197133 - protein, 17 aa, Mycobacterium bovis
ATACADCGVTVDRMPRV

SEQ ID NO: 197134 - protein, 26 aa, Mycobacterium bovis
ATADCELDWWLGFSSAASLLGSPGQA

SEQ ID NO: 197135 - protein, 23 aa, Mycobacterium bovis
ATALEGSGWTVAAEEAGPVTGMM

SEQ ID NO: 197136 - protein, 18 aa, Mycobacterium bovis
ATALPGANRMPHWAAGTL

SEQ ID NO: 197137 - protein, 17 aa, Mycobacterium bovis
ATALRRAGRSAGPRQLG

SEQ ID NO: 197138 - protein, 26 aa, Mycobacterium bovis
ATARAYRAAAEFVPRIGALIDTVHRH

SEQ ID NO: 197139 - protein, 17 aa, Mycobacterium bovis
ATARPPTFVLFTTGFLE

SEQ ID NO: 197140 - protein, 20 aa, Mycobacterium bovis
ATASALGLVGVRELIQMRRP

SEQ ID NO: 197141 - protein, 19 aa, Mycobacterium bovis
ATASRLTPFTAPPQTTNPS

SEQ ID NO: 197142 - protein, 31 aa, Mycobacterium bovis
ATAVAALRGQHSWAAAIPWSDIQKYWMMFLG

SEQ ID NO: 197143 - protein, 18 aa, Mycobacterium bovis
ATAVAWLAGKVESFGVRL

SEQ ID NO: 197144 - protein, 26 aa, Mycobacterium bovis
ATAYLECAQACGLGLLGGPPTPETAL

SEQ ID NO: 197145 - protein, 22 aa, Mycobacterium bovis
ATCGGIRVWSLYVPNGRALDDP

SEQ ID NO: 197146 - protein, 26 aa, Mycobacterium bovis
ATDLAEWLVRQGVPFRSAHEAAGAAV

SEQ ID NO: 197147 - protein, 21 aa, Mycobacterium bovis
ATDVAARWPVPGPRDDKYTQG

SEQ ID NO: 197148 - protein, 18 aa, Mycobacterium bovis
ATDVARPAETVRGWLRRF

SEQ ID NO: 197149 - protein, 27 aa, Mycobacterium bovis
ATDVGCSWLPLYHDMGLAFVLSAALAG

SEQ ID NO: 197150 - protein, 19 aa, Mycobacterium bovis
ATEALNLVSYVLGDSRFER

SEQ ID NO: 197151 - protein, 20 aa, Mycobacterium bovis
ATEDAWRRVFEFFGQHLRAG

SEQ ID NO: 197152 - protein, 32 aa, Mycobacterium bovis
ATEIMVCRYADGVGHPFWFSRTVFGELARLHG

SEQ ID NO: 197153 - protein, 21 aa, Mycobacterium bovis
ATELLLAMVRRLSVADTGIEL

SEQ ID NO: 197154 - protein, 18 aa, Mycobacterium bovis
ATFDGTILIGDIPIPIID

SEQ ID NO: 197155 - protein, 22 aa, Mycobacterium bovis
ATFGHLWQWVGTNIGRYHSYPR

SEQ ID NO: 197156 - protein, 18 aa, Mycobacterium bovis
ATFPETQILAAFGQTEMS

SEQ ID NO: 197157 - protein, 35 aa, Mycobacterium bovis
ATGFLGRYLALEWLDRMDLVNGKLICLVRARSDEE

SEQ ID NO: 197158 - protein, 28 aa, Mycobacterium bovis
ATGGIPVTVEVPVGGILAPLQPFQATAV

SEQ ID NO: 197159 - protein, 29 aa, Mycobacterium bovis
ATGKLADFGELRWRDGVAVTVVLAAENYP

SEQ ID NO: 197160 - protein, 18 aa, Mycobacterium bovis
ATGLPVLTVRSLVTRPIT

SEQ ID NO: 197161 - protein, 25 aa, Mycobacterium bovis
ATGQWARTAVGLARDVAEAFARDPE

SEQ ID NO: 197162 - protein, 23 aa, Mycobacterium bovis
ATGRAVGVLADLQGPKIRLGRFA

SEQ ID NO: 197163 - protein, 20 aa, Mycobacterium bovis
ATGRRFEALSALSAGVKEVR

SEQ ID NO: 197164 - protein, 27 aa, Mycobacterium bovis
ATGVKRQEDFIGIHFFSPVDKMPLVEI

SEQ ID NO: 197165 - protein, 24 aa, Mycobacterium bovis
ATHATELFAVFDIYRTRFGALLTA

SEQ ID NO: 197166 - protein, 30 aa, Mycobacterium bovis
ATHIGGLWWILTCLMHGGLCVTGGENTTSL

SEQ ID NO: 197167 - protein, 26 aa, Mycobacterium bovis
ATHLDPRLLIEFCLLATQYDAIAATI

SEQ ID NO: 197168 - protein, 18 aa, Mycobacterium bovis
ATIRPYRPSVSADLPPSA

SEQ ID NO: 197169 - protein, 19 aa, Mycobacterium bovis
ATKAVGWSPTDWVDNTLAT

SEQ ID NO: 197170 - protein, 28 aa, Mycobacterium bovis
ATKYTVGFKFMSRIVPYPGTPLYQAYSD

SEQ ID NO: 197171 - protein, 17 aa, Mycobacterium bovis
ATLASDLMEVWRAPIID

SEQ ID NO: 197172 - protein, 18 aa, Mycobacterium bovis
ATLDRYNAYAARGADPDF

SEQ ID NO: 197173 - protein, 25 aa, Mycobacterium bovis
ATLHHRASALIGRLMRELTADWDYS

SEQ ID NO: 197174 - protein, 17 aa, Mycobacterium bovis
ATLPRAFIIGPDGSTTV

SEQ ID NO: 197175 - protein, 17 aa, Mycobacterium bovis
ATLPWLGDHRIHNVAAL

SEQ ID NO: 197176 - protein, 17 aa, Mycobacterium bovis
ATLRCRRLGAVLHAAAD

SEQ ID NO: 197177 - protein, 17 aa, Mycobacterium bovis
ATLTFRDPKELRFFTRT

SEQ ID NO: 197178 - protein, 19 aa, Mycobacterium bovis
ATLVRAVCDGRRLVTLDGP

SEQ ID NO: 197179 - protein, 25 aa, Mycobacterium bovis
ATMARPDLTFDLVRPGIAVYGLSPV

SEQ ID NO: 197180 - protein, 18 aa, Mycobacterium bovis
ATMHPSRYLTLIEGVTAV

SEQ ID NO: 197181 - protein, 19 aa, Mycobacterium bovis
ATMLPFSWQGVSLHAAGAS

SEQ ID NO: 197182 - protein, 18 aa, Mycobacterium bovis
ATMPDPIITLARTFMVRP

SEQ ID NO: 197183 - protein, 17 aa, Mycobacterium bovis
ATMRALTGRSWRAGLRQ

SEQ ID NO: 197184 - protein, 20 aa, Mycobacterium bovis
ATMRGEFLWCQLFSEPGAGS

SEQ ID NO: 197185 - protein, 27 aa, Mycobacterium bovis
ATMSPAWGMYCGYELFEHRAVREGSEE

SEQ ID NO: 197186 - protein, 19 aa, Mycobacterium bovis
ATNFGPLQPLFDVINAPTL

SEQ ID NO: 197187 - protein, 18 aa, Mycobacterium bovis
ATPALFFAVGQGYRNFTQ

SEQ ID NO: 197188 - protein, 18 aa, Mycobacterium bovis
ATPEALVESALWEASLFE

SEQ ID NO: 197189 - protein, 28 aa, Mycobacterium bovis
ATPELMPLPIALAHRLSRRLTEVRKNGV

SEQ ID NO: 197190 - protein, 24 aa, Mycobacterium bovis
ATPKRPVIFECVGVPGIIDGIIAS

SEQ ID NO: 197191 - protein, 18 aa, Mycobacterium bovis
ATPLQAIAAMDAMDYDVH

SEQ ID NO: 197192 - protein, 18 aa, Mycobacterium bovis
ATPPPTWEDIGWLRELWG

SEQ ID NO: 197193 - protein, 18 aa, Mycobacterium bovis
ATPPRPGPQPPRIEPPES

SEQ ID NO: 197194 - protein, 20 aa, Mycobacterium bovis
ATQAIPAYEPEPGKPAPAAV

SEQ ID NO: 197195 - protein, 25 aa, Mycobacterium bovis
ATQQYPLDRLKAIGAQYDATINDVA

SEQ ID NO: 197196 - protein, 18 aa, Mycobacterium bovis
ATQRCGEAGRTLRIPSPR

SEQ ID NO: 197197 - protein, 24 aa, Mycobacterium bovis
ATRAEGVACYQLFISGLLDVTDNV

SEQ ID NO: 197198 - protein, 18 aa, Mycobacterium bovis
ATRGYRYGPAFRGLTAMW

SEQ ID NO: 197199 - protein, 25 aa, Mycobacterium bovis
ATRLRIPAERWVYPQAGTDAHDTPA

SEQ ID NO: 197200 - protein, 18 aa, Mycobacterium bovis
ATRPEVRGGLGGFAGLFT

SEQ ID NO: 197201 - protein, 24 aa, Mycobacterium bovis
ATRPPAVLHRIRQTLAIQPVSIGS

SEQ ID NO: 197202 - protein, 19 aa, Mycobacterium bovis
ATRRLALTGTPFRSDDSPI

SEQ ID NO: 197203 - protein, 20 aa, Mycobacterium bovis
ATRRSWAVLGEMAELGEDAI

SEQ ID NO: 197204 - protein, 27 aa, Mycobacterium bovis
ATRSGDVWLLNGFKWFASNCAGEAFVV

SEQ ID NO: 197205 - protein, 18 aa, Mycobacterium bovis
ATRVPFVIARIGEKATQP

SEQ ID NO: 197206 - protein, 19 aa, Mycobacterium bovis
ATSGRCFSAAPNFAFELAV

SEQ ID NO: 197207 - protein, 19 aa, Mycobacterium bovis
ATSTGVCATCYGRSMATGK

SEQ ID NO: 197208 - protein, 23 aa, Mycobacterium bovis
ATSTWPDMKIVNNIEVTGQAPPG

SEQ ID NO: 197209 - protein, 29 aa, Mycobacterium bovis
ATTCAPLTWPEGWRRWPQRVYGDTRLELA

SEQ ID NO: 197210 - protein, 25 aa, Mycobacterium bovis
ATTDEPFAALAFKIATHPFFGKLTY

SEQ ID NO: 197211 - protein, 18 aa, Mycobacterium bovis
ATTNCFPMIQISGSSSRP

SEQ ID NO: 197212 - protein, 17 aa, Mycobacterium bovis
ATTTLLRPVKPPPSEGW

SEQ ID NO: 197213 - protein, 17 aa, Mycobacterium bovis
ATVGVIHFFATHGTSMT

SEQ ID NO: 197214 - protein, 25 aa, Mycobacterium bovis
ATVPVGILCLEFLVHAWDFAIATGS

SEQ ID NO: 197215 - protein, 22 aa, Mycobacterium bovis
ATVSVAAWGIRLAREAERKAGE

SEQ ID NO: 197216 - protein, 19 aa, Mycobacterium bovis
ATYRPGQAVEAVFVSALPN

SEQ ID NO: 197217 - protein, 18 aa, Mycobacterium bovis
AVAAIAPMPPGAPEGMPP

SEQ ID NO: 197218 - protein, 24 aa, Mycobacterium bovis
AVAAIRVAPFAAWCAEQGQEPDSP

SEQ ID NO: 197219 - protein, 23 aa, Mycobacterium bovis
AVAARLWPTTALIVDHGLQPGSA

SEQ ID NO: 197220 - protein, 17 aa, Mycobacterium bovis
AVAARTRSGVILRSPAA

SEQ ID NO: 197221 - protein, 23 aa, Mycobacterium bovis
AVADCGRLLAGRLHRAVDGASQL

SEQ ID NO: 197222 - protein, 29 aa, Mycobacterium bovis
AVADSFYLPLVVRRRIWFLAKSEYFTGTG

SEQ ID NO: 197223 - protein, 28 aa, Mycobacterium bovis
AVAEGGRFACGGARPADREVGFYIEPTV

SEQ ID NO: 197224 - protein, 17 aa, Mycobacterium bovis
AVAGGGGRGMRRVGDIA

SEQ ID NO: 197225 - protein, 19 aa, Mycobacterium bovis
AVAGRRGGVTVATNMAGRG

SEQ ID NO: 197226 - protein, 23 aa, Mycobacterium bovis
AVAISALQWRGSQTSDPVETPVE

SEQ ID NO: 197227 - protein, 20 aa, Mycobacterium bovis
AVALGYDFLPGTTVNRYCSS

SEQ ID NO: 197228 - protein, 24 aa, Mycobacterium bovis
AVALQIAALRARYLSRDDVPEDIV

SEQ ID NO: 197229 - protein, 18 aa, Mycobacterium bovis
AVAPLCNAMSRLGGVTLS

SEQ ID NO: 197230 - protein, 29 aa, Mycobacterium bovis
AVAPMPGGFPIELGMTIRLAREKNYDLLL

SEQ ID NO: 197231 - protein, 27 aa, Mycobacterium bovis
AVAREVLRAGPGVPELRAAGERMRDAV

SEQ ID NO: 197232 - protein, 25 aa, Mycobacterium bovis
AVARGDASAGWCVSIAITSALLVAY

SEQ ID NO: 197233 - protein, 22 aa, Mycobacterium bovis
AVASRVGAPLGHDYAVISLSDR

SEQ ID NO: 197234 - protein, 17 aa, Mycobacterium bovis
AVATSMPKRGVGAAVLI

SEQ ID NO: 197235 - protein, 24 aa, Mycobacterium bovis
AVAVLRRLAPRARITGGVDRVELA

SEQ ID NO: 197236 - protein, 24 aa, Mycobacterium bovis
AVCALEPYWEALRKVYAPFESGLP

SEQ ID NO: 197237 - protein, 25 aa, Mycobacterium bovis
AVDLRYLGSLTHGFLNLFQLGGGSA

SEQ ID NO: 197238 - protein, 28 aa, Mycobacterium bovis
AVDPAHPFPFVSGLSLNLAVTVRQPEDG

SEQ ID NO: 197239 - protein, 22 aa, Mycobacterium bovis
AVDPAVVVLLNLSRDQLDRVGE

SEQ ID NO: 197240 - protein, 27 aa, Mycobacterium bovis
AVDPLLPEVAWSWLVDALTARTDQVRA

SEQ ID NO: 197241 - protein, 22 aa, Mycobacterium bovis
AVDPYAIGVPGVYLCSQSAPPG

SEQ ID NO: 197242 - protein, 24 aa, Mycobacterium bovis
AVDRAILRVSVWELLHAADVPEPV

SEQ ID NO: 197243 - protein, 24 aa, Mycobacterium bovis
AVDSGVKVGMVFGELVHGEVDVRI

SEQ ID NO: 197244 - protein, 26 aa, Mycobacterium bovis
AVDTDLRWRIVTALATAGAIDADGPE

SEQ ID NO: 197245 - protein, 20 aa, Mycobacterium bovis
AVDYLEIWDAQAWQNYQQIH

SEQ ID NO: 197246 - protein, 19 aa, Mycobacterium bovis
AVEAGERLGFLPGTLSEKI

SEQ ID NO: 197247 - protein, 18 aa, Mycobacterium bovis
AVEFGFVAHRGMTVLPLA

SEQ ID NO: 197248 - protein, 24 aa, Mycobacterium bovis
AVENALKAAFDWKSRHNQAHGIDP

SEQ ID NO: 197249 - protein, 42 aa, Mycobacterium bovis
AVEPGDFVILNWRAVCGQCRACKRGRPRYCFDTFNAEQKMTL

SEQ ID NO: 197250 - protein, 17 aa, Mycobacterium bovis
AVERNGLHRLVNPRTGK

SEQ ID NO: 197251 - protein, 18 aa, Mycobacterium bovis
AVERVMVVRDRVRTEPPL

SEQ ID NO: 197252 - protein, 33 aa, Mycobacterium bovis
AVEVALFRLLGSWGVRPDFVMGHSIGELSAAHV

SEQ ID NO: 197253 - protein, 17 aa, Mycobacterium bovis
AVFADRGAHVVLAVRNL

SEQ ID NO: 197254 - protein, 23 aa, Mycobacterium bovis
AVFDLPKGAPRRFIRDLYEAISQ

SEQ ID NO: 197255 - protein, 19 aa, Mycobacterium bovis
AVFEAEFGDGSALGLQIEY

SEQ ID NO: 197256 - protein, 20 aa, Mycobacterium bovis
AVFERIWLRTTLLGAELQPF

SEQ ID NO: 197257 - protein, 19 aa, Mycobacterium bovis
AVFNGFLPAVARMRALDPV

SEQ ID NO: 197258 - protein, 25 aa, Mycobacterium bovis
AVFPRYHPRWAWWLTSVPVLREFLV

SEQ ID NO: 197259 - protein, 27 aa, Mycobacterium bovis
AVGDKWRLAEVLAWQAYVGFAGEGDPG

SEQ ID NO: 197260 - protein, 17 aa, Mycobacterium bovis
AVGELTPSVAALAALAS

SEQ ID NO: 197261 - protein, 33 aa, Mycobacterium bovis
AVGGARRCAAQSWPLDRVKAVKDAAGVSLNDVV

SEQ ID NO: 197262 - protein, 17 aa, Mycobacterium bovis
AVGKLYVQRHFPPDAKS

SEQ ID NO: 197263 - protein, 20 aa, Mycobacterium bovis
AVGRPGWPTTTASRRPLVEA

SEQ ID NO: 197264 - protein, 18 aa, Mycobacterium bovis
AVGVCWHAGRGSYPWLPT

SEQ ID NO: 197265 - protein, 19 aa, Mycobacterium bovis
AVHNAEFARGVAFAEERAE

SEQ ID NO: 197266 - protein, 18 aa, Mycobacterium bovis
AVHTLPMLYALREQTPDT

SEQ ID NO: 197267 - protein, 18 aa, Mycobacterium bovis
AVIEMIHLATLYHDDVMD

SEQ ID NO: 197268 - protein, 26 aa, Mycobacterium bovis
AVIGRELDRYLPFLATTKVLMAAVRA

SEQ ID NO: 197269 - protein, 17 aa, Mycobacterium bovis
AVIPGKCQLTVVPGATH

SEQ ID NO: 197270 - protein, 25 aa, Mycobacterium bovis
AVIRAEADLARFPADVARVVVRLIH

SEQ ID NO: 197271 - protein, 25 aa, Mycobacterium bovis
AVIVCPIGFVADHIEVVWDLDHELR

SEQ ID NO: 197272 - protein, 23 aa, Mycobacterium bovis
AVKHLCAQMLCRAEQADVAAADA

SEQ ID NO: 197273 - protein, 23 aa, Mycobacterium bovis
AVKSSLRTAVRAFREAAHAGDKA

SEQ ID NO: 197274 - protein, 20 aa, Mycobacterium bovis
AVKVCGGAVLGEFATLVNPQ

SEQ ID NO: 197275 - protein, 29 aa, Mycobacterium bovis
AVLAHPGLPQAVPVTRLWLSKQQTSDLMA

SEQ ID NO: 197276 - protein, 23 aa, Mycobacterium bovis
AVLALASVEAFFGAGAQRQLDGD

SEQ ID NO: 197277 - protein, 22 aa, Mycobacterium bovis
AVLDRNGLRPSRIWVTDDGLVV

SEQ ID NO: 197278 - protein, 18 aa, Mycobacterium bovis
AVLECAGVHDILAKSLGS

SEQ ID NO: 197279 - protein, 20 aa, Mycobacterium bovis
AVLPGYGWIFPLGNGEVNIG

SEQ ID NO: 197280 - protein, 25 aa, Mycobacterium bovis
AVLRALRLETEWPARQLVDDRWVWL

SEQ ID NO: 197281 - protein, 25 aa, Mycobacterium bovis
AVLSRAQLLELVWGYDFAADTNVVD

SEQ ID NO: 197282 - protein, 18 aa, Mycobacterium bovis
AVMLVCPDPAPLLDTVLK

SEQ ID NO: 197283 - protein, 20 aa, Mycobacterium bovis
AVMSCGTLRELLTIAMRYFA

SEQ ID NO: 197284 - protein, 25 aa, Mycobacterium bovis
AVNGPAIGGGLCLALAADIRVASSS

SEQ ID NO: 197285 - protein, 18 aa, Mycobacterium bovis
AVNNLALQALVAAFAADK

SEQ ID NO: 197286 - protein, 18 aa, Mycobacterium bovis
AVNTAAWYVNAAIPTAIF

SEQ ID NO: 197287 - protein, 20 aa, Mycobacterium bovis
AVPDHSFFGLLWADVKFEWH

SEQ ID NO: 197288 - protein, 25 aa, Mycobacterium bovis
AVPLAKACARIMLGATIAQLRAEGL

SEQ ID NO: 197289 - protein, 21 aa, Mycobacterium bovis
AVPRRPVIRPIPVDDSGFTVE

SEQ ID NO: 197290 - protein, 17 aa, Mycobacterium bovis
AVQAALWAVDEAASRDI

SEQ ID NO: 197291 - protein, 17 aa, Mycobacterium bovis
AVQLACRAPSLHNSQPW

SEQ ID NO: 197292 - protein, 18 aa, Mycobacterium bovis
AVQLAVLVDRGHRELPLR

SEQ ID NO: 197293 - protein, 20 aa, Mycobacterium bovis
AVQRLRKERSIGLSEAVNEL

SEQ ID NO: 197294 - protein, 18 aa, Mycobacterium bovis
AVRADKSWVTSAGFADVY

SEQ ID NO: 197295 - protein, 18 aa, Mycobacterium bovis
AVRADWRGQRLVSALLDA

SEQ ID NO: 197296 - protein, 18 aa, Mycobacterium bovis
AVRDGRPTVLQSLTEDPA

SEQ ID NO: 197297 - protein, 23 aa, Mycobacterium bovis
AVRELRPDLVLLDLMLPGMNGID

SEQ ID NO: 197298 - protein, 25 aa, Mycobacterium bovis
AVRGPKLFQGLAFVVSRRRLLGRFV

SEQ ID NO: 197299 - protein, 21 aa, Mycobacterium bovis
AVRGWRTGDIRPERYDRLAQL

SEQ ID NO: 197300 - protein, 19 aa, Mycobacterium bovis
AVRIGDWPAAYAIGEHLSV

SEQ ID NO: 197301 - protein, 18 aa, Mycobacterium bovis
AVRNELNLSVLQRELTRL

SEQ ID NO: 197302 - protein, 25 aa, Mycobacterium bovis
AVRPEPFGALLYHFGTRKLSFLKNR

SEQ ID NO: 197303 - protein, 25 aa, Mycobacterium bovis
AVRTFARRRIDAILADVAPADGPDD

SEQ ID NO: 197304 - protein, 19 aa, Mycobacterium bovis
AVSADWGLDEILLPSTGPA

SEQ ID NO: 197305 - protein, 18 aa, Mycobacterium bovis
AVSELVGFISTPRCIQAM

SEQ ID NO: 197306 - protein, 21 aa, Mycobacterium bovis
AVSFWRAVQTQVWRGHPDPKR

SEQ ID NO: 197307 - protein, 24 aa, Mycobacterium bovis
AVSIELADGLGLPVLSVASMLARP

SEQ ID NO: 197308 - protein, 19 aa, Mycobacterium bovis
AVSLPSYGGSTLWANTAAA

SEQ ID NO: 197309 - protein, 22 aa, Mycobacterium bovis
AVSPEGLPAVPSVLARLDRFEI

SEQ ID NO: 197310 - protein, 21 aa, Mycobacterium bovis
AVSQLFGRYGQEFQTVSNQLA

SEQ ID NO: 197311 - protein, 23 aa, Mycobacterium bovis
AVSRAFIAHSVWQRMGDELLAKA

SEQ ID NO: 197312 - protein, 17 aa, Mycobacterium bovis
AVSSFGLSGTNAHVVVE

SEQ ID NO: 197313 - protein, 18 aa, Mycobacterium bovis
AVSSHYEAPFAFTGGTIT

SEQ ID NO: 197314 - protein, 24 aa, Mycobacterium bovis
AVSSPRVLSDLFWMGRYGERAENM

SEQ ID NO: 197315 - protein, 24 aa, Mycobacterium bovis
AVTAGLAGSSWLGAASTAMTGAAA

SEQ ID NO: 197316 - protein, 18 aa, Mycobacterium bovis
AVTEWFAVDWHREIVDKW

SEQ ID NO: 197317 - protein, 18 aa, Mycobacterium bovis
AVTLWKQWDRCALHWFPG

SEQ ID NO: 197318 - protein, 24 aa, Mycobacterium bovis
AVTNPARWALLYGSPVPGYHAPPD

SEQ ID NO: 197319 - protein, 25 aa, Mycobacterium bovis
AVTPAVGALLCLLAKLSGGKAVAEV

SEQ ID NO: 197320 - protein, 24 aa, Mycobacterium bovis
AVTTRLRFNFFVLKLPIRPPALVA

SEQ ID NO: 197321 - protein, 17 aa, Mycobacterium bovis
AVTVFLAPPSWQDLQAR

SEQ ID NO: 197322 - protein, 18 aa, Mycobacterium bovis
AVTVPELGTFLAECPPIA

SEQ ID NO: 197323 - protein, 22 aa, Mycobacterium bovis
AVVGMAGRFPGAKDVSAFWSNL

SEQ ID NO: 197324 - protein, 18 aa, Mycobacterium bovis
AVVISMRLPQRRHAVNRW

SEQ ID NO: 197325 - protein, 24 aa, Mycobacterium bovis
AVVKQAAAFHSEFTRTLEAAGNAY

SEQ ID NO: 197326 - protein, 17 aa, Mycobacterium bovis
AVVLWEAQFGDFVNGAQ

SEQ ID NO: 197327 - protein, 24 aa, Mycobacterium bovis
AVVMAPMYLGLRVWSRATIGLAYA

SEQ ID NO: 197328 - protein, 27 aa, Mycobacterium bovis
AVVMSFSAAAVWRIRRAAPLLPTVLLG

SEQ ID NO: 197329 - protein, 23 aa, Mycobacterium bovis
AVVPRAHGSALFERGETQILGVT

SEQ ID NO: 197330 - protein, 18 aa, Mycobacterium bovis
AVVQPMLVAANRADLVSL

SEQ ID NO: 197331 - protein, 19 aa, Mycobacterium bovis
AVWQLLCADGDAIDAIGRS

SEQ ID NO: 197332 - protein, 23 aa, Mycobacterium bovis
AVYDFLNTRCLTIAGGTEQILLT

SEQ ID NO: 197333 - protein, 23 aa, Mycobacterium bovis
AVYLADCRKLGITVLPPDVNESG

SEQ ID NO: 197334 - protein, 25 aa, Mycobacterium bovis
AVYRRVSLPDGRYVFTTRVIISARD

SEQ ID NO: 197335 - protein, 18 aa, Mycobacterium bovis
AWAALPRAGAVIFATGGM

SEQ ID NO: 197336 - protein, 34 aa, Mycobacterium bovis
AWAETYPGTLSYYLASAFGEVWMQPSGSVGLVGF

SEQ ID NO: 197337 - protein, 18 aa, Mycobacterium bovis
AWAVLVAYFNRLRCGTGD

SEQ ID NO: 197338 - protein, 37 aa, Mycobacterium bovis
AWDMPDMPGEFFALTVDHLFGRIWTRPGLSMRDRRMA

SEQ ID NO: 197339 - protein, 22 aa, Mycobacterium bovis
AWEARVRKRFAFLTDLDADEQR

SEQ ID NO: 197340 - protein, 18 aa, Mycobacterium bovis
AWEGLTFAEAAERDPELH

SEQ ID NO: 197341 - protein, 23 aa, Mycobacterium bovis
AWEPKTGAVGSLWDVVRDRRLNH

SEQ ID NO: 197342 - protein, 24 aa, Mycobacterium bovis
AWHKICVERAILPGMQELVRRIGD

SEQ ID NO: 197343 - protein, 18 aa, Mycobacterium bovis
AWLAEGLLMYLPAEAQDR

SEQ ID NO: 197344 - protein, 22 aa, Mycobacterium bovis
AWNGRAGDYVAIPPTRHALHAV

SEQ ID NO: 197345 - protein, 27 aa, Mycobacterium bovis
AWRNDQWYTARLCPAPLRPEERQTTVV

SEQ ID NO: 197346 - protein, 24 aa, Mycobacterium bovis
AWRTALDPEGEWMPAVITAADRRL

SEQ ID NO: 197347 - protein, 18 aa, Mycobacterium bovis
AWRTVGAIVARVWADTEK

SEQ ID NO: 197348 - protein, 22 aa, Mycobacterium bovis
AWSEAYIPGAGWIGLDPTSGLL

SEQ ID NO: 197349 - protein, 19 aa, Mycobacterium bovis
AWSGSRFAQRPVLPEDIHR

SEQ ID NO: 197350 - protein, 33 aa, Mycobacterium bovis
AWTLAMGHAMIRAGLRLKKLGTDRSWRPDVVHA

SEQ ID NO: 197351 - protein, 18 aa, Mycobacterium bovis
AWTNARQSYPVRVAHVLS

SEQ ID NO: 197352 - protein, 19 aa, Mycobacterium bovis
AWTTANWEWFDPVHSHRIL

SEQ ID NO: 197353 - protein, 21 aa, Mycobacterium bovis
AWWPECSKEAYADGIAGAVEA

SEQ ID NO: 197354 - protein, 19 aa, Mycobacterium bovis
AYAARAGITCAVLIPQGKI

SEQ ID NO: 197355 - protein, 19 aa, Mycobacterium bovis
AYACSFRITEAVYFVERLV

SEQ ID NO: 197356 - protein, 21 aa, Mycobacterium bovis
AYADMPLFLFHLLEYMDVDYE

SEQ ID NO: 197357 - protein, 23 aa, Mycobacterium bovis
AYAEGLRALYLYAAAHQDDAVAQ

SEQ ID NO: 197358 - protein, 23 aa, Mycobacterium bovis
AYAEGLRALYLYTATFQDAAVAE

SEQ ID NO: 197359 - protein, 18 aa, Mycobacterium bovis
AYAIPGVAVAVWAGGQEY

SEQ ID NO: 197360 - protein, 30 aa, Mycobacterium bovis; identical to SEQ ID NO: 78436

SEQ ID NO: 197361 - protein, 19 aa, Mycobacterium bovis
AYAMEANWALLLLDDDGAG

SEQ ID NO: 197362 - protein, 18 aa, Mycobacterium bovis
AYAVLAQESVRCRRRGVN

SEQ ID NO: 197363 - protein, 17 aa, Mycobacterium bovis
AYCPSKAGTDLLAKTLA

SEQ ID NO: 197364 - protein, 21 aa, Mycobacterium bovis
AYEPFPGMALADTFQISEAGD

SEQ ID NO: 197365 - protein, 20 aa, Mycobacterium bovis
AYETAYRLTVPPPVIAENRT

SEQ ID NO: 197366 - protein, 20 aa, Mycobacterium bovis
AYFNRLRCGTGDYIDFSRFD

SEQ ID NO: 197367 - protein, 18 aa, Mycobacterium bovis
AYGGTFLQFSDYMRPAVR

SEQ ID NO: 197368 - protein, 19 aa, Mycobacterium bovis
AYGPAGFLQYQFVIPTEAV

SEQ ID NO: 197369 - protein, 18 aa, Mycobacterium bovis
AYGVRPGAVIGHSMGESA

SEQ ID NO: 197370 - protein, 23 aa, Mycobacterium bovis
AYGWSSLRSRPALRDQAAGALHG

SEQ ID NO: 197371 - protein, 23 aa, Mycobacterium bovis
AYLQGHLPGAVFVSLEDELSDHT

SEQ ID NO: 197372 - protein, 19 aa, Mycobacterium bovis
AYPPLFVGRFFDMMRIEAL

SEQ ID NO: 197373 - protein, 17 aa, Mycobacterium bovis
AYRADYSARGWAMNSLF

SEQ ID NO: 197374 - protein, 17 aa, Mycobacterium bovis
AYRKLRGLVEPFAAQLG

SEQ ID NO: 197375 - protein, 17 aa, Mycobacterium bovis
AYRSIYVRKRLRCGNRH

SEQ ID NO: 197376 - protein, 18 aa, Mycobacterium bovis
AYSTRLKITPTRVWTTPT

SEQ ID NO: 197377 - protein, 25 aa, Mycobacterium bovis
AYVMDSWLRPVPDGVAGELYLAGAQ

SEQ ID NO: 197378 - protein, 21 aa, Mycobacterium bovis
CAAISAPLRPGSGMPPIGVPV

SEQ ID NO: 197379 - protein, 25 aa, Mycobacterium bovis
CAALSTRWCSMRVQLQGSAGGHIET

SEQ ID NO: 197380 - protein, 20 aa, Mycobacterium bovis
CAASLRVALARVHPRATGIV

SEQ ID NO: 197381 - protein, 19 aa, Mycobacterium bovis
CADGRYVAVGAIEPQFYAA

SEQ ID NO: 197382 - protein, 28 aa, Mycobacterium bovis
CAELLDWPAKLRLLDGFRQRENLSWSAP

SEQ ID NO: 197383 - protein, 20 aa, Mycobacterium bovis
CAGADLSALGAGVGDPAEPR

SEQ ID NO: 197384 - protein, 34 aa, Mycobacterium bovis
CAIDAMSSRCFPSYALRRRAKALGSLTQMELLMI

SEQ ID NO: 197385 - protein, 17 aa, Mycobacterium bovis
CAIIPNPTVEQLADIAI

SEQ ID NO: 197386 - protein, 20 aa, Mycobacterium bovis
CAITAYPDRGFTNAGTFAES

SEQ ID NO: 197387 - protein, 20 aa, Mycobacterium bovis
CALEVTWTQFGMRLAAIGAH

SEQ ID NO: 197388 - protein, 21 aa, Mycobacterium bovis
CALPLHRRFGLAATARASFAV

SEQ ID NO: 197389 - protein, 18 aa, Mycobacterium bovis
CALSESKIAATAHILDTE

SEQ ID NO: 197390 - protein, 19 aa, Mycobacterium bovis
CAMVGCPIVGINDSGGARI

SEQ ID NO: 197391 - protein, 27 aa, Mycobacterium bovis
CANCRGGEYRRCVRHGLADMYGFIPVD

SEQ ID NO: 197392 - protein, 20 aa, Mycobacterium bovis
CAPDHPWAREHRQWFTELPD

SEQ ID NO: 197393 - protein, 19 aa, Mycobacterium bovis
CAPFELSRDAPLRITVVRT

SEQ ID NO: 197394 - protein, 29 aa, Mycobacterium bovis
CAPSRSLPLLECWTALAALSRDTTKLRLG

SEQ ID NO: 197395 - protein, 19 aa, Mycobacterium bovis
CARSRILVQRSVYDRFMEL

SEQ ID NO: 197396 - protein, 21 aa, Mycobacterium bovis
CARVLRGSGLLMVSTPNRITF

SEQ ID NO: 197397 - protein, 25 aa, Mycobacterium bovis
CATMPTPFLAVGESFWDFRQVTDEE

SEQ ID NO: 197398 - protein, 18 aa, Mycobacterium bovis
CAVDGAIHVMTTVLATLP

SEQ ID NO: 197399 - protein, 19 aa, Mycobacterium bovis
CAVEGIPVKVALINNGNLG

SEQ ID NO: 197400 - protein, 24 aa, Mycobacterium bovis
CCAPDDVLPAIAFAVAHTGKPVIV

SEQ ID NO: 197401 - protein, 17 aa, Mycobacterium bovis
CDAEFERMRVEALEVLD

SEQ ID NO: 197402 - protein, 25 aa, Mycobacterium bovis
CDFWFPPIELPVGFGQTRTAKQLPV

SEQ ID NO: 197403 - protein, 25 aa, Mycobacterium bovis
CDGPRFRWVNGMRVSFENGFPDSTL

SEQ ID NO: 197404 - protein, 18 aa, Mycobacterium bovis
CDGTSALRYRELVAEVGG

SEQ ID NO: 197405 - protein, 32 aa, Mycobacterium bovis
CDGVVIGRGCLGRPWLFAELSAAFTGSPAPTP

SEQ ID NO: 197406 - protein, 20 aa, Mycobacterium bovis
CDLGRQIGYLLASQEPALAE

SEQ ID NO: 197407 - protein, 22 aa, Mycobacterium bovis
CDPELLTLWISRRVNTEALPGR

SEQ ID NO: 197408 - protein, 24 aa, Mycobacterium bovis
CDQLMPEYLRFVKGVVDAQDMSLN

SEQ ID NO: 197409 - protein, 25 aa, Mycobacterium bovis
CDRPIADVCPVEWARMANRSVLQWD

SEQ ID NO: 197410 - protein, 18 aa, Mycobacterium bovis
CDRRKGLGADGVLRVTTA

SEQ ID NO: 197411 - protein, 17 aa, Mycobacterium bovis
CDVCEALQVMVERTRAV

SEQ ID NO: 197412 - protein, 27 aa, Mycobacterium bovis
CEDIGVDIAFTWDHFFPLYGDPDGPHF

SEQ ID NO: 197413 - protein, 18 aa, Mycobacterium bovis
CEGPEPGDSLTLRYAGAR

SEQ ID NO: 197414 - protein, 27 aa, Mycobacterium bovis
CESLYHFAWDEFCDWYLELAKTQLAQG

SEQ ID NO: 197415 - protein, 21 aa, Mycobacterium bovis
CETRSAWSFNRYAHLHTERHE

SEQ ID NO: 197416 - protein, 20 aa, Mycobacterium bovis
CEVVRRLKAAGAVIVGKTNT

SEQ ID NO: 197417 - protein, 19 aa, Mycobacterium bovis
CFSNAMPPDEEWPRSTVSE

SEQ ID NO: 197418 - protein, 19 aa, Mycobacterium bovis
CFTGAPLTHDLCVHGNPVV

SEQ ID NO: 197419 - protein, 28 aa, Mycobacterium bovis
CFVVCSEILPRWGVQTVFVDGDDLSQWE

SEQ ID NO: 197420 - protein, 17 aa, Mycobacterium bovis
CGAGGGASYIARNLGPA

SEQ ID NO: 197421 - protein, 26 aa, Mycobacterium bovis
CGALSEWRATLIVRESACLDVADRRA

SEQ ID NO: 197422 - protein, 21 aa, Mycobacterium bovis
CGAVLDHFRVAMAAAGTTANV

SEQ ID NO: 197423 - protein, 33 aa, Mycobacterium bovis
CGFDTPYPPARLEKLWLPGPDRLLDCVERVLRQ

SEQ ID NO: 197424 - protein, 17 aa, Mycobacterium bovis
CGHLASRYGVPMRVITF

SEQ ID NO: 197425 - protein, 23 aa, Mycobacterium bovis
CGIKASMGMGAIRVQPLAPREKC

SEQ ID NO: 197426 - protein, 20 aa, Mycobacterium bovis
CGLAGLAVDTDLRWRIVTAL

SEQ ID NO: 197427 - protein, 19 aa, Mycobacterium bovis
CGLAPSSIYWHFGSKEGVL

SEQ ID NO: 197428 - protein, 20 aa, Mycobacterium bovis
CGLGHRKGRIAPGYDADLLA

SEQ ID NO: 197429 - protein, 18 aa, Mycobacterium bovis
CGLIDRIGFRDQAYARMA

SEQ ID NO: 197430 - protein, 35 aa, Mycobacterium bovis
CGNGLRPEIWDEFTTRFGVARVCEFYAASEGNSAF

SEQ ID NO: 197431 - protein, 25 aa, Mycobacterium bovis
CGTIRVGSFRGRWLDPRHAGPATAA

SEQ ID NO: 197432 - protein, 26 aa, Mycobacterium bovis
CGVEPNMRWRTFCDELLAVIDKLNVD

SEQ ID NO: 197433 - protein, 17 aa, Mycobacterium bovis
CGVLPDLTVGHSLGEVA

SEQ ID NO: 197434 - protein, 19 aa, Mycobacterium bovis
CHDGYRWLRLLGYEPEQIV

SEQ ID NO: 197435 - protein, 25 aa, Mycobacterium bovis
CHGLQCGFCTPGMLITARALLDRNP

SEQ ID NO: 197436 - protein, 20 aa, Mycobacterium bovis
CIAAKRFIVHADIYDDFVDK

SEQ ID NO: 197437 - protein, 23 aa, Mycobacterium bovis
CIDSDGWVTYRCRADDTEVIGGV

SEQ ID NO: 197438 - protein, 19 aa, Mycobacterium bovis
CKLPEAIAAVSHERIALLV

SEQ ID NO: 197439 - protein, 17 aa, Mycobacterium bovis
CKSNVLYKGALQGDPAS

SEQ ID NO: 197440 - protein, 25 aa, Mycobacterium bovis
CLAEAGWPVRVWAAALPQQTTSAVA

SEQ ID NO: 197441 - protein, 19 aa, Mycobacterium bovis
CLDAGVKVGCFRPPTVPAG

SEQ ID NO: 197442 - protein, 23 aa, Mycobacterium bovis
CLGSGRWPGRLLGSVSSGLLRHA

SEQ ID NO: 197443 - protein, 24 aa, Mycobacterium bovis
CLHDPCLPVDLTVRGHPRDLYRVY

SEQ ID NO: 197444 - protein, 21 aa, Mycobacterium bovis
CLPESDFPTLIDLYLQGRLPL

SEQ ID NO: 197445 - protein, 18 aa, Mycobacterium bovis
CLTLDYDTMRGMDSGEYR

SEQ ID NO: 197446 - protein, 18 aa, Mycobacterium bovis
CLTQRQVLDQAPDAVDGR

SEQ ID NO: 197447 - protein, 19 aa, Mycobacterium bovis
CLTRTLSCRIFRRRRELPV

SEQ ID NO: 197448 - protein, 18 aa, Mycobacterium bovis
CNAMSRLGGVTLSKAGLR

SEQ ID NO: 197449 - protein, 18 aa, Mycobacterium bovis
CNEFSEWQSAGLGHDALL

SEQ ID NO: 197450 - protein, 22 aa, Mycobacterium bovis
CPASAYSRMCLTTFFTSLTQRF

SEQ ID NO: 197451 - protein, 17 aa, Mycobacterium bovis
CPDLDTCMYTLGGGVDP

SEQ ID NO: 197452 - protein, 19 aa, Mycobacterium bovis
CPDQFLGAHVRRVTGRKNL

SEQ ID NO: 197453 - protein, 19 aa, Mycobacterium bovis
CPFIPGRVPEDLLAMVVAV

SEQ ID NO: 197454 - protein, 29 aa, Mycobacterium bovis
CPGVVRTRLAEALWKDHEDPLAATIALGR

SEQ ID NO: 197455 - protein, 19 aa, Mycobacterium bovis
CPPAGTGTHHYRFTLYHLP

SEQ ID NO: 197456 - protein, 24 aa, Mycobacterium bovis
CPTYKRIRILGGHRLGMMMRIAVR

SEQ ID NO: 197457 - protein, 20 aa, Mycobacterium bovis
CPVVMPAKLFDEWFPANKLV

SEQ ID NO: 197458 - protein, 19 aa, Mycobacterium bovis
CPYCGSPYSFLPQLNPGDI

SEQ ID NO: 197459 - protein, 27 aa, Mycobacterium bovis
CQDFARLAIACLRANGLAACYVSGYLA

SEQ ID NO: 197460 - protein, 27 aa, Mycobacterium bovis
CQEVLKQAAAFHGEFTRALAAAGAAYA

SEQ ID NO: 197461 - protein, 18 aa, Mycobacterium bovis
CQGFITQLGRNFQVIYEQ

SEQ ID NO: 197462 - protein, 22 aa, Mycobacterium bovis
CQLDRIGARLAEPLRIALAGTL

SEQ ID NO: 197463 - protein, 25 aa, Mycobacterium bovis
CQQAGIYGKLAWEKTIPNWFFEPDI

SEQ ID NO: 197464 - protein, 19 aa, Mycobacterium bovis
CQRAIGITLARMMSRRQFG

SEQ ID NO: 197465 - protein, 17 aa, Mycobacterium bovis
CQSILGYVVRWVDQGVG

SEQ ID NO: 197466 - protein, 21 aa, Mycobacterium bovis
CQTFRRNRRWALLENAPVMNE

SEQ ID NO: 197467 - protein, 26 aa, Mycobacterium bovis
CQVAAMALRIGVAVAHRDRDYEAIRT

SEQ ID NO: 197468 - protein, 19 aa, Mycobacterium bovis
CQVQRELAHVAGLHHRSVK

SEQ ID NO: 197469 - protein, 18 aa, Mycobacterium bovis
CRAAFQALELMVVVDVAM

SEQ ID NO: 197470 - protein, 17 aa, Mycobacterium bovis
CRAGALLLRGSPCAIGW

SEQ ID NO: 197471 - protein, 22 aa, Mycobacterium bovis
CRAKHRLPGLQFVQGDAQNLPF

SEQ ID NO: 197472 - protein, 18 aa, Mycobacterium bovis
CRAPSLHNSQPWRWIAED

SEQ ID NO: 197473 - protein, 27 aa, Mycobacterium bovis
CRASLDRLGLDYVDLYLIHWPAPPVGK

SEQ ID NO: 197474 - protein, 18 aa, Mycobacterium bovis
CRDERGGSVAVEIKRRGE

SEQ ID NO: 197475 - protein, 26 aa, Mycobacterium bovis
CREGHCGACACTLRAGKVNMGVNDVL

SEQ ID NO: 197476 - protein, 18 aa, Mycobacterium bovis
CRGLARVDFFLTDDGPVI

SEQ ID NO: 197477 - protein, 17 aa, Mycobacterium bovis
CRHCPVMQECAADALDN

SEQ ID NO: 197478 - protein, 17 aa, Mycobacterium bovis
CRIGERSSHTWFVLTHL

SEQ ID NO: 197479 - protein, 18 aa, Mycobacterium bovis
CRITTRCAPRGCPLHSPR

SEQ ID NO: 197480 - protein, 18 aa, Mycobacterium bovis
CRLDCRRRGPAVPQRDPP

SEQ ID NO: 197481 - protein, 32 aa, Mycobacterium bovis
CRLDRLAGELSVWSRAAVQIAFALRAGANRYA

SEQ ID NO: 197482 - protein, 19 aa, Mycobacterium bovis
CRLIRRHGRVMVICSDPRH

SEQ ID NO: 197483 - protein, 17 aa, Mycobacterium bovis
CRPGWVHTADGRILSGG

SEQ ID NO: 197484 - protein, 18 aa, Mycobacterium bovis
CRPPHCVASVSPARPSAG

SEQ ID NO: 197485 - protein, 19 aa, Mycobacterium bovis
CRQIMLYHLDRGWADHLAY

SEQ ID NO: 197486 - protein, 18 aa, Mycobacterium bovis
CRQVPVHHSFAYRSYSWY

SEQ ID NO: 197487 - protein, 17 aa, Mycobacterium bovis
CRRQHTFSSTLTVESPQ

SEQ ID NO: 197488 - protein, 21 aa, Mycobacterium bovis
CRRSVPHLQRLLAHLESSLKD

SEQ ID NO: 197489 - protein, 27 aa, Mycobacterium bovis
CRSRARLLGLRLRRLRYLRTAAARRPQ

SEQ ID NO: 197490 - protein, 19 aa, Mycobacterium bovis
CSAMARSYLGPEFDIHCGG

SEQ ID NO: 197491 - protein, 25 aa, Mycobacterium bovis
CSAPGCDVPGYYCEVHHVTPYAQCR

SEQ ID NO: 197492 - protein, 19 aa, Mycobacterium bovis
CSFRAFSVHMRELRQVGVI

SEQ ID NO: 197493 - protein, 20 aa, Mycobacterium bovis
CSHNAHMYYVLLAPSADREE

SEQ ID NO: 197494 - protein, 17 aa, Mycobacterium bovis
CSLQRRYQKLVEEAPAP

SEQ ID NO: 197495 - protein, 23 aa, Mycobacterium bovis
CSPDSFRSLRCVVSAGEALELGL

SEQ ID NO: 197496 - protein, 19 aa, Mycobacterium bovis
CSRKHGWEGVIAKRRDSRY

SEQ ID NO: 197497 - protein, 22 aa, Mycobacterium bovis
CSSGLTAIHLACRSLHDGESDI

SEQ ID NO: 197498 - protein, 19 aa, Mycobacterium bovis
CSWRRWWPDLRLQVTEDRA

SEQ ID NO: 197499 - protein, 24 aa, Mycobacterium bovis
CSYLNKLLWILTGNFAKKGGQHLH

SEQ ID NO: 197500 - protein, 21 aa, Mycobacterium bovis
CTAAARAVSWPAVTSPAGPVT

SEQ ID NO: 197501 - protein, 19 aa, Mycobacterium bovis
CTAGHPPPLLVTADASARY

SEQ ID NO: 197502 - protein, 17 aa, Mycobacterium bovis
CTGSRPALPDLPGITEA

SEQ ID NO: 197503 - protein, 20 aa, Mycobacterium bovis
CTLPLTGVGCVDRIVTELAV

SEQ ID NO: 197504 - protein, 17 aa, Mycobacterium bovis
CTNRASYVVHLHAVDEC

SEQ ID NO: 197505 - protein, 17 aa, Mycobacterium bovis
CTVGRTLKSGTTVNLEV

SEQ ID NO: 197506 - protein, 17 aa, Mycobacterium bovis
CTYHVAHPGGRAYDEPP

SEQ ID NO: 197507 - protein, 18 aa, Mycobacterium bovis
CTYREGLSAVRVAGGVAG

SEQ ID NO: 197508 - protein, 18 aa, Mycobacterium bovis
CVDLRRTFVPSKGFGLLP

SEQ ID NO: 197509 - protein, 20 aa, Mycobacterium bovis
CVEFAAARPGMLGLQTALSV

SEQ ID NO: 197510 - protein, 24 aa, Mycobacterium bovis
CVGAGIPAVTFWAAVPHYVSHPPN

SEQ ID NO: 197511 - protein, 25 aa, Mycobacterium bovis
CVGMQILFACGVEFGVQTPGCGHWP

SEQ ID NO: 197512 - protein, 17 aa, Mycobacterium bovis
CVGSDWCRYGQQDSVQL

SEQ ID NO: 197513 - protein, 19 aa, Mycobacterium bovis
CVGSLDFTSGEFQYCTAGH

SEQ ID NO: 197514 - protein, 25 aa, Mycobacterium bovis
CVLERFRAIKPWLVGGRVHAPFWEV

SEQ ID NO: 197515 - protein, 25 aa, Mycobacterium bovis
CVNQTRILAPRSRYDEIVAAVTNFV

SEQ ID NO: 197516 - protein, 23 aa, Mycobacterium bovis
CVSCPIRRQCLAAALQRAEPWGV

SEQ ID NO: 197517 - protein, 20 aa, Mycobacterium bovis
CVSHQLPVWTLRLYLTGKRL

SEQ ID NO: 197518 - protein, 18 aa, Mycobacterium bovis
CVTACPVSAIAPNTRLDF

SEQ ID NO: 197519 - protein, 21 aa, Mycobacterium bovis
CVTSVKWARLDSAPFTDRLVR

SEQ ID NO: 197520 - protein, 18 aa, Mycobacterium bovis
CWRTFLTCDANLAVTLPP

SEQ ID NO: 197521 - protein, 22 aa, Mycobacterium bovis
CYEEAHRACLIIGRRDAVVHDV

SEQ ID NO: 197522 - protein, 19 aa, Mycobacterium bovis
CYGAAGVAMGTRFLLTSDS

SEQ ID NO: 197523 - protein, 17 aa, Mycobacterium bovis
DAAAIPEAHWRLGDACE

SEQ ID NO: 197524 - protein, 17 aa, Mycobacterium bovis
DAAGIEWAATSALSASL

SEQ ID NO: 197525 - protein, 17 aa, Mycobacterium bovis
DAAIAWGGANGAFELNV

SEQ ID NO: 197526 - protein, 20 aa, Mycobacterium bovis
DAALRVLAPLGLVFDENSPW

SEQ ID NO: 197527 - protein, 22 aa, Mycobacterium bovis
DAAQWLATHGWQVHSVSNREEM

SEQ ID NO: 197528 - protein, 23 aa, Mycobacterium bovis
DAARGRMGAVRFGIYQAGCNSSL

SEQ ID NO: 197529 - protein, 20 aa, Mycobacterium bovis
DAARPWLTRLCDERTVVAVL

SEQ ID NO: 197530 - protein, 26 aa, Mycobacterium bovis
DAARRVGGTDVVVWLGTLSTLSRTAF

SEQ ID NO: 197531 - protein, 19 aa, Mycobacterium bovis
DAARSFVAAPGRAMTSAGL

SEQ ID NO: 197532 - protein, 17 aa, Mycobacterium bovis
DAARVSAAVADRCSWRR

SEQ ID NO: 197533 - protein, 25 aa, Mycobacterium bovis
DAASARGSLRLSLGHTSVEADVDAA

SEQ ID NO: 197534 - protein, 22 aa, Mycobacterium bovis
DAAVALGRRVSFVGRSMVRNMR

SEQ ID NO: 197535 - protein, 18 aa, Mycobacterium bovis
DAAVHFVQRHCETGNSVV

SEQ ID NO: 197536 - protein, 28 aa, Mycobacterium bovis
DAAVLPSHYEPFGLVALEAAAAGTPLVT

SEQ ID NO: 197537 - protein, 26 aa, Mycobacterium bovis
DADCAQLRAAASVLMEALRMERSQVA

SEQ ID NO: 197538 - protein, 24 aa, Mycobacterium bovis
DADVIRYLRWFTFLSADELAELEQ

SEQ ID NO: 197539 - protein, 24 aa, Mycobacterium bovis
DAEGLLPAITFVFSRAGCDAAVTQ

SEQ ID NO: 197540 - protein, 24 aa, Mycobacterium bovis
DAEGSALLREFVGMTLNLPTPEEA

SEQ ID NO: 197541 - protein, 23 aa, Mycobacterium bovis
DAEKYRRLHVIVGDSNMSETTTM

SEQ ID NO: 197542 - protein, 25 aa, Mycobacterium bovis
DAELRRRRWSLCPAKRDNSVSAGQR

SEQ ID NO: 197543 - protein, 22 aa, Mycobacterium bovis
DAERRKALEAGYDLNQVLTTED

SEQ ID NO: 197544 - protein, 20 aa, Mycobacterium bovis
DAEVAALGRFASAYTESLEN

SEQ ID NO: 197545 - protein, 17 aa, Mycobacterium bovis
DAEYLFDQFVELMAGEG

SEQ ID NO: 197546 - protein, 20 aa, Mycobacterium bovis
DAFADFLAGFHIIDRHFATA

SEQ ID NO: 197547 - protein, 22 aa, Mycobacterium bovis
DAFGDKVLPLYLPSGDGLIGLL

SEQ ID NO: 197548 - protein, 17 aa, Mycobacterium bovis
DAFVYPETMPAWFTEAD

SEQ ID NO: 197549 - protein, 25 aa, Mycobacterium bovis
DAGADYRPACDVMLALVAQLDPGQR

SEQ ID NO: 197550 - protein, 19 aa, Mycobacterium bovis
DAGDCAVLARALVACGCGS

SEQ ID NO: 197551 - protein, 19 aa, Mycobacterium bovis
DAGERWPDAQIVSMRDVAA

SEQ ID NO: 197552 - protein, 22 aa, Mycobacterium bovis
DAGLHWFRAALDARPADESIID

SEQ ID NO: 197553 - protein, 21 aa, Mycobacterium bovis
DAGLLSGAVTMVWQREKLLQV

SEQ ID NO: 197554 - protein, 22 aa, Mycobacterium bovis
DAGPPTMAARCARNLAEGLLLT

SEQ ID NO: 197555 - protein, 20 aa, Mycobacterium bovis
DAGVLAALLLNRISLAPGEA

SEQ ID NO: 197556 - protein, 17 aa, Mycobacterium bovis
DAGVPARRRGRGVASEV

SEQ ID NO: 197557 - protein, 27 aa, Mycobacterium bovis
DAHGFAAFYRRCRLVTARLWPTLIEPL

SEQ ID NO: 197558 - protein, 24 aa, Mycobacterium bovis
DAHTWLRDHGVSLDAPARPRPVTA

SEQ ID NO: 197559 - protein, 24 aa, Mycobacterium bovis
DAIDFRAAAGIYRAARRAGETVRS

SEQ ID NO: 197560 - protein, 21 aa, Mycobacterium bovis
DAIEDLHIWTAESVRADRLDF

SEQ ID NO: 197561 - protein, 26 aa, Mycobacterium bovis
DAIPCSAPLPAPRVSPYPAVFQDVSL

SEQ ID NO: 197562 - protein, 26 aa, Mycobacterium bovis
DAKAFARLGIRCFGFSPLRLPPDLDF

SEQ ID NO: 197563 - protein, 31 aa, Mycobacterium bovis; identical to SEQ ID NO: 87302

SEQ ID NO: 197564 - protein, 24 aa, Mycobacterium bovis
DAKREMLSRLGVEYVGDSRSVDFA

SEQ ID NO: 197565 - protein, 26 aa, Mycobacterium bovis
DAKRLVDFAAGLAFALRGSFDKVATK

SEQ ID NO: 197566 - protein, 20 aa, Mycobacterium bovis
DAKRMFACFDQPDLKATFDV

SEQ ID NO: 197567 - protein, 24 aa, Mycobacterium bovis
DALAADVRRADCQIVVTDADHRAL

SEQ ID NO: 197568 - protein, 19 aa, Mycobacterium bovis
DALCAHLATMHPSRYLTLI

SEQ ID NO: 197569 - protein, 17 aa, Mycobacterium bovis
DALDRMREQAARIGRAT

SEQ ID NO: 197570 - protein, 18 aa, Mycobacterium bovis
DALFARARARGITPAMTL

SEQ ID NO: 197571 - protein, 18 aa, Mycobacterium bovis
DALIGPDVTREWVSDLPS

SEQ ID NO: 197572 - protein, 25 aa, Mycobacterium bovis
DALINRVVPIPGLRSTEAQWARTLA

SEQ ID NO: 197573 - protein, 17 aa, Mycobacterium bovis
DALLRYQTLSARDALHI

SEQ ID NO: 197574 - protein, 31 aa, Mycobacterium bovis
DALLTRGRYQYRPEPPFVLGAEIAGVVRSAP

SEQ ID NO: 197575 - protein, 19 aa, Mycobacterium bovis
DALPRNALGKVLKKQLLSE

SEQ ID NO: 197576 - protein, 17 aa, Mycobacterium bovis
DALRGYASITVVERSIA

SEQ ID NO: 197577 - protein, 25 aa, Mycobacterium bovis
DALSTARFEFRWNDQFALSLDPDTA

SEQ ID NO: 197578 - protein, 21 aa, Mycobacterium bovis
DAMAGAELMLGMRRFAPSSST

SEQ ID NO: 197579 - protein, 28 aa, Mycobacterium bovis
DAMAREVRRGGLPLQRLVNGESMAAVAR

SEQ ID NO: 197580 - protein, 24 aa, Mycobacterium bovis
DAMGHPRWWFDLLTTEPLAFASLD

SEQ ID NO: 197581 - protein, 17 aa, Mycobacterium bovis
DAMMTDGRWDPGKDFAM

SEQ ID NO: 197582 - protein, 19 aa, Mycobacterium bovis
DAMTQGWFTGLIPITVPIA

SEQ ID NO: 197583 - protein, 20 aa, Mycobacterium bovis
DAPCCVQIVPVAPLAFSSQI

SEQ ID NO: 197584 - protein, 20 aa, Mycobacterium bovis
DAPLNWCNPSGRALGAPPTT

SEQ ID NO: 197585 - protein, 20 aa, Mycobacterium bovis
DAPLPAWSHRFLFYDREGVD

SEQ ID NO: 197586 - protein, 17 aa, Mycobacterium bovis
DAPQLAPAVAWVKKRAG

SEQ ID NO: 197587 - protein, 24 aa, Mycobacterium bovis
DAPVIRMLLRVCREQGLELAASLR

SEQ ID NO: 197588 - protein, 19 aa, Mycobacterium bovis
DAPVLRRAQTRFANAPIRW

SEQ ID NO: 197589 - protein, 17 aa, Mycobacterium bovis
DAPVPGTGAGVFTGIAG

SEQ ID NO: 197590 - protein, 18 aa, Mycobacterium bovis
DAPWKDIEAQGWIAPAEC

SEQ ID NO: 197591 - protein, 24 aa, Mycobacterium bovis
DAQAWAAEIARLAPLAIQHAKRVL

SEQ ID NO: 197592 - protein, 19 aa, Mycobacterium bovis
DAQRRVHRVWADIRNEVLG

SEQ ID NO: 197593 - protein, 26 aa, Mycobacterium bovis
DARAYRLNWPAGTVVYEIDQPSVLEY

SEQ ID NO: 197594 - protein, 26 aa, Mycobacterium bovis
DARGTIEWSETCYRYTGAHRDALSGE

SEQ ID NO: 197595 - protein, 27 aa, Mycobacterium bovis
DARTAEFVFRPGPVFTNLLLADEINRT

SEQ ID NO: 197596 - protein, 43 aa, Mycobacterium bovis
DASDLSNILLLGPVGDLFPILSIPGAMSQNFTNVVMTVTDTTI

SEQ ID NO: 197597 - protein, 19 aa, Mycobacterium bovis
DASERTLRLLVPADGVPRV

SEQ ID NO: 197598 - protein, 17 aa, Mycobacterium bovis
DASKHGPLTGGDGGVGG

SEQ ID NO: 197599 - protein, 20 aa, Mycobacterium bovis
DASPAYLGFNLFQHAIARAV

SEQ ID NO: 197600 - protein, 30 aa, Mycobacterium bovis
DASRASATLIWRRPRWARRLQPAPIADLLT

SEQ ID NO: 197601 - protein, 23 aa, Mycobacterium bovis
DATKRYGDFVALDHVDFVVPTGS

SEQ ID NO: 197602 - protein, 22 aa, Mycobacterium bovis
DATQIHGGYGFMNEYPVARHYR

SEQ ID NO: 197603 - protein, 24 aa, Mycobacterium bovis
DATVEVAIRLGVDPRKADQMVRGT

SEQ ID NO: 197604 - protein, 17 aa, Mycobacterium bovis
DAVAAFVESGRTVVLGL

SEQ ID NO: 197605 - protein, 25 aa, Mycobacterium bovis
DAVAEMTVALLLAVARHLIPADADV

SEQ ID NO: 197606 - protein, 18 aa, Mycobacterium bovis
DAVALRQALADGIIDCVA

SEQ ID NO: 197607 - protein, 27 aa, Mycobacterium bovis
DAVDLWGADGAEGWTADPIIGVGSAAT

SEQ ID NO: 197608 - protein, 24 aa, Mycobacterium bovis
DAVLPEKPELILLDNFAVWQTQTA

SEQ ID NO: 197609 - protein, 24 aa, Mycobacterium bovis
DAVLPLRWTDGGMSRVRVLRGAPS

SEQ ID NO: 197610 - protein, 20 aa, Mycobacterium bovis
DAVLYTRAGPEIGVASTKTF

SEQ ID NO: 197611 - protein, 24 aa, Mycobacterium bovis
DAVRATREFLVWAVNDAIERGELA

SEQ ID NO: 197612 - protein, 26 aa, Mycobacterium bovis
DAVSDFPADRGWDVYGLFDPDPDACG

SEQ ID NO: 197613 - protein, 23 aa, Mycobacterium bovis
DAVTGMAGLLAWSQAPTRALGRF

SEQ ID NO: 197614 - protein, 19 aa, Mycobacterium bovis
DAVVCAYVALYAQRRPADV

SEQ ID NO: 197615 - protein, 21 aa, Mycobacterium bovis
DAWEDFLFWLAADRKTARRIT

SEQ ID NO: 197616 - protein, 17 aa, Mycobacterium bovis
DAWLGRIACGDRDLASL

SEQ ID NO: 197617 - protein, 19 aa, Mycobacterium bovis
DAYFARFGGVRDYLRAVVE

SEQ ID NO: 197618 - protein, 20 aa, Mycobacterium bovis
DAYGRYMIRVKEMWESMKIV

SEQ ID NO: 197619 - protein, 17 aa, Mycobacterium bovis
DAYRFLPTLGEVDLHLF

SEQ ID NO: 197620 - protein, 30 aa, Mycobacterium bovis
DCEVCGYHCWAEFFVAGLGWLPADASCATK

SEQ ID NO: 197621 - protein, 19 aa, Mycobacterium bovis
DCGACKPACRVEAIYWEGD

SEQ ID NO: 197622 - protein, 25 aa, Mycobacterium bovis
DCGADFRLTDAAVWERFYGSSHAGS

SEQ ID NO: 197623 - protein, 26 aa, Mycobacterium bovis
DCGAELLVEIARFWVGLAKLDDSRGR

SEQ ID NO: 197624 - protein, 17 aa, Mycobacterium bovis
DCRAAGVQWALVASPAV

SEQ ID NO: 197625 - protein, 27 aa, Mycobacterium bovis
DCRTPTIAAVQGWCIGGAVDLISAVDI

SEQ ID NO: 197626 - protein, 33 aa, Mycobacterium bovis
DDALKQLFGYLVWRDTKAAILLFIRNKDVTAVI

SEQ ID NO: 197627 - protein, 21 aa, Mycobacterium bovis
DDALMKITHVLRGEDLLPSTP

SEQ ID NO: 197628 - protein, 17 aa, Mycobacterium bovis
DDARPVLERASARETAA

SEQ ID NO: 197629 - protein, 18 aa, Mycobacterium bovis
DDAVALYVKAMTRLPQLT

SEQ ID NO: 197630 - protein, 18 aa, Mycobacterium bovis
DDCVFDYEAQLLAAPELD

SEQ ID NO: 197631 - protein, 25 aa, Mycobacterium bovis
DDDAARMWARLRIHLAESGRRVRIN

SEQ ID NO: 197632 - protein, 43 aa, Mycobacterium bovis
DDELAGSAHFVWVRDTLRLGGKFPLKAGMLTSLGFGHVSGLVA

SEQ ID NO: 197633 - protein, 23 aa, Mycobacterium bovis
DDEQRKRLLAGLLTGARIGTIAV

SEQ ID NO: 197634 - protein, 22 aa, Mycobacterium bovis
DDEWPVLAFAAFSGAGARARPC

SEQ ID NO: 197635 - protein, 24 aa, Mycobacterium bovis
DDEYRRIRQILGRRPTDTELAMYS

SEQ ID NO: 197636 - protein, 19 aa, Mycobacterium bovis
DDGDIGLIIAVKRLAAAKT

SEQ ID NO: 197637 - protein, 19 aa, Mycobacterium bovis
DDGFTEMRGKLDGAAAGQQ

SEQ ID NO: 197638 - protein, 24 aa, Mycobacterium bovis
DDGFVRVIYRWSRTGDLAAALAAA

SEQ ID NO: 197639 - protein, 23 aa, Mycobacterium bovis
DDGIGLDEFVDWLNSPTSGSGCT

SEQ ID NO: 197640 - protein, 24 aa, Mycobacterium bovis
DDGIGLDEYVDWLIEAGYPIRRID

SEQ ID NO: 197641 - protein, 17 aa, Mycobacterium bovis
DDGLPVIRVPAGTPPIT

SEQ ID NO: 197642 - protein, 26 aa, Mycobacterium bovis
DDGRITLWRDYFDVYDMFKGLLRGLV

SEQ ID NO: 197643 - protein, 22 aa, Mycobacterium bovis
DDGRVCGLVAIELATGRIETIL

SEQ ID NO: 197644 - protein, 26 aa, Mycobacterium bovis
DDGTRIPVSIVHRADIEFPAPALIYG

SEQ ID NO: 197645 - protein, 23 aa, Mycobacterium bovis
DDIAQRGWPVFCVSTATRENLQP

SEQ ID NO: 197646 - protein, 19 aa, Mycobacterium bovis
DDKNIRIAPSFPSVPDLRN

SEQ ID NO: 197647 - protein, 20 aa, Mycobacterium bovis
DDKPWFAIGGINAQRLPAVL

SEQ ID NO: 197648 - protein, 17 aa, Mycobacterium bovis
DDLLLPIVKGVGSERAY

SEQ ID NO: 197649 - protein, 19 aa, Mycobacterium bovis
DDLQAVIAMLKKADLDVAL

SEQ ID NO: 197650 - protein, 25 aa, Mycobacterium bovis
DDLVEAIGVDAARYSLIRSSVDTAI

SEQ ID NO: 197651 - protein, 21 aa, Mycobacterium bovis
DDMPEDLKPVLCRQMEVYAGF

SEQ ID NO: 197652 - protein, 23 aa, Mycobacterium bovis
DDMSVGQLVKWARESIGRTEKID

SEQ ID NO: 197653 - protein, 32 aa, Mycobacterium bovis
DDPDILALRARQMRNMWATLMVSQGTPMIAHG

SEQ ID NO: 197654 - protein, 27 aa, Mycobacterium bovis
DDPLAMYLFDLCTLPLNLAGHCGMSVP

SEQ ID NO: 197655 - protein, 26 aa, Mycobacterium bovis
DDPNWFRFHQMFADFLHRRLERGGSH

SEQ ID NO: 197656 - protein, 19 aa, Mycobacterium bovis
DDPRSWIAQPMMELSTVPT

SEQ ID NO: 197657 - protein, 19 aa, Mycobacterium bovis
DDQKWVWGGAGVIEPDYTR

SEQ ID NO: 197658 - protein, 20 aa, Mycobacterium bovis
DDRFRLLTGGARSTVQRQQT

SEQ ID NO: 197659 - protein, 21 aa, Mycobacterium bovis
DDRKVAFKRSYRDVDVLLVDD

SEQ ID NO: 197660 - protein, 25 aa, Mycobacterium bovis
DDRLCLRFSSRLGITVASVDYRLAP

SEQ ID NO: 197661 - protein, 18 aa, Mycobacterium bovis
DDRRPLGTLRCWRHSDIG

SEQ ID NO: 197662 - protein, 27 aa, Mycobacterium bovis
DDRVVTKCFLLWAGVVGAISLEVFGQY

SEQ ID NO: 197663 - protein, 24 aa, Mycobacterium bovis
DDSPAAQVAVRWAARDAELRKIPL

SEQ ID NO: 197664 - protein, 20 aa, Mycobacterium bovis
DDSRLRWLRAGEVPTLGNWF

SEQ ID NO: 197665 - protein, 18 aa, Mycobacterium bovis
DDTHLRAIAQLNFANARR

SEQ ID NO: 197666 - protein, 20 aa, Mycobacterium bovis
DDTKLDWARTFGATHTVNAR

SEQ ID NO: 197667 - protein, 19 aa, Mycobacterium bovis
DDTLPMLTGIRVEILGETV

SEQ ID NO: 197668 - protein, 25 aa, Mycobacterium bovis
DDVIAWRGERRFVERLSRATIDVSK

SEQ ID NO: 197669 - protein, 19 aa, Mycobacterium bovis
DDVPGFGLVMFGAIREAST

SEQ ID NO: 197670 - protein, 19 aa, Mycobacterium bovis
DDVSAHPASIGFPPYHPPM

SEQ ID NO: 197671 - protein, 19 aa, Mycobacterium bovis
DDVTVRFLLTAGAIGSLFK

SEQ ID NO: 197672 - protein, 20 aa, Mycobacterium bovis
DDVVIRLPFRTDLTNDGTYF

SEQ ID NO: 197673 - protein, 26 aa, Mycobacterium bovis
DDVYDAAAAWARRFLDGPPHALAAAK

SEQ ID NO: 197674 - protein, 29 aa, Mycobacterium bovis
DDYVYPGHAIWWLARGLEFFQDGEQFGEL

SEQ ID NO: 197675 - protein, 20 aa, Mycobacterium bovis
DEAEAYFLSRLDEWENVIAG

SEQ ID NO: 197676 - protein, 22 aa, Mycobacterium bovis
DEAFPRLSVIRAPRHDRVVGPF

SEQ ID NO: 197677 - protein, 20 aa, Mycobacterium bovis
DEDAARRCVDLTLERFGSVD

SEQ ID NO: 197678 - protein, 23 aa, Mycobacterium bovis
DEDRELLESFDLSYGEDEGGEED

SEQ ID NO: 197679 - protein, 21 aa, Mycobacterium bovis
DEEERRMSVMNGREVARESRD

SEQ ID NO: 197680 - protein, 41 aa, Mycobacterium bovis
DEFEIPIKLRVSVCVIYIPFKGCVKHVSVTIPITTEHLGPY

SEQ ID NO: 197681 - protein, 23 aa, Mycobacterium bovis
DEFTYPLKWGWLDVDEVVDVLRA

SEQ ID NO: 197682 - protein, 19 aa, Mycobacterium bovis
DEGFARPGARRSREDFEIC

SEQ ID NO: 197683 - protein, 25 aa, Mycobacterium bovis
DEGFHAATVRRIRPGEQLVLGDGVG

SEQ ID NO: 197684 - protein, 26 aa, Mycobacterium bovis
DEHGRWPRSVGLSVWGTSAMRTAGDD

SEQ ID NO: 197685 - protein, 20 aa, Mycobacterium bovis
DEIFGPVVVVLTFDDEADAI

SEQ ID NO: 197686 - protein, 33 aa, Mycobacterium bovis
DEIGDAFLSRSCRWALAAANLWQGNLEAAVGLS

SEQ ID NO: 197687 - protein, 23 aa, Mycobacterium bovis
DEISVLQASLFTAYGTLYQQVSA

SEQ ID NO: 197688 - protein, 20 aa, Mycobacterium bovis
DEITELFGPGLAEITVIRNG

SEQ ID NO: 197689 - protein, 21 aa, Mycobacterium bovis
DEIWQCDGCSITHQRDDNAAI

SEQ ID NO: 197690 - protein, 18 aa, Mycobacterium bovis
DEKPCPRERPPADQLAAF

SEQ ID NO: 197691 - protein, 24 aa, Mycobacterium bovis
DEKVEYVDVRFCDLPGIMQHFTIP

SEQ ID NO: 197692 - protein, 21 aa, Mycobacterium bovis
DELAAELWLAAASFESVCSGL

SEQ ID NO: 197693 - protein, 24 aa, Mycobacterium bovis
DELAEALAGFIAEFGLSLVGGCCG

SEQ ID NO: 197694 - protein, 23 aa, Mycobacterium bovis
DELAEPLLAAGYPRLEHITQDTE

SEQ ID NO: 197695 - protein, 17 aa, Mycobacterium bovis
DELCAPGSRVALGALGS

SEQ ID NO: 197696 - protein, 20 aa, Mycobacterium bovis
DELCDRVAFVVDGRIVALDS

SEQ ID NO: 197697 - protein, 24 aa, Mycobacterium bovis
DELDAIRIGRRIVARLNWIKQGPA

SEQ ID NO: 197698 - protein, 18 aa, Mycobacterium bovis
DELDRLGVRLRLDDTGAL

SEQ ID NO: 197699 - protein, 20 aa, Mycobacterium bovis
DELDRLIARVKRLREEAGKT

SEQ ID NO: 197700 - protein, 17 aa, Mycobacterium bovis
DELGRILGVKGRVLPMC

SEQ ID NO: 197701 - protein, 31 aa, Mycobacterium bovis
DELIRGGVRDVVLCPGSRNAPLAFALQDADR

SEQ ID NO: 197702 - protein, 19 aa, Mycobacterium bovis
DELKRVLEALLLVIDTPVT

SEQ ID NO: 197703 - protein, 25 aa, Mycobacterium bovis
DELLDRVSSKYALVIYAAKRARQIN

SEQ ID NO: 197704 - protein, 23 aa, Mycobacterium bovis
DELLRGFLDWLFARYRDIVDSTA

SEQ ID NO: 197705 - protein, 24 aa, Mycobacterium bovis
DELPLPRPRYEIFVYSPRVEGVHL

SEQ ID NO: 197706 - protein, 21 aa, Mycobacterium bovis
DELRAAVSKYWKIDEIRPAFI

SEQ ID NO: 197707 - protein, 19 aa, Mycobacterium bovis
DELRGAAASAAFVVASGSL

SEQ ID NO: 197708 - protein, 18 aa, Mycobacterium bovis
DEMICGMAEVVKAGFIAD

SEQ ID NO: 197709 - protein, 17 aa, Mycobacterium bovis
DEMRAIVQIAARRPTTG

SEQ ID NO: 197710 - protein, 21 aa, Mycobacterium bovis
DENRIAALLAARCPIDGFGVG

SEQ ID NO: 197711 - protein, 21 aa, Mycobacterium bovis
DENYILLEWGIDRDFEHYRKA

SEQ ID NO: 197712 - protein, 23 aa, Mycobacterium bovis
DEPDAFAATGGWQSFRVPCLPSD

SEQ ID NO: 197713 - protein, 26 aa, Mycobacterium bovis
DEPLVRRLWVLKVWGDVVDDRRGTRP

SEQ ID NO: 197714 - protein, 20 aa, Mycobacterium bovis
DEPWCRTLASHLGHFATTDA

SEQ ID NO: 197715 - protein, 22 aa, Mycobacterium bovis
DEQLLLLPLTSLRGLRHTLKKL

SEQ ID NO: 197716 - protein, 26 aa, Mycobacterium bovis
DEQRRWAAEGVQRGWQATMVLTEPDA

SEQ ID NO: 197717 - protein, 19 aa, Mycobacterium bovis
DEQWQCDRCSVVHQRDDCA

SEQ ID NO: 197718 - protein, 21 aa, Mycobacterium bovis
DETNFEYGLECILDHAGRLIE

SEQ ID NO: 197719 - protein, 27 aa, Mycobacterium bovis
DEVICAFGRIGSMFACEDLGYVPDMIT

SEQ ID NO: 197720 - protein, 19 aa, Mycobacterium bovis
DEVKIQMEAAGMCRSDHHL

SEQ ID NO: 197721 - protein, 30 aa, Mycobacterium bovis
DEVLGRALVVRRLEMLPVECVARGYLTGSG

SEQ ID NO: 197722 - protein, 22 aa, Mycobacterium bovis
DEVSAAVAALFGAHGQTYQVLS

SEQ ID NO: 197723 - protein, 20 aa, Mycobacterium bovis
DEVVFGWRSFELYPPQVRVA

SEQ ID NO: 197724 - protein, 30 aa, Mycobacterium bovis
DEWAARAGPRWSYADVLGYFRRIENVTAAW

SEQ ID NO: 197725 - protein, 27 aa, Mycobacterium bovis
DEWCVISIRSDDEWRRATSVFGQPELA

SEQ ID NO: 197726 - protein, 25 aa, Mycobacterium bovis
DEWERRAIAVFGHRPYIGVSANIVA

SEQ ID NO: 197727 - protein, 21 aa, Mycobacterium bovis
DEYFRRAAAAGARQVVILAAG

SEQ ID NO: 197728 - protein, 20 aa, Mycobacterium bovis
DEYLALQCGRSVHTRRAYLG

SEQ ID NO: 197729 - protein, 19 aa, Mycobacterium bovis
DFAAACERARVVFLGPPAR

SEQ ID NO: 197730 - protein, 17 aa, Mycobacterium bovis
DFACPLPAEISAVPAAL

SEQ ID NO: 197731 - protein, 25 aa, Mycobacterium bovis
DFAQYWSEICQIPISFITETVKRAQ

SEQ ID NO: 197732 - protein, 23 aa, Mycobacterium bovis
DFAYDVSHLELPLPADGSTMPST

SEQ ID NO: 197733 - protein, 26 aa, Mycobacterium bovis
DFCDKALEGFTMFALNQGEVCTCPSR

SEQ ID NO: 197734 - protein, 25 aa, Mycobacterium bovis
DFCDPEVVEALKFHLRDLAVTFRFG

SEQ ID NO: 197735 - protein, 19 aa, Mycobacterium bovis
DFESIRWRLDVWNASAQVS

SEQ ID NO: 197736 - protein, 18 aa, Mycobacterium bovis
DFFAELTIYTSSACLIGK

SEQ ID NO: 197737 - protein, 24 aa, Mycobacterium bovis
DFGAAGPRSSWRATDPVLYAMSGA

SEQ ID NO: 197738 - protein, 20 aa, Mycobacterium bovis
DFGKREVMMVHTLLWPDEIR

SEQ ID NO: 197739 - protein, 23 aa, Mycobacterium bovis
DFKQCPLLYRFRAIDRLPEATSA

SEQ ID NO: 197740 - protein, 17 aa, Mycobacterium bovis
DFLAIVARRRRRHPNMH

SEQ ID NO: 197741 - protein, 20 aa, Mycobacterium bovis
DFLGPINWMRPLRAIAARHE

SEQ ID NO: 197742 - protein, 18 aa, Mycobacterium bovis
DFLRICVIATEFELVMPF

SEQ ID NO: 197743 - protein, 22 aa, Mycobacterium bovis
DGALDRCVLCDLTGKRVDVKEA

SEQ ID NO: 197744 - protein, 19 aa, Mycobacterium bovis
DGAPIPVQFSCKGANVAPP

SEQ ID NO: 197745 - protein, 18 aa, Mycobacterium bovis
DGAVFRKRVPGPHFDAGI

SEQ ID NO: 197746 - protein, 27 aa, Mycobacterium bovis
DGAWRDPRVWWQLRNPFTPSWGEPYVD

SEQ ID NO: 197747 - protein, 23 aa, Mycobacterium bovis
DGDARLLLIVAELPLPMQNVNEE

SEQ ID NO: 197748 - protein, 20 aa, Mycobacterium bovis
DGDNVWPGILGFDDTVIPQV

SEQ ID NO: 197749 - protein, 28 aa, Mycobacterium bovis
DGDRSACIKAMIEKVVDRMYAEIDDNRF

SEQ ID NO: 197750 - protein, 17 aa, Mycobacterium bovis
DGDYRFGQQIVVSHDGG

SEQ ID NO: 197751 - protein, 22 aa, Mycobacterium bovis
DGEARQGRRGRRFRDRRRRGER

SEQ ID NO: 197752 - protein, 25 aa, Mycobacterium bovis
DGEFVKFGPSWAWPKPVQPHIPVLV

SEQ ID NO: 197753 - protein, 20 aa, Mycobacterium bovis
DGEIAEAAWFTRDEVRAALA

SEQ ID NO: 197754 - protein, 18 aa, Mycobacterium bovis
DGEPALLDCLEFEDELRY

SEQ ID NO: 197755 - protein, 24 aa, Mycobacterium bovis
DGEPFVLHPGEFVLGSTLELFTLP

SEQ ID NO: 197756 - protein, 19 aa, Mycobacterium bovis
DGGAFYGPRGRYEVAGGGV

SEQ ID NO: 197757 - protein, 23 aa, Mycobacterium bovis
DGGDGGGLFSIGVGGDGGNAGNG

SEQ ID NO: 197758 - protein, 22 aa, Mycobacterium bovis
DGGDPKGALVPTSWSHAMAVAA

SEQ ID NO: 197759 - protein, 18 aa, Mycobacterium bovis
DGGFLQSVRLCVDRLGFA

SEQ ID NO: 197760 - protein, 30 aa, Mycobacterium bovis
DGGGSIRIPCTWCGLFGLKPQRDRISLEPH

SEQ ID NO: 197761 - protein, 18 aa, Mycobacterium bovis
DGGIWPRQRVRDEALTFM

SEQ ID NO: 197762 - protein, 18 aa, Mycobacterium bovis
DGGLACWTTALLHSRLVR

SEQ ID NO: 197763 - protein, 19 aa, Mycobacterium bovis
DGGLHRFLLSAASAFVAGV

SEQ ID NO: 197764 - protein, 23 aa, Mycobacterium bovis
DGGLLLPLGVRRLRSYGSARHAR

SEQ ID NO: 197765 - protein, 20 aa, Mycobacterium bovis
DGGLPAWRSAGGSIETGQVS

SEQ ID NO: 197766 - protein, 25 aa, Mycobacterium bovis
DGGLPTDHPAVWNHPVVDPHTVEPD

SEQ ID NO: 197767 - protein, 17 aa, Mycobacterium bovis
DGGRDEQLLLLPLTSLR

SEQ ID NO: 197768 - protein, 24 aa, Mycobacterium bovis
DGGVGGVGGKGGFGGAGGAGGNGG

SEQ ID NO: 197769 - protein, 20 aa, Mycobacterium bovis
DGGYGGWGGAGGNGGAGGSA

SEQ ID NO: 197770 - protein, 19 aa, Mycobacterium bovis
DGIDPLRDVVMLGATNRPD

SEQ ID NO: 197771 - protein, 26 aa, Mycobacterium bovis
DGIERGRIAILLKVHHALIDGEGGLR

SEQ ID NO: 197772 - protein, 19 aa, Mycobacterium bovis
DGIGVPACVGAAGRAVTSV

SEQ ID NO: 197773 - protein, 21 aa, Mycobacterium bovis
DGISEFLERIAVQAGSGGTPL

SEQ ID NO: 197774 - protein, 35 aa, Mycobacterium bovis
DGLVRRSRVHWVRARVVQLERGWVLRDETGGRWQA

SEQ ID NO: 197775 - protein, 21 aa, Mycobacterium bovis
DGLYDLLGIGIPNQGGILYSS

SEQ ID NO: 197776 - protein, 19 aa, Mycobacterium bovis
DGLYTRWPDRDSLVSEIDT

SEQ ID NO: 197777 - protein, 22 aa, Mycobacterium bovis
DGMAGWYFTKWQRVLNDGLDAV

SEQ ID NO: 197778 - protein, 17 aa, Mycobacterium bovis
DGMEPYLGVAVHGFPNY

SEQ ID NO: 197779 - protein, 26 aa, Mycobacterium bovis
DGMGGLRLLLSLARAYADEPDEVGGP

SEQ ID NO: 197780 - protein, 18 aa, Mycobacterium bovis
DGMTYVGLVPFRMSSTKL

SEQ ID NO: 197781 - protein, 22 aa, Mycobacterium bovis
DGNEVWVLPGGLTRVALVEGSR

SEQ ID NO: 197782 - protein, 18 aa, Mycobacterium bovis
DGNGRWATQRGLARTEGH

SEQ ID NO: 197783 - protein, 40 aa, Mycobacterium bovis
DGNLPKGRLSDMVRRILRSMFAVGIDRWKPAPAPDMNAHN

SEQ ID NO: 197784 - protein, 18 aa, Mycobacterium bovis
DGPDRVRISGVIGEPPPP

SEQ ID NO: 197785 - protein, 20 aa, Mycobacterium bovis
DGPESRFAKTMALVAEHGAA

SEQ ID NO: 197786 - protein, 20 aa, Mycobacterium bovis
DGPICKLALPERISSGTHSA

SEQ ID NO: 197787 - protein, 18 aa, Mycobacterium bovis
DGPPGVKGDGGNGGNGGN

SEQ ID NO: 197788 - protein, 17 aa, Mycobacterium bovis
DGPVVVVGHSFGGAVAM

SEQ ID NO: 197789 - protein, 18 aa, Mycobacterium bovis
DGQYLKAARRLYMTATPR

SEQ ID NO: 197790 - protein, 19 aa, Mycobacterium bovis
DGRIAGLVRQVCARALSLP

SEQ ID NO: 197791 - protein, 28 aa, Mycobacterium bovis
DGRLGVGWPKEFGGLGFGPIEQQIFVNE

SEQ ID NO: 197792 - protein, 18 aa, Mycobacterium bovis
DGRMHGVQVWSGPTDAEP

SEQ ID NO: 197793 - protein, 20 aa, Mycobacterium bovis
DGRRLRRRRLDAGDQAGFPL

SEQ ID NO: 197794 - protein, 17 aa, Mycobacterium bovis
DGSDFVFMDSQDYEQHP

SEQ ID NO: 197795 - protein, 23 aa, Mycobacterium bovis
DGSHAAITAALWGVDEAISRAVP

SEQ ID NO: 197796 - protein, 27 aa, Mycobacterium bovis
DGSSVLIQMMWAMRATGMWTDTRGANM

SEQ ID NO: 197797 - protein, 18 aa, Mycobacterium bovis
DGSVWARVRLSDGEVIDA

SEQ ID NO: 197798 - protein, 18 aa, Mycobacterium bovis
DGSWHIDGVKRFITSGDS

SEQ ID NO: 197799 - protein, 22 aa, Mycobacterium bovis
DGTELPADLVVVGIGSTPATEW

SEQ ID NO: 197800 - protein, 17 aa, Mycobacterium bovis
DGTHTEWIEASRANDFG

SEQ ID NO: 197801 - protein, 27 aa, Mycobacterium bovis
DGTIVRYRVGELIPVYRSQRALLQRLL

SEQ ID NO: 197802 - protein, 20 aa, Mycobacterium bovis
DGTVIWTLPGDQTYVTTPGS

SEQ ID NO: 197803 - protein, 21 aa, Mycobacterium bovis
DGTWLRANFISSLDGGATVDG

SEQ ID NO: 197804 - protein, 17 aa, Mycobacterium bovis
DGVAHGFTVARHGPDVY

SEQ ID NO: 197805 - protein, 25 aa, Mycobacterium bovis
DGVARRRARVVVPFQPRLLMVGDAF

SEQ ID NO: 197806 - protein, 17 aa, Mycobacterium bovis
DGVIIPTECEFFSLRGL

SEQ ID NO: 197807 - protein, 27 aa, Mycobacterium bovis
DGVLGRLWLARGGTYALANIRGGGEYG

SEQ ID NO: 197808 - protein, 18 aa, Mycobacterium bovis
DGVLHEFTTVPGVKEDVT

SEQ ID NO: 197809 - protein, 24 aa, Mycobacterium bovis
DGVLRARKLPDWPTGPLPKVRVAA

SEQ ID NO: 197810 - protein, 17 aa, Mycobacterium bovis
DGVRFCAVCGNVSDNER

SEQ ID NO: 197811 - protein, 26 aa, Mycobacterium bovis
DGVVAGIHLEGPWLSPARCGAHDHTR

SEQ ID NO: 197812 - protein, 20 aa, Mycobacterium bovis
DGWVHFDAPAGMLIPDSVAT

SEQ ID NO: 197813 - protein, 22 aa, Mycobacterium bovis
DGWVRAQLLHYIAAHRISISTK

SEQ ID NO: 197814 - protein, 32 aa, Mycobacterium bovis
DGYNAPESTSPWHNLQQDILSFINEPTEALTG

SEQ ID NO: 197815 - protein, 23 aa, Mycobacterium bovis
DGYSRSGAGFGVAAAASGGGTFL

SEQ ID NO: 197816 - protein, 25 aa, Mycobacterium bovis
DHELDVWSLTDLVAFSTNSQGGSSI

SEQ ID NO: 197817 - protein, 25 aa, Mycobacterium bovis
DHFARRGRRVHRLAVSHAFHSLLME

SEQ ID NO: 197818 - protein, 24 aa, Mycobacterium bovis
DHGEIPLGIYCRASLAEYMDAERL

SEQ ID NO: 197819 - protein, 18 aa, Mycobacterium bovis
DHGGRWCRHRSLQRRLHR

SEQ ID NO: 197820 - protein, 18 aa, Mycobacterium bovis
DHGLRYVVLINGSLVNPS

SEQ ID NO: 197821 - protein, 22 aa, Mycobacterium bovis
DHLELGESLGLIDMQRGAKVSG

SEQ ID NO: 197822 - protein, 18 aa, Mycobacterium bovis
DHLLMAITVEEVYGSVAS

SEQ ID NO: 197823 - protein, 18 aa, Mycobacterium bovis
DHPEWVMPTNWAVAVDRP

SEQ ID NO: 197824 - protein, 27 aa, Mycobacterium bovis
DHPGDPWTVPKFYWTVLGLSALISGAR

SEQ ID NO: 197825 - protein, 17 aa, Mycobacterium bovis
DHRGSYLQMHFALAQPP

SEQ ID NO: 197826 - protein, 23 aa, Mycobacterium bovis
DHRRIPGPLPLHPSADRRGIHSA

SEQ ID NO: 197827 - protein, 18 aa, Mycobacterium bovis
DHSRGSWRGRDFTGTEYV

SEQ ID NO: 197828 - protein, 19 aa, Mycobacterium bovis
DIALRRPSLDDVFLAMTTD

SEQ ID NO: 197829 - protein, 20 aa, Mycobacterium bovis
DIARGSLRLWSLAGGMPLHR

SEQ ID NO: 197830 - protein, 27 aa, Mycobacterium bovis
DIDEALKLADLVAVFAPGGALAQYDET

SEQ ID NO: 197831 - protein, 17 aa, Mycobacterium bovis
DIDLVFSPFFNALPIRR

SEQ ID NO: 197832 - protein, 18 aa, Mycobacterium bovis
DIEAQGWIAPAECVEVRV

SEQ ID NO: 197833 - protein, 19 aa, Mycobacterium bovis
DIEDVFAGLGLSLFPGTAR

SEQ ID NO: 197834 - protein, 24 aa, Mycobacterium bovis
DIEEFSRRFGVQVEDGFGSTENAV

SEQ ID NO: 197835 - protein, 18 aa, Mycobacterium bovis
DIEPEWLSSVSTIGVTAG

SEQ ID NO: 197836 - protein, 30 aa, Mycobacterium bovis
DIEVPAPPFWGSRIVKGLAVADYTGLLDER

SEQ ID NO: 197837 - protein, 18 aa, Mycobacterium bovis
DIGEAVGIVAAQSIGEPG

SEQ ID NO: 197838 - protein, 18 aa, Mycobacterium bovis
DIGISHVVFKPGTIEQIR

SEQ ID NO: 197839 - protein, 22 aa, Mycobacterium bovis
DIGKHFSVNVMLARDTIRRRLA

SEQ ID NO: 197840 - protein, 18 aa, Mycobacterium bovis
DIGRGRNGVLYAGEVNWD

SEQ ID NO: 197841 - protein, 20 aa, Mycobacterium bovis
DIGRLRWQFERIARGVPVAA

SEQ ID NO: 197842 - protein, 20 aa, Mycobacterium bovis
DIHFQPRYIFAAIDAGCAAV

SEQ ID NO: 197843 - protein, 33 aa, Mycobacterium bovis
DILAALVRLAVEWPLELFGHITAMPVPAVVKLH

SEQ ID NO: 197844 - protein, 17 aa, Mycobacterium bovis
DILLQGVSICFDQLHEI

SEQ ID NO: 197845 - protein, 25 aa, Mycobacterium bovis
DILQKEGLNWVTWVVGETTYSPLPA

SEQ ID NO: 197846 - protein, 24 aa, Mycobacterium bovis
DILSEVWVSGELVTAVAEQTLGVL

SEQ ID NO: 197847 - protein, 17 aa, Mycobacterium bovis
DINTGWFNTGIMNTGTR

SEQ ID NO: 197848 - protein, 25 aa, Mycobacterium bovis
DINVKIDKGEFVFLIGPSGSGKSTF

SEQ ID NO: 197849 - protein, 26 aa, Mycobacterium bovis
DIPDNEFRVVLARRGQHWVSAVRVGN

SEQ ID NO: 197850 - protein, 25 aa, Mycobacterium bovis
DIPGFADSLLRGWQAKKRTSTRISN

SEQ ID NO: 197851 - protein, 24 aa, Mycobacterium bovis
DIPPMDFTLGLPVLGPITGQLGPI

SEQ ID NO: 197852 - protein, 23 aa, Mycobacterium bovis
DIPRAGVEYGQLLAVLPLQRMLP

SEQ ID NO: 197853 - protein, 19 aa, Mycobacterium bovis
DITARRGALLVLDEVQTGM

SEQ ID NO: 197854 - protein, 23 aa, Mycobacterium bovis
DITKEVLGALGITVLSEPGFEAD

SEQ ID NO: 197855 - protein, 23 aa, Mycobacterium bovis
DITVNVDGFWMLQALLDIRHVAP

SEQ ID NO: 197856 - protein, 24 aa, Mycobacterium bovis
DIVAYCRGAYCVMAPDAVRIARDA

SEQ ID NO: 197857 - protein, 26 aa, Mycobacterium bovis
DIVPRYRTMRGYKVERRFGWDTHGLP

SEQ ID NO: 197858 - protein, 20 aa, Mycobacterium bovis
DIVRLLRLYDAGQLMLDELV

SEQ ID NO: 197859 - protein, 25 aa, Mycobacterium bovis
DIWGKRRLAYEIAKHAEGIYVVIDV

SEQ ID NO: 197860 - protein, 18 aa, Mycobacterium bovis
DIYDEFLELAAIRTKAVR

SEQ ID NO: 197861 - protein, 29 aa, Mycobacterium bovis
DKAKAAPLWRVLVALSIRHVGPTAARALA

SEQ ID NO: 197862 - protein, 22 aa, Mycobacterium bovis
DKAKAMGAIALFGESYPDEVRV

SEQ ID NO: 197863 - protein, 23 aa, Mycobacterium bovis
DKDIPHLTAAIIAKYISNLRLLG

SEQ ID NO: 197864 - protein, 24 aa, Mycobacterium bovis
DKGDRLAYNRVWVKALGEMPDDPV

SEQ ID NO: 197865 - protein, 19 aa, Mycobacterium bovis
DKHKLALEREMLGLYVSGH

SEQ ID NO: 197866 - protein, 22 aa, Mycobacterium bovis
DKIARIGIRVADVLDPEQLTHK

SEQ ID NO: 197867 - protein, 24 aa, Mycobacterium bovis
DKLDLKPGMTLLDIGCGWGTTMRR

SEQ ID NO: 197868 - protein, 21 aa, Mycobacterium bovis
DKLKDAGFYWATRSGVTVSMA

SEQ ID NO: 197869 - protein, 17 aa, Mycobacterium bovis
DKLRPGPTMISDRKLAW

SEQ ID NO: 197870 - protein, 18 aa, Mycobacterium bovis
DKNPELEPLLSQAIEAAT

SEQ ID NO: 197871 - protein, 24 aa, Mycobacterium bovis
DKPDLRFGLELVECTDFFSDTTFR

SEQ ID NO: 197872 - protein, 20 aa, Mycobacterium bovis
DKPKPWRVFSAATPAESVSL

SEQ ID NO: 197873 - protein, 21 aa, Mycobacterium bovis
DKPLMRRKLAEMVVDVEAALA

SEQ ID NO: 197874 - protein, 24 aa, Mycobacterium bovis
DKPPGVAETIDWVAALVALGVADL

SEQ ID NO: 197875 - protein, 17 aa, Mycobacterium bovis
DKRGHRLGPAFAGLVDA

SEQ ID NO: 197876 - protein, 22 aa, Mycobacterium bovis
DKTGHPFLQHLLAHRDVTRLKV

SEQ ID NO: 197877 - protein, 23 aa, Mycobacterium bovis
DKVGNVDALFLFDVLLHQVSPDW

SEQ ID NO: 197878 - protein, 22 aa, Mycobacterium bovis
DKVLGYRNWLGLNKGDLAAAVD

SEQ ID NO: 197879 - protein, 18 aa, Mycobacterium bovis
DKVLRAKVDGAWNLHELT

SEQ ID NO: 197880 - protein, 19 aa, Mycobacterium bovis
DKVVLGFLGCRDTLPHLQR

SEQ ID NO: 197881 - protein, 18 aa, Mycobacterium bovis
DKWHRRRVIEPIDMDAYR

SEQ ID NO: 197882 - protein, 20 aa, Mycobacterium bovis
DLAAIAGFCAQAAVRRTPLL

SEQ ID NO: 197883 - protein, 24 aa, Mycobacterium bovis
DLAARLKAVWAPQGLIHRGQGRWY

SEQ ID NO: 197884 - protein, 17 aa, Mycobacterium bovis
DLAAWPATLDRVLAIGG

SEQ ID NO: 197885 - protein, 19 aa, Mycobacterium bovis
DLADEVFTWARAVSAEVDP

SEQ ID NO: 197886 - protein, 24 aa, Mycobacterium bovis
DLAGRPRFVTAMRWGHLPLAGENG

SEQ ID NO: 197887 - protein, 27 aa, Mycobacterium bovis
DLALDKLHLEPGMTLLDIGCGWGGGLQ

SEQ ID NO: 197888 - protein, 18 aa, Mycobacterium bovis
DLALQCAPDHPWAREHRQ

SEQ ID NO: 197889 - protein, 20 aa, Mycobacterium bovis
DLATPGFLSGIGNFGTNLAG

SEQ ID NO: 197890 - protein, 17 aa, Mycobacterium bovis
DLAVTFRFGEEVTAVDV

SEQ ID NO: 197891 - protein, 19 aa, Mycobacterium bovis
DLCDAESKVAAARSPIKAD

SEQ ID NO: 197892 - protein, 24 aa, Mycobacterium bovis
DLCTGGAEVLWRFAERSGEGSPDD

SEQ ID NO: 197893 - protein, 25 aa, Mycobacterium bovis
DLDDALRSWLAFGAEKVREVVVLAR

SEQ ID NO: 197894 - protein, 18 aa, Mycobacterium bovis
DLDFARSIAEQGHLPAEV

SEQ ID NO: 197895 - protein, 19 aa, Mycobacterium bovis
DLDGIRVLRSFDESMALRK

SEQ ID NO: 197896 - protein, 23 aa, Mycobacterium bovis
DLDGRLPFDLRRAVLSNGSVILE

SEQ ID NO: 197897 - protein, 18 aa, Mycobacterium bovis
DLDHPPVLLIMGLGAQML

SEQ ID NO: 197898 - protein, 24 aa, Mycobacterium bovis
DLEHWRWMWDTNVLGTLRVTRALL

SEQ ID NO: 197899 - protein, 19 aa, Mycobacterium bovis
DLFLGVPFNIASYALLTHM

SEQ ID NO: 197900 - protein, 21 aa, Mycobacterium bovis
DLFPHAVKWRGTTYLEDGLHR

SEQ ID NO: 197901 - protein, 21 aa, Mycobacterium bovis
DLFRYPGIRSDSDMYTLGFRF

SEQ ID NO: 197902 - protein, 20 aa, Mycobacterium bovis
DLGALAWRGLLDRTDIDPAA

SEQ ID NO: 197903 - protein, 32 aa, Mycobacterium bovis
DLGPLRASIDPFGWYRSWEEMLTGMAPLAGLG

SEQ ID NO: 197904 - protein, 24 aa, Mycobacterium bovis
DLIDPALLRPGRLERLVFVEPPDA

SEQ ID NO: 197905 - protein, 32 aa, Mycobacterium bovis
DLKPISAPERLRSGWLNGIKHWQVDYTGRCPV

SEQ ID NO: 197906 - protein, 20 aa, Mycobacterium bovis
DLKQRPVVIEAAAQGCSPDQ

SEQ ID NO: 197907 - protein, 18 aa, Mycobacterium bovis
DLLELAYPLMSWPRRGVF

SEQ ID NO: 197908 - protein, 25 aa, Mycobacterium bovis
DLLERGRYDLVLALASTHTGDGTVE

SEQ ID NO: 197909 - protein, 38 aa, Mycobacterium bovis
DLLFIGCTPIVWAGPIANWVAACDAMIALDAPTVVPGH

SEQ ID NO: 197910 - protein, 20 aa, Mycobacterium bovis
DLLIGWRLLVLAGVAHAALA

SEQ ID NO: 197911 - protein, 25 aa, Mycobacterium bovis
DLLIKDGRLAPDFDDEVIAQSCVTR

SEQ ID NO: 197912 - protein, 22 aa, Mycobacterium bovis
DLLKCSFCGKSQKQVKKLIAGP

SEQ ID NO: 197913 - protein, 21 aa, Mycobacterium bovis
DLLPELQAAGVHYTIAVEAAD

SEQ ID NO: 197914 - protein, 24 aa, Mycobacterium bovis
DLLQLKAAVLGSRRAMTRAGRHIP

SEQ ID NO: 197915 - protein, 17 aa, Mycobacterium bovis
DLLRPVLNMPRHPIRLA

SEQ ID NO: 197916 - protein, 23 aa, Mycobacterium bovis
DLLRSPRPRWPPNAAGMQVECTD

SEQ ID NO: 197917 - protein, 24 aa, Mycobacterium bovis
DLLTGWRDAWELGRAARDNSLRLL

SEQ ID NO: 197918 - protein, 18 aa, Mycobacterium bovis
DLLVVRRGEKVVVEVSVV

SEQ ID NO: 197919 - protein, 26 aa, Mycobacterium bovis
DLNQLWMCGLPGYSPGDLIDFEFCGD

SEQ ID NO: 197920 - protein, 23 aa, Mycobacterium bovis
DLPGRLRAVGFTDIHVDVAGARL

SEQ ID NO: 197921 - protein, 29 aa, Mycobacterium bovis
DLPKLGERLNLPAGWSYHTRVLTSELRVD

SEQ ID NO: 197922 - protein, 22 aa, Mycobacterium bovis
DLPLHPGFAASWQRLRTAPATV

SEQ ID NO: 197923 - protein, 18 aa, Mycobacterium bovis
DLPRQPVHPELRVVDLAI

SEQ ID NO: 197924 - protein, 33 aa, Mycobacterium bovis
DLQFRPEVSDGLFLRLAITSVDSLACAYAAVLA

SEQ ID NO: 197925 - protein, 18 aa, Mycobacterium bovis
DLQPGSSIMPGKVNPVLP

SEQ ID NO: 197926 - protein, 35 aa, Mycobacterium bovis
DLRAFLADKVVRWWLPERWAFVDEIPRTSVGKYDK

SEQ ID NO: 197927 - protein, 20 aa, Mycobacterium bovis
DLRAGTLTRRAHWRSPAGKQ

SEQ ID NO: 197928 - protein, 19 aa, Mycobacterium bovis
DLRGITKLTGITVDDVAKR

SEQ ID NO: 197929 - protein, 21 aa, Mycobacterium bovis
DLRGLLGAFMFTGPQLEQPAG

SEQ ID NO: 197930 - protein, 18 aa, Mycobacterium bovis
DLRGNPTLREVLQRTRQM

SEQ ID NO: 197931 - protein, 22 aa, Mycobacterium bovis
DLRGRFRWWGLYTQREQGYDGT

SEQ ID NO: 197932 - protein, 20 aa, Mycobacterium bovis
DLRHDWPDALRRGGFDAAEP

SEQ ID NO: 197933 - protein, 17 aa, Mycobacterium bovis
DLRRIAVVTPRQLVGPR

SEQ ID NO: 197934 - protein, 24 aa, Mycobacterium bovis
DLSTLRFALSGAEPVEPADVEDLL

SEQ ID NO: 197935 - protein, 23 aa, Mycobacterium bovis
DLSTLRLIPWLPGTALVIADLVW

SEQ ID NO: 197936 - protein, 19 aa, Mycobacterium bovis
DLTAPPVWFIKTIGDAVML

SEQ ID NO: 197937 - protein, 23 aa, Mycobacterium bovis
DLTDYLLEMGIRVRYLHSEVDTL

SEQ ID NO: 197938 - protein, 25 aa, Mycobacterium bovis
DLTFRRRSCCLFYRVPAGGKCGDCP

SEQ ID NO: 197939 - protein, 20 aa, Mycobacterium bovis
DLTRRIALRQTVDMVRVTME

SEQ ID NO: 197940 - protein, 19 aa, Mycobacterium bovis
DLVLALRWVHDNIAEFGGD

SEQ ID NO: 197941 - protein, 24 aa, Mycobacterium bovis
DLVLRRLTESLARDRTRHQVSEVT

SEQ ID NO: 197942 - protein, 31 aa, Mycobacterium bovis
DLVRAVPLVGGLWFRFLHSVKAGIKDSLSPQ

SEQ ID NO: 197943 - protein, 28 aa, Mycobacterium bovis
DLVSQGRFRFGVGVGWLREEVANHGVDP

SEQ ID NO: 197944 - protein, 17 aa, Mycobacterium bovis
DLYRGCMRGRTMYVVPF

SEQ ID NO: 197945 - protein, 18 aa, Mycobacterium bovis
DLYWAARGAGPGFFGVVT

SEQ ID NO: 197946 - protein, 17 aa, Mycobacterium bovis
DMAGLPPQAAGTVDAAL

SEQ ID NO: 197947 - protein, 17 aa, Mycobacterium bovis
DMFRLDLDGIVARLRPA

SEQ ID NO: 197948 - protein, 24 aa, Mycobacterium bovis
DMILGLRMITPVGVLDLGRVPASA

SEQ ID NO: 197949 - protein, 26 aa, Mycobacterium bovis
DMIMELLDAFGIAMAGAPGFEADDVL

SEQ ID NO: 197950 - protein, 29 aa, Mycobacterium bovis
DMLRCRRWCSGTSNRWCEMRVRVDGRKGG

SEQ ID NO: 197951 - protein, 21 aa, Mycobacterium bovis
DMMAAFADQAALAWRLATAQR

SEQ ID NO: 197952 - protein, 17 aa, Mycobacterium bovis
DMRSGRMSDDDWTRLAR

SEQ ID NO: 197953 - protein, 24 aa, Mycobacterium bovis
DMTRRLAREEAMLVGGSCGMAVVA

SEQ ID NO: 197954 - protein, 24 aa, Mycobacterium bovis
DNAFTADELAAWAGRIHAEVGDAA

SEQ ID NO: 197955 - protein, 21 aa, Mycobacterium bovis
DNAMLGLLCDAAFDELTRPDV

SEQ ID NO: 197956 - protein, 24 aa, Mycobacterium bovis
DNARLRARIGVMLQGGGGYPAARA

SEQ ID NO: 197957 - protein, 22 aa, Mycobacterium bovis
DNGIKIFGPGGHKLDDDTEDQI

SEQ ID NO: 197958 - protein, 24 aa, Mycobacterium bovis
DNGRIRYKRVCEACGEVVDYRDLA

SEQ ID NO: 197959 - protein, 18 aa, Mycobacterium bovis
DNHIFDWETGDAAATEAV

SEQ ID NO: 197960 - protein, 22 aa, Mycobacterium bovis
DNKRFKVVWQVLNALRSHDERF

SEQ ID NO: 197961 - protein, 17 aa, Mycobacterium bovis
DNLERVWAPKATGALRM

SEQ ID NO: 197962 - protein, 22 aa, Mycobacterium bovis
DNLRRGGIQFADTRGYAYDRRD

SEQ ID NO: 197963 - protein, 17 aa, Mycobacterium bovis
DNMREYLAAGAKERQRL

SEQ ID NO: 197964 - protein, 25 aa, Mycobacterium bovis
DNQIWQCPVVLLADVRSVGVQGDGR

SEQ ID NO: 197965 - protein, 22 aa, Mycobacterium bovis
DNQQGFNFAGGWNSGSGNSGLF

SEQ ID NO: 197966 - protein, 22 aa, Mycobacterium bovis
DNQQGFNFAGGWNSGTANIGLF

SEQ ID NO: 197967 - protein, 37 aa, Mycobacterium bovis
DNRPIGVLFKRIFDRPARRPVRRVLLFVVPSSGPAPD

SEQ ID NO: 197968 - protein, 17 aa, Mycobacterium bovis
DNSGLDWGALGECDYLY

SEQ ID NO: 197969 - protein, 17 aa, Mycobacterium bovis
DNSYVHNLIHGFILAAA

SEQ ID NO: 197970 - protein, 19 aa, Mycobacterium bovis
DNTYYCFGTAAGPHPFPTM

SEQ ID NO: 197971 - protein, 40 aa, Mycobacterium bovis
DNVGRIVVHLAPWLEPQPICWAIDHVRVCVGHGYPDGPAA

SEQ ID NO: 197972 - protein, 25 aa, Mycobacterium bovis
DNVIREFVEHTGIPFLPMSMAKGLL

SEQ ID NO: 197973 - protein, 17 aa, Mycobacterium bovis
DNWLSSPYSHWAFQHVE

SEQ ID NO: 197974 - protein, 26 aa, Mycobacterium bovis
DPADPRLSPLLAESLSGLAPALIAVA

SEQ ID NO: 197975 - protein, 17 aa, Mycobacterium bovis
DPADRLIYATAIEHGWR

SEQ ID NO: 197976 - protein, 19 aa, Mycobacterium bovis
DPAIISWPNGIAAHGEIRD

SEQ ID NO: 197977 - protein, 22 aa, Mycobacterium bovis
DPAIRRKPSIFVLEDAPWSAFR

SEQ ID NO: 197978 - protein, 22 aa, Mycobacterium bovis
DPAKRLAQALGINDLGNTPQRV

SEQ ID NO: 197979 - protein, 23 aa, Mycobacterium bovis
DPARAARVLGFRAAVDPGEGLRE

SEQ ID NO: 197980 - protein, 17 aa, Mycobacterium bovis
DPATGSRRRYPWGTEEP

SEQ ID NO: 197981 - protein, 18 aa, Mycobacterium bovis
DPATGVTVGPIFSSGSII

SEQ ID NO: 197982 - protein, 24 aa, Mycobacterium bovis
DPAVARLPCVWVVDVDSVQHEPSA

SEQ ID NO: 197983 - protein, 26 aa, Mycobacterium bovis
DPDAVGGLYVHWIVTGIAPGSGSTAD

SEQ ID NO: 197984 - protein, 19 aa, Mycobacterium bovis
DPDAWARLIDTYEVTALNF

SEQ ID NO: 197985 - protein, 26 aa, Mycobacterium bovis
DPDGRLAALLRFSADRAADWYSLGLR

SEQ ID NO: 197986 - protein, 23 aa, Mycobacterium bovis
DPDLTPALASMVFVARPPTATPT

SEQ ID NO: 197987 - protein, 17 aa, Mycobacterium bovis
DPDRCVRGQYLGYTEVA

SEQ ID NO: 197988 - protein, 24 aa, Mycobacterium bovis
DPDRMPFSVPWTRASREDLPFNTL

SEQ ID NO: 197989 - protein, 17 aa, Mycobacterium bovis
DPDTVLLGTDFGGDSLT

SEQ ID NO: 197990 - protein, 26 aa, Mycobacterium bovis
DPEEVAGFLADYGWRLTEQAGPEELV

SEQ ID NO: 197991 - protein, 20 aa, Mycobacterium bovis
DPEVPPALRRLVLEGQAAVQ

SEQ ID NO: 197992 - protein, 25 aa, Mycobacterium bovis
DPFWDRLRFPAALDRVQVPVLLVGG

SEQ ID NO: 197993 - protein, 24 aa, Mycobacterium bovis
DPGHSFPAIALCQRFRAAADTPTL

SEQ ID NO: 197994 - protein, 25 aa, Mycobacterium bovis
DPGPACYRGGGPLCVTDANVMLGRI

SEQ ID NO: 197995 - protein, 18 aa, Mycobacterium bovis
DPGRVGLFRHVLRPAFLQ

SEQ ID NO: 197996 - protein, 20 aa, Mycobacterium bovis
DPGTVFALEMAFFGALVQAG

SEQ ID NO: 197997 - protein, 23 aa, Mycobacterium bovis
DPGVISYLWRTARMGVEDIESML

SEQ ID NO: 197998 - protein, 25 aa, Mycobacterium bovis
DPIDIAYPVLWRNLTAIVASVLDAI

SEQ ID NO: 197999 - protein, 21 aa, Mycobacterium bovis
DPIPHGLLFERFLNPERTSMP

SEQ ID NO: 198000 - protein, 27 aa, Mycobacterium bovis
DPIRYPARLAPLHGWGSDGADTIGTVG

SEQ ID NO: 198001 - protein, 25 aa, Mycobacterium bovis
DPKAVPSRLAWEAGVALADSLLARY

SEQ ID NO: 198002 - protein, 24 aa, Mycobacterium bovis
DPKFSGQLALHFKATIGEDVLSRL

SEQ ID NO: 198003 - protein, 19 aa, Mycobacterium bovis
DPKHSGPCDVLYRDIGDYL

SEQ ID NO: 198004 - protein, 27 aa, Mycobacterium bovis
DPKTAVLNWKGDQVIVFVELSGSGARY

SEQ ID NO: 198005 - protein, 19 aa, Mycobacterium bovis
DPLFTRTGAGLAFTPGGLR

SEQ ID NO: 198006 - protein, 21 aa, Mycobacterium bovis
DPMQWRVLERAFSRHSALILI

SEQ ID NO: 198007 - protein, 23 aa, Mycobacterium bovis
DPPFEGMWWLYVPLAFDDFAVVL

SEQ ID NO: 198008 - protein, 18 aa, Mycobacterium bovis
DPQHRLFLQCAWHALEDA

SEQ ID NO: 198009 - protein, 23 aa, Mycobacterium bovis
DPQHRLLLETSWEAMEHGGLTPN

SEQ ID NO: 198010 - protein, 19 aa, Mycobacterium bovis
DPQLAAFYHRLMTTQRHCH

SEQ ID NO: 198011 - protein, 21 aa, Mycobacterium bovis
DPQMLRYFASIGISLDSRLRV

SEQ ID NO: 198012 - protein, 24 aa, Mycobacterium bovis
DPQQRLLLETSWEAIEHAGLDPAS

SEQ ID NO: 198013 - protein, 25 aa, Mycobacterium bovis
DPQQRLLLEVSWEALEHAGIIPESL

SEQ ID NO: 198014 - protein, 24 aa, Mycobacterium bovis
DPQQRLLLEVSWEALERTGIDPTK

SEQ ID NO: 198015 - protein, 18 aa, Mycobacterium bovis
DPQQRLMLEVSWEALEHA

SEQ ID NO: 198016 - protein, 18 aa, Mycobacterium bovis
DPQRAGLVRSHFGARRKA

SEQ ID NO: 198017 - protein, 19 aa, Mycobacterium bovis
DPQVPLPGFVLKRAIKGTI

SEQ ID NO: 198018 - protein, 25 aa, Mycobacterium bovis
DPRARARFLAITGGGGFLLYLQMHE

SEQ ID NO: 198019 - protein, 17 aa, Mycobacterium bovis
DPRHPVTVDARRIGRWR

SEQ ID NO: 198020 - protein, 19 aa, Mycobacterium bovis
DPRMLPILDELCADQDVAA

SEQ ID NO: 198021 - protein, 25 aa, Mycobacterium bovis
DPRPPMITSGLRIGTPALAARGFSH

SEQ ID NO: 198022 - protein, 18 aa, Mycobacterium bovis
DPRRAHVSLSKHPYQIGV

SEQ ID NO: 198023 - protein, 18 aa, Mycobacterium bovis
DPRRQLTVVGAREHNLRG

SEQ ID NO: 198024 - protein, 25 aa, Mycobacterium bovis
DPRRRCAPLGAGRCLLGSGSALGWI

SEQ ID NO: 198025 - protein, 19 aa, Mycobacterium bovis
DPRSGRWQGLAKTECGLHA

SEQ ID NO: 198026 - protein, 20 aa, Mycobacterium bovis
DPRTGLPLVSVGTVVTSEDV

SEQ ID NO: 198027 - protein, 21 aa, Mycobacterium bovis
DPSGNCLEVFHGTALEHRRVV

SEQ ID NO: 198028 - protein, 17 aa, Mycobacterium bovis
DPSYHGVVFAELGPPAF

SEQ ID NO: 198029 - protein, 17 aa, Mycobacterium bovis
DPTWVYTCAYFERDDMT

SEQ ID NO: 198030 - protein, 18 aa, Mycobacterium bovis
DPVRLAALRKVMPRLLNV

SEQ ID NO: 198031 - protein, 22 aa, Mycobacterium bovis
DPWLPSLGNPLTFLSPANIAFA

SEQ ID NO: 198032 - protein, 17 aa, Mycobacterium bovis
DPYPHYRELLAGERVQY

SEQ ID NO: 198033 - protein, 20 aa, Mycobacterium bovis
DQAAAVAILQSWLDERLAAM

SEQ ID NO: 198034 - protein, 19 aa, Mycobacterium bovis
DQAALAWRLATAQRQMREV

SEQ ID NO: 198035 - protein, 23 aa, Mycobacterium bovis
DQARLLCEKAAWTIDQHGNKEAR

SEQ ID NO: 198036 - protein, 18 aa, Mycobacterium bovis
DQDIKVIVLRGAGRAFSG

SEQ ID NO: 198037 - protein, 18 aa, Mycobacterium bovis
DQHAGGPGRVFVYSGQGS

SEQ ID NO: 198038 - protein, 17 aa, Mycobacterium bovis
DQHVWCFLGDGEMDEPE

SEQ ID NO: 198039 - protein, 24 aa, Mycobacterium bovis
DQLDALCALGLQSRIVAAALPNSS

SEQ ID NO: 198040 - protein, 22 aa, Mycobacterium bovis
DQLGRRVHRVACDYQAVRTHFF

SEQ ID NO: 198041 - protein, 23 aa, Mycobacterium bovis
DQLIRAREFDVVVAGGQESMTKA

SEQ ID NO: 198042 - protein, 17 aa, Mycobacterium bovis
DQLRLTGTHWGCDTSNC

SEQ ID NO: 198043 - protein, 22 aa, Mycobacterium bovis
DQLRRHGWKGFGPVPYSHQPNR

SEQ ID NO: 198044 - protein, 24 aa, Mycobacterium bovis
DQLRRYPWPQGHTMSVLSNALTDQ

SEQ ID NO: 198045 - protein, 18 aa, Mycobacterium bovis
DQLSRGPLLSGMFGTFPV

SEQ ID NO: 198046 - protein, 20 aa, Mycobacterium bovis
DQMLAYNLSPSFNWDTTGMT

SEQ ID NO: 198047 - protein, 23 aa, Mycobacterium bovis
DQRRLGELIDLFNSARFSRQGEH

SEQ ID NO: 198048 - protein, 19 aa, Mycobacterium bovis
DQRVVDWLVDKFKGTSGID

SEQ ID NO: 198049 - protein, 26 aa, Mycobacterium bovis
DQRWPETRIDPSLTRISALMDLLGSP

SEQ ID NO: 198050 - protein, 18 aa, Mycobacterium bovis
DQVRCLLAGELGPELGPV

SEQ ID NO: 198051 - protein, 24 aa, Mycobacterium bovis
DRAARYGDRVFLKFGDQQLTYRDA

SEQ ID NO: 198052 - protein, 27 aa, Mycobacterium bovis
DRAIPRGVGTAGVWRLPDRNTLQEVLT

SEQ ID NO: 198053 - protein, 26 aa, Mycobacterium bovis
DRALELGCGTGFFLLNLIQAGVARRG

SEQ ID NO: 198054 - protein, 18 aa, Mycobacterium bovis
DRASCKYMKMITPAALLR

SEQ ID NO: 198055 - protein, 18 aa, Mycobacterium bovis
DRCGVVLVGPHGVGKTLL

SEQ ID NO: 198056 - protein, 26 aa, Mycobacterium bovis
DRCNLRCSYCMPERGLRWLPGEQLLR

SEQ ID NO: 198057 - protein, 19 aa, Mycobacterium bovis
DRDGFVFGEGGALLLIETE

SEQ ID NO: 198058 - protein, 22 aa, Mycobacterium bovis
DRDGVLTSFDWTRAEEDVRRIT

SEQ ID NO: 198059 - protein, 23 aa, Mycobacterium bovis
DRDGVRIPMQWTPDRNAGFSTAN

SEQ ID NO: 198060 - protein, 20 aa, Mycobacterium bovis
DREGELFVPVELDIDAVSHL

SEQ ID NO: 198061 - protein, 19 aa, Mycobacterium bovis
DREKHGALRGSMTVLAVNT

SEQ ID NO: 198062 - protein, 18 aa, Mycobacterium bovis
DRELWRKLIDAGILSSAA

SEQ ID NO: 198063 - protein, 25 aa, Mycobacterium bovis
DREREVAELLLLGMPYRDIGARLFI

SEQ ID NO: 198064 - protein, 20 aa, Mycobacterium bovis
DRERIALSNVRIKSSVQNYP

SEQ ID NO: 198065 - protein, 22 aa, Mycobacterium bovis
DREVLTAWGAYGEKQMYGKTVQ

SEQ ID NO: 198066 - protein, 26 aa, Mycobacterium bovis
DRFNELVMRAGLTWQQVVLLRAYAKY

SEQ ID NO: 198067 - protein, 17 aa, Mycobacterium bovis
DRFWLAVGRTRSNAYLL

SEQ ID NO: 198068 - protein, 20 aa, Mycobacterium bovis
DRGAGVLGFAGTAGKESVGR

SEQ ID NO: 198069 - protein, 29 aa, Mycobacterium bovis
DRGALPVKLCYAGPFFRYERPQAGRYRQL

SEQ ID NO: 198070 - protein, 23 aa, Mycobacterium bovis
DRGCSRPGCDAPAYHSEVHHVTP

SEQ ID NO: 198071 - protein, 23 aa, Mycobacterium bovis
DRGLRFMSACGVADRNLQTAEIY

SEQ ID NO: 198072 - protein, 21 aa, Mycobacterium bovis
DRGMPVLGICNGFQVLCEAGL

SEQ ID NO: 198073 - protein, 21 aa, Mycobacterium bovis
DRGPSQWLLRMLATQTQRAEL

SEQ ID NO: 198074 - protein, 24 aa, Mycobacterium bovis
DRGRPLWEVWVIEGLADSKWAILT

SEQ ID NO: 198075 - protein, 22 aa, Mycobacterium bovis
DRHLLRPLREVMWGHDENLLNS

SEQ ID NO: 198076 - protein, 20 aa, Mycobacterium bovis
DRHLRYPLRDVIWGHDQDLL

SEQ ID NO: 198077 - protein, 17 aa, Mycobacterium bovis
DRHPGWNRGSARAAHAD

SEQ ID NO: 198078 - protein, 18 aa, Mycobacterium bovis
DRIARLVVANGFLPAAQG

SEQ ID NO: 198079 - protein, 26 aa, Mycobacterium bovis
DRICIPVPFYHCFGMVMGNLAATSHG

SEQ ID NO: 198080 - protein, 17 aa, Mycobacterium bovis
DRIGVAMLQAAEQAGLI

SEQ ID NO: 198081 - protein, 17 aa, Mycobacterium bovis
DRIPVVLDVNALLGPIN

SEQ ID NO: 198082 - protein, 22 aa, Mycobacterium bovis
DRIRYHGGEFIDLIVGGSTYDL

SEQ ID NO: 198083 - protein, 18 aa, Mycobacterium bovis
DRITAWGLAGEPSLKQFV

SEQ ID NO: 198084 - protein, 25 aa, Mycobacterium bovis
DRITKARWVYFLTRMRNPTGDTAPF

SEQ ID NO: 198085 - protein, 20 aa, Mycobacterium bovis
DRIVSFEAFDAFKKERYLTF

SEQ ID NO: 198086 - protein, 25 aa, Mycobacterium bovis
DRIVSIGAFEAFKMERYAAFFERSY

SEQ ID NO: 198087 - protein, 20 aa, Mycobacterium bovis
DRIVSIGAFEHFGHDRHADF

SEQ ID NO: 198088 - protein, 20 aa, Mycobacterium bovis
DRIVSIGAFEHFGHERYDAF

SEQ ID NO: 198089 - protein, 20 aa, Mycobacterium bovis
DRIVSIGAFEHFGHQRYHHF

SEQ ID NO: 198090 - protein, 20 aa, Mycobacterium bovis
DRIVSLGAFEHFADGAGDAG

SEQ ID NO: 198091 - protein, 28 aa, Mycobacterium bovis
DRLARRAWQRFQAIEARGGFVEAHDFLA

SEQ ID NO: 198092 - protein, 18 aa, Mycobacterium bovis
DRLGYVVGLILAGANEPS

SEQ ID NO: 198093 - protein, 21 aa, Mycobacterium bovis
DRLIYATAIEHGWRLVTKDRR

SEQ ID NO: 198094 - protein, 23 aa, Mycobacterium bovis
DRLKPWDVIAARLTAAAAADLVL

SEQ ID NO: 198095 - protein, 27 aa, Mycobacterium bovis
DRLMARIDAKLGFPQRDPHGAPIPGAD

SEQ ID NO: 198096 - protein, 24 aa, Mycobacterium bovis
DRLPFDSPMYWHLFEPALRDAVDK

SEQ ID NO: 198097 - protein, 20 aa, Mycobacterium bovis
DRLPMDKLLAGVAHVVHEMH

SEQ ID NO: 198098 - protein, 21 aa, Mycobacterium bovis
DRLPRFMRYLAAITAQELNVA

SEQ ID NO: 198099 - protein, 21 aa, Mycobacterium bovis
DRLQYFVSCLVYMPRDRYTTA

SEQ ID NO: 198100 - protein, 18 aa, Mycobacterium bovis
DRLRKALWNLYWRGTANM

SEQ ID NO: 198101 - protein, 18 aa, Mycobacterium bovis
DRLSGRRLTLGVASDGPR

SEQ ID NO: 198102 - protein, 18 aa, Mycobacterium bovis
DRMLARLSSTVAVVPELR

SEQ ID NO: 198103 - protein, 23 aa, Mycobacterium bovis
DRPAFKTCVAHGIVLGFDGQKMS

SEQ ID NO: 198104 - protein, 19 aa, Mycobacterium bovis
DRPALPAALTILRDITAGS

SEQ ID NO: 198105 - protein, 20 aa, Mycobacterium bovis
DRPDALVLDVMMPRLDGLEV

SEQ ID NO: 198106 - protein, 17 aa, Mycobacterium bovis
DRPEPVSVMTAAAQGFV

SEQ ID NO: 198107 - protein, 31 aa, Mycobacterium bovis
DRPLARFGAWYEMFPRSTGGWDDDGNPVHGT

SEQ ID NO: 198108 - protein, 19 aa, Mycobacterium bovis
DRPPEWLVRQLAALLPELA

SEQ ID NO: 198109 - protein, 20 aa, Mycobacterium bovis
DRPSAHEILSAKLAPAQEAP

SEQ ID NO: 198110 - protein, 21 aa, Mycobacterium bovis
DRPVMPARFLILGSASPDLVG

SEQ ID NO: 198111 - protein, 28 aa, Mycobacterium bovis
DRRATRLVAEWPPRLNIPDPDPLRLIYF

SEQ ID NO: 198112 - protein, 20 aa, Mycobacterium bovis
DRRCGPNLYSRQVAYATRLV

SEQ ID NO: 198113 - protein, 28 aa, Mycobacterium bovis
DRRDAIRHAVAWARPGDVVLIAGKGHET

SEQ ID NO: 198114 - protein, 24 aa, Mycobacterium bovis
DRRFTRTRLRTEVLPLLEDVLGGG

SEQ ID NO: 198115 - protein, 20 aa, Mycobacterium bovis
DRRSALLPLLHLVQGEDSYL

SEQ ID NO: 198116 - protein, 23 aa, Mycobacterium bovis
DRRVEFWPTVAIRSALESGDIAT

SEQ ID NO: 198117 - protein, 19 aa, Mycobacterium bovis
DRRVLADAVDVLRRLLDHA

SEQ ID NO: 198118 - protein, 20 aa, Mycobacterium bovis
DRRVLEFGGRLYTAKDSRTT

SEQ ID NO: 198119 - protein, 23 aa, Mycobacterium bovis
DRSIVPVRVIWLPPADRSRAGKV

SEQ ID NO: 198120 - protein, 17 aa, Mycobacterium bovis
DRSRINPVVAQLMEDPN

SEQ ID NO: 198121 - protein, 22 aa, Mycobacterium bovis
DRSRQLAAIGCHFTQSADNPVL

SEQ ID NO: 198122 - protein, 21 aa, Mycobacterium bovis
DRSYVNIGFWSSVPVGATEGA

SEQ ID NO: 198123 - protein, 17 aa, Mycobacterium bovis
DRTELRWITSALTEVEL

SEQ ID NO: 198124 - protein, 18 aa, Mycobacterium bovis
DRTGCRDALRRDGADTVV

SEQ ID NO: 198125 - protein, 17 aa, Mycobacterium bovis
DRTRPCGRWSYARPDAN

SEQ ID NO: 198126 - protein, 21 aa, Mycobacterium bovis
DRVAAAAAFHPGGLVANSPDS

SEQ ID NO: 198127 - protein, 20 aa, Mycobacterium bovis
DRVAELARMLAGLGDSDSGR

SEQ ID NO: 198128 - protein, 18 aa, Mycobacterium bovis
DRVARADEALPFAAIAVG

SEQ ID NO: 198129 - protein, 20 aa, Mycobacterium bovis
DRVGACRQLADALGATVLLK

SEQ ID NO: 198130 - protein, 25 aa, Mycobacterium bovis
DRVGIWAPNRWEWVLVQYATAEIGA

SEQ ID NO: 198131 - protein, 17 aa, Mycobacterium bovis
DRVNLAITALRDEVEAE

SEQ ID NO: 198132 - protein, 24 aa, Mycobacterium bovis
DRWHSLARLAIRDDIYGALRSLCF

SEQ ID NO: 198133 - protein, 17 aa, Mycobacterium bovis
DRYEVHHGVRITDSALV

SEQ ID NO: 198134 - protein, 20 aa, Mycobacterium bovis
DRYLEVWNLVFMQNERGEGT

SEQ ID NO: 198135 - protein, 21 aa, Mycobacterium bovis
DRYRHLVALSITDFGAAGPRS

SEQ ID NO: 198136 - protein, 24 aa, Mycobacterium bovis
DRYRMYPLVRRLLFLIPPEHAHKL

SEQ ID NO: 198137 - protein, 23 aa, Mycobacterium bovis
DRYSEIFAHSFARPTAIADGLAE

SEQ ID NO: 198138 - protein, 20 aa, Mycobacterium bovis
DSAEAVGGAGGKGGDGGVGG

SEQ ID NO: 198139 - protein, 24 aa, Mycobacterium bovis
DSAELPLFRYVGGPNAHILPVPMM

SEQ ID NO: 198140 - protein, 21 aa, Mycobacterium bovis
DSAFDGYEFSRACESLYHFAW

SEQ ID NO: 198141 - protein, 17 aa, Mycobacterium bovis
DSAGDLGDWGGPDALAD

SEQ ID NO: 198142 - protein, 21 aa, Mycobacterium bovis
DSATEPVHFVQMWVIPDATGI

SEQ ID NO: 198143 - protein, 17 aa, Mycobacterium bovis
DSAVRRYVTDAGALLPR

SEQ ID NO: 198144 - protein, 17 aa, Mycobacterium bovis
DSDGFYYIVDRVKDMIV

SEQ ID NO: 198145 - protein, 17 aa, Mycobacterium bovis
DSFLRAAELLGVTPDAA

SEQ ID NO: 198146 - protein, 27 aa, Mycobacterium bovis
DSGDDCPDWVAGELWVSGRGIARGYRG

SEQ ID NO: 198147 - protein, 17 aa, Mycobacterium bovis
DSGLLMSTFGPRTALWL

SEQ ID NO: 198148 - protein, 18 aa, Mycobacterium bovis
DSGVQAWLGPLPDDPAGL

SEQ ID NO: 198149 - protein, 25 aa, Mycobacterium bovis
DSIEHARTWPGHMGAAMANAYSANP

SEQ ID NO: 198150 - protein, 17 aa, Mycobacterium bovis
DSLACAYAAVLAEAKRY

SEQ ID NO: 198151 - protein, 17 aa, Mycobacterium bovis
DSLAITWAHPELPQRAF

SEQ ID NO: 198152 - protein, 20 aa, Mycobacterium bovis
DSLDWPDYIGQLSVEGSAGA

SEQ ID NO: 198153 - protein, 18 aa, Mycobacterium bovis
DSLHALVITGGYDLDPAA

SEQ ID NO: 198154 - protein, 22 aa, Mycobacterium bovis
DSLLRRLKQYSGRLATEAVSAM

SEQ ID NO: 198155 - protein, 18 aa, Mycobacterium bovis
DSMLVKLTCRGRDLPTAV

SEQ ID NO: 198156 - protein, 23 aa, Mycobacterium bovis
DSMRAGLQALAWIAHQPEATRRS

SEQ ID NO: 198157 - protein, 19 aa, Mycobacterium bovis
DSMVWRFAADTNDLGVPIT

SEQ ID NO: 198158 - protein, 22 aa, Mycobacterium bovis
DSPARGGRHLGFAKALVYEMPH

SEQ ID NO: 198159 - protein, 18 aa, Mycobacterium bovis
DSPDRLWEALLRGDDLVT

SEQ ID NO: 198160 - protein, 24 aa, Mycobacterium bovis
DSPFRGVKKVHYWAARSTGGEFTP

SEQ ID NO: 198161 - protein, 20 aa, Mycobacterium bovis
DSPISLAFLTFLPRFDCQDR

SEQ ID NO: 198162 - protein, 20 aa, Mycobacterium bovis
DSQESFGLKESAWVIDELRE

SEQ ID NO: 198163 - protein, 20 aa, Mycobacterium bovis
DSQLAGFMRNAAGGTLFNFG

SEQ ID NO: 198164 - protein, 25 aa, Mycobacterium bovis
DSRGRYLIRGVIGPDEFHSGYPGNE

SEQ ID NO: 198165 - protein, 20 aa, Mycobacterium bovis
DSRLRELVIMRIGWLTDCDY

SEQ ID NO: 198166 - protein, 24 aa, Mycobacterium bovis
DSTKLRAAAVAWRSAGTQFALTEI

SEQ ID NO: 198167 - protein, 23 aa, Mycobacterium bovis
DSTTETFAAITLEVDTRRWAGVP

SEQ ID NO: 198168 - protein, 24 aa, Mycobacterium bovis
DSVADFLAARGIRLPPGSPTDLTD

SEQ ID NO: 198169 - protein, 17 aa, Mycobacterium bovis
DSVAWLAQRGILVAPGD

SEQ ID NO: 198170 - protein, 23 aa, Mycobacterium bovis
DSVKRLVGEIGERHGRLDMLVNN

SEQ ID NO: 198171 - protein, 23 aa, Mycobacterium bovis
DSVSCPRSSEVIVRKAPSQEDHW

SEQ ID NO: 198172 - protein, 17 aa, Mycobacterium bovis
DSVWLCDHFLTISPGEY

SEQ ID NO: 198173 - protein, 26 aa, Mycobacterium bovis
DTACSSSLVAIHWAMSSLRSGECDLA

SEQ ID NO: 198174 - protein, 24 aa, Mycobacterium bovis
DTATSLPGRGAWLHPLRQCAQQAI

SEQ ID NO: 198175 - protein, 25 aa, Mycobacterium bovis
DTAYFGNAFPPNYLVNSHISAEQVG

SEQ ID NO: 198176 - protein, 17 aa, Mycobacterium bovis
DTCETRSAWSFNRYAHL

SEQ ID NO: 198177 - protein, 23 aa, Mycobacterium bovis
DTDEVIDVVLLWWRDGDGDLVDT

SEQ ID NO: 198178 - protein, 24 aa, Mycobacterium bovis
DTEIPSPAAGVLTKIIAQEDDTVE

SEQ ID NO: 198179 - protein, 25 aa, Mycobacterium bovis
DTEITRLVPFIEWLRGAYPDQLISV

SEQ ID NO: 198180 - protein, 28 aa, Mycobacterium bovis
DTEPWRGEPLLAYLRKMVFWSMVTPRAA

SEQ ID NO: 198181 - protein, 24 aa, Mycobacterium bovis
DTGVPRPGLSTIFSPSRSTFGVDL

SEQ ID NO: 198182 - protein, 26 aa, Mycobacterium bovis
DTHLLRYPLPAAWCTDVDVELYLKDE

SEQ ID NO: 198183 - protein, 20 aa, Mycobacterium bovis
DTIAALSRRASALLDGLDGA

SEQ ID NO: 198184 - protein, 17 aa, Mycobacterium bovis
DTLADAKALAGAHPDGI

SEQ ID NO: 198185 - protein, 36 aa, Mycobacterium bovis; identical to SEQ ID NO: 79016

SEQ ID NO: 198186 - protein, 27 aa, Mycobacterium bovis
DTNVYYRRALMLAACFGRGSEYPQRVV

SEQ ID NO: 198187 - protein, 24 aa, Mycobacterium bovis
DTPCDLLIAVGVSFGGLVTRSFSP

SEQ ID NO: 198188 - protein, 22 aa, Mycobacterium bovis
DTPIEIDFGPSPAINLNIGKPD

SEQ ID NO: 198189 - protein, 18 aa, Mycobacterium bovis
DTPKAIAALDGWVTDAVE

SEQ ID NO: 198190 - protein, 20 aa, Mycobacterium bovis
DTPLPRVSIFLSILDAHVQR

SEQ ID NO: 198191 - protein, 21 aa, Mycobacterium bovis
DTPTIASLVAWANEADLGRTV

SEQ ID NO: 198192 - protein, 24 aa, Mycobacterium bovis
DTPTLFTGVEWLEAARAAGIDAVE

SEQ ID NO: 198193 - protein, 30 aa, Mycobacterium bovis; identical to SEQ ID NO: 87610

SEQ ID NO: 198194 - protein, 24 aa, Mycobacterium bovis
DTRTDVSLVLRMHHGGDFVIEPLP

SEQ ID NO: 198195 - protein, 25 aa, Mycobacterium bovis
DTSASVTCGIGFADLSSFTALTQAL

SEQ ID NO: 198196 - protein, 20 aa, Mycobacterium bovis
DTSFSMVMENRWLPMKRTAL

SEQ ID NO: 198197 - protein, 20 aa, Mycobacterium bovis
DTSNCGTCVVEVDGVPVKSC

SEQ ID NO: 198198 - protein, 18 aa, Mycobacterium bovis
DTTISWSSVEEALGCLSH

SEQ ID NO: 198199 - protein, 18 aa, Mycobacterium bovis
DTVARLIGPAALKYLLFS

SEQ ID NO: 198200 - protein, 17 aa, Mycobacterium bovis
DTVVFPALRDVMSAVEF

SEQ ID NO: 198201 - protein, 19 aa, Mycobacterium bovis
DTYGFPIELTLEMAAETGL

SEQ ID NO: 198202 - protein, 24 aa, Mycobacterium bovis
DVAADVWSVTSWGELNRDGVAIET

SEQ ID NO: 198203 - protein, 22 aa, Mycobacterium bovis
DVADYLAGSGWQVTTSTGKELF

SEQ ID NO: 198204 - protein, 18 aa, Mycobacterium bovis
DVAEGPVYVRKQIVHNTV

SEQ ID NO: 198205 - protein, 17 aa, Mycobacterium bovis
DVAELLPELTLAQRWDL

SEQ ID NO: 198206 - protein, 23 aa, Mycobacterium bovis
DVAETLIEVALRFVKIRETAWRV

SEQ ID NO: 198207 - protein, 18 aa, Mycobacterium bovis
DVAFRPKTIIPRLSATFP

SEQ ID NO: 198208 - protein, 25 aa, Mycobacterium bovis
DVALSVPVSGTWVDIRFTLPANTVD

SEQ ID NO: 198209 - protein, 29 aa, Mycobacterium bovis
DVAQLCERAELAAHWLSHGRWTDGWDPHR

SEQ ID NO: 198210 - protein, 23 aa, Mycobacterium bovis
DVAQLLLRVGIFSWITHAPKLGG

SEQ ID NO: 198211 - protein, 20 aa, Mycobacterium bovis
DVARLRERWEQIEAKAQETK

SEQ ID NO: 198212 - protein, 22 aa, Mycobacterium bovis
DVDAALHYLARMLVAGEDPRFI

SEQ ID NO: 198213 - protein, 26 aa, Mycobacterium bovis
DVDFYRWTQWIFLQIYNAWFDTTANK

SEQ ID NO: 198214 - protein, 26 aa, Mycobacterium bovis
DVDPGKRVVFTWGWEDHGDPPPGGST

SEQ ID NO: 198215 - protein, 18 aa, Mycobacterium bovis
DVDTPWRKLPAKARKAIL

SEQ ID NO: 198216 - protein, 18 aa, Mycobacterium bovis
DVEALALAAGERFGPDRV

SEQ ID NO: 198217 - protein, 19 aa, Mycobacterium bovis
DVEGFPYKEIAEIMDTPIG

SEQ ID NO: 198218 - protein, 27 aa, Mycobacterium bovis
DVELRIPKLRKGSFFPAILEPRRRIDQ

SEQ ID NO: 198219 - protein, 25 aa, Mycobacterium bovis
DVFHIDRGYPLFVENLVSLGAEIER

SEQ ID NO: 198220 - protein, 24 aa, Mycobacterium bovis
DVFSEALAAPLFWIAANAGLDGSV

SEQ ID NO: 198221 - protein, 18 aa, Mycobacterium bovis
DVFVPRHRFLSYKAMNDH

SEQ ID NO: 198222 - protein, 17 aa, Mycobacterium bovis
DVGCGEAAISLALAERG

SEQ ID NO: 198223 - protein, 24 aa, Mycobacterium bovis
DVGHIPGAVKIDWHTDLNDPRVRD

SEQ ID NO: 198224 - protein, 24 aa, Mycobacterium bovis
DVIAVGITPAGSWVLTDANPDALT

SEQ ID NO: 198225 - protein, 25 aa, Mycobacterium bovis
DVIEVPGLLDLSSLWQIYAVDRPTL

SEQ ID NO: 198226 - protein, 26 aa, Mycobacterium bovis
DVIGLRIAGGAIVWATPDHKVLTEYG

SEQ ID NO: 198227 - protein, 18 aa, Mycobacterium bovis
DVIPEVLGPVVELRDGSE

SEQ ID NO: 198228 - protein, 21 aa, Mycobacterium bovis
DVKGLRLTLTQAAWRVAEDSL

SEQ ID NO: 198229 - protein, 25 aa, Mycobacterium bovis
DVLEFRRRVGMLFQRPNPFPMSIMD

SEQ ID NO: 198230 - protein, 20 aa, Mycobacterium bovis
DVLIAFGRYPSFEGHLPQLG

SEQ ID NO: 198231 - protein, 20 aa, Mycobacterium bovis
DVLLGLGWLAPSHVDQWRQG

SEQ ID NO: 198232 - protein, 20 aa, Mycobacterium bovis
DVLLRAGIQGADAFAAVSSG

SEQ ID NO: 198233 - protein, 23 aa, Mycobacterium bovis
DVLNRCRGAAVVTPLLLADAYHA

SEQ ID NO: 198234 - protein, 18 aa, Mycobacterium bovis
DVLPAEWLAVPLAGGGIV

SEQ ID NO: 198235 - protein, 18 aa, Mycobacterium bovis
DVLPLWVAEMDVKLPPTV

SEQ ID NO: 198236 - protein, 22 aa, Mycobacterium bovis
DVLRAGDVLIVIGTEDGIAGVE

SEQ ID NO: 198237 - protein, 24 aa, Mycobacterium bovis
DVLRCGICGSDLHARLHCDELADV

SEQ ID NO: 198238 - protein, 17 aa, Mycobacterium bovis
DVMLDWDPTTAYSCQQG

SEQ ID NO: 198239 - protein, 23 aa, Mycobacterium bovis
DVMPARGVGVIELRGESLTPGYL

SEQ ID NO: 198240 - protein, 22 aa, Mycobacterium bovis
DVNGIVFNRAFTGAVQTIYDAS

SEQ ID NO: 198241 - protein, 24 aa, Mycobacterium bovis
DVNIPIHIPITASFTDIVYSGLDL

SEQ ID NO: 198242 - protein, 24 aa, Mycobacterium bovis
DVNYRLTLRNGVLIHRKLPADPAT

SEQ ID NO: 198243 - protein, 18 aa, Mycobacterium bovis
DVRAAGAGSRRDTRVLRG

SEQ ID NO: 198244 - protein, 18 aa, Mycobacterium bovis
DVRRWWRSDSLWQAHDAR

SEQ ID NO: 198245 - protein, 18 aa, Mycobacterium bovis
DVSDFGHRLLAYLRAADA

SEQ ID NO: 198246 - protein, 17 aa, Mycobacterium bovis
DVSFPLGVLTSVTGVSG

SEQ ID NO: 198247 - protein, 28 aa, Mycobacterium bovis
DVSKRALAGLPYRAAEIGLLVLATSTGF

SEQ ID NO: 198248 - protein, 23 aa, Mycobacterium bovis
DVSNNFYEWVLGPSMTYTCAVFP

SEQ ID NO: 198249 - protein, 20 aa, Mycobacterium bovis
DVTDRAWVTIVWDDPVNLMS

SEQ ID NO: 198250 - protein, 22 aa, Mycobacterium bovis
DVTEQFGTPGWIISQGPQVLLD

SEQ ID NO: 198251 - protein, 26 aa, Mycobacterium bovis
DVVAELRAGLPPTLAVAGSYLDGIGV

SEQ ID NO: 198252 - protein, 18 aa, Mycobacterium bovis
DVVEAIVAQGVWCGMTIP

SEQ ID NO: 198253 - protein, 25 aa, Mycobacterium bovis
DVVFASHHWPTWGREKIVEFLSQQR

SEQ ID NO: 198254 - protein, 22 aa, Mycobacterium bovis
DVVGGSCRFVLSGYSSGGVLAY

SEQ ID NO: 198255 - protein, 17 aa, Mycobacterium bovis
DVVIFGRGLGVALATAP

SEQ ID NO: 198256 - protein, 18 aa, Mycobacterium bovis
DVVNKVWFLDAVRGQVDV

SEQ ID NO: 198257 - protein, 23 aa, Mycobacterium bovis
DWAAKGTLLLGVRAVIAESFERI

SEQ ID NO: 198258 - protein, 27 aa, Mycobacterium bovis
DWAARARWANPAAWRLPGDDVTALRGT

SEQ ID NO: 198259 - protein, 26 aa, Mycobacterium bovis
DWDLKSLRWAWNRAKDDVAPWWAENS

SEQ ID NO: 198260 - protein, 19 aa, Mycobacterium bovis
DWDRIGAAVQEAFRGGADG

SEQ ID NO: 198261 - protein, 24 aa, Mycobacterium bovis
DWLVGNGGLDWAVKRTADSSQRLY

SEQ ID NO: 198262 - protein, 24 aa, Mycobacterium bovis
DWNRAGSARAWWVLTAAGIANVRI

SEQ ID NO: 198263 - protein, 21 aa, Mycobacterium bovis
DWPAEAVVVGPLHFEPTDRVL

SEQ ID NO: 198264 - protein, 20 aa, Mycobacterium bovis
DWPHIGVALMQPRARGRITL

SEQ ID NO: 198265 - protein, 18 aa, Mycobacterium bovis
DWVSMAVVSDGSYGVPEG

SEQ ID NO: 198266 - protein, 20 aa, Mycobacterium bovis
DWYADLPVASPQVFGDQTDV

SEQ ID NO: 198267 - protein, 25 aa, Mycobacterium bovis
DYAGGVRAGHRLKFWTPGGSSTPLL

SEQ ID NO: 198268 - protein, 18 aa, Mycobacterium bovis
DYAPVVMVNWEFFDNQTP

SEQ ID NO: 198269 - protein, 32 aa, Mycobacterium bovis
DYHARNPLRFAAPCPGQHGWRAPAAAAPPLDQ

SEQ ID NO: 198270 - protein, 17 aa, Mycobacterium bovis
DYIRAGLNAGLDIDSFA

SEQ ID NO: 198271 - protein, 22 aa, Mycobacterium bovis
DYLKRLTADLRRTRRRLSDLEA

SEQ ID NO: 198272 - protein, 22 aa, Mycobacterium bovis
DYLPCLVSIQFRLLPDGKDYVF

SEQ ID NO: 198273 - protein, 22 aa, Mycobacterium bovis
DYSDAGLYLWATRGEPCRDSVA

SEQ ID NO: 198274 - protein, 26 aa, Mycobacterium bovis
DYWASWCGPCRAFAPTFAESSEKHPD

SEQ ID NO: 198275 - protein, 23 aa, Mycobacterium bovis
DYWYRNVRQTVLFDQAVRNACEQ

SEQ ID NO: 198276 - protein, 19 aa, Mycobacterium bovis
EAAAVYDLFVKTLGVSAGT

SEQ ID NO: 198277 - protein, 18 aa, Mycobacterium bovis
EAADKLRSPISISTGVLW

SEQ ID NO: 198278 - protein, 23 aa, Mycobacterium bovis
EAAELHEIYKLGVVSIPTNMPMI

SEQ ID NO: 198279 - protein, 18 aa, Mycobacterium bovis
EAAFLIHRVPAWSTNLSR

SEQ ID NO: 198280 - protein, 20 aa, Mycobacterium bovis
EAAGRLMFYGQGAGGAPTAS

SEQ ID NO: 198281 - protein, 17 aa, Mycobacterium bovis
EAAHGRRLLRIAASSAF

SEQ ID NO: 198282 - protein, 23 aa, Mycobacterium bovis
EAAKGVAMPLRLTSPAPCTNCHG

SEQ ID NO: 198283 - protein, 25 aa, Mycobacterium bovis
EAAKLRLAVLAGRLRAAGVRVDLAY

SEQ ID NO: 198284 - protein, 24 aa, Mycobacterium bovis
EAALAIRAGALWVAANVDPTLPTE

SEQ ID NO: 198285 - protein, 18 aa, Mycobacterium bovis
EAALRVARDIAAKDTRVI

SEQ ID NO: 198286 - protein, 22 aa, Mycobacterium bovis
EAARAEGGWLLNKDGYRYLQDY

SEQ ID NO: 198287 - protein, 20 aa, Mycobacterium bovis
EAARIALNPTQEWLDEFDRA

SEQ ID NO: 198288 - protein, 17 aa, Mycobacterium bovis
EAARLGLANATFERHDL

SEQ ID NO: 198289 - protein, 20 aa, Mycobacterium bovis
EAARRLGRRSLVLVPNTAVQ

SEQ ID NO: 198290 - protein, 18 aa, Mycobacterium bovis
EAARRTLNRPGFGLTESL

SEQ ID NO: 198291 - protein, 17 aa, Mycobacterium bovis
EAARTWADRLIGAAAAG

SEQ ID NO: 198292 - protein, 26 aa, Mycobacterium bovis
EAAYPGRFLLGIGVGHAEMISEYRKP

SEQ ID NO: 198293 - protein, 28 aa, Mycobacterium bovis
EACPAALVDRWAPGRVMLNAYGPTETTI

SEQ ID NO: 198294 - protein, 20 aa, Mycobacterium bovis
EADARLMAHAVFGLLNSTPH

SEQ ID NO: 198295 - protein, 20 aa, Mycobacterium bovis
EAEAAEPLAEWEQELLASAT

SEQ ID NO: 198296 - protein, 20 aa, Mycobacterium bovis
EAEGADVVQIFLGNPQSWKA

SEQ ID NO: 198297 - protein, 17 aa, Mycobacterium bovis
EAEGAKADARRKVRDGG

SEQ ID NO: 198298 - protein, 19 aa, Mycobacterium bovis
EAEGLRYRSVLGLADLGLD

SEQ ID NO: 198299 - protein, 22 aa, Mycobacterium bovis
EAELRRGRRYSVARRLAGLFAS

SEQ ID NO: 198300 - protein, 24 aa, Mycobacterium bovis
EAEQWPGVRVRVIPAMTAAQAVAS

SEQ ID NO: 198301 - protein, 24 aa, Mycobacterium bovis
EAFVAAYMPFLAWLIQASADCVEM

SEQ ID NO: 198302 - protein, 19 aa, Mycobacterium bovis
EAGKARWAAQEEIVDLIAN

SEQ ID NO: 198303 - protein, 17 aa, Mycobacterium bovis
EAGKVYRLWVVGRLQLW

SEQ ID NO: 198304 - protein, 20 aa, Mycobacterium bovis
EAGLHLVGVFTFPGHSYAPG

SEQ ID NO: 198305 - protein, 22 aa, Mycobacterium bovis
EAGPRDKNRFIGVPAAFSKLFR

SEQ ID NO: 198306 - protein, 19 aa, Mycobacterium bovis
EAGQLARLVGPSGHPVFRH

SEQ ID NO: 198307 - protein, 24 aa, Mycobacterium bovis
EAGRAGVFRPLWAHDRTAERQALT

SEQ ID NO: 198308 - protein, 23 aa, Mycobacterium bovis
EAGSKVKVTIMFRGREQSRPELG

SEQ ID NO: 198309 - protein, 17 aa, Mycobacterium bovis
EAGSPVWHQLTTRDYRS

SEQ ID NO: 198310 - protein, 18 aa, Mycobacterium bovis
EAHLRRHAPWGAQVTVTR

SEQ ID NO: 198311 - protein, 20 aa, Mycobacterium bovis
EAHRIAPMVVEYVEEDIGPR

SEQ ID NO: 198312 - protein, 19 aa, Mycobacterium bovis
EAIAARGAVPVVVGGSMLY

SEQ ID NO: 198313 - protein, 25 aa, Mycobacterium bovis
EAIDAEIPLLVVITEGIPVQDTAYA

SEQ ID NO: 198314 - protein, 17 aa, Mycobacterium bovis
EAIDRFGLDMIDTTPSM

SEQ ID NO: 198315 - protein, 17 aa, Mycobacterium bovis
EAIQLFTERARLVQPNF

SEQ ID NO: 198316 - protein, 21 aa, Mycobacterium bovis
EAIRASGLSAGIVDAGLSRGL

SEQ ID NO: 198317 - protein, 28 aa, Mycobacterium bovis
EAIRQLAIRAFAAIDCRGLARVDFFLTD

SEQ ID NO: 198318 - protein, 22 aa, Mycobacterium bovis
EAIVAQGVWCGMTIPRVYPEMP

SEQ ID NO: 198319 - protein, 19 aa, Mycobacterium bovis
EAIVDRIDYIVSLGETVMS

SEQ ID NO: 198320 - protein, 23 aa, Mycobacterium bovis
EAKEVIEAGGLYVLGTERHESRR

SEQ ID NO: 198321 - protein, 20 aa, Mycobacterium bovis
EAKIKLSDMRSGRMSDDDWT

SEQ ID NO: 198322 - protein, 20 aa, Mycobacterium bovis
EAKLGYPLDRSHTAAIIWYD

SEQ ID NO: 198323 - protein, 25 aa, Mycobacterium bovis
EALADGVVRPVVFLAYSGQARWRDS

SEQ ID NO: 198324 - protein, 26 aa, Mycobacterium bovis
EALARARRALNEFGVEGLATVIPFHR

SEQ ID NO: 198325 - protein, 18 aa, Mycobacterium bovis
EALEHAGIDPLSLRGSAT

SEQ ID NO: 198326 - protein, 17 aa, Mycobacterium bovis
EALEMKDLLVVGDIPGF

SEQ ID NO: 198327 - protein, 22 aa, Mycobacterium bovis
EALGKIYAGMGIVRHPEIREVR

SEQ ID NO: 198328 - protein, 19 aa, Mycobacterium bovis
EALGLARLGATVVVNDVAS

SEQ ID NO: 198329 - protein, 17 aa, Mycobacterium bovis
EALIRMDLAEMLREEGY

SEQ ID NO: 198330 - protein, 17 aa, Mycobacterium bovis
EALMSVASEVAGIGSAL

SEQ ID NO: 198331 - protein, 24 aa, Mycobacterium bovis
EALQKLAARCPIAVLSGRDLADVT

SEQ ID NO: 198332 - protein, 22 aa, Mycobacterium bovis
EALRRISEGAAMIRSKGEAGTG

SEQ ID NO: 198333 - protein, 21 aa, Mycobacterium bovis
EALRRRTLITAAQYLALGIDP

SEQ ID NO: 198334 - protein, 18 aa, Mycobacterium bovis
EALTMAASDLANIGSTIN

SEQ ID NO: 198335 - protein, 19 aa, Mycobacterium bovis
EALVPLVLAGTTHRETPRL

SEQ ID NO: 198336 - protein, 26 aa, Mycobacterium bovis
EALYAEMWAQDALAMYGYAAASGAAG

SEQ ID NO: 198337 - protein, 26 aa, Mycobacterium bovis
EANIAPWLRAAHRYGAKVKWAEVDIE

SEQ ID NO: 198338 - protein, 24 aa, Mycobacterium bovis
EANLRLVVSLAKRYTGRGMPLLDL

SEQ ID NO: 198339 - protein, 19 aa, Mycobacterium bovis
EAPGACVVVNPCLAGGSLE

SEQ ID NO: 198340 - protein, 20 aa, Mycobacterium bovis
EAPGIAGIVEELFPVAATTD

SEQ ID NO: 198341 - protein, 26 aa, Mycobacterium bovis
EAQLDRFAIRLELRYLSERDETSMLR

SEQ ID NO: 198342 - protein, 20 aa, Mycobacterium bovis
EAQLDRFLLKLNVTLPARDS

SEQ ID NO: 198343 - protein, 24 aa, Mycobacterium bovis
EAQNRYGRKVSWGVEVGGERILFT

SEQ ID NO: 198344 - protein, 20 aa, Mycobacterium bovis
EAQRCRCRGIDLRLVSHQPI

SEQ ID NO: 198345 - protein, 27 aa, Mycobacterium bovis
EAQRLAEACGLDLVALGKVVRHSDSFT

SEQ ID NO: 198346 - protein, 27 aa, Mycobacterium bovis
EARGVPMTAGCVVPRGDVLELIDDIKD

SEQ ID NO: 198347 - protein, 28 aa, Mycobacterium bovis
EARPRAGILRAREFVMKDSYSFDIDAAG

SEQ ID NO: 198348 - protein, 23 aa, Mycobacterium bovis
EARRLRWAAPYLAVPRVLGVGVD

SEQ ID NO: 198349 - protein, 22 aa, Mycobacterium bovis
EARRVWEGRGPVVVLANSGSPT

SEQ ID NO: 198350 - protein, 28 aa, Mycobacterium bovis
EARTRAIARLGSFFSDRRMAALRAAEVV

SEQ ID NO: 198351 - protein, 25 aa, Mycobacterium bovis
EARVSRRLVAMLARRGYGQTLACEV

SEQ ID NO: 198352 - protein, 22 aa, Mycobacterium bovis
EASYFGPSFMINWLHNRYGNYK

SEQ ID NO: 198353 - protein, 24 aa, Mycobacterium bovis
EATAEAFAGGWFHSGDLVRMDSDG

SEQ ID NO: 198354 - protein, 19 aa, Mycobacterium bovis
EATFFNFEFPRNGFQLRRP

SEQ ID NO: 198355 - protein, 19 aa, Mycobacterium bovis
EATGALLLIGDPAAGDPLL

SEQ ID NO: 198356 - protein, 25 aa, Mycobacterium bovis
EATLVGRLSVPAAWSTAAPATTAGA

SEQ ID NO: 198357 - protein, 17 aa, Mycobacterium bovis
EATRPALRDPLILPSMC

SEQ ID NO: 198358 - protein, 23 aa, Mycobacterium bovis
EATRPLVICDLGMPRDVDPAVAR

SEQ ID NO: 198359 - protein, 22 aa, Mycobacterium bovis
EATSAAPLQDLLGVVNAPAQAL

SEQ ID NO: 198360 - protein, 30 aa, Mycobacterium bovis
EAVARIGWCIADRRIGVITGEVGAGKTVAV

SEQ ID NO: 198361 - protein, 19 aa, Mycobacterium bovis
EAVARLGRHQFPLVCTDTV

SEQ ID NO: 198362 - protein, 18 aa, Mycobacterium bovis
EAVDEFKKIIGVIQASGH

SEQ ID NO: 198363 - protein, 26 aa, Mycobacterium bovis
EAVESGLRVARKWGADVNGLPAGRHD

SEQ ID NO: 198364 - protein, 21 aa, Mycobacterium bovis
EAVFWFLSRKTPVFVKWLLRR

SEQ ID NO: 198365 - protein, 26 aa, Mycobacterium bovis
EAVGACSRGLMSRADVDAIERAICPG

SEQ ID NO: 198366 - protein, 28 aa, Mycobacterium bovis
EAVGIAAYRCGDWAQALAELRAARRMGS

SEQ ID NO: 198367 - protein, 23 aa, Mycobacterium bovis
EAVLARELELCYAAIALVTDVDA

SEQ ID NO: 198368 - protein, 26 aa, Mycobacterium bovis
EAVLPSAFFFEIAQWADGDGEPVAMQ

SEQ ID NO: 198369 - protein, 19 aa, Mycobacterium bovis
EAVMNRFSPQQAQLTLIDP

SEQ ID NO: 198370 - protein, 17 aa, Mycobacterium bovis
EAVNLALRTLLGEADTA

SEQ ID NO: 198371 - protein, 25 aa, Mycobacterium bovis
EAVRAAMVQPALVAANRSDLVSLVF

SEQ ID NO: 198372 - protein, 17 aa, Mycobacterium bovis
EAVSGWATKQPQVWWTS

SEQ ID NO: 198373 - protein, 18 aa, Mycobacterium bovis
EAVVAEFAEQFSVDVSAI

SEQ ID NO: 198374 - protein, 19 aa, Mycobacterium bovis
EAWARHGVEHPMGADFSGV

SEQ ID NO: 198375 - protein, 33 aa, Mycobacterium bovis
EAWMRPMFRGLRHWRVLRLLRTVGMHHALGLRA

SEQ ID NO: 198376 - protein, 22 aa, Mycobacterium bovis
EAYLGRRWVKLDATIDAPTAAR

SEQ ID NO: 198377 - protein, 22 aa, Mycobacterium bovis
EAYRISISELDWMTPQTRQRAL

SEQ ID NO: 198378 - protein, 18 aa, Mycobacterium bovis
ECEFIIRLLPDGVMSNYL

SEQ ID NO: 198379 - protein, 22 aa, Mycobacterium bovis
ECGGGRRWASAEARRHVTQGID

SEQ ID NO: 198380 - protein, 27 aa, Mycobacterium bovis
ECGIAKGSLRGGLVLGLEDSSSRMSRL

SEQ ID NO: 198381 - protein, 23 aa, Mycobacterium bovis
ECPDLRVDDAFMLPATEVDQQYR

SEQ ID NO: 198382 - protein, 17 aa, Mycobacterium bovis
ECVPVLMAALGKITGYD

SEQ ID NO: 198383 - protein, 23 aa, Mycobacterium bovis
EDAEGPGATILLRLDQDVPDDVR

SEQ ID NO: 198384 - protein, 19 aa, Mycobacterium bovis
EDARFAAMVVLERLRPDQR

SEQ ID NO: 198385 - protein, 24 aa, Mycobacterium bovis
EDCHFCSQSGLFASPVRSAWLDIP

SEQ ID NO: 198386 - protein, 27 aa, Mycobacterium bovis
EDDEARLQRLLAFVARQEPRLNWAVGV

SEQ ID NO: 198387 - protein, 21 aa, Mycobacterium bovis
EDERIGVLSFPLGKQQRPAAA

SEQ ID NO: 198388 - protein, 30 aa, Mycobacterium bovis
EDESRLTFLAVRRWYGWSAGRILNLDIGGG

SEQ ID NO: 198389 - protein, 19 aa, Mycobacterium bovis
EDGRFVARYGPFRVEAPLS

SEQ ID NO: 198390 - protein, 19 aa, Mycobacterium bovis
EDHLDWHATMAEYTAAKAR

SEQ ID NO: 198391 - protein, 22 aa, Mycobacterium bovis
EDIARIGGRLARRYRSSHRGID

SEQ ID NO: 198392 - protein, 17 aa, Mycobacterium bovis
EDIELTGPMAARLWVQL

SEQ ID NO: 198393 - protein, 19 aa, Mycobacterium bovis
EDLLNRWTWIPFGAGRHRC

SEQ ID NO: 198394 - protein, 19 aa, Mycobacterium bovis
EDLRYGPDVTTLATVPASA

SEQ ID NO: 198395 - protein, 26 aa, Mycobacterium bovis
EDNRAWRLYRRLGFTDIIRGYHFAGD

SEQ ID NO: 198396 - protein, 19 aa, Mycobacterium bovis
EDPAHGWQPQAGVMHTIEV

SEQ ID NO: 198397 - protein, 21 aa, Mycobacterium bovis
EDSHHVLKLAAGIEPPVELPF

SEQ ID NO: 198398 - protein, 22 aa, Mycobacterium bovis
EDVPGFCKSATLAEIKATDYAL

SEQ ID NO: 198399 - protein, 19 aa, Mycobacterium bovis
EDVRFSGGLATAIADGDSV

SEQ ID NO: 198400 - protein, 21 aa, Mycobacterium bovis
EDWMTRLLLGFGSDVRVLAPE

SEQ ID NO: 198401 - protein, 17 aa, Mycobacterium bovis
EDYDRFWVRDEITGEEY

SEQ ID NO: 198402 - protein, 18 aa, Mycobacterium bovis
EEAARWGLVQKVVAPQDL

SEQ ID NO: 198403 - protein, 22 aa, Mycobacterium bovis
EEADRLAARLARIDDIEGDRDR

SEQ ID NO: 198404 - protein, 21 aa, Mycobacterium bovis
EEAREALADTVVRRGDTPLPV

SEQ ID NO: 198405 - protein, 18 aa, Mycobacterium bovis
EEAVFRIDHYLGKETVQN

SEQ ID NO: 198406 - protein, 28 aa, Mycobacterium bovis
EEDAVFGVFCRRWGVPLIDGGTVRLPRL

SEQ ID NO: 198407 - protein, 18 aa, Mycobacterium bovis
EEGLACAILGVPVADLIE

SEQ ID NO: 198408 - protein, 17 aa, Mycobacterium bovis
EEGLEGAGLSELGAAEA

SEQ ID NO: 198409 - protein, 25 aa, Mycobacterium bovis
EEHRKAFRRTIKWRTGCEGRISHLK

SEQ ID NO: 198410 - protein, 23 aa, Mycobacterium bovis
EEIPPGFSHCLLLSEARVVAAGL

SEQ ID NO: 198411 - protein, 34 aa, Mycobacterium bovis
EEITDRILLLDGLPNYQRIGSLRIGQTLREQFEA

SEQ ID NO: 198412 - protein, 24 aa, Mycobacterium bovis
EEIWDCTYDRWGVDQAEQYLRELQ

SEQ ID NO: 198413 - protein, 21 aa, Mycobacterium bovis
EEKHPTPEWIVVGAGTGGTSA

SEQ ID NO: 198414 - protein, 17 aa, Mycobacterium bovis
EELKKLLYQACMAAART

SEQ ID NO: 198415 - protein, 21 aa, Mycobacterium bovis
EELLRGADMVFVTAGEGGGTG

SEQ ID NO: 198416 - protein, 26 aa, Mycobacterium bovis
EELNEAICPWCIADGSAASRFDATFT

SEQ ID NO: 198417 - protein, 17 aa, Mycobacterium bovis
EELRVGTPRGPNLFENM

SEQ ID NO: 198418 - protein, 22 aa, Mycobacterium bovis
EELTELALGLGRQFVAQGRVRS

SEQ ID NO: 198419 - protein, 21 aa, Mycobacterium bovis
EEPARLLSQFIHGIKTLPVTW

SEQ ID NO: 198420 - protein, 19 aa, Mycobacterium bovis
EERYRICSTVHTKIAVVKS

SEQ ID NO: 198421 - protein, 35 aa, Mycobacterium bovis
EESALFAADLARMYIRYAERHGWAVTVLDETTSDL

SEQ ID NO: 198422 - protein, 23 aa, Mycobacterium bovis
EESRGRLSAVVQRELADEAYHGG

SEQ ID NO: 198423 - protein, 26 aa, Mycobacterium bovis
EEVAPWLDLVRKLGVLAGVLSDELPV

SEQ ID NO: 198424 - protein, 29 aa, Mycobacterium bovis
EEVEVLRLSALRGLFSAVIEDAVTFVNAP

SEQ ID NO: 198425 - protein, 19 aa, Mycobacterium bovis
EEVLACAHAGIPVTVVPGV

SEQ ID NO: 198426 - protein, 35 aa, Mycobacterium bovis
EEVLTELWALIGYRIPTPIPRIGYAEAMRRFGTDK

SEQ ID NO: 198427 - protein, 17 aa, Mycobacterium bovis
EEVPRDGLLRLLVDVQY

SEQ ID NO: 198428 - protein, 22 aa, Mycobacterium bovis
EEVRDRLAASFPKIGPLMDDAR

SEQ ID NO: 198429 - protein, 24 aa, Mycobacterium bovis
EEVREYLAQLGFRTVNEAVGQAGA

SEQ ID NO: 198430 - protein, 24 aa, Mycobacterium bovis
EEVVLRLRALLRRTGVTTVDSGAQ

SEQ ID NO: 198431 - protein, 21 aa, Mycobacterium bovis
EEYCKRRLGLDAALGSIDRSK

SEQ ID NO: 198432 - protein, 17 aa, Mycobacterium bovis
EEYYLSFLLDRANRTYL

SEQ ID NO: 198433 - protein, 29 aa, Mycobacterium bovis
EFAAAFKPPLRWGIRMTGHRFFREYPYRD

SEQ ID NO: 198434 - protein, 18 aa, Mycobacterium bovis
EFAEDWVNLVALAVNEEN

SEQ ID NO: 198435 - protein, 25 aa, Mycobacterium bovis
EFAWLRSRLPTLWTNSYFVATVGGF

SEQ ID NO: 198436 - protein, 22 aa, Mycobacterium bovis
EFDEHLLVRAGHAFQQVTGYHR

SEQ ID NO: 198437 - protein, 22 aa, Mycobacterium bovis
EFDGRIITVPFSFKEIDDDGLI

SEQ ID NO: 198438 - protein, 20 aa, Mycobacterium bovis
EFDIAISFRDAQNIKTVGDV

SEQ ID NO: 198439 - protein, 26 aa, Mycobacterium bovis
EFDSRAIGPGGLFLALPGARADGHDH

SEQ ID NO: 198440 - protein, 17 aa, Mycobacterium bovis
EFFATIRAAGYTRVSLG

SEQ ID NO: 198441 - protein, 19 aa, Mycobacterium bovis
EFGAYPAVIGRELDRYLPF

SEQ ID NO: 198442 - protein, 22 aa, Mycobacterium bovis
EFGRLPEPLAMLSPDEGLLTAG

SEQ ID NO: 198443 - protein, 18 aa, Mycobacterium bovis
EFIAYRYALATGIIDETG

SEQ ID NO: 198444 - protein, 26 aa, Mycobacterium bovis
EFISWEPFTRMAFRFNECSTRAVGAF

SEQ ID NO: 198445 - protein, 19 aa, Mycobacterium bovis
EFLALKVEGILDCAELLVV

SEQ ID NO: 198446 - protein, 20 aa, Mycobacterium bovis
EFLPTGGRVLAVFEPAGPGV

SEQ ID NO: 198447 - protein, 20 aa, Mycobacterium bovis
EFLSAAATDLANLGSTISAA

SEQ ID NO: 198448 - protein, 40 aa, Mycobacterium bovis
EFLSPQVRALWGGRTGRPFPWHSLGEAYLGRRWVKLDATI

SEQ ID NO: 198449 - protein, 17 aa, Mycobacterium bovis
EFLTRWATGELDAADVD

SEQ ID NO: 198450 - protein, 23 aa, Mycobacterium bovis
EFPVLPPEINSVLMYSGAGSSPL

SEQ ID NO: 198451 - protein, 18 aa, Mycobacterium bovis
EFQGGGPHAWYLSDGILA

SEQ ID NO: 198452 - protein, 18 aa, Mycobacterium bovis
EFSRACESLYHFAWDEFC

SEQ ID NO: 198453 - protein, 20 aa, Mycobacterium bovis
EFSRHLKLLAKELEVPVVAI

SEQ ID NO: 198454 - protein, 17 aa, Mycobacterium bovis
EFTEAWTTFATVEKSWA

SEQ ID NO: 198455 - protein, 18 aa, Mycobacterium bovis
EFVAPVVAYLCTEECADN

SEQ ID NO: 198456 - protein, 19 aa, Mycobacterium bovis
EFYFLEMNTRLQVEHPVTE

SEQ ID NO: 198457 - protein, 27 aa, Mycobacterium bovis
EGAEARYLWPSMFAQVADEYDRRYGLD

SEQ ID NO: 198458 - protein, 27 aa, Mycobacterium bovis
EGALVTLDWLGAHGFGRLLQHTVVVLN

SEQ ID NO: 198459 - protein, 17 aa, Mycobacterium bovis
EGALYLRMDDFPARLVV

SEQ ID NO: 198460 - protein, 21 aa, Mycobacterium bovis
EGAMTPGALAIRERVRPPSMT

SEQ ID NO: 198461 - protein, 24 aa, Mycobacterium bovis
EGARRFAAGAGRHGAPAPRAEQGD

SEQ ID NO: 198462 - protein, 20 aa, Mycobacterium bovis
EGAVCTAMLDLYQNEGIIAE

SEQ ID NO: 198463 - protein, 18 aa, Mycobacterium bovis
EGDPLWTADGKQWGLEYL

SEQ ID NO: 198464 - protein, 22 aa, Mycobacterium bovis
EGELRPQLLDRFGLTVDVQASR

SEQ ID NO: 198465 - protein, 22 aa, Mycobacterium bovis
EGEVRQGVLALSAWSESDTPEL

SEQ ID NO: 198466 - protein, 19 aa, Mycobacterium bovis
EGFARWLRESAAVGVTDTT

SEQ ID NO: 198467 - protein, 19 aa, Mycobacterium bovis
EGFLAEPWWCRMVVMSAER

SEQ ID NO: 198468 - protein, 31 aa, Mycobacterium bovis
EGFMRDVPCPVCAGTRLKPEILAVTLAGESK

SEQ ID NO: 198469 - protein, 19 aa, Mycobacterium bovis
EGFVGLRVVPWLWGAPPTD

SEQ ID NO: 198470 - protein, 31 aa, Mycobacterium bovis
EGGIGALAGKSGFGGFGGLLLGADGYNAPES

SEQ ID NO: 198471 - protein, 27 aa, Mycobacterium bovis
EGGLMPGFGGAPWVGGHWGLGGEGHSG

SEQ ID NO: 198472 - protein, 22 aa, Mycobacterium bovis
EGGPRPTHFAGVLTVVLKLLQI

SEQ ID NO: 198473 - protein, 25 aa, Mycobacterium bovis
EGHRLRADAILLRRTDRLPFAEPPD

SEQ ID NO: 198474 - protein, 23 aa, Mycobacterium bovis
EGIGRPRVEPSFLPGVVDRMVAV

SEQ ID NO: 198475 - protein, 23 aa, Mycobacterium bovis
EGIIAAAAIRCMGGAIQAQLAPR

SEQ ID NO: 198476 - protein, 18 aa, Mycobacterium bovis
EGKIRTVYEPVVKTTIIA

SEQ ID NO: 198477 - protein, 18 aa, Mycobacterium bovis
EGKVKVELALARGKQARD

SEQ ID NO: 198478 - protein, 18 aa, Mycobacterium bovis
EGLAAVLRGAADQARAAV

SEQ ID NO: 198479 - protein, 23 aa, Mycobacterium bovis
EGLEVTPVPGVVVHLPIAQVGPQ

SEQ ID NO: 198480 - protein, 19 aa, Mycobacterium bovis
EGLGPFPTDRGWALRELFD

SEQ ID NO: 198481 - protein, 22 aa, Mycobacterium bovis
EGLPPGSALLVVKRGPNAGSRF

SEQ ID NO: 198482 - protein, 24 aa, Mycobacterium bovis
EGLTRAKARLRWREKELVGVGLAR

SEQ ID NO: 198483 - protein, 24 aa, Mycobacterium bovis
EGPAALPWGDLGVDVVVESTGLFT

SEQ ID NO: 198484 - protein, 25 aa, Mycobacterium bovis
EGPELRSDVRLDFKPVVQTRYEPKE

SEQ ID NO: 198485 - protein, 18 aa, Mycobacterium bovis
EGPKGGPGMREMLAITGA

SEQ ID NO: 198486 - protein, 25 aa, Mycobacterium bovis
EGPLPQTRFVLRKALAAHLPVILVV

SEQ ID NO: 198487 - protein, 26 aa, Mycobacterium bovis
EGPMAARLGLAGWPRAAEESIVARDA

SEQ ID NO: 198488 - protein, 21 aa, Mycobacterium bovis
EGPRGVSAFVVEKGTPGLSFG

SEQ ID NO: 198489 - protein, 26 aa, Mycobacterium bovis
EGPSYTRPASWRGLDVPEVLLSGDHA

SEQ ID NO: 198490 - protein, 21 aa, Mycobacterium bovis
EGPWLRTGDLGVIFEGELFIT

SEQ ID NO: 198491 - protein, 20 aa, Mycobacterium bovis
EGRDMLALTSSQWDITDPAA

SEQ ID NO: 198492 - protein, 20 aa, Mycobacterium bovis
EGRLRQSSWRGLRPDKKPSE

SEQ ID NO: 198493 - protein, 18 aa, Mycobacterium bovis
EGRLRRFDCSQMTDGGAG

SEQ ID NO: 198494 - protein, 23 aa, Mycobacterium bovis
EGTEFRPGVNVGVDISAEKLRAD

SEQ ID NO: 198495 - protein, 18 aa, Mycobacterium bovis
EGVDVPRLSVGVYATNAS

SEQ ID NO: 198496 - protein, 26 aa, Mycobacterium bovis
EGVEGLRMTWGRAVILEAMRRYLQQR

SEQ ID NO: 198497 - protein, 17 aa, Mycobacterium bovis
EGVRLFRFDRIVDAAEL

SEQ ID NO: 198498 - protein, 24 aa, Mycobacterium bovis
EGVSGVREAACYEIPDEEFGALVG

SEQ ID NO: 198499 - protein, 27 aa, Mycobacterium bovis
EGVSRAELIRLLLNRALTTAGDDLASD

SEQ ID NO: 198500 - protein, 21 aa, Mycobacterium bovis
EGYPSIGCAPCTAKPAEGADP

SEQ ID NO: 198501 - protein, 18 aa, Mycobacterium bovis
EHAIVQFVKAICSPMALA

SEQ ID NO: 198502 - protein, 19 aa, Mycobacterium bovis
EHALALLLAASRQIPAADA

SEQ ID NO: 198503 - protein, 20 aa, Mycobacterium bovis
EHDPRLAAAERSELDALITC

SEQ ID NO: 198504 - protein, 26 aa, Mycobacterium bovis
EHGASSEAARAWWGNFLAQKANEAGI

SEQ ID NO: 198505 - protein, 22 aa, Mycobacterium bovis
EHGGKYGSHWLVDNRPDLFDGI

SEQ ID NO: 198506 - protein, 17 aa, Mycobacterium bovis
EHHAVLDSVNWLVEHEG

SEQ ID NO: 198507 - protein, 21 aa, Mycobacterium bovis
EHKTRIRGASFVDRDGNELFR

SEQ ID NO: 198508 - protein, 25 aa, Mycobacterium bovis
EHLRPPESFPGWLHDGDVVTLQVEG

SEQ ID NO: 198509 - protein, 25 aa, Mycobacterium bovis
EHLSALRAIPRLSVVRPADANETAY

SEQ ID NO: 198510 - protein, 23 aa, Mycobacterium bovis
EHPFPVWTERGGPATIVPMFLLY

SEQ ID NO: 198511 - protein, 26 aa, Mycobacterium bovis
EHPGKWRVVFFWPKDFTFVCPTEIAA

SEQ ID NO: 198512 - protein, 20 aa, Mycobacterium bovis
EHVADTFIAMGWELAEGPEV

SEQ ID NO: 198513 - protein, 25 aa, Mycobacterium bovis
EIAESPIDWDIAWPAGDLQVNLTPA

SEQ ID NO: 198514 - protein, 22 aa, Mycobacterium bovis
EIAFPARLPAPLVRSTITAIDW

SEQ ID NO: 198515 - protein, 20 aa, Mycobacterium bovis
EIAGIGAGVTWAADNRTVYY

SEQ ID NO: 198516 - protein, 25 aa, Mycobacterium bovis
EIAQTVARWLVLYLRRPGGQTQFAA

SEQ ID NO: 198517 - protein, 21 aa, Mycobacterium bovis
EIARRAGVGAGTVYRHFPTKE

SEQ ID NO: 198518 - protein, 28 aa, Mycobacterium bovis
EICEDPRFSIARLSLLDRGMVFVVAHVR

SEQ ID NO: 198519 - protein, 30 aa, Mycobacterium bovis
EIDAAEIYVPFSWFEPMWLENLGFAREGEG

SEQ ID NO: 198520 - protein, 19 aa, Mycobacterium bovis
EIDDAFRWSEENRNLQRKA

SEQ ID NO: 198521 - protein, 29 aa, Mycobacterium bovis
EIDGAAVDRIWRAARHWYRAGMHPAIQLC

SEQ ID NO: 198522 - protein, 22 aa, Mycobacterium bovis
EIEALGYGAVWVGGSPPAALSW

SEQ ID NO: 198523 - protein, 17 aa, Mycobacterium bovis
EIEALYYLHPLTGEVIR

SEQ ID NO: 198524 - protein, 21 aa, Mycobacterium bovis
EIEPRSGRHLGNFPQAFTHLA

SEQ ID NO: 198525 - protein, 23 aa, Mycobacterium bovis
EIGNTEWPKWETVMAADPVDPAE

SEQ ID NO: 198526 - protein, 30 aa, Mycobacterium bovis
EIGVEAGLIGPEWFPDSYPWVPSINPGLNF

SEQ ID NO: 198527 - protein, 24 aa, Mycobacterium bovis
EIHDRMPLLLAEEDWDDWLNPDAP

SEQ ID NO: 198528 - protein, 17 aa, Mycobacterium bovis
EIKFRSVLEEPTYEDGI

SEQ ID NO: 198529 - protein, 26 aa, Mycobacterium bovis
EILATEILDPLGFRWTNFGVAERDVP

SEQ ID NO: 198530 - protein, 20 aa, Mycobacterium bovis
EILHAAAVEAARVAGAGRGS

SEQ ID NO: 198531 - protein, 24 aa, Mycobacterium bovis
EILRIQALCARYCLTIDTQDGEGW

SEQ ID NO: 198532 - protein, 24 aa, Mycobacterium bovis
EILSELQPSLVIEFGTRYGGSAVY

SEQ ID NO: 198533 - protein, 17 aa, Mycobacterium bovis
EIMGRSYGGGILELEPR

SEQ ID NO: 198534 - protein, 20 aa, Mycobacterium bovis
EINSALIFAGAGPEPMAAAA

SEQ ID NO: 198535 - protein, 20 aa, Mycobacterium bovis
EINSLRMFIGAGTAPMLAAA

SEQ ID NO: 198536 - protein, 21 aa, Mycobacterium bovis
EIPANRPGRAVSMEKHHLMIG

SEQ ID NO: 198537 - protein, 20 aa, Mycobacterium bovis
EIPGAWRLPLSGDEADADIA

SEQ ID NO: 198538 - protein, 23 aa, Mycobacterium bovis
EIPPRRLRYAPGQFLTLRVPSER

SEQ ID NO: 198539 - protein, 17 aa, Mycobacterium bovis
EIRAHALAIGDDLVGRG

SEQ ID NO: 198540 - protein, 17 aa, Mycobacterium bovis
EIRAVGIGELLARIDRL

SEQ ID NO: 198541 - protein, 24 aa, Mycobacterium bovis
EIVCAGRPLLEWCVRRRLDDEPRI

SEQ ID NO: 198542 - protein, 17 aa, Mycobacterium bovis
EIVDKWRAAGVRMVDER

SEQ ID NO: 198543 - protein, 19 aa, Mycobacterium bovis
EIVDPRPLTLLPEPNPGDL

SEQ ID NO: 198544 - protein, 33 aa, Mycobacterium bovis
EIVERYDLVLSFHCKQRFPAALIDGVRCVNVHP

SEQ ID NO: 198545 - protein, 19 aa, Mycobacterium bovis
EIVGRFLALLELYRTRAVA

SEQ ID NO: 198546 - protein, 17 aa, Mycobacterium bovis
EIVRPWADAVWDTGIEF

SEQ ID NO: 198547 - protein, 18 aa, Mycobacterium bovis
EIVVAAATDLAGIGSAIS

SEQ ID NO: 198548 - protein, 24 aa, Mycobacterium bovis
EIVYRAPTLMSCYWNNPEATAEAF

SEQ ID NO: 198549 - protein, 30 aa, Mycobacterium bovis
EIYDTGHLEACLRLWAEDLLAEPLQFSIVL

SEQ ID NO: 198550 - protein, 18 aa, Mycobacterium bovis
EKACAWDPATGSRRRYPW

SEQ ID NO: 198551 - protein, 21 aa, Mycobacterium bovis
EKAYGAGPCSGHLTDIEHFVF

SEQ ID NO: 198552 - protein, 24 aa, Mycobacterium bovis
EKCREYRITPVFVEVREGQSTRHG

SEQ ID NO: 198553 - protein, 17 aa, Mycobacterium bovis
EKDGCGDLDFDWLDDGW

SEQ ID NO: 198554 - protein, 20 aa, Mycobacterium bovis
EKFSPFSGFGYFTSGLSGFA

SEQ ID NO: 198555 - protein, 18 aa, Mycobacterium bovis
EKGPRLGVLGVVVEIDGR

SEQ ID NO: 198556 - protein, 17 aa, Mycobacterium bovis
EKGRWYLVGHDRDRDAT

SEQ ID NO: 198557 - protein, 29 aa, Mycobacterium bovis
EKHDLAFGTSRWSSKLVHGGLRYLASGNV

SEQ ID NO: 198558 - protein, 19 aa, Mycobacterium bovis
EKIGALAITEPGGGSDVGH

SEQ ID NO: 198559 - protein, 23 aa, Mycobacterium bovis
EKLATLRPVFGVKAGDATMTAGN

SEQ ID NO: 198560 - protein, 17 aa, Mycobacterium bovis
EKLEAFANFGFPESHAL

SEQ ID NO: 198561 - protein, 20 aa, Mycobacterium bovis
EKLELRRVAIFDGTVEAYLH

SEQ ID NO: 198562 - protein, 18 aa, Mycobacterium bovis
EKLLELLPNRVITDSIGS

SEQ ID NO: 198563 - protein, 19 aa, Mycobacterium bovis
EKLRKAAGLLNLDDLAESA

SEQ ID NO: 198564 - protein, 17 aa, Mycobacterium bovis
EKMEKAVAVARDDLSTI

SEQ ID NO: 198565 - protein, 24 aa, Mycobacterium bovis
EKPGRREGWDYPDMARESGTKALR

SEQ ID NO: 198566 - protein, 17 aa, Mycobacterium bovis
EKPRIPDVCDALGVPWL

SEQ ID NO: 198567 - protein, 21 aa, Mycobacterium bovis
EKPSLPAHIGMTLRSRGFTDQ

SEQ ID NO: 198568 - protein, 35 aa, Mycobacterium bovis
EKRREMAYEGKIDWAFGELLALGSLVAEGKLVRLS

SEQ ID NO: 198569 - protein, 30 aa, Mycobacterium bovis
EKRSWLRARGLKIFRWWAGPSVVVTTRRGT

SEQ ID NO: 198570 - protein, 22 aa, Mycobacterium bovis
EKSASPVWCRVGARCDHRGKRS

SEQ ID NO: 198571 - protein, 20 aa, Mycobacterium bovis
EKWQCDGCSITHQRDDNAAI

SEQ ID NO: 198572 - protein, 24 aa, Mycobacterium bovis
ELAELRLALMHGRLSADDKDAAMA

SEQ ID NO: 198573 - protein, 19 aa, Mycobacterium bovis
ELAIKTGRPLIGINDGAGA

SEQ ID NO: 198574 - protein, 17 aa, Mycobacterium bovis
ELAKALADFLFDDERAM

SEQ ID NO: 198575 - protein, 19 aa, Mycobacterium bovis
ELAPGRRALVRTGVAVAVP

SEQ ID NO: 198576 - protein, 24 aa, Mycobacterium bovis
ELAPRGVQVVGVYVGLVDTDMGRF

SEQ ID NO: 198577 - protein, 23 aa, Mycobacterium bovis
ELAPRPTTPFAQALRLALIDAAP

SEQ ID NO: 198578 - protein, 25 aa, Mycobacterium bovis
ELASCPPILVLTGRPDDTWLASWSR

SEQ ID NO: 198579 - protein, 20 aa, Mycobacterium bovis
ELATLMAHVKLGLKEEVLAT

SEQ ID NO: 198580 - protein, 25 aa, Mycobacterium bovis
ELAYPLMSWPRRGVFGGPTPAPRGL

SEQ ID NO: 198581 - protein, 21 aa, Mycobacterium bovis
ELCDEFDALLIFDEVQTGCGL

SEQ ID NO: 198582 - protein, 22 aa, Mycobacterium bovis
ELDDCAFPLLSGVEIGSDPQKI

SEQ ID NO: 198583 - protein, 19 aa, Mycobacterium bovis
ELDIPVVAGGVLDHRTALH

SEQ ID NO: 198584 - protein, 20 aa, Mycobacterium bovis
ELDRRLRTGPTPWSGSETLP

SEQ ID NO: 198585 - protein, 17 aa, Mycobacterium bovis
ELDSAGDLGDWGGPDAL

SEQ ID NO: 198586 - protein, 20 aa, Mycobacterium bovis
ELDVAWMIFAHRVFQELAGL

SEQ ID NO: 198587 - protein, 21 aa, Mycobacterium bovis
ELEASLLLYFGGVSRLSSEVI

SEQ ID NO: 198588 - protein, 20 aa, Mycobacterium bovis
ELEAVLAAGAQRAHDVASKT

SEQ ID NO: 198589 - protein, 18 aa, Mycobacterium bovis
ELEELLKERLELIRSRRR

SEQ ID NO: 198590 - protein, 18 aa, Mycobacterium bovis
ELEKLVCGERVPFAALRT

SEQ ID NO: 198591 - protein, 21 aa, Mycobacterium bovis
ELERVLARSAGILGIELGADA

SEQ ID NO: 198592 - protein, 22 aa, Mycobacterium bovis
ELFSAVRFDIGWTASSDDGLPP

SEQ ID NO: 198593 - protein, 29 aa, Mycobacterium bovis
ELGANHALHGVLMATNFFGINTIPIALNE

SEQ ID NO: 198594 - protein, 36 aa, Mycobacterium bovis
ELGDLHWFYVYSGVMWACVFMRTGARRVHFGEIEKP

SEQ ID NO: 198595 - protein, 20 aa, Mycobacterium bovis
ELGDLLLQVLFHARIAEDAS

SEQ ID NO: 198596 - protein, 17 aa, Mycobacterium bovis
ELGEFGIRVNSIHPYSV

SEQ ID NO: 198597 - protein, 25 aa, Mycobacterium bovis
ELGRSGRLKGAGFYEYADGKRSGLW

SEQ ID NO: 198598 - protein, 17 aa, Mycobacterium bovis
ELGTFLAECPPIAVLTS

SEQ ID NO: 198599 - protein, 27 aa, Mycobacterium bovis
ELGYKGLLAPLTFICVFGYKAQAAFFK

SEQ ID NO: 198600 - protein, 20 aa, Mycobacterium bovis
ELGYKYSHRIPMQMHNKVTI

SEQ ID NO: 198601 - protein, 29 aa, Mycobacterium bovis
ELHFLGATLWRSGIQRVLRGFVERDDWCE

SEQ ID NO: 198602 - protein, 17 aa, Mycobacterium bovis
ELHRRWLQDTSITPPGG

SEQ ID NO: 198603 - protein, 26 aa, Mycobacterium bovis
ELIDFWRFNVAFARQILEQQPISGPG

SEQ ID NO: 198604 - protein, 25 aa, Mycobacterium bovis
ELIDGARMEIDWTGCRDFDELIVYC

SEQ ID NO: 198605 - protein, 17 aa, Mycobacterium bovis
ELIGFAARQRSASVGSH

SEQ ID NO: 198606 - protein, 18 aa, Mycobacterium bovis
ELINRGGEKISPERVEGV

SEQ ID NO: 198607 - protein, 28 aa, Mycobacterium bovis
ELIRVRISPAWLRLDARFGSVYRHRGHA

SEQ ID NO: 198608 - protein, 26 aa, Mycobacterium bovis
ELKARADALGRAFIDQGITFSLSGQE

SEQ ID NO: 198609 - protein, 25 aa, Mycobacterium bovis
ELKLDRKIAERRVFPAVDVNPSGTR

SEQ ID NO: 198610 - protein, 19 aa, Mycobacterium bovis
ELLARVGLSRANLNYSGGG

SEQ ID NO: 198611 - protein, 21 aa, Mycobacterium bovis
ELLEFPGGILGVALNLDEHSV

SEQ ID NO: 198612 - protein, 21 aa, Mycobacterium bovis
ELLEVCRRHGALLLVDEAHGL

SEQ ID NO: 198613 - protein, 20 aa, Mycobacterium bovis
ELLGGIPLAGFFAAGEIGPI

SEQ ID NO: 198614 - protein, 19 aa, Mycobacterium bovis
ELLGIPWVELNPHPLYLPS

SEQ ID NO: 198615 - protein, 33 aa, Mycobacterium bovis
ELLGTRYLPPFAYFMDWPNAFQVLAGDFVTTDD

SEQ ID NO: 198616 - protein, 25 aa, Mycobacterium bovis
ELLIKAEAIGVNFIDTYFRSGQYPR

SEQ ID NO: 198617 - protein, 18 aa, Mycobacterium bovis
ELLQLPVDVAYEGLLTDD

SEQ ID NO: 198618 - protein, 18 aa, Mycobacterium bovis
ELLQRPGQRLAYNGRLLE

SEQ ID NO: 198619 - protein, 28 aa, Mycobacterium bovis
ELLSVAAGMPFPLFVKAVAGGGGRGMRR

SEQ ID NO: 198620 - protein, 22 aa, Mycobacterium bovis
ELLVRGGVVFSGYWRNEQATTE

SEQ ID NO: 198621 - protein, 22 aa, Mycobacterium bovis
ELNLHLACYRAFDDIGSVIHSH

SEQ ID NO: 198622 - protein, 23 aa, Mycobacterium bovis
ELNSLRMFTGAGSAPMLAAAVAW

SEQ ID NO: 198623 - protein, 19 aa, Mycobacterium bovis
ELNVMGAMQLFAACQKAPS

SEQ ID NO: 198624 - protein, 29 aa, Mycobacterium bovis
ELNVPRRDLRMLAARLGSDVPFALHGGTA

SEQ ID NO: 198625 - protein, 25 aa, Mycobacterium bovis
ELPGDLAWQPPLWRALVTTVGADPP

SEQ ID NO: 198626 - protein, 21 aa, Mycobacterium bovis
ELPGDTFVLAVQWHPEKSLDD

SEQ ID NO: 198627 - protein, 19 aa, Mycobacterium bovis
ELPPGLADFDLSKLKFPGK

SEQ ID NO: 198628 - protein, 24 aa, Mycobacterium bovis
ELPSRLAANPSIAGWLRELEAVCT

SEQ ID NO: 198629 - protein, 21 aa, Mycobacterium bovis
ELPVLPRQRVLVISTGSELAS

SEQ ID NO: 198630 - protein, 23 aa, Mycobacterium bovis
ELQFGTNHLGHFALTGLVLDHML

SEQ ID NO: 198631 - protein, 24 aa, Mycobacterium bovis
ELQHLDIGNALALGNVGGVNLGLA

SEQ ID NO: 198632 - protein, 25 aa, Mycobacterium bovis
ELQWPAMRISHCRPPGSDRDVVLMC

SEQ ID NO: 198633 - protein, 17 aa, Mycobacterium bovis
ELRECVGSELLTEPEQL

SEQ ID NO: 198634 - protein, 22 aa, Mycobacterium bovis
ELREKIGAVAMGRVLTLIIAPD

SEQ ID NO: 198635 - protein, 20 aa, Mycobacterium bovis
ELRIGLATAEDIRQWSYGEV

SEQ ID NO: 198636 - protein, 22 aa, Mycobacterium bovis
ELRRLIPPWVTLGSRLAALPKP

SEQ ID NO: 198637 - protein, 22 aa, Mycobacterium bovis
ELRRRVKAMSYGLAYGLSAYGL

SEQ ID NO: 198638 - protein, 20 aa, Mycobacterium bovis
ELRSYFATLMTPERREALSS

SEQ ID NO: 198639 - protein, 21 aa, Mycobacterium bovis
ELSASPGFRRANLPPLNVPLA

SEQ ID NO: 198640 - protein, 24 aa, Mycobacterium bovis
ELSDLPGAVPRMYVVTRGAQRVLA

SEQ ID NO: 198641 - protein, 17 aa, Mycobacterium bovis
ELSEICGHIASLPATAV

SEQ ID NO: 198642 - protein, 24 aa, Mycobacterium bovis
ELSENLPGYIFSGVAPVVTEMLWD

SEQ ID NO: 198643 - protein, 25 aa, Mycobacterium bovis
ELSKELRPWVPVVSLVKGLEQGTNM

SEQ ID NO: 198644 - protein, 24 aa, Mycobacterium bovis
ELSRAVFSKGIFPAVDPLASSSTI

SEQ ID NO: 198645 - protein, 20 aa, Mycobacterium bovis
ELTAALGIGAFADKTLVHSG

SEQ ID NO: 198646 - protein, 24 aa, Mycobacterium bovis
ELTAEQRGTVALMHGEREFPSFQA

SEQ ID NO: 198647 - protein, 25 aa, Mycobacterium bovis
ELTEKGRALAIAVMRKHRLAERLLV

SEQ ID NO: 198648 - protein, 21 aa, Mycobacterium bovis
ELTPYRGAWCGNDVWRGALPP

SEQ ID NO: 198649 - protein, 21 aa, Mycobacterium bovis
ELTRVRFGALDLRIDTKPDLT

SEQ ID NO: 198650 - protein, 30 aa, Mycobacterium bovis
ELVIPVCTRLGLSPPDVWTLSKLVRHHLLL

SEQ ID NO: 198651 - protein, 19 aa, Mycobacterium bovis
ELWFGAHPGDPAWLQTPHG

SEQ ID NO: 198652 - protein, 25 aa, Mycobacterium bovis
ELWPLRPDVRTLLCSSVMGVWGGHG

SEQ ID NO: 198653 - protein, 20 aa, Mycobacterium bovis
ELYITGRIADLLTIDGRNHY

SEQ ID NO: 198654 - protein, 19 aa, Mycobacterium bovis
EMAFKIAGSQVLKKAAALA

SEQ ID NO: 198655 - protein, 18 aa, Mycobacterium bovis
EMDPSGAGKWLLISDCAA

SEQ ID NO: 198656 - protein, 18 aa, Mycobacterium bovis
EMGLLGFEEYLEAKLIAT

SEQ ID NO: 198657 - protein, 19 aa, Mycobacterium bovis
EMHSRSGLIDEVKASTVDL

SEQ ID NO: 198658 - protein, 21 aa, Mycobacterium bovis
EMLGAAATDLASIGSAISTAN

SEQ ID NO: 198659 - protein, 21 aa, Mycobacterium bovis
EMLTMGFADDVERILSETPEY

SEQ ID NO: 198660 - protein, 25 aa, Mycobacterium bovis
EMLTTAATDLAKIGSTITAANTAAA

SEQ ID NO: 198661 - protein, 23 aa, Mycobacterium bovis
EMNPNGGMLARFPDLTLPTLDLT

SEQ ID NO: 198662 - protein, 20 aa, Mycobacterium bovis
EMQGRIAGSRLEFFESSSHM

SEQ ID NO: 198663 - protein, 18 aa, Mycobacterium bovis
EMRLPWDATKQRRFDALM

SEQ ID NO: 198664 - protein, 20 aa, Mycobacterium bovis
EMTVLVGGLRVLGANYKRLP

SEQ ID NO: 198665 - protein, 24 aa, Mycobacterium bovis
ENAIWKARTQGVGYLDLTGCMALG

SEQ ID NO: 198666 - protein, 23 aa, Mycobacterium bovis
ENAIWPDLFIAGGGISRKADKWV

SEQ ID NO: 198667 - protein, 29 aa, Mycobacterium bovis
ENGQRLAATIPRARFEVIEGARTFSMVDS

SEQ ID NO: 198668 - protein, 31 aa, Mycobacterium bovis
ENHRKRIGELWARFSAVAADNPHAWIRNPVT

SEQ ID NO: 198669 - protein, 17 aa, Mycobacterium bovis
ENIREVHRADLIGQHIG

SEQ ID NO: 198670 - protein, 26 aa, Mycobacterium bovis
ENLFFKEKRYDLARVGRYKVNKKLGL

SEQ ID NO: 198671 - protein, 19 aa, Mycobacterium bovis
ENLREHRRGLLVDLVTNVS

SEQ ID NO: 198672 - protein, 18 aa, Mycobacterium bovis
ENLRRWSGMHRRDGMAGW

SEQ ID NO: 198673 - protein, 17 aa, Mycobacterium bovis
ENMPTGGTLLRWSAPLR

SEQ ID NO: 198674 - protein, 17 aa, Mycobacterium bovis
ENPAGTVGEIWVQGDNV

SEQ ID NO: 198675 - protein, 30 aa, Mycobacterium bovis
ENRVRHVPVLDGKKLIGIVSIGDVVKSRMG

SEQ ID NO: 198676 - protein, 29 aa, Mycobacterium bovis
ENVPISPIWLCPLRLRDHAGWPLYPIRPD

SEQ ID NO: 198677 - protein, 18 aa, Mycobacterium bovis
EPAFFGVRPHVVLKGGAI

SEQ ID NO: 198678 - protein, 32 aa, Mycobacterium bovis
EPANGPPPPGRWVRRKPAAAARLDAARAALTE

SEQ ID NO: 198679 - protein, 24 aa, Mycobacterium bovis
EPDLACSGLRFAYDGLIPLPDGVR

SEQ ID NO: 198680 - protein, 20 aa, Mycobacterium bovis
EPDLKLGRGGLRDVQLLDAL

SEQ ID NO: 198681 - protein, 30 aa, Mycobacterium bovis
EPDWVNTIFLSTRFRAWRVGGYNEYLYTFF

SEQ ID NO: 198682 - protein, 34 aa, Mycobacterium bovis
EPELRAIFINSVWAPRLRIVESILQAGVRSGEID

SEQ ID NO: 198683 - protein, 21 aa, Mycobacterium bovis
EPEMLDRLDIVVASVHSKLSM

SEQ ID NO: 198684 - protein, 23 aa, Mycobacterium bovis
EPEPHWGPFGGAAPVSAGVGHAA

SEQ ID NO: 198685 - protein, 34 aa, Mycobacterium bovis
EPGDRLLDVGCGWGGMVRYAARRGVRVIGATLSA

SEQ ID NO: 198686 - protein, 17 aa, Mycobacterium bovis
EPGHGLALAALGLDPIV

SEQ ID NO: 198687 - protein, 27 aa, Mycobacterium bovis
EPGVPGRTDCKWGAYLDNVGDFDPEFF

SEQ ID NO: 198688 - protein, 19 aa, Mycobacterium bovis
EPHGAGLANSGFRRDPLVA

SEQ ID NO: 198689 - protein, 22 aa, Mycobacterium bovis
EPHRVLTLPLVRAGQPVADTSL

SEQ ID NO: 198690 - protein, 25 aa, Mycobacterium bovis
EPHYGPPPLLLRMVEAGQLGKKSGR

SEQ ID NO: 198691 - protein, 24 aa, Mycobacterium bovis
EPITDSWYLTSIRAGLEPWSDGVG

SEQ ID NO: 198692 - protein, 27 aa, Mycobacterium bovis
EPKVPRAARVAVRWLRAVALDRIGDVE

SEQ ID NO: 198693 - protein, 24 aa, Mycobacterium bovis
EPKWDGFRSICFRDGDQVELGSRN

SEQ ID NO: 198694 - protein, 25 aa, Mycobacterium bovis
EPLPEGSGFEFLDKVVGGAVPRQFI

SEQ ID NO: 198695 - protein, 22 aa, Mycobacterium bovis
EPMIPIYIFYSMFGFQRTGDSF

SEQ ID NO: 198696 - protein, 20 aa, Mycobacterium bovis
EPMLEEFARVAARVQAREPQ

SEQ ID NO: 198697 - protein, 31 aa, Mycobacterium bovis
EPNLKPGDALFFGHGLNVHFGLIKPPADVAV

SEQ ID NO: 198698 - protein, 25 aa, Mycobacterium bovis
EPPFALCGPRGTLIARGVRTRYCDV

SEQ ID NO: 198699 - protein, 17 aa, Mycobacterium bovis
EPRAWETLQRGWNVVGL

SEQ ID NO: 198700 - protein, 19 aa, Mycobacterium bovis
EPRFIKLTGELASEQTLSF

SEQ ID NO: 198701 - protein, 19 aa, Mycobacterium bovis
EPRYAALVRDCMDTADPRF

SEQ ID NO: 198702 - protein, 25 aa, Mycobacterium bovis
EPSEAVVAAARWARSELDYIPGTTS

SEQ ID NO: 198703 - protein, 19 aa, Mycobacterium bovis
EPVEWKRDQALKFGATHVY

SEQ ID NO: 198704 - protein, 25 aa, Mycobacterium bovis
EPVLKLLKITGDWQKFKGLPGAQGR

SEQ ID NO: 198705 - protein, 18 aa, Mycobacterium bovis
EPVLPFTVVAARLADAAD

SEQ ID NO: 198706 - protein, 19 aa, Mycobacterium bovis
EPYGVEWTKPVARFEEALA

SEQ ID NO: 198707 - protein, 19 aa, Mycobacterium bovis
EQANINWGKAGRMRWKGKR

SEQ ID NO: 198708 - protein, 17 aa, Mycobacterium bovis
EQDHARFAKIFDVNLWA

SEQ ID NO: 198709 - protein, 26 aa, Mycobacterium bovis
EQDQPWMISELDLRQMLHVTPGTVLV

SEQ ID NO: 198710 - protein, 24 aa, Mycobacterium bovis
EQEYKEFYKHVAHAWDDPLEIIAM

SEQ ID NO: 198711 - protein, 17 aa, Mycobacterium bovis
EQFGRLDIVVANAGVLG

SEQ ID NO: 198712 - protein, 25 aa, Mycobacterium bovis
EQFVKRLGTHAAIFTVPNFLELDYW

SEQ ID NO: 198713 - protein, 25 aa, Mycobacterium bovis
EQGDPRFSDVSSRIFGTPHDVDVGA

SEQ ID NO: 198714 - protein, 23 aa, Mycobacterium bovis
EQIDPRWAKLVEMLGPESDTLRG

SEQ ID NO: 198715 - protein, 18 aa, Mycobacterium bovis
EQIDRGQGFLALVDYAHK

SEQ ID NO: 198716 - protein, 24 aa, Mycobacterium bovis
EQIIAVDGAHLWHPYSSIGREAVS

SEQ ID NO: 198717 - protein, 26 aa, Mycobacterium bovis
EQLELLVGLVCLQAAAVLGRPSAEDV

SEQ ID NO: 198718 - protein, 24 aa, Mycobacterium bovis
EQLGWPRVRIHYRSGTRIPTGATI

SEQ ID NO: 198719 - protein, 20 aa, Mycobacterium bovis
EQLHDLEWVNALGALTGNMA

SEQ ID NO: 198720 - protein, 18 aa, Mycobacterium bovis
EQLIRCNGALRLPELDLA

SEQ ID NO: 198721 - protein, 24 aa, Mycobacterium bovis
EQLPAREALAWGLISAVYPDSDFE

SEQ ID NO: 198722 - protein, 26 aa, Mycobacterium bovis
EQLPVYRPPLDMARLFNQPELGPTDD

SEQ ID NO: 198723 - protein, 22 aa, Mycobacterium bovis
EQLVEFRWELAVGDDPLSEEEI

SEQ ID NO: 198724 - protein, 22 aa, Mycobacterium bovis
EQMWAADVAAMVGYHSGASAAA

SEQ ID NO: 198725 - protein, 25 aa, Mycobacterium bovis
EQMWAQDVAAMFGYHAGASAAVSAL

SEQ ID NO: 198726 - protein, 19 aa, Mycobacterium bovis
EQRDRWWSDFDGLAPTAVE

SEQ ID NO: 198727 - protein, 23 aa, Mycobacterium bovis
EQRPSFRRTVKWRTGSEGRISTL

SEQ ID NO: 198728 - protein, 18 aa, Mycobacterium bovis
EQTFLLRLLGGELRQGAK

SEQ ID NO: 198729 - protein, 17 aa, Mycobacterium bovis
EQTFSHLDLPSWDLDPV

SEQ ID NO: 198730 - protein, 18 aa, Mycobacterium bovis
EQVMTARGLALVRDDSLT

SEQ ID NO: 198731 - protein, 17 aa, Mycobacterium bovis
EQWLKTTGLNTLRPDFE

SEQ ID NO: 198732 - protein, 18 aa, Mycobacterium bovis
EQYISVGVGRDYTDVSPL

SEQ ID NO: 198733 - protein, 26 aa, Mycobacterium bovis
ERAHLLPVFRLRYLPTPLGLHHPIWV

SEQ ID NO: 198734 - protein, 19 aa, Mycobacterium bovis
ERAPAPALHRLTVGALRAV

SEQ ID NO: 198735 - protein, 18 aa, Mycobacterium bovis
ERAPDLQVAMPILPQQAL

SEQ ID NO: 198736 - protein, 22 aa, Mycobacterium bovis
ERARCIAGGLAAAGVGLGDVVG

SEQ ID NO: 198737 - protein, 17 aa, Mycobacterium bovis
ERARIMFMIGTLTPDRV

SEQ ID NO: 198738 - protein, 17 aa, Mycobacterium bovis
ERARQAGAVGLVVTTDW

SEQ ID NO: 198739 - protein, 24 aa, Mycobacterium bovis
ERATPMPIPIGLWMFQTKLHVNAG

SEQ ID NO: 198740 - protein, 20 aa, Mycobacterium bovis
ERCNYVKEAPGWRVSTDTDE

SEQ ID NO: 198741 - protein, 24 aa, Mycobacterium bovis
ERDRPRISLGPLPVAEHLRDCTAG

SEQ ID NO: 198742 - protein, 24 aa, Mycobacterium bovis
ERDVFPGGCFFAAAAADVDSQPGP

SEQ ID NO: 198743 - protein, 26 aa, Mycobacterium bovis
ERDWAPKAYGAWQLHRATADQPLDWF

SEQ ID NO: 198744 - protein, 25 aa, Mycobacterium bovis
ERFLARPGLVYLLWPVALGYLRVVT

SEQ ID NO: 198745 - protein, 22 aa, Mycobacterium bovis
ERFRTRYAIPIERHGHTEPAER

SEQ ID NO: 198746 - protein, 19 aa, Mycobacterium bovis
ERGGALIALNHTSYVDWVP

SEQ ID NO: 198747 - protein, 24 aa, Mycobacterium bovis
ERIGVAACNTARCVDYVGAGTVEF

SEQ ID NO: 198748 - protein, 21 aa, Mycobacterium bovis
ERIGWERSIRVLSARVAELRP

SEQ ID NO: 198749 - protein, 18 aa, Mycobacterium bovis
ERISEKFPTSGIAVLRVA

SEQ ID NO: 198750 - protein, 21 aa, Mycobacterium bovis
ERKEIRPATISTYQMITRRTK

SEQ ID NO: 198751 - protein, 22 aa, Mycobacterium bovis
ERKGALRGLRLSYFGDGANNMA

SEQ ID NO: 198752 - protein, 18 aa, Mycobacterium bovis
ERLADILTRYAADTRDAS

SEQ ID NO: 198753 - protein, 25 aa, Mycobacterium bovis
ERLAEMPRVLRLCAARTGAELNVSA

SEQ ID NO: 198754 - protein, 32 aa, Mycobacterium bovis
ERLAFYRTLYRDHARYGAALWLVAANMASYSD

SEQ ID NO: 198755 - protein, 18 aa, Mycobacterium bovis
ERLALGFGSSSFRYAAPA

SEQ ID NO: 198756 - protein, 21 aa, Mycobacterium bovis
ERLDDRFQFGVLLTAAPEATP

SEQ ID NO: 198757 - protein, 18 aa, Mycobacterium bovis
ERLISGLARANARTKGRF

SEQ ID NO: 198758 - protein, 18 aa, Mycobacterium bovis
ERLQGLFMASFEAIEHHH

SEQ ID NO: 198759 - protein, 26 aa, Mycobacterium bovis
ERLREERARLQAHLERLQAEYDQLSV

SEQ ID NO: 198760 - protein, 24 aa, Mycobacterium bovis
ERLSRLGGVVGTAFQIADDIIDID

SEQ ID NO: 198761 - protein, 45 aa, Mycobacterium bovis
ERLTCSPWLNAEWRLVSDHIRAIVALGGFAWQVALRLAGASGTPK

SEQ ID NO: 198762 - protein, 27 aa, Mycobacterium bovis
ERLTRAWTGLRAMRSYALATMEGPAVE

SEQ ID NO: 198763 - protein, 18 aa, Mycobacterium bovis
ERLVARIAALPVNQLIMV

SEQ ID NO: 198764 - protein, 18 aa, Mycobacterium bovis
ERLVRRGVPAVVLNAKND

SEQ ID NO: 198765 - protein, 21 aa, Mycobacterium bovis
ERLWPTEEFELARSRIPARPP

SEQ ID NO: 198766 - protein, 18 aa, Mycobacterium bovis
ERMRLGALARHIAEELPL

SEQ ID NO: 198767 - protein, 17 aa, Mycobacterium bovis
ERMWAQDVAAMVGYHAG

SEQ ID NO: 198768 - protein, 19 aa, Mycobacterium bovis
ERPEPKRAGVLVVSSDRGL

SEQ ID NO: 198769 - protein, 19 aa, Mycobacterium bovis
ERPEPLAAKATWADLQSTA

SEQ ID NO: 198770 - protein, 18 aa, Mycobacterium bovis
ERPFPLDLVPRVISAPEW

SEQ ID NO: 198771 - protein, 19 aa, Mycobacterium bovis
ERPIPSWLQVVGERQRVLI

SEQ ID NO: 198772 - protein, 22 aa, Mycobacterium bovis
ERPRGMSYLVVRGRRGGSAMAA

SEQ ID NO: 198773 - protein, 18 aa, Mycobacterium bovis
ERPRLVVHRSARHIHVQL

SEQ ID NO: 198774 - protein, 25 aa, Mycobacterium bovis
ERPYREFPLDWMLGRLGLAGFRILE

SEQ ID NO: 198775 - protein, 21 aa, Mycobacterium bovis
ERQLKTLPLVERFYQADRSVA

SEQ ID NO: 198776 - protein, 24 aa, Mycobacterium bovis
ERQRAVGGAGRFLADAMLDLFGSH

SEQ ID NO: 198777 - protein, 23 aa, Mycobacterium bovis
ERRKEMLHNAALRGEQMKGHAAT

SEQ ID NO: 198778 - protein, 29 aa, Mycobacterium bovis
ERRVRDGLLEIGRALNIPPLATNDCHYVT

SEQ ID NO: 198779 - protein, 26 aa, Mycobacterium bovis
ERSCFPSRHARFMVNYATHWTEARED

SEQ ID NO: 198780 - protein, 22 aa, Mycobacterium bovis
ERSLVHLGLKHYFLVDFPQEPG

SEQ ID NO: 198781 - protein, 21 aa, Mycobacterium bovis
ERSSHTWFVLRELLGHQNVKN

SEQ ID NO: 198782 - protein, 21 aa, Mycobacterium bovis
ERTGYSWGPLSLMLLATAIAQ

SEQ ID NO: 198783 - protein, 18 aa, Mycobacterium bovis
ERTLLAGDFVRSFVGLDS

SEQ ID NO: 198784 - protein, 24 aa, Mycobacterium bovis
ERTRAKARLSWAGRQMVGVGLARL

SEQ ID NO: 198785 - protein, 17 aa, Mycobacterium bovis
ERVALALLTYVEERTDG

SEQ ID NO: 198786 - protein, 18 aa, Mycobacterium bovis
ERVLPGAILRQLSDEEMN

SEQ ID NO: 198787 - protein, 26 aa, Mycobacterium bovis
ERVLVHPRPRLSVMAVGGELVDISRT

SEQ ID NO: 198788 - protein, 19 aa, Mycobacterium bovis
ERVPGSVVDRSFVDNHCAG

SEQ ID NO: 198789 - protein, 21 aa, Mycobacterium bovis
ERYARCLGSAVNPVLRQGNSD

SEQ ID NO: 198790 - protein, 17 aa, Mycobacterium bovis
ERYDAFFSLAHRLLPAD

SEQ ID NO: 198791 - protein, 28 aa, Mycobacterium bovis
ERYLTALMPMVWRACEREDFVVEVQAMR

SEQ ID NO: 198792 - protein, 19 aa, Mycobacterium bovis
ERYMKLLAPRWQMMSDPQL

SEQ ID NO: 198793 - protein, 25 aa, Mycobacterium bovis
ESAAAFQGAHARFVAAAAKVNTLLD

SEQ ID NO: 198794 - protein, 18 aa, Mycobacterium bovis
ESACAELVSLLVGTAPGS

SEQ ID NO: 198795 - protein, 22 aa, Mycobacterium bovis
ESADIPQFLAIAREAAERRTGL

SEQ ID NO: 198796 - protein, 18 aa, Mycobacterium bovis
ESAIKAALSNWIAGQAAV

SEQ ID NO: 198797 - protein, 20 aa, Mycobacterium bovis
ESAKFWLAVLTELRNRGVKD

SEQ ID NO: 198798 - protein, 18 aa, Mycobacterium bovis
ESAVGYSRAVRIGPLVVV

SEQ ID NO: 198799 - protein, 22 aa, Mycobacterium bovis
ESAVRSGLDLAGFNKLADELED

SEQ ID NO: 198800 - protein, 30 aa, Mycobacterium bovis
ESAWSVFISARWQADFRADVPVLLVCGHRA

SEQ ID NO: 198801 - protein, 18 aa, Mycobacterium bovis
ESAYDRYYGDPSNKPNPN

SEQ ID NO: 198802 - protein, 24 aa, Mycobacterium bovis
ESCGKCTPCREGTFWLDKIYERLE

SEQ ID NO: 198803 - protein, 18 aa, Mycobacterium bovis
ESDQRSAAVIARNIEALG

SEQ ID NO: 198804 - protein, 20 aa, Mycobacterium bovis
ESDYARMWIQAATTMASYQA

SEQ ID NO: 198805 - protein, 17 aa, Mycobacterium bovis
ESEFRTSLRSCPAEKRR

SEQ ID NO: 198806 - protein, 20 aa, Mycobacterium bovis
ESELRAAVNAARAAGDTWAA

SEQ ID NO: 198807 - protein, 26 aa, Mycobacterium bovis
ESFPLYCCANGKALLAALPPERQARA

SEQ ID NO: 198808 - protein, 18 aa, Mycobacterium bovis
ESGIGYAAGDAVAAATYL

SEQ ID NO: 198809 - protein, 18 aa, Mycobacterium bovis
ESHCGWPSFFDPKSSDAV

SEQ ID NO: 198810 - protein, 17 aa, Mycobacterium bovis
ESIKATLTFRDPKELRF

SEQ ID NO: 198811 - protein, 19 aa, Mycobacterium bovis
ESIRKFRILPVDFTEDTGE

SEQ ID NO: 198812 - protein, 29 aa, Mycobacterium bovis
ESKIASWTEPKGGYFISLDVLPGTARRTV

SEQ ID NO: 198813 - protein, 25 aa, Mycobacterium bovis
ESKTVIGLNMLRLWDDRRTLEPWIA

SEQ ID NO: 198814 - protein, 18 aa, Mycobacterium bovis
ESLASRWLADRIAADSTV

SEQ ID NO: 198815 - protein, 22 aa, Mycobacterium bovis
ESLDGWPVNFALLGKGNTVNPD

SEQ ID NO: 198816 - protein, 17 aa, Mycobacterium bovis
ESLRVAGGFTLDGLGGW

SEQ ID NO: 198817 - protein, 19 aa, Mycobacterium bovis
ESLSREFRGLLDRVPPAKT

SEQ ID NO: 198818 - protein, 19 aa, Mycobacterium bovis
ESLTEVWRTDGYCHCMFTA

SEQ ID NO: 198819 - protein, 22 aa, Mycobacterium bovis
ESMLRAPGFGKYHTDHMVSIDY

SEQ ID NO: 198820 - protein, 23 aa, Mycobacterium bovis
ESNAPVLLGLIGLWYSNFFGAQS

SEQ ID NO: 198821 - protein, 19 aa, Mycobacterium bovis
ESPDAYDLELMWDANDDNQ

SEQ ID NO: 198822 - protein, 24 aa, Mycobacterium bovis
ESPQETWTRLVLIDAGLPKPQTQI

SEQ ID NO: 198823 - protein, 28 aa, Mycobacterium bovis
ESRALEDWCHQLAWPIRPAVSADPPSTA

SEQ ID NO: 198824 - protein, 24 aa, Mycobacterium bovis
ESRKAIHFQEWWVRYRAQVPTHSF

SEQ ID NO: 198825 - protein, 18 aa, Mycobacterium bovis
ESRSWRLTATGDYQEPGL

SEQ ID NO: 198826 - protein, 26 aa, Mycobacterium bovis
ESSAAFQAAHARFVAAAAKVNTLLDV

SEQ ID NO: 198827 - protein, 25 aa, Mycobacterium bovis
ESTRYEAWSFPDFATGVAALRTITQ

SEQ ID NO: 198828 - protein, 24 aa, Mycobacterium bovis
ESVCSGLADRWWQGPSSRMMAAQA

SEQ ID NO: 198829 - protein, 25 aa, Mycobacterium bovis
ESWHGRFPFDWGVSAHPKVDNKTGE

SEQ ID NO: 198830 - protein, 27 aa, Mycobacterium bovis
ESYEFWREFLASLKARGLTGVHLVISD

SEQ ID NO: 198831 - protein, 19 aa, Mycobacterium bovis
ETAELLYGTALLAEGGALE

SEQ ID NO: 198832 - protein, 30 aa, Mycobacterium bovis
ETAGALKNVFAIAVGMGYSLGIGENTRALV

SEQ ID NO: 198833 - protein, 23 aa, Mycobacterium bovis
ETALKFGATHAFADAASAAAKVD

SEQ ID NO: 198834 - protein, 34 aa, Mycobacterium bovis
ETAPYNDIVSWNWTELPSALGVTNHLAFRAQTYG

SEQ ID NO: 198835 - protein, 23 aa, Mycobacterium bovis
ETAWKVAKQYFKLTGKPGKHKVI

SEQ ID NO: 198836 - protein, 18 aa, Mycobacterium bovis
ETAYAWRTILARRNGSGP

SEQ ID NO: 198837 - protein, 18 aa, Mycobacterium bovis
ETAYCLGVEKLLGITDEI

SEQ ID NO: 198838 - protein, 24 aa, Mycobacterium bovis
ETDEAGNLISEWDDTPEGFGRIAA

SEQ ID NO: 198839 - protein, 27 aa, Mycobacterium bovis
ETDKPFLMPVEDVFTITGRGTVVTGRV

SEQ ID NO: 198840 - protein, 25 aa, Mycobacterium bovis
ETEGRPRLRYWLDRLSTDGILAHAA

SEQ ID NO: 198841 - protein, 27 aa, Mycobacterium bovis
ETELRELRSAGAVFGLLDVDDEFFVIV

SEQ ID NO: 198842 - protein, 19 aa, Mycobacterium bovis
ETEVLCGRPLTKLMQESRS

SEQ ID NO: 198843 - protein, 25 aa, Mycobacterium bovis
ETGLRPDFPRPALLSGAGDAVEFRL

SEQ ID NO: 198844 - protein, 24 aa, Mycobacterium bovis
ETGVRRFALRPVIGIDPAAVSPWW

SEQ ID NO: 198845 - protein, 28 aa, Mycobacterium bovis
ETLAELGPWRWAPTFAFIDQQAAEVHWE

SEQ ID NO: 198846 - protein, 30 aa, Mycobacterium bovis
ETLAFFAGIGIPIAEIWGMSELSCVATASH

SEQ ID NO: 198847 - protein, 24 aa, Mycobacterium bovis
ETLIQCGWFQIRISASDVVAASTR

SEQ ID NO: 198848 - protein, 23 aa, Mycobacterium bovis
ETLNLANLPGYRVGGTIHIIVNN

SEQ ID NO: 198849 - protein, 25 aa, Mycobacterium bovis
ETLRLHPPLIILMRVAKGEFEVQGH

SEQ ID NO: 198850 - protein, 30 aa, Mycobacterium bovis
ETLRRAGVRTNTWWLPAMQSLYETDYGPVL

SEQ ID NO: 198851 - protein, 23 aa, Mycobacterium bovis
ETMGDFMAATAYEVLRRQLETFT

SEQ ID NO: 198852 - protein, 34 aa, Mycobacterium bovis
ETNSLRMYLGAGSRPLLAAAGAWDGLAEELHAAA

SEQ ID NO: 198853 - protein, 21 aa, Mycobacterium bovis
ETPSQFFPFTGLNSLTYDVSV

SEQ ID NO: 198854 - protein, 20 aa, Mycobacterium bovis
ETREIWSYGSGYGGNALLGK

SEQ ID NO: 198855 - protein, 24 aa, Mycobacterium bovis
ETRLLLRKSMHLLRDKQLWWRVGR

SEQ ID NO: 198856 - protein, 21 aa, Mycobacterium bovis
ETRTGDLWLFRGRSRPDRAIQ

SEQ ID NO: 198857 - protein, 23 aa, Mycobacterium bovis
ETSKRYMHHYNFPPFSTGETGRV

SEQ ID NO: 198858 - protein, 18 aa, Mycobacterium bovis
ETSMLRRRLERGSADPTV

SEQ ID NO: 198859 - protein, 25 aa, Mycobacterium bovis
ETTFSVGLANLGFWNLGSANIGNYN

SEQ ID NO: 198860 - protein, 18 aa, Mycobacterium bovis
ETTPGGGVTIVIPGHENV

SEQ ID NO: 198861 - protein, 32 aa, Mycobacterium bovis
ETVAAVATDLKRIGASLAHENASAAASTTAVV

SEQ ID NO: 198862 - protein, 32 aa, Mycobacterium bovis
ETVLHEMAHMWFGDLVTMTWWDDLWLNESFAT

SEQ ID NO: 198863 - protein, 23 aa, Mycobacterium bovis
ETVVEARCGIGYLHTGIEKNLEY

SEQ ID NO: 198864 - protein, 25 aa, Mycobacterium bovis
ETYDIYMHYLRGCSDLFRDKYTDVC

SEQ ID NO: 198865 - protein, 22 aa, Mycobacterium bovis
EVAAGIAGLIKTILCLKNKALP

SEQ ID NO: 198866 - protein, 18 aa, Mycobacterium bovis
EVAAHEFLLFPTVAHSHA

SEQ ID NO: 198867 - protein, 18 aa, Mycobacterium bovis
EVAALGVNIDFIRGISDY

SEQ ID NO: 198868 - protein, 18 aa, Mycobacterium bovis
EVACPFHDWRWGGDGRCK

SEQ ID NO: 198869 - protein, 18 aa, Mycobacterium bovis
EVADTYFALMDRLGTDGL

SEQ ID NO: 198870 - protein, 18 aa, Mycobacterium bovis
EVAGRLAAQVGAYHLMRT

SEQ ID NO: 198871 - protein, 17 aa, Mycobacterium bovis
EVAGYRLPAGVMVVPAI

SEQ ID NO: 198872 - protein, 29 aa, Mycobacterium bovis
EVARAQVCAAWHIAELPAAAGRDADGILA

SEQ ID NO: 198873 - protein, 27 aa, Mycobacterium bovis
EVARYLFRRVVSWGRSSNVFLRNGARL

SEQ ID NO: 198874 - protein, 19 aa, Mycobacterium bovis
EVAVLKILALQFIMSDPRH

SEQ ID NO: 198875 - protein, 21 aa, Mycobacterium bovis
EVDAIRWLSWEQFVRDVTAGV

SEQ ID NO: 198876 - protein, 19 aa, Mycobacterium bovis
EVFCDTPLQDCERRDPKGL

SEQ ID NO: 198877 - protein, 19 aa, Mycobacterium bovis
EVFLVMPFTTDFMKLTPDR

SEQ ID NO: 198878 - protein, 17 aa, Mycobacterium bovis
EVGGRVTSPPQPPVAAL

SEQ ID NO: 198879 - protein, 26 aa, Mycobacterium bovis
EVGRLRGGQTLIGFLAPRNADNSIGA

SEQ ID NO: 198880 - protein, 18 aa, Mycobacterium bovis
EVGTPFCVTVDFDSLQDN

SEQ ID NO: 198881 - protein, 20 aa, Mycobacterium bovis
EVGWRDPFRLAVGPFPCLPA

SEQ ID NO: 198882 - protein, 18 aa, Mycobacterium bovis
EVHSALLSSGPGPGPLLV

SEQ ID NO: 198883 - protein, 24 aa, Mycobacterium bovis
EVIADGPIALARLIPAGVDVRGNA

SEQ ID NO: 198884 - protein, 24 aa, Mycobacterium bovis
EVIEKMRVAGRIAAGALAEAGKAV

SEQ ID NO: 198885 - protein, 20 aa, Mycobacterium bovis
EVIKNFKKGFAATGGGSVVP

SEQ ID NO: 198886 - protein, 20 aa, Mycobacterium bovis
EVLAQREFCAPFELSRDAPL

SEQ ID NO: 198887 - protein, 21 aa, Mycobacterium bovis
EVLARGTAWLDTGTFDSLLDA

SEQ ID NO: 198888 - protein, 19 aa, Mycobacterium bovis
EVLETEYLKRPLIDGPAPE

SEQ ID NO: 198889 - protein, 23 aa, Mycobacterium bovis
EVLPNYSGGLGILAGDHLKSASD

SEQ ID NO: 198890 - protein, 19 aa, Mycobacterium bovis
EVLRLRWRPGCMPLPQRVI

SEQ ID NO: 198891 - protein, 28 aa, Mycobacterium bovis
EVLSALSCRPAIVVPAFLSRGYHVRTDL

SEQ ID NO: 198892 - protein, 25 aa, Mycobacterium bovis
EVLSFLSVSSVDYWAYRPALQQVAA

SEQ ID NO: 198893 - protein, 17 aa, Mycobacterium bovis
EVLSTILLECTMAGMAT

SEQ ID NO: 198894 - protein, 20 aa, Mycobacterium bovis
EVMAAAATDLANIGSSISAA

SEQ ID NO: 198895 - protein, 21 aa, Mycobacterium bovis
EVNAGVYAFDIAALRSALSRL

SEQ ID NO: 198896 - protein, 17 aa, Mycobacterium bovis
EVPADRIVNTWPADTLL

SEQ ID NO: 198897 - protein, 24 aa, Mycobacterium bovis
EVPSRAYVSAFGFKGPDQQKPAGV

SEQ ID NO: 198898 - protein, 26 aa, Mycobacterium bovis
EVQIPKLRAGSFFPSLLERRRRIDKA

SEQ ID NO: 198899 - protein, 17 aa, Mycobacterium bovis
EVRAVPAAAQASVLVLP

SEQ ID NO: 198900 - protein, 19 aa, Mycobacterium bovis
EVRHECLEYALAHDERFGI

SEQ ID NO: 198901 - protein, 19 aa, Mycobacterium bovis
EVRHVPPGDMPGGTAAADA

SEQ ID NO: 198902 - protein, 20 aa, Mycobacterium bovis
EVRLGLGAVRYLGAELAEKL

SEQ ID NO: 198903 - protein, 23 aa, Mycobacterium bovis
EVRRARKSIAQFKLREGMPVGVR

SEQ ID NO: 198904 - protein, 18 aa, Mycobacterium bovis
EVRSRFYARAPELHRSPV

SEQ ID NO: 198905 - protein, 25 aa, Mycobacterium bovis
EVRYFIDRLAGWYVITSSDRMSREG

SEQ ID NO: 198906 - protein, 27 aa, Mycobacterium bovis
EVSAAVSRLFGAYGQQFQALNARAATF

SEQ ID NO: 198907 - protein, 23 aa, Mycobacterium bovis
EVSALTAAHFAAHAAMYQSVSAR

SEQ ID NO: 198908 - protein, 23 aa, Mycobacterium bovis
EVSALTAAQFAAHAQIYQAVSAQ

SEQ ID NO: 198909 - protein, 17 aa, Mycobacterium bovis
EVSEFSRHLKLLAKELE

SEQ ID NO: 198910 - protein, 22 aa, Mycobacterium bovis
EVSEYGGALLPRLITPGEAARL

SEQ ID NO: 198911 - protein, 18 aa, Mycobacterium bovis
EVSHARGVGGPGGAGGAG

SEQ ID NO: 198912 - protein, 21 aa, Mycobacterium bovis
EVTGVPILFASTGEKLEDFDV

SEQ ID NO: 198913 - protein, 17 aa, Mycobacterium bovis
EVTRKLDKMGWRSSDTA

SEQ ID NO: 198914 - protein, 27 aa, Mycobacterium bovis
EVVQRPAGRARSRWFSDYLRTVTQRDV

SEQ ID NO: 198915 - protein, 22 aa, Mycobacterium bovis
EVVRREGASWVRIADDGDWATS

SEQ ID NO: 198916 - protein, 19 aa, Mycobacterium bovis
EVVRRLRAAGAVIIGKTNV

SEQ ID NO: 198917 - protein, 24 aa, Mycobacterium bovis
EVVSAAAGDLANVGSTISAANKAA

SEQ ID NO: 198918 - protein, 17 aa, Mycobacterium bovis
EVVVCPTAVPPHDPASY

SEQ ID NO: 198919 - protein, 20 aa, Mycobacterium bovis
EVWLTARWGAHTRKAGRTWW

SEQ ID NO: 198920 - protein, 21 aa, Mycobacterium bovis
EVWTSQMIVAPAFVDAAAKDL

SEQ ID NO: 198921 - protein, 19 aa, Mycobacterium bovis
EVYDYLRLLYARAGTPHCP

SEQ ID NO: 198922 - protein, 21 aa, Mycobacterium bovis
EVYELRGSELIRIEAPTDASV

SEQ ID NO: 198923 - protein, 35 aa, Mycobacterium bovis
EVYFELRLADAWVWDMYRPARFVKQVRVVTFKDVN

SEQ ID NO: 198924 - protein, 17 aa, Mycobacterium bovis
EWAFPAWVPLPVSELAL

SEQ ID NO: 198925 - protein, 27 aa, Mycobacterium bovis
EWDAVIAVHLRGHFLLTRNAAAYWRDK

SEQ ID NO: 198926 - protein, 24 aa, Mycobacterium bovis
EWGPDYYERIGVSFELPNHYQKLT

SEQ ID NO: 198927 - protein, 20 aa, Mycobacterium bovis
EWNLDFAAALTRLLTATLLG

SEQ ID NO: 198928 - protein, 27 aa, Mycobacterium bovis
EWPANPRFLMCTPLSHAGAAFFTPTVI

SEQ ID NO: 198929 - protein, 23 aa, Mycobacterium bovis
EWPDRLRRLLSKQVGLILRRTID

SEQ ID NO: 198930 - protein, 24 aa, Mycobacterium bovis
EWTQHWRVASGLGVSADDLLGVRD

SEQ ID NO: 198931 - protein, 18 aa, Mycobacterium bovis
EWVIPRGYSIIINIAQIH

SEQ ID NO: 198932 - protein, 27 aa, Mycobacterium bovis
EYADGKRSGLWPGLRETFKSGSSQPPL

SEQ ID NO: 198933 - protein, 22 aa, Mycobacterium bovis
EYAEMWAQDAAVMYSYEGASAA

SEQ ID NO: 198934 - protein, 24 aa, Mycobacterium bovis
EYAEVQPLKGARISGSLHMTVQTA

SEQ ID NO: 198935 - protein, 21 aa, Mycobacterium bovis
EYCVVKSGFGLEVAKTADVAI

SEQ ID NO: 198936 - protein, 26 aa, Mycobacterium bovis
EYDVLNRLKPGIVMCREKQDTTSAVL

SEQ ID NO: 198937 - protein, 23 aa, Mycobacterium bovis
EYEIKDVWYVVGLRGTGSNTLVV

SEQ ID NO: 198938 - protein, 17 aa, Mycobacterium bovis
EYLDMFYNLGIAGRAMR

SEQ ID NO: 198939 - protein, 17 aa, Mycobacterium bovis
EYLQLACAGGFPEVVQR

SEQ ID NO: 198940 - protein, 27 aa, Mycobacterium bovis
EYLSGRWAQAYGFPLMPIDGILVGTAA

SEQ ID NO: 198941 - protein, 25 aa, Mycobacterium bovis
EYQRRLRAANALDFDDLIGETVAVL

SEQ ID NO: 198942 - protein, 24 aa, Mycobacterium bovis
EYRRKVRLCLDVFETMLAQTRFEA

SEQ ID NO: 198943 - protein, 18 aa, Mycobacterium bovis
EYSPESYTGTELEYAKQV

SEQ ID NO: 198944 - protein, 31 aa, Mycobacterium bovis
EYVKTPAQVLLRWNLQLGNAVVVRSARPERI

SEQ ID NO: 198945 - protein, 19 aa, Mycobacterium bovis
FAAAAWRAGVLRYVVDLEN

SEQ ID NO: 198946 - protein, 21 aa, Mycobacterium bovis
FAAKARRLFPSGSPFGLGVLL

SEQ ID NO: 198947 - protein, 17 aa, Mycobacterium bovis
FAALADEAQRCRCRGID

SEQ ID NO: 198948 - protein, 17 aa, Mycobacterium bovis
FAAPVVCAFGMTEATHQ

SEQ ID NO: 198949 - protein, 19 aa, Mycobacterium bovis
FAASHLRDGAVLLDVSRID

SEQ ID NO: 198950 - protein, 17 aa, Mycobacterium bovis
FAASVFSTRGCPYRCTF

SEQ ID NO: 198951 - protein, 20 aa, Mycobacterium bovis
FAASWQRLRTAPATVPLARC

SEQ ID NO: 198952 - protein, 17 aa, Mycobacterium bovis
FAAVALASIRELGLNPQ

SEQ ID NO: 198953 - protein, 32 aa, Mycobacterium bovis; identical to SEQ ID NO: 79584

SEQ ID NO: 198954 - protein, 17 aa, Mycobacterium bovis
FADDVERILSETPEYKQ

SEQ ID NO: 198955 - protein, 19 aa, Mycobacterium bovis
FADEAVLASTGWHLMMALI

SEQ ID NO: 198956 - protein, 17 aa, Mycobacterium bovis
FADELDVVLAAPSRILV

SEQ ID NO: 198957 - protein, 20 aa, Mycobacterium bovis
FADHLARVGLYPDAPKLPAV

SEQ ID NO: 198958 - protein, 18 aa, Mycobacterium bovis
FADLAEVMAGVFAARRSS

SEQ ID NO: 198959 - protein, 18 aa, Mycobacterium bovis
FADRALVMYAGRVVESAG

SEQ ID NO: 198960 - protein, 24 aa, Mycobacterium bovis
FADRKPVCYRMHPDNVPALTALRP

SEQ ID NO: 198961 - protein, 24 aa, Mycobacterium bovis
FADRPQFRHRIAFLPNYDMSMARL

SEQ ID NO: 198962 - protein, 26 aa, Mycobacterium bovis
FADTHARVGLLPTWGLSVRLPQKVGI

SEQ ID NO: 198963 - protein, 17 aa, Mycobacterium bovis
FADVPWRGNRINRIRYF

SEQ ID NO: 198964 - protein, 25 aa, Mycobacterium bovis
FAEFLEVRGSLLPDDERLLAEQWLL

SEQ ID NO: 198965 - protein, 21 aa, Mycobacterium bovis
FAEGYCLPTVLNNALYMDRYP

SEQ ID NO: 198966 - protein, 17 aa, Mycobacterium bovis
FAELSVRAISLRAGVAR

SEQ ID NO: 198967 - protein, 18 aa, Mycobacterium bovis
FAERGHLSSKEWPGMLAF

SEQ ID NO: 198968 - protein, 36 aa, Mycobacterium bovis
FAGADFEAGMMWREVYRLRQPVLLIWGREDRVNPLD

SEQ ID NO: 198969 - protein, 17 aa, Mycobacterium bovis
FAGANLIPLRGGPIDLN

SEQ ID NO: 198970 - protein, 20 aa, Mycobacterium bovis
FAGFRLRASGIATQVTSRSL

SEQ ID NO: 198971 - protein, 25 aa, Mycobacterium bovis
FAGFRRLRALFTHRRDNGLLRECTV

SEQ ID NO: 198972 - protein, 17 aa, Mycobacterium bovis
FAGIDWRPSELGSPIIE

SEQ ID NO: 198973 - protein, 18 aa, Mycobacterium bovis
FAGLPAYQQGLGRKVRFM

SEQ ID NO: 198974 - protein, 17 aa, Mycobacterium bovis
FAGMISVAIDSADGATV

SEQ ID NO: 198975 - protein, 17 aa, Mycobacterium bovis
FAGREFIGVQGTQLSRY

SEQ ID NO: 198976 - protein, 18 aa, Mycobacterium bovis
FAGSWGYQVTSYYAPTSR

SEQ ID NO: 198977 - protein, 18 aa, Mycobacterium bovis
FAHFQWRAQHNDLKTLPF

SEQ ID NO: 198978 - protein, 24 aa, Mycobacterium bovis
FAIAARFADHLNIVAAVDELPRKM

SEQ ID NO: 198979 - protein, 17 aa, Mycobacterium bovis
FAILAWRGREREDLLAN

SEQ ID NO: 198980 - protein, 18 aa, Mycobacterium bovis
FAKEFARNATESGGRSMI

SEQ ID NO: 198981 - protein, 21 aa, Mycobacterium bovis
FAKLLFTNPVKAFQFLVDLIL

SEQ ID NO: 198982 - protein, 17 aa, Mycobacterium bovis
FALGYPMDIGSYVAFLS

SEQ ID NO: 198983 - protein, 19 aa, Mycobacterium bovis
FALGYSHPVVIEAPEGITF

SEQ ID NO: 198984 - protein, 18 aa, Mycobacterium bovis
FALLRAGAIPVMCLPGHR

SEQ ID NO: 198985 - protein, 25 aa, Mycobacterium bovis
FALTLRLLVIALKHNVILNSTWVDS

SEQ ID NO: 198986 - protein, 18 aa, Mycobacterium bovis
FANELFASNAYRDYLEVH

SEQ ID NO: 198987 - protein, 17 aa, Mycobacterium bovis
FANRRVDAVQDGTLLSS

SEQ ID NO: 198988 - protein, 21 aa, Mycobacterium bovis
FANSDAWFLIRVVTAPDGTAL

SEQ ID NO: 198989 - protein, 17 aa, Mycobacterium bovis
FAPGYGVEIGLLIDTFD

SEQ ID NO: 198990 - protein, 18 aa, Mycobacterium bovis
FAPLEMSAALQALATILT

SEQ ID NO: 198991 - protein, 20 aa, Mycobacterium bovis
FAPRELVELAVAAEAHGMDS

SEQ ID NO: 198992 - protein, 25 aa, Mycobacterium bovis
FAPRFHPSYRHAAAVRREIGVPTVF

SEQ ID NO: 198993 - protein, 19 aa, Mycobacterium bovis
FAQLGTWSGRIVVDGERIA

SEQ ID NO: 198994 - protein, 20 aa, Mycobacterium bovis
FAQRARWANATADLLEAEAD

SEQ ID NO: 198995 - protein, 23 aa, Mycobacterium bovis
FARECLADGVAVLVEERVDLRRE

SEQ ID NO: 198996 - protein, 17 aa, Mycobacterium bovis
FARFRRLRWRHPLDGQT

SEQ ID NO: 198997 - protein, 17 aa, Mycobacterium bovis
FARHGFTEIEGTPVTAE

SEQ ID NO: 198998 - protein, 20 aa, Mycobacterium bovis
FARMWRGYARGVLEKLSALL

SEQ ID NO: 198999 - protein, 19 aa, Mycobacterium bovis
FARSGCRRPALLAHSVAIR

SEQ ID NO: 199000 - protein, 20 aa, Mycobacterium bovis
FASGDAWPLVPGEIARLTFD

SEQ ID NO: 199001 - protein, 20 aa, Mycobacterium bovis
FASGRVAYAMGLQGPAITVD

SEQ ID NO: 199002 - protein, 25 aa, Mycobacterium bovis
FASLDRWPGTVGEYLNTVFDPSLTF

SEQ ID NO: 199003 - protein, 19 aa, Mycobacterium bovis
FASLRRWTGGSIPETDIPI

SEQ ID NO: 199004 - protein, 17 aa, Mycobacterium bovis
FASRIGVTAQDLTAYLD

SEQ ID NO: 199005 - protein, 21 aa, Mycobacterium bovis
FASRLPRYFPTALRERFTPEI

SEQ ID NO: 199006 - protein, 28 aa, Mycobacterium bovis
FASTAWTSTWRRWCIPANAATSSTTCAP

SEQ ID NO: 199007 - protein, 17 aa, Mycobacterium bovis
FASVGGFIAGDRPVVDY

SEQ ID NO: 199008 - protein, 22 aa, Mycobacterium bovis
FATDHLRLVGLHSHIGSQIFDV

SEQ ID NO: 199009 - protein, 24 aa, Mycobacterium bovis
FATELRNLLARCAERGLDPLELQQ

SEQ ID NO: 199010 - protein, 25 aa, Mycobacterium bovis
FATHPFGPVAVAGFVVYRLDDGPAV

SEQ ID NO: 199011 - protein, 19 aa, Mycobacterium bovis
FAVATWNGLVWINLDADAE

SEQ ID NO: 199012 - protein, 19 aa, Mycobacterium bovis
FAVDPDRSAQFLLVVLTQA

SEQ ID NO: 199013 - protein, 17 aa, Mycobacterium bovis
FAVGDRVMGLFPEGTGT

SEQ ID NO: 199014 - protein, 20 aa, Mycobacterium bovis
FAVRQGSGGAGRWRGGDGAV

SEQ ID NO: 199015 - protein, 26 aa, Mycobacterium bovis
FCHNGCPLGNLIPEWNDLVRRGRWRD

SEQ ID NO: 199016 - protein, 17 aa, Mycobacterium bovis
FCSTCDRTRLTADGQIR

SEQ ID NO: 199017 - protein, 18 aa, Mycobacterium bovis
FDALGRWLLARTAEIVAG

SEQ ID NO: 199018 - protein, 17 aa, Mycobacterium bovis
FDAVCFTSSSTVRNLVG

SEQ ID NO: 199019 - protein, 20 aa, Mycobacterium bovis
FDAVIAVHLKGHFATMRHAA

SEQ ID NO: 199020 - protein, 20 aa, Mycobacterium bovis
FDCPGCAWPEEPGGRKLAEF

SEQ ID NO: 199021 - protein, 19 aa, Mycobacterium bovis
FDDHPWNWAAHVAGQRTPR

SEQ ID NO: 199022 - protein, 20 aa, Mycobacterium bovis
FDDMARLGAQVTIFRLGSDP

SEQ ID NO: 199023 - protein, 23 aa, Mycobacterium bovis
FDELYAAGATAIFPPGTVIADAA

SEQ ID NO: 199024 - protein, 23 aa, Mycobacterium bovis
FDEVFARMWELYLAYSEAGFRSG

SEQ ID NO: 199025 - protein, 27 aa, Mycobacterium bovis
FDFGRPEVRNFLVANALYWLQEFHIDG

SEQ ID NO: 199026 - protein, 17 aa, Mycobacterium bovis
FDFYFADSTAFRANIAQ

SEQ ID NO: 199027 - protein, 20 aa, Mycobacterium bovis
FDGDGMIHVVGFRDGKAFYR

SEQ ID NO: 199028 - protein, 17 aa, Mycobacterium bovis
FDGQPSWSGKPEVAATT

SEQ ID NO: 199029 - protein, 19 aa, Mycobacterium bovis
FDGYRFQRGPVLVVVEDGR

SEQ ID NO: 199030 - protein, 18 aa, Mycobacterium bovis
FDHQLTRIELRRMGYLQR

SEQ ID NO: 199031 - protein, 17 aa, Mycobacterium bovis
FDHVGALAATVMGMPPT

SEQ ID NO: 199032 - protein, 23 aa, Mycobacterium bovis
FDIGKLRYHKIVLMADADVDGQH

SEQ ID NO: 199033 - protein, 17 aa, Mycobacterium bovis
FDIWSYIGAEQVRLPSI

SEQ ID NO: 199034 - protein, 25 aa, Mycobacterium bovis
FDLETDWPIRAALLSTPEQTVLSLV

SEQ ID NO: 199035 - protein, 23 aa, Mycobacterium bovis
FDLIHRLWLDLGHELHYVQNITD

SEQ ID NO: 199036 - protein, 23 aa, Mycobacterium bovis
FDPELQLWVAACLYKGGVDVYRT

SEQ ID NO: 199037 - protein, 19 aa, Mycobacterium bovis
FDPLRPSLVEMGRAVVREG

SEQ ID NO: 199038 - protein, 23 aa, Mycobacterium bovis
FDPQRLAALLAMPADAEPVAILC

SEQ ID NO: 199039 - protein, 26 aa, Mycobacterium bovis
FDPSKPCAWLAEGLVRYLPARAQDLL

SEQ ID NO: 199040 - protein, 24 aa, Mycobacterium bovis
FDPSRAMPAYNWMTVAKSALESVN

SEQ ID NO: 199041 - protein, 23 aa, Mycobacterium bovis
FDQGENFAFLGGRDWDPSQSTLP

SEQ ID NO: 199042 - protein, 35 aa, Mycobacterium bovis
FDRGDRVGIAWLRHTCGVCKYCRRGSENLCPQSRY

SEQ ID NO: 199043 - protein, 19 aa, Mycobacterium bovis
FDRINYRGATDPTLDVLQD

SEQ ID NO: 199044 - protein, 18 aa, Mycobacterium bovis
FDRLRNLAAIKDVAARPT

SEQ ID NO: 199045 - protein, 23 aa, Mycobacterium bovis
FDRRAILKVFRRVSSGINPDIEL

SEQ ID NO: 199046 - protein, 20 aa, Mycobacterium bovis
FDRVIAINLRGAWLCTKHAA

SEQ ID NO: 199047 - protein, 18 aa, Mycobacterium bovis
FDSLKLFQLITELEDEFD

SEQ ID NO: 199048 - protein, 26 aa, Mycobacterium bovis
FDTACSSGLMAVHLACRSLHDGEADL

SEQ ID NO: 199049 - protein, 18 aa, Mycobacterium bovis
FDTARLAVFDADSGANLT

SEQ ID NO: 199050 - protein, 18 aa, Mycobacterium bovis
FDTELGPVVANFLLADEI

SEQ ID NO: 199051 - protein, 17 aa, Mycobacterium bovis
FDTRRGMVVGSPVDLVD

SEQ ID NO: 199052 - protein, 20 aa, Mycobacterium bovis
FDTVVDCAFYHTFSTAPELQ

SEQ ID NO: 199053 - protein, 17 aa, Mycobacterium bovis
FDVGFPFAVADEKPDAE

SEQ ID NO: 199054 - protein, 17 aa, Mycobacterium bovis
FDVHEIVEIGPFTIPQV

SEQ ID NO: 199055 - protein, 20 aa, Mycobacterium bovis
FEAGKPFELMELDLDGPGPG

SEQ ID NO: 199056 - protein, 17 aa, Mycobacterium bovis
FEALKAAAIVSGVAQAL

SEQ ID NO: 199057 - protein, 19 aa, Mycobacterium bovis
FEALSALSAGVKEVRAVIE

SEQ ID NO: 199058 - protein, 24 aa, Mycobacterium bovis
FEARFRFVEEMIRLGADARTDGHH

SEQ ID NO: 199059 - protein, 18 aa, Mycobacterium bovis
FEASRQLAALSIFANSGG

SEQ ID NO: 199060 - protein, 25 aa, Mycobacterium bovis
FEDLVIRLLEAMGYGRAGAVERTSA

SEQ ID NO: 199061 - protein, 25 aa, Mycobacterium bovis
FEDVRASGLLPRWEQTQRFIGEMRG

SEQ ID NO: 199062 - protein, 20 aa, Mycobacterium bovis
FEEHVRWYRMYGMSMRPVPK

SEQ ID NO: 199063 - protein, 26 aa, Mycobacterium bovis
FEGELAIVIGRACKDVPAAQAVDNIL

SEQ ID NO: 199064 - protein, 17 aa, Mycobacterium bovis
FEGTSFGGALMTTTGVE

SEQ ID NO: 199065 - protein, 22 aa, Mycobacterium bovis
FEGVMMPELFMADAMGATGKPL

SEQ ID NO: 199066 - protein, 24 aa, Mycobacterium bovis
FEHRCPGCGEPVIWQLVDEDAPLR

SEQ ID NO: 199067 - protein, 22 aa, Mycobacterium bovis
FEIDVPKVLEFKARVLSERGAV

SEQ ID NO: 199068 - protein, 23 aa, Mycobacterium bovis
FEIKEFKTGAARMAIEAGVPIVP

SEQ ID NO: 199069 - protein, 20 aa, Mycobacterium bovis
FEKGRSWPRERTRAKLEEVL

SEQ ID NO: 199070 - protein, 25 aa, Mycobacterium bovis
FEKTLRFWLDRGVDGFRIDVAHGMA

SEQ ID NO: 199071 - protein, 19 aa, Mycobacterium bovis
FELHEELIQAVGLTRDEAA

SEQ ID NO: 199072 - protein, 18 aa, Mycobacterium bovis
FELLRFLMRNPRRALSRT

SEQ ID NO: 199073 - protein, 17 aa, Mycobacterium bovis
FEMPPHLHMAMVQSLLV

SEQ ID NO: 199074 - protein, 17 aa, Mycobacterium bovis
FENAIAVVMAFGGSTNA

SEQ ID NO: 199075 - protein, 18 aa, Mycobacterium bovis
FEPTLDYVVVKAPRFAFE

SEQ ID NO: 199076 - protein, 23 aa, Mycobacterium bovis
FEQAADAVMHWGMQRNAGLRVRA

SEQ ID NO: 199077 - protein, 17 aa, Mycobacterium bovis
FEQALRIAYGESIENHR

SEQ ID NO: 199078 - protein, 21 aa, Mycobacterium bovis
FEQHLRAVLDYPLGDSDAVVP

SEQ ID NO: 199079 - protein, 18 aa, Mycobacterium bovis
FEQRPGEALALGQVLDTL

SEQ ID NO: 199080 - protein, 18 aa, Mycobacterium bovis
FEQVAFLLWRGELPTDAE

SEQ ID NO: 199081 - protein, 18 aa, Mycobacterium bovis
FERIARGVPVAAPWDARR

SEQ ID NO: 199082 - protein, 17 aa, Mycobacterium bovis
FERTLLGRALDFWNEEV

SEQ ID NO: 199083 - protein, 24 aa, Mycobacterium bovis
FESLLPRYLTTRVYAALLESAASE

SEQ ID NO: 199084 - protein, 23 aa, Mycobacterium bovis
FETICRYRLPVTVVILNNGGVYR

SEQ ID NO: 199085 - protein, 19 aa, Mycobacterium bovis
FEVAAHEFLLFPTVAHSHA

SEQ ID NO: 199086 - protein, 25 aa, Mycobacterium bovis
FEVEGGIIRVAEGWAHGPQVDKGVK

SEQ ID NO: 199087 - protein, 17 aa, Mycobacterium bovis
FEVEQMLPLDGHTPLTT

SEQ ID NO: 199088 - protein, 17 aa, Mycobacterium bovis
FEVLRAIVADFVATQEP

SEQ ID NO: 199089 - protein, 18 aa, Mycobacterium bovis
FFAAPLAWQERLWPTEEF

SEQ ID NO: 199090 - protein, 19 aa, Mycobacterium bovis
FFDGFPRNAHPMPVLSSVV

SEQ ID NO: 199091 - protein, 19 aa, Mycobacterium bovis
FFEFLTDLLDGWVAYFAEH

SEQ ID NO: 199092 - protein, 19 aa, Mycobacterium bovis
FFFLRPKDIAIYVGSGELD

SEQ ID NO: 199093 - protein, 18 aa, Mycobacterium bovis
FFGHSMGGMLAFEVALRY

SEQ ID NO: 199094 - protein, 18 aa, Mycobacterium bovis
FFGKLTYIRVYSGTVESG

SEQ ID NO: 199095 - protein, 17 aa, Mycobacterium bovis
FFGRPLKASMFFSPGGV

SEQ ID NO: 199096 - protein, 27 aa, Mycobacterium bovis
FFIEDWAEIWPCAGMAYPKALADDLRP

SEQ ID NO: 199097 - protein, 22 aa, Mycobacterium bovis
FFKDPVKGFFRALDYTLPWDVD

SEQ ID NO: 199098 - protein, 30 aa, Mycobacterium bovis
FFLHIPFPPVELFMQMPWRTEIIQGLLGAD

SEQ ID NO: 199099 - protein, 23 aa, Mycobacterium bovis
FFNNYRPQFYFRTTDVTGVVTLP

SEQ ID NO: 199100 - protein, 18 aa, Mycobacterium bovis
FFNTVYLDDVFVPDELVL

SEQ ID NO: 199101 - protein, 25 aa, Mycobacterium bovis
FFPSVREYSVRYGLTERRQAMLPGH

SEQ ID NO: 199102 - protein, 20 aa, Mycobacterium bovis
FFPTPACARLTEQNLQGFRS

SEQ ID NO: 199103 - protein, 23 aa, Mycobacterium bovis
FGAADPRFACVVRAFASMFPGRR

SEQ ID NO: 199104 - protein, 26 aa, Mycobacterium bovis
FGAGGIGGAGGPGFNGGAGGAGGRSG

SEQ ID NO: 199105 - protein, 17 aa, Mycobacterium bovis
FGALLSRGIGDTIRVSL

SEQ ID NO: 199106 - protein, 20 aa, Mycobacterium bovis
FGANMSGWWNQAHTALAGAG

SEQ ID NO: 199107 - protein, 21 aa, Mycobacterium bovis
FGAQLSAFHAQFVQSLTNGAR

SEQ ID NO: 199108 - protein, 17 aa, Mycobacterium bovis
FGARWGTQVNRIELARR

SEQ ID NO: 199109 - protein, 17 aa, Mycobacterium bovis
FGASLPVRVCTICTDPW

SEQ ID NO: 199110 - protein, 19 aa, Mycobacterium bovis
FGASSAFGGPCRTSTAELL

SEQ ID NO: 199111 - protein, 18 aa, Mycobacterium bovis
FGDPFPAPTQGITIHTGP

SEQ ID NO: 199112 - protein, 18 aa, Mycobacterium bovis
FGDRVMILMLNRTEFVES

SEQ ID NO: 199113 - protein, 18 aa, Mycobacterium bovis
FGDTEPWHVARTLTNAVL

SEQ ID NO: 199114 - protein, 26 aa, Mycobacterium bovis
FGDYFKRGAIELAWALLTNSLAAGGY

SEQ ID NO: 199115 - protein, 20 aa, Mycobacterium bovis
FGEGGGRLVAERLSRAVGAD

SEQ ID NO: 199116 - protein, 20 aa, Mycobacterium bovis
FGEGVRPPWSIGEPQPELAA

SEQ ID NO: 199117 - protein, 20 aa, Mycobacterium bovis
FGEPELRPEDLLRVDSQGRG

SEQ ID NO: 199118 - protein, 25 aa, Mycobacterium bovis
FGEPGGRELDLWLHRAAVDLVAVHA

SEQ ID NO: 199119 - protein, 17 aa, Mycobacterium bovis
FGEVIAYASRGVTLTPG

SEQ ID NO: 199120 - protein, 31 aa, Mycobacterium bovis
FGFATAPLVVAGCIMMRVCHLDTCPVGVATQ

SEQ ID NO: 199121 - protein, 26 aa, Mycobacterium bovis
FGFSPLRLPPDLDFTSLFHGVDERVP

SEQ ID NO: 199122 - protein, 29 aa, Mycobacterium bovis
FGGAGAGIANFLGFSVLHGGAGGAGGTAT

SEQ ID NO: 199123 - protein, 17 aa, Mycobacterium bovis
FGGGFQHWGDAMMTDGR

SEQ ID NO: 199124 - protein, 23 aa, Mycobacterium bovis
FGGPAVDSRWVWVLDPIDGTINH

SEQ ID NO: 199125 - protein, 25 aa, Mycobacterium bovis
FGHAGGCPHPLVVVAGAATRWVWVK

SEQ ID NO: 199126 - protein, 25 aa, Mycobacterium bovis
FGHDIGYRIAHHADLTTPPPIEVHE

SEQ ID NO: 199127 - protein, 17 aa, Mycobacterium bovis
FGHDNVTVFAARVRGDV

SEQ ID NO: 199128 - protein, 18 aa, Mycobacterium bovis
FGHSGWQPGDAWMAETTL

SEQ ID NO: 199129 - protein, 17 aa, Mycobacterium bovis
FGIALGMAAFRPGRPSR

SEQ ID NO: 199130 - protein, 18 aa, Mycobacterium bovis
FGIEPDLAEALVCAAARE

SEQ ID NO: 199131 - protein, 25 aa, Mycobacterium bovis
FGISGEVTFDYGIAYDRSRKVAEGR

SEQ ID NO: 199132 - protein, 19 aa, Mycobacterium bovis
FGLARRLSAAGADVIMAIR

SEQ ID NO: 199133 - protein, 23 aa, Mycobacterium bovis
FGLEIPGNIYTRIGNPTTDVVEQ

SEQ ID NO: 199134 - protein, 18 aa, Mycobacterium bovis
FGLGCVAGAAGVARLHDY

SEQ ID NO: 199135 - protein, 19 aa, Mycobacterium bovis
FGLHQALRLGKPLQFHVGF

SEQ ID NO: 199136 - protein, 25 aa, Mycobacterium bovis
FGLIPEFIGRLPVVASVTNLDKESL

SEQ ID NO: 199137 - protein, 17 aa, Mycobacterium bovis
FGLNMPIAREVDAVINH

SEQ ID NO: 199138 - protein, 17 aa, Mycobacterium bovis
FGNFGANMSGWWNQAHT

SEQ ID NO: 199139 - protein, 23 aa, Mycobacterium bovis
FGNFGGANSGFWNLASATSGASG

SEQ ID NO: 199140 - protein, 18 aa, Mycobacterium bovis
FGNHGARLSGILNNGSGP

SEQ ID NO: 199141 - protein, 18 aa, Mycobacterium bovis
FGNIIRLLPPLTIGDELL

SEQ ID NO: 199142 - protein, 17 aa, Mycobacterium bovis
FGNRIARTATYIKGDPH

SEQ ID NO: 199143 - protein, 24 aa, Mycobacterium bovis
FGNSGSGLSGWFNTSPVGLLAGSG

SEQ ID NO: 199144 - protein, 19 aa, Mycobacterium bovis
FGPEVKRRIMIGTYALSAG

SEQ ID NO: 199145 - protein, 20 aa, Mycobacterium bovis
FGPKRRRPQLLAVDNVVVCA

SEQ ID NO: 199146 - protein, 17 aa, Mycobacterium bovis
FGPLALASAFADRIAER

SEQ ID NO: 199147 - protein, 17 aa, Mycobacterium bovis
FGPSPAINLNIGKPDGS

SEQ ID NO: 199148 - protein, 24 aa, Mycobacterium bovis
FGPVARGGLRWSDRRDDFRTEILG

SEQ ID NO: 199149 - protein, 20 aa, Mycobacterium bovis
FGPYAGWSPKFLKHGQISDL

SEQ ID NO: 199150 - protein, 26 aa, Mycobacterium bovis
FGQPEIKLGVLPGMGGSQRLTRAIGK

SEQ ID NO: 199151 - protein, 25 aa, Mycobacterium bovis
FGQQMYTGMCTRAEMSAAAAGLPLE

SEQ ID NO: 199152 - protein, 24 aa, Mycobacterium bovis
FGQVTSGLTAGVWQGAAAAAMAAA

SEQ ID NO: 199153 - protein, 20 aa, Mycobacterium bovis
FGRIDGRPVGIVANQPTHFA

SEQ ID NO: 199154 - protein, 20 aa, Mycobacterium bovis
FGRLPFTMRGIRLEAVGVDD

SEQ ID NO: 199155 - protein, 25 aa, Mycobacterium bovis
FGSAAYWRRHIRQAVRFADSVRFAQ

SEQ ID NO: 199156 - protein, 22 aa, Mycobacterium bovis
FGSGNGRAGLPGSGNVGNGNLG

SEQ ID NO: 199157 - protein, 25 aa, Mycobacterium bovis
FGSPESRKWLCDMFADARMLAHDTG

SEQ ID NO: 199158 - protein, 18 aa, Mycobacterium bovis
FGSSARNRALLAERAGLV

SEQ ID NO: 199159 - protein, 27 aa, Mycobacterium bovis
FGSSSFRYAAPAGRNWTTADLAGMRIA

SEQ ID NO: 199160 - protein, 17 aa, Mycobacterium bovis
FGSVRVVEPAEWTRSNR

SEQ ID NO: 199161 - protein, 19 aa, Mycobacterium bovis
FGSVTSGLVVGWWQGSASA

SEQ ID NO: 199162 - protein, 18 aa, Mycobacterium bovis
FGTAGSRLDDLAAALPRI

SEQ ID NO: 199163 - protein, 26 aa, Mycobacterium bovis
FGTTQRFGVPMGFGGPHAGYLAVHAK

SEQ ID NO: 199164 - protein, 22 aa, Mycobacterium bovis
FGVEPPVALILQGASLHDLTAD

SEQ ID NO: 199165 - protein, 17 aa, Mycobacterium bovis
FGVRVVAVLVAQTGLSE

SEQ ID NO: 199166 - protein, 28 aa, Mycobacterium bovis
FGVYLHVPFCLTRCGYCDFNTYTPAQLG

SEQ ID NO: 199167 - protein, 21 aa, Mycobacterium bovis
FHDRFTASRLFGAPPGYVGYE

SEQ ID NO: 199168 - protein, 17 aa, Mycobacterium bovis
FHFPRIYLDYIGHGDSD

SEQ ID NO: 199169 - protein, 17 aa, Mycobacterium bovis
FHFRPHLTAASGKHGMG

SEQ ID NO: 199170 - protein, 19 aa, Mycobacterium bovis
FHGFRQGRNPFWDRLSRAM

SEQ ID NO: 199171 - protein, 23 aa, Mycobacterium bovis
FHRMAVDAFASLAADAIEAAQQT

SEQ ID NO: 199172 - protein, 18 aa, Mycobacterium bovis
FHRWCAALSTRWCSMRVQ

SEQ ID NO: 199173 - protein, 17 aa, Mycobacterium bovis
FHVKGDPSAAVTIADIA

SEQ ID NO: 199174 - protein, 19 aa, Mycobacterium bovis
FIADGAIEVGGRLPINTHG

SEQ ID NO: 199175 - protein, 25 aa, Mycobacterium bovis
FIAHLPGYQGWQWAVVVASYSGADH

SEQ ID NO: 199176 - protein, 27 aa, Mycobacterium bovis
FICVFGYKAQAAFFKHANIATAEAQIV

SEQ ID NO: 199177 - protein, 18 aa, Mycobacterium bovis
FIDACHTRRLGVLIDAVF

SEQ ID NO: 199178 - protein, 18 aa, Mycobacterium bovis
FIDERPQLLTARASADRG

SEQ ID NO: 199179 - protein, 21 aa, Mycobacterium bovis
FIEDVARTWHLTRYAGVADEI

SEQ ID NO: 199180 - protein, 24 aa, Mycobacterium bovis
FIEISAHPALLFAIGQNCEGAANL

SEQ ID NO: 199181 - protein, 19 aa, Mycobacterium bovis
FIGECKVWSGPRTMDDALK

SEQ ID NO: 199182 - protein, 22 aa, Mycobacterium bovis
FIGGNFSNGAFWQSDHQGQWGA

SEQ ID NO: 199183 - protein, 17 aa, Mycobacterium bovis
FIGHTFAVHDGRKHVPV

SEQ ID NO: 199184 - protein, 25 aa, Mycobacterium bovis
FIIGRIKDLLIVYGRNHAPDDIEAT

SEQ ID NO: 199185 - protein, 24 aa, Mycobacterium bovis
FIMPTTCPECGSPLAPEKEGDADI

SEQ ID NO: 199186 - protein, 33 aa, Mycobacterium bovis
FISGNYSNGFFWRGDYQGLIGLSTTITIPEIPY

SEQ ID NO: 199187 - protein, 33 aa, Mycobacterium bovis
FITGNFNNGFLWRGDHQGLIFGSPGFFNSTSAP

SEQ ID NO: 199188 - protein, 33 aa, Mycobacterium bovis
FITGNYSNGFWWRGDYQGLAGISQTITVPDTAV

SEQ ID NO: 199189 - protein, 20 aa, Mycobacterium bovis
FITGRIKELLVVDGANHYPE

SEQ ID NO: 199190 - protein, 34 aa, Mycobacterium bovis
FIVPAEGFLPALLDWCRKNHVVFIADEVQTGFAR

SEQ ID NO: 199191 - protein, 21 aa, Mycobacterium bovis
FIVTEIFPGGRLPSIPMVQEC

SEQ ID NO: 199192 - protein, 30 aa, Mycobacterium bovis
FKAARRGLVPGLPRLLRVVGHYYKPGFHPS

SEQ ID NO: 199193 - protein, 24 aa, Mycobacterium bovis
FKAMAAGLSSLAGRGDEESGEPAA

SEQ ID NO: 199194 - protein, 21 aa, Mycobacterium bovis
FKCPRSIAFEPQLPRTDTGKL

SEQ ID NO: 199195 - protein, 26 aa, Mycobacterium bovis
FKGRNVEIPDHFRIYVSQKLARLERF

SEQ ID NO: 199196 - protein, 21 aa, Mycobacterium bovis
FKHVAEMFAELEATALRSYPR

SEQ ID NO: 199197 - protein, 17 aa, Mycobacterium bovis
FKKGFAATGGGSVVPDE

SEQ ID NO: 199198 - protein, 18 aa, Mycobacterium bovis
FKKGKLVFKQAGIANPAI

SEQ ID NO: 199199 - protein, 23 aa, Mycobacterium bovis
FKLPREGDAEFSFLPRFSPGKGL

SEQ ID NO: 199200 - protein, 21 aa, Mycobacterium bovis
FKMAAELAYLEFGDLIDAMVT

SEQ ID NO: 199201 - protein, 17 aa, Mycobacterium bovis
FKPGTLTSLGFSYDVLH

SEQ ID NO: 199202 - protein, 27 aa, Mycobacterium bovis
FKPLYGSSLVTGWARLHGYPLGILANA

SEQ ID NO: 199203 - protein, 18 aa, Mycobacterium bovis
FKQWGGRTPKAFGRELDG

SEQ ID NO: 199204 - protein, 19 aa, Mycobacterium bovis
FKRYAWWPYTLVMRRVNVF

SEQ ID NO: 199205 - protein, 18 aa, Mycobacterium bovis
FKTALRLARHRELVDGAD

SEQ ID NO: 199206 - protein, 20 aa, Mycobacterium bovis
FKTHGCQPWQNTGSEGAAPA

SEQ ID NO: 199207 - protein, 25 aa, Mycobacterium bovis
FKVLLKELQSLCLNVEVLSSDGAAI

SEQ ID NO: 199208 - protein, 22 aa, Mycobacterium bovis
FKVRRGEVIGLLGPNGAGKTTM

SEQ ID NO: 199209 - protein, 18 aa, Mycobacterium bovis
FLAGFHIIDRHFATAPLE

SEQ ID NO: 199210 - protein, 20 aa, Mycobacterium bovis
FLAIAGRRVQLEIFTKFNIP

SEQ ID NO: 199211 - protein, 23 aa, Mycobacterium bovis
FLANTGRPLIGNGANGAPGTGAD

SEQ ID NO: 199212 - protein, 19 aa, Mycobacterium bovis
FLAPPGRAPVLVYGPGPAG

SEQ ID NO: 199213 - protein, 23 aa, Mycobacterium bovis
FLARLCKTAIWIDHGVIRLAGGI

SEQ ID NO: 199214 - protein, 21 aa, Mycobacterium bovis
FLDKRGPGIQQLACRVSDLDA

SEQ ID NO: 199215 - protein, 18 aa, Mycobacterium bovis
FLDRGLRDTGRCRVPLIL

SEQ ID NO: 199216 - protein, 20 aa, Mycobacterium bovis
FLDSARGVHQFLGRRRFVYP

SEQ ID NO: 199217 - protein, 18 aa, Mycobacterium bovis
FLEGCGRTDFPGGDSDEM

SEQ ID NO: 199218 - protein, 18 aa, Mycobacterium bovis
FLELAAIRTKAVRQGDPL

SEQ ID NO: 199219 - protein, 30 aa, Mycobacterium bovis
FLEPFRLSDPFITIDAFQVVAGVLFLENII

SEQ ID NO: 199220 - protein, 24 aa, Mycobacterium bovis
FLESLRYDLAVQEIFVFTPKGDVI

SEQ ID NO: 199221 - protein, 18 aa, Mycobacterium bovis
FLGLRPPPPQRYPLSEAQ

SEQ ID NO: 199222 - protein, 19 aa, Mycobacterium bovis
FLGRLRGSDITRFRCAGRR

SEQ ID NO: 199223 - protein, 25 aa, Mycobacterium bovis
FLGRYCTGYERFERYLLGLDDGIPK

SEQ ID NO: 199224 - protein, 29 aa, Mycobacterium bovis
FLHPDLVWDFRLPRVVSINVSGHKYGLTY

SEQ ID NO: 199225 - protein, 17 aa, Mycobacterium bovis
FLHRAFDQLLFDIGLHR

SEQ ID NO: 199226 - protein, 20 aa, Mycobacterium bovis
FLIIDGWPGFVGEFPDLEGQ

SEQ ID NO: 199227 - protein, 24 aa, Mycobacterium bovis
FLKSKLRTGGLLLNHCITRHDNRS

SEQ ID NO: 199228 - protein, 17 aa, Mycobacterium bovis
FLLAFLACFDAGDRVAM

SEQ ID NO: 199229 - protein, 17 aa, Mycobacterium bovis
FLLNQMLVWGFTGQVIS

SEQ ID NO: 199230 - protein, 20 aa, Mycobacterium bovis
FLLNRNRLNVAVSRAQYAAV

SEQ ID NO: 199231 - protein, 17 aa, Mycobacterium bovis
FLLQGGDCAETFMDNTE

SEQ ID NO: 199232 - protein, 18 aa, Mycobacterium bovis
FLLQRPLLTAIRRTEPTV

SEQ ID NO: 199233 - protein, 18 aa, Mycobacterium bovis
FLLTAGFFETHRPYPHER

SEQ ID NO: 199234 - protein, 25 aa, Mycobacterium bovis
FLMSVGDLIIGWLLQRQAAVAVAAL

SEQ ID NO: 199235 - protein, 17 aa, Mycobacterium bovis
FLPAVARMRALDPVTSE

SEQ ID NO: 199236 - protein, 25 aa, Mycobacterium bovis
FLPELGLRRENIVFISGIGCSSRFP

SEQ ID NO: 199237 - protein, 26 aa, Mycobacterium bovis
FLPMEELIAAFLPVLFPGMEIVEHHA

SEQ ID NO: 199238 - protein, 17 aa, Mycobacterium bovis
FLPRFSPGKGLGVIPRE

SEQ ID NO: 199239 - protein, 25 aa, Mycobacterium bovis
FLQRPARWIQLLARNGRTISAGPNF

SEQ ID NO: 199240 - protein, 26 aa, Mycobacterium bovis
FLRAAARRCDITWPQPQVLCTMRLAR

SEQ ID NO: 199241 - protein, 20 aa, Mycobacterium bovis
FLRISREITCAQANLMPATA

SEQ ID NO: 199242 - protein, 18 aa, Mycobacterium bovis
FLRQIIANQQVYWQQIAA

SEQ ID NO: 199243 - protein, 20 aa, Mycobacterium bovis
FLRWGQGAFDDFKVVPPGTG

SEQ ID NO: 199244 - protein, 17 aa, Mycobacterium bovis
FLSGGFLAPPGRAPVLV

SEQ ID NO: 199245 - protein, 17 aa, Mycobacterium bovis
FLSGGYSLPAIPLGIDV

SEQ ID NO: 199246 - protein, 26 aa, Mycobacterium bovis
FLTACQRRYGSVFTLHVAGFGHMVYL

SEQ ID NO: 199247 - protein, 28 aa, Mycobacterium bovis
FLTPNGRPFFCGTYYPKAAFLQLLSAIS

SEQ ID NO: 199248 - protein, 22 aa, Mycobacterium bovis
FLTRNRLVAAVARAAVVVEAGL

SEQ ID NO: 199249 - protein, 18 aa, Mycobacterium bovis
FMAARTAFFDEYFLATAD

SEQ ID NO: 199250 - protein, 29 aa, Mycobacterium bovis
FMEVAKLRAGRLLWSELVAQFAPKSAKSL

SEQ ID NO: 199251 - protein, 18 aa, Mycobacterium bovis
FMGSCAYAVLAQESVRCR

SEQ ID NO: 199252 - protein, 17 aa, Mycobacterium bovis
FMIGRPASDPAYFPCYA

SEQ ID NO: 199253 - protein, 21 aa, Mycobacterium bovis
FMRILGPQFLSRFYGRTLNTH

SEQ ID NO: 199254 - protein, 17 aa, Mycobacterium bovis
FMRPFRADEWLLYDQSS

SEQ ID NO: 199255 - protein, 34 aa, Mycobacterium bovis
FMSGNFSNGLLWRGDHEGLFSLFYSLDVPRITIV

SEQ ID NO: 199256 - protein, 24 aa, Mycobacterium bovis
FNEAADLAAVWQLPVVILVENIRG

SEQ ID NO: 199257 - protein, 26 aa, Mycobacterium bovis
FNKASRRIKLAWFLLNAARYMPAQVF

SEQ ID NO: 199258 - protein, 17 aa, Mycobacterium bovis
FNPPGIECERYDLRSNI

SEQ ID NO: 199259 - protein, 19 aa, Mycobacterium bovis
FNQFCYLQLSGKRSRRGQP

SEQ ID NO: 199260 - protein, 17 aa, Mycobacterium bovis
FNRPLRPLAPVAHLDFD

SEQ ID NO: 199261 - protein, 17 aa, Mycobacterium bovis
FNRRKGVRMSMLVSADA

SEQ ID NO: 199262 - protein, 26 aa, Mycobacterium bovis
FNRTHPMLCALPIERAIDAAETLDAE

SEQ ID NO: 199263 - protein, 19 aa, Mycobacterium bovis
FNWPALPVAMADTIVPDFP

SEQ ID NO: 199264 - protein, 17 aa, Mycobacterium bovis
FPARAFDALDALVASAA

SEQ ID NO: 199265 - protein, 22 aa, Mycobacterium bovis
FPDDIAHYLWTWTDRSAGSLRA

SEQ ID NO: 199266 - protein, 19 aa, Mycobacterium bovis
FPDPWPKARHHKRRLLQPA

SEQ ID NO: 199267 - protein, 19 aa, Mycobacterium bovis
FPDRPALELDGWAYARPLA

SEQ ID NO: 199268 - protein, 41 aa, Mycobacterium bovis
FPESHALSFASLVFYSAWFKLHHPAAFCAALLRAQPMGFYS

SEQ ID NO: 199269 - protein, 17 aa, Mycobacterium bovis
FPFPDNSGLDWGALGEC

SEQ ID NO: 199270 - protein, 25 aa, Mycobacterium bovis
FPGEISGGMRKRAGLARALVLDPQI

SEQ ID NO: 199271 - protein, 36 aa, Mycobacterium bovis
FPGGHCRGVCLGGYLLQGGYGWNSRIYGPACESVIG

SEQ ID NO: 199272 - protein, 20 aa, Mycobacterium bovis
FPILKRIMRGGNPLAYLDSG

SEQ ID NO: 199273 - protein, 33 aa, Mycobacterium bovis
FPKASVMTHHRWLRALAVFGGMGLRLKGSDTLY

SEQ ID NO: 199274 - protein, 28 aa, Mycobacterium bovis
FPKVAAMHYPVWRQSWTGILDPYLLDMI

SEQ ID NO: 199275 - protein, 27 aa, Mycobacterium bovis
FPLDLVPRVISAPEWTRLERGITQRVK

SEQ ID NO: 199276 - protein, 17 aa, Mycobacterium bovis
FPLMPRIFMAVRRESRF

SEQ ID NO: 199277 - protein, 21 aa, Mycobacterium bovis
FPNAPMRAVPMWAHPEPLPPV

SEQ ID NO: 199278 - protein, 25 aa, Mycobacterium bovis
FPNFCTGELTTAIAMTEPGTGSDLQ

SEQ ID NO: 199279 - protein, 20 aa, Mycobacterium bovis
FPPAGTLSGIAKRELRGVPA

SEQ ID NO: 199280 - protein, 24 aa, Mycobacterium bovis
FPPGWSRCRAPAGPPVPLIVNSRP

SEQ ID NO: 199281 - protein, 25 aa, Mycobacterium bovis
FPPYHPPMRTFLGVPVRVRDESFGT

SEQ ID NO: 199282 - protein, 22 aa, Mycobacterium bovis
FPQHRRAHAWWQDTVNGHTRIG

SEQ ID NO: 199283 - protein, 18 aa, Mycobacterium bovis
FPSACGKTNLAMLQPTIP

SEQ ID NO: 199284 - protein, 20 aa, Mycobacterium bovis
FPSKEAVLLTLLDRVVNQAD

SEQ ID NO: 199285 - protein, 24 aa, Mycobacterium bovis
FPTADDVVVAWPHRYLAAQAEAGG

SEQ ID NO: 199286 - protein, 20 aa, Mycobacterium bovis
FPTDRGWALRELFDGSRRNG

SEQ ID NO: 199287 - protein, 17 aa, Mycobacterium bovis
FPTRSLSDFGFANVDRN

SEQ ID NO: 199288 - protein, 24 aa, Mycobacterium bovis
FQAEARQLLDLMVHSVYSNKDAFL

SEQ ID NO: 199289 - protein, 17 aa, Mycobacterium bovis
FQFTGQRFFRIRGGQLY

SEQ ID NO: 199290 - protein, 21 aa, Mycobacterium bovis
FQHYLGEPLGGFTGWRPQLPV

SEQ ID NO: 199291 - protein, 19 aa, Mycobacterium bovis
FQLDIMRVPGIIVARTDAE

SEQ ID NO: 199292 - protein, 22 aa, Mycobacterium bovis
FQLGGAAARGGERSCFPSRHAR

SEQ ID NO: 199293 - protein, 21 aa, Mycobacterium bovis
FQMMGLCQILRDGVIPPNRSL

SEQ ID NO: 199294 - protein, 23 aa, Mycobacterium bovis
FQPQLRVLVDLGYADYGPGGNYA

SEQ ID NO: 199295 - protein, 20 aa, Mycobacterium bovis
FQQRVWKALLTIPYGETRSY

SEQ ID NO: 199296 - protein, 17 aa, Mycobacterium bovis
FQRTRSGYDPVAVNHYI

SEQ ID NO: 199297 - protein, 24 aa, Mycobacterium bovis
FQSFPAVAGSSLFAKLHDSAARKS

SEQ ID NO: 199298 - protein, 23 aa, Mycobacterium bovis
FQTLTGRPLIGNGANGTPGTGAA

SEQ ID NO: 199299 - protein, 23 aa, Mycobacterium bovis
FQVSAEWSWLVLVGAVVGDWLVS

SEQ ID NO: 199300 - protein, 23 aa, Mycobacterium bovis
FRAELTIPLILLGGITNRTTMDL

SEQ ID NO: 199301 - protein, 17 aa, Mycobacterium bovis
FRALCRQLEQSKVGTVS

SEQ ID NO: 199302 - protein, 18 aa, Mycobacterium bovis
FRALYRLERHQLLDCPIL

SEQ ID NO: 199303 - protein, 17 aa, Mycobacterium bovis
FRAMAPLDPDRCVRGQY

SEQ ID NO: 199304 - protein, 17 aa, Mycobacterium bovis
FRASVWGTGSFTVNDFL

SEQ ID NO: 199305 - protein, 21 aa, Mycobacterium bovis
FRELSIPYLPVRWSTDNPDSI

SEQ ID NO: 199306 - protein, 20 aa, Mycobacterium bovis
FREVSELAANFGVMNSGVAV

SEQ ID NO: 199307 - protein, 23 aa, Mycobacterium bovis
FRFFAAPGSWTLRALSAAGNGDA

SEQ ID NO: 199308 - protein, 20 aa, Mycobacterium bovis
FRFGPEPDRSQTFACEASSH

SEQ ID NO: 199309 - protein, 19 aa, Mycobacterium bovis
FRGALAVDAHMRRHKTTKA

SEQ ID NO: 199310 - protein, 17 aa, Mycobacterium bovis
FRGERLVNSMFTLSTMV

SEQ ID NO: 199311 - protein, 18 aa, Mycobacterium bovis
FRGLSLRPFMIGRPASDP

SEQ ID NO: 199312 - protein, 17 aa, Mycobacterium bovis
FRGSELIAEKWNLSREE

SEQ ID NO: 199313 - protein, 22 aa, Mycobacterium bovis
FRIPYDPHLATGLAVDFSSLKR

SEQ ID NO: 199314 - protein, 19 aa, Mycobacterium bovis
FRKHPRARAGWDRATGRIP

SEQ ID NO: 199315 - protein, 17 aa, Mycobacterium bovis
FRLGEKVDDPLAMYLFD

SEQ ID NO: 199316 - protein, 21 aa, Mycobacterium bovis
FRLGSDPGLARFIDQVARRVQ

SEQ ID NO: 199317 - protein, 17 aa, Mycobacterium bovis
FRLIAEEALTLMAGAAT

SEQ ID NO: 199318 - protein, 25 aa, Mycobacterium bovis
FRLLPPRTMRALLARICEQEGVVVD

SEQ ID NO: 199319 - protein, 22 aa, Mycobacterium bovis
FRLRELRAAQSLTQVQVAALAH

SEQ ID NO: 199320 - protein, 19 aa, Mycobacterium bovis
FRNARELREAVPLMPVEQL

SEQ ID NO: 199321 - protein, 19 aa, Mycobacterium bovis
FRPATLHQAYLALRAWGLP

SEQ ID NO: 199322 - protein, 19 aa, Mycobacterium bovis
FRPEFFAAMRELCDEFDAL

SEQ ID NO: 199323 - protein, 22 aa, Mycobacterium bovis
FRPGDEGRLVLGDRIAAGAQLG

SEQ ID NO: 199324 - protein, 30 aa, Mycobacterium bovis
FRPKVWPAVRRIDGAYGDRNLVCSCPPVEA

SEQ ID NO: 199325 - protein, 17 aa, Mycobacterium bovis
FRPLGRVPERGRLLREL

SEQ ID NO: 199326 - protein, 20 aa, Mycobacterium bovis
FRPLLNLALRRFLRNLRRYT

SEQ ID NO: 199327 - protein, 20 aa, Mycobacterium bovis
FRPVALESLSHFPVTVAAHR

SEQ ID NO: 199328 - protein, 20 aa, Mycobacterium bovis
FRRFTPRARNAVVAAQNAAH

SEQ ID NO: 199329 - protein, 28 aa, Mycobacterium bovis
FRRHAGLDLLPRLLFRNGELDISVVRSI

SEQ ID NO: 199330 - protein, 20 aa, Mycobacterium bovis
FRRHQVVYQRLAPRCTARDV

SEQ ID NO: 199331 - protein, 17 aa, Mycobacterium bovis
FRRLAVFPSGFDLDGAQ

SEQ ID NO: 199332 - protein, 17 aa, Mycobacterium bovis
FRRVHLSTGDHFDLYDT

SEQ ID NO: 199333 - protein, 17 aa, Mycobacterium bovis
FRSAAPVWRHDPAPTVL

SEQ ID NO: 199334 - protein, 17 aa, Mycobacterium bovis
FRTALRDSLDIYGVMAT

SEQ ID NO: 199335 - protein, 20 aa, Mycobacterium bovis
FRTSLRSCPAEKRRDMLFDH

SEQ ID NO: 199336 - protein, 23 aa, Mycobacterium bovis
FSAAIPPNLPLPAKIVMQVLDPI

SEQ ID NO: 199337 - protein, 21 aa, Mycobacterium bovis
FSAGGPVLWPDLEAILVVPNN

SEQ ID NO: 199338 - protein, 17 aa, Mycobacterium bovis
FSAKFASAVSKNPFVGE

SEQ ID NO: 199339 - protein, 21 aa, Mycobacterium bovis
FSAPLRRAGAVLVTPVPHPGR

SEQ ID NO: 199340 - protein, 17 aa, Mycobacterium bovis
FSARRLDGGFSEWLAAD

SEQ ID NO: 199341 - protein, 17 aa, Mycobacterium bovis
FSCYVHPEIEFFLLKPG

SEQ ID NO: 199342 - protein, 28 aa, Mycobacterium bovis
FSDELGMTFPQWRTQLRLQHALVLLAER

SEQ ID NO: 199343 - protein, 21 aa, Mycobacterium bovis
FSDKQLDMMAAFADQAALAWR

SEQ ID NO: 199344 - protein, 20 aa, Mycobacterium bovis
FSDVLKAMGVYPGLDGAAPV

SEQ ID NO: 199345 - protein, 19 aa, Mycobacterium bovis
FSEGGCWRTFLTCDANLAV

SEQ ID NO: 199346 - protein, 24 aa, Mycobacterium bovis
FSEPCTDCRGSGSIIEHPCEECKG

SEQ ID NO: 199347 - protein, 17 aa, Mycobacterium bovis
FSETGAIKAKSVIIAAG

SEQ ID NO: 199348 - protein, 21 aa, Mycobacterium bovis
FSEVHPLPGRDLMPVVDGASA

SEQ ID NO: 199349 - protein, 18 aa, Mycobacterium bovis
FSGASWQRCRVHFMRNLY

SEQ ID NO: 199350 - protein, 17 aa, Mycobacterium bovis
FSGKILAPAHLPQEQSQ

SEQ ID NO: 199351 - protein, 18 aa, Mycobacterium bovis
FSGKILAPAHLPQEQSQR

SEQ ID NO: 199352 - protein, 24 aa, Mycobacterium bovis
FSGPARKVLELTFREALRLGHNYI

SEQ ID NO: 199353 - protein, 23 aa, Mycobacterium bovis
FSHGGALKSSWYGDCLPESDFPT

SEQ ID NO: 199354 - protein, 23 aa, Mycobacterium bovis
FSKLFRSEIDWDYLTEPQPELDG

SEQ ID NO: 199355 - protein, 17 aa, Mycobacterium bovis
FSLCMDNGMPILVFNLL

SEQ ID NO: 199356 - protein, 20 aa, Mycobacterium bovis
FSMASGRVAYAMRLHGPAIT

SEQ ID NO: 199357 - protein, 22 aa, Mycobacterium bovis
FSMHGELYKAIARQAHVIHESF

SEQ ID NO: 199358 - protein, 17 aa, Mycobacterium bovis
FSMVLPSFVNTELIAGT

SEQ ID NO: 199359 - protein, 17 aa, Mycobacterium bovis
FSNLKARAAVGALDGSL

SEQ ID NO: 199360 - protein, 17 aa, Mycobacterium bovis
FSREKVISGVRRACQGR

SEQ ID NO: 199361 - protein, 17 aa, Mycobacterium bovis
FSRIGALPITKASDRLQ

SEQ ID NO: 199362 - protein, 17 aa, Mycobacterium bovis
FSRISDVLLPFLVTRQL

SEQ ID NO: 199363 - protein, 25 aa, Mycobacterium bovis
FSRQRLRDLGLWGLTNFDRVDFVYT

SEQ ID NO: 199364 - protein, 25 aa, Mycobacterium bovis
FSRWNVGKDLSFVPLRPERVVEVRY

SEQ ID NO: 199365 - protein, 24 aa, Mycobacterium bovis
FSSKLELYLAVLHRHVENLVSGVH

SEQ ID NO: 199366 - protein, 18 aa, Mycobacterium bovis
FSTLLSNAGTIFWNGPMG

SEQ ID NO: 199367 - protein, 30 aa, Mycobacterium bovis
FSTRGCPYRCTFCGTGAMSAMLGKDSYRAK

SEQ ID NO: 199368 - protein, 18 aa, Mycobacterium bovis
FSVLCPQGRLVDAPLPAW

SEQ ID NO: 199369 - protein, 17 aa, Mycobacterium bovis
FSWKNTGQILADEGHHV

SEQ ID NO: 199370 - protein, 18 aa, Mycobacterium bovis
FTAAEALEYGFVDHIITR

SEQ ID NO: 199371 - protein, 26 aa, Mycobacterium bovis
FTAEVDIRPKISLPDLSALTVSVDPI

SEQ ID NO: 199372 - protein, 17 aa, Mycobacterium bovis
FTANPWLSGYMSQALNL

SEQ ID NO: 199373 - protein, 20 aa, Mycobacterium bovis
FTATPRTGMWRLNHDGRVSF

SEQ ID NO: 199374 - protein, 25 aa, Mycobacterium bovis
FTAYDCARLRFILTAQRDHYLPLKV

SEQ ID NO: 199375 - protein, 25 aa, Mycobacterium bovis
FTDPRIATPMLARIGGAALAEDVNG

SEQ ID NO: 199376 - protein, 25 aa, Mycobacterium bovis
FTENPAGSVLIEFGHTKVLCTASVT

SEQ ID NO: 199377 - protein, 18 aa, Mycobacterium bovis
FTERAAPILADLRQLEAI

SEQ ID NO: 199378 - protein, 17 aa, Mycobacterium bovis
FTESLAFGATRNPWCLN

SEQ ID NO: 199379 - protein, 21 aa, Mycobacterium bovis
FTETVTWWQVHRRAMIVAEEL

SEQ ID NO: 199380 - protein, 23 aa, Mycobacterium bovis
FTGAFGPVVVPPIPVPAINAHLT

SEQ ID NO: 199381 - protein, 25 aa, Mycobacterium bovis
FTGQRFFRIRGGQLYGQLRDVAYQS

SEQ ID NO: 199382 - protein, 23 aa, Mycobacterium bovis
FTGVPCIVDLATMREAIADLGGN

SEQ ID NO: 199383 - protein, 17 aa, Mycobacterium bovis
FTHELRMTLRELGSRRV

SEQ ID NO: 199384 - protein, 19 aa, Mycobacterium bovis
FTHLLGYALVQAVKKFPNM

SEQ ID NO: 199385 - protein, 18 aa, Mycobacterium bovis
FTHTCFMVTPYEGYVAVA

SEQ ID NO: 199386 - protein, 17 aa, Mycobacterium bovis
FTIPAQTPVTVGMEVAN

SEQ ID NO: 199387 - protein, 21 aa, Mycobacterium bovis
FTIPIIGFESFAFSFHIHTEP

SEQ ID NO: 199388 - protein, 17 aa, Mycobacterium bovis
FTLLEALIRRPGIVHTR

SEQ ID NO: 199389 - protein, 22 aa, Mycobacterium bovis
FTPEELYPLTGVRSLVLNTSVE

SEQ ID NO: 199390 - protein, 17 aa, Mycobacterium bovis
FTPRAKKVLELSLREAL

SEQ ID NO: 199391 - protein, 25 aa, Mycobacterium bovis
FTQQLKKLAGLSERLTSAAAAAAGP

SEQ ID NO: 199392 - protein, 17 aa, Mycobacterium bovis
FTRMMAGLGEALGFDVD

SEQ ID NO: 199393 - protein, 17 aa, Mycobacterium bovis
FTRRSHAWLEQQTGCRK

SEQ ID NO: 199394 - protein, 30 aa, Mycobacterium bovis
FTSDQEVRWCPGCGDYVILNTIRNFLPELG

SEQ ID NO: 199395 - protein, 23 aa, Mycobacterium bovis
FTSEVRGVFTYRVNKAGLITNMR

SEQ ID NO: 199396 - protein, 20 aa, Mycobacterium bovis
FTSHGLRLGVEASLRSLARV

SEQ ID NO: 199397 - protein, 27 aa, Mycobacterium bovis
FTTAAWRKLLVNALAGFMVLSGRRSAM

SEQ ID NO: 199398 - protein, 25 aa, Mycobacterium bovis
FTTGVPVQWSAVFAGSGGRRVQLPT

SEQ ID NO: 199399 - protein, 17 aa, Mycobacterium bovis
FTVADAYQGRGIGSFLI

SEQ ID NO: 199400 - protein, 23 aa, Mycobacterium bovis
FTVFPDGYSLPAIPLGIDVGGAI

SEQ ID NO: 199401 - protein, 18 aa, Mycobacterium bovis
FVAALRAIWLAWQDGTKL

SEQ ID NO: 199402 - protein, 18 aa, Mycobacterium bovis
FVAHRGMTVLPLAKSASG

SEQ ID NO: 199403 - protein, 26 aa, Mycobacterium bovis
FVALCRAAGVPARIAFQTIDAPDKEF

SEQ ID NO: 199404 - protein, 18 aa, Mycobacterium bovis
FVDAMCRKALRLTPEDTG

SEQ ID NO: 199405 - protein, 17 aa, Mycobacterium bovis
FVERLSRATIDVSKGHP

SEQ ID NO: 199406 - protein, 23 aa, Mycobacterium bovis
FVEVRRAGIALAREVERRAPDAV

SEQ ID NO: 199407 - protein, 36 aa, Mycobacterium bovis
FVGATSRPSALALDDVVKFLLPRGSTRKAAKGAAST

SEQ ID NO: 199408 - protein, 21 aa, Mycobacterium bovis
FVGIAEAYVLNAFRRAGVPMQ

SEQ ID NO: 199409 - protein, 20 aa, Mycobacterium bovis
FVHAHPRWIAQAFADALGAA

SEQ ID NO: 199410 - protein, 20 aa, Mycobacterium bovis
FVIAANRSRLVSLALSNLFG

SEQ ID NO: 199411 - protein, 28 aa, Mycobacterium bovis
FVLAPWQIHDWILLTPWGLLSWPQINQQ

SEQ ID NO: 199412 - protein, 17 aa, Mycobacterium bovis
FVLGALRDNQTWSTPAE

SEQ ID NO: 199413 - protein, 26 aa, Mycobacterium bovis
FVLPNAWDVPSALAYLAEGFTAIGTT

SEQ ID NO: 199414 - protein, 17 aa, Mycobacterium bovis
FVLSAAVDHAHDLLARA

SEQ ID NO: 199415 - protein, 19 aa, Mycobacterium bovis
FVNGKSWLVFGPYAGWSPK

SEQ ID NO: 199416 - protein, 25 aa, Mycobacterium bovis
FVNSRPKPLSAYLFTKSRAVRERVI

SEQ ID NO: 199417 - protein, 25 aa, Mycobacterium bovis
FVNVYRVVSNLGVFDFGGPDHSMRA

SEQ ID NO: 199418 - protein, 17 aa, Mycobacterium bovis
FVPLRPERVVEVRYDHM

SEQ ID NO: 199419 - protein, 23 aa, Mycobacterium bovis
FVPLRPGHVSIYLCGATVQGLPH

SEQ ID NO: 199420 - protein, 22 aa, Mycobacterium bovis
FVRGEGAGVVVLKRLTDAVRDG

SEQ ID NO: 199421 - protein, 24 aa, Mycobacterium bovis
FVRSEGCAMVLLKRLPDALRDGNR

SEQ ID NO: 199422 - protein, 27 aa, Mycobacterium bovis
FVRTSGYLPGPHDVYVSMNMVRKNGMR

SEQ ID NO: 199423 - protein, 19 aa, Mycobacterium bovis
FVSACSAPGHIRYKQLQDL

SEQ ID NO: 199424 - protein, 26 aa, Mycobacterium bovis
FVSGEGCVMLALKRLPDALADGDRIL

SEQ ID NO: 199425 - protein, 18 aa, Mycobacterium bovis
FVSQLGFAVAPRVRAAIE

SEQ ID NO: 199426 - protein, 21 aa, Mycobacterium bovis
FVTCDARLATRLPEGLTDAQA

SEQ ID NO: 199427 - protein, 17 aa, Mycobacterium bovis
FVVEIAAELPMQMICIL

SEQ ID NO: 199428 - protein, 19 aa, Mycobacterium bovis
FVVGMSLGGLTAIRLAAMA

SEQ ID NO: 199429 - protein, 24 aa, Mycobacterium bovis
FWDLLCAGRSGIVRVPAQRWDADA

SEQ ID NO: 199430 - protein, 21 aa, Mycobacterium bovis
FWTFPRSCNPTGGLMSTARDQ

SEQ ID NO: 199431 - protein, 18 aa, Mycobacterium bovis
FYAQCAIDAGVAFVNALP

SEQ ID NO: 199432 - protein, 19 aa, Mycobacterium bovis
FYASIAHLCVDPMIVGVLF

SEQ ID NO: 199433 - protein, 19 aa, Mycobacterium bovis
FYAYAEILLALGRGDEALQ

SEQ ID NO: 199434 - protein, 20 aa, Mycobacterium bovis
FYCVANMPASVPKTSTYALT

SEQ ID NO: 199435 - protein, 22 aa, Mycobacterium bovis
FYEADYWKARLAETPVDVATLE

SEQ ID NO: 199436 - protein, 18 aa, Mycobacterium bovis
FYFLTGRGALLQLGLLQL

SEQ ID NO: 199437 - protein, 19 aa, Mycobacterium bovis
FYNTEGLPYFSIGMGNNFI

SEQ ID NO: 199438 - protein, 18 aa, Mycobacterium bovis
FYRGKIAVAAFFAKNMLP

SEQ ID NO: 199439 - protein, 19 aa, Mycobacterium bovis
GAAAIRITDYLSRDLTITQ

SEQ ID NO: 199440 - protein, 18 aa, Mycobacterium bovis
GAADLSFGDAPVVLTAGY

SEQ ID NO: 199441 - protein, 26 aa, Mycobacterium bovis
GAAEALRWAMMRGEPLVVLADALAEA

SEQ ID NO: 199442 - protein, 19 aa, Mycobacterium bovis
GAAGLARAAVSVFEEALAA

SEQ ID NO: 199443 - protein, 19 aa, Mycobacterium bovis
GAAIAGRGWTLVWGGGHVS

SEQ ID NO: 199444 - protein, 25 aa, Mycobacterium bovis
GAAIDYKAGELLPVEIPEIPEHTPN

SEQ ID NO: 199445 - protein, 22 aa, Mycobacterium bovis
GAAIELMHLGTLCHDRVVDESD

SEQ ID NO: 199446 - protein, 24 aa, Mycobacterium bovis
GAAISELTNMRWWSGPASDSMVAA

SEQ ID NO: 199447 - protein, 18 aa, Mycobacterium bovis
GAAKHARKVAAWGADAMI

SEQ ID NO: 199448 - protein, 27 aa, Mycobacterium bovis
GAALARLEARIVLRLLLDRTSVIEAAD

SEQ ID NO: 199449 - protein, 17 aa, Mycobacterium bovis
GAAMFLLQRRSRATADR

SEQ ID NO: 199450 - protein, 23 aa, Mycobacterium bovis
GAAPRARVPAVRESIYSSIDDLQ

SEQ ID NO: 199451 - protein, 24 aa, Mycobacterium bovis
GAAWIDPRVRGHVVALADPATGLA

SEQ ID NO: 199452 - protein, 17 aa, Mycobacterium bovis
GACAQVNSDLGLLAPEK

SEQ ID NO: 199453 - protein, 19 aa, Mycobacterium bovis
GACDSTLLIAERVQSYADV

SEQ ID NO: 199454 - protein, 24 aa, Mycobacterium bovis
GACEPVCPVEAIFYEDDVPEQWSH

SEQ ID NO: 199455 - protein, 21 aa, Mycobacterium bovis
GACLNREMSRFIDALRSSINF

SEQ ID NO: 199456 - protein, 20 aa, Mycobacterium bovis
GADAAYVCRGRVCDLPVTSA

SEQ ID NO: 199457 - protein, 25 aa, Mycobacterium bovis
GADEVSAAIAALFSGHAQAYQALSA

SEQ ID NO: 199458 - protein, 26 aa, Mycobacterium bovis
GADEVSAAIASLFAAHGQAYQAVSAQ

SEQ ID NO: 199459 - protein, 25 aa, Mycobacterium bovis
GADEVSAAIASLFSGNAQAYQALSA

SEQ ID NO: 199460 - protein, 25 aa, Mycobacterium bovis
GADEVSAAVAALFSGHAQTYQALST

SEQ ID NO: 199461 - protein, 26 aa, Mycobacterium bovis
GADEVSAAVASLFSGHAQAYQTLGTQ

SEQ ID NO: 199462 - protein, 30 aa, Mycobacterium bovis
GADEVSQAIARLFSDYATHYQSLNAQAAAF

SEQ ID NO: 199463 - protein, 28 aa, Mycobacterium bovis
GADEVSTAVAALFGAHGQAYQALSAQAQ

SEQ ID NO: 199464 - protein, 29 aa, Mycobacterium bovis
GADEVSTAVAALFGAHGQAYQALSAQAQA

SEQ ID NO: 199465 - protein, 26 aa, Mycobacterium bovis
GADEVSVAISALFGSHAQGYQTLSAQ

SEQ ID NO: 199466 - protein, 18 aa, Mycobacterium bovis
GADGEVGGAGGAGGSGPN

SEQ ID NO: 199467 - protein, 21 aa, Mycobacterium bovis
GADGKLGAFVEVKNSTIGTGT

SEQ ID NO: 199468 - protein, 18 aa, Mycobacterium bovis
GADIVALDICAPVSGSVT

SEQ ID NO: 199469 - protein, 23 aa, Mycobacterium bovis
GADPAHQGLHMWLAEYPQPRPPR

SEQ ID NO: 199470 - protein, 19 aa, Mycobacterium bovis
GADPARFDGSIGVYGTSSP

SEQ ID NO: 199471 - protein, 17 aa, Mycobacterium bovis
GADRCFDTPLAESAIIG

SEQ ID NO: 199472 - protein, 22 aa, Mycobacterium bovis
GADSLKGLCPFHNEKSPSFHVR

SEQ ID NO: 199473 - protein, 17 aa, Mycobacterium bovis
GADTFFGEPELRPEDLL

SEQ ID NO: 199474 - protein, 19 aa, Mycobacterium bovis
GAEALDWVRARNKPTTAAF

SEQ ID NO: 199475 - protein, 25 aa, Mycobacterium bovis
GAELQARLRLAITRRRSTLAGTLQF

SEQ ID NO: 199476 - protein, 18 aa, Mycobacterium bovis
GAELTLYLHHCMADGHHG

SEQ ID NO: 199477 - protein, 19 aa, Mycobacterium bovis
GAEPLFLLDYIAVGRIVPE

SEQ ID NO: 199478 - protein, 22 aa, Mycobacterium bovis
GAERMTRVSFGFREPDGGGFNP

SEQ ID NO: 199479 - protein, 26 aa, Mycobacterium bovis
GAESFPEETFPVIVALMTNVFDGAAI

SEQ ID NO: 199480 - protein, 19 aa, Mycobacterium bovis
GAGCCDLAFAAPEAARTLK

SEQ ID NO: 199481 - protein, 21 aa, Mycobacterium bovis
GAGGDGFGFVGAGGNGGNAGT

SEQ ID NO: 199482 - protein, 23 aa, Mycobacterium bovis
GAGGIPGLIGNGGNGGDGGASVT

SEQ ID NO: 199483 - protein, 18 aa, Mycobacterium bovis
GAGGLLFGAGGAGGAGGL

SEQ ID NO: 199484 - protein, 25 aa, Mycobacterium bovis
GAGGNGGRGGMLIGNGGAGGAGGTG

SEQ ID NO: 199485 - protein, 20 aa, Mycobacterium bovis
GAGGQGGLLFGDGGNGGAGG

SEQ ID NO: 199486 - protein, 23 aa, Mycobacterium bovis
GAGGRAGGGVGGIGGAGGAGGNG

SEQ ID NO: 199487 - protein, 35 aa, Mycobacterium bovis
GAGGRGGAGGLGFGSEAPGRPGGAGGTGGAGGNGG

SEQ ID NO: 199488 - protein, 20 aa, Mycobacterium bovis
GAGGSAFLIGSGGTGGVGGA

SEQ ID NO: 199489 - protein, 17 aa, Mycobacterium bovis
GAGGSARGLIFALGGAG

SEQ ID NO: 199490 - protein, 26 aa, Mycobacterium bovis
GAGGTGGPGGFGIFGGGAGGDGGSGG

SEQ ID NO: 199491 - protein, 22 aa, Mycobacterium bovis
GAGGYFCAGMDLKAATQKPPGD

SEQ ID NO: 199492 - protein, 18 aa, Mycobacterium bovis
GAGHLWKLVRTFDDPATW

SEQ ID NO: 199493 - protein, 26 aa, Mycobacterium bovis
GAGISRPTFYFYFPSKEAVLLTLLDR

SEQ ID NO: 199494 - protein, 19 aa, Mycobacterium bovis
GAGNMSGFGNFGAGNSGFF

SEQ ID NO: 199495 - protein, 27 aa, Mycobacterium bovis
GAGPEPMAAAATAWDGLAMELASAAAS

SEQ ID NO: 199496 - protein, 18 aa, Mycobacterium bovis
GAGPIIVPSIQFPAIPLD

SEQ ID NO: 199497 - protein, 20 aa, Mycobacterium bovis
GAGQLLSHSGVAGASGKGGA

SEQ ID NO: 199498 - protein, 25 aa, Mycobacterium bovis
GAGRGARFLLGLVVSTGVGGGLVLD

SEQ ID NO: 199499 - protein, 26 aa, Mycobacterium bovis
GAGSAPMLAAAVAWDGLAAELGSAAS

SEQ ID NO: 199500 - protein, 24 aa, Mycobacterium bovis
GAGSIRIPAAWTHLVGIKPQRGRI

SEQ ID NO: 199501 - protein, 18 aa, Mycobacterium bovis
GAGTLGFAGTTHKASPGQ

SEQ ID NO: 199502 - protein, 21 aa, Mycobacterium bovis
GAIALGHPFGMTGARITTTLL

SEQ ID NO: 199503 - protein, 30 aa, Mycobacterium bovis
GAIAVQWCRSWPGCTAVAFERDERRRRNIG

SEQ ID NO: 199504 - protein, 25 aa, Mycobacterium bovis
GAIPGGWWLTFGQILGLAQNAPGVA

SEQ ID NO: 199505 - protein, 27 aa, Mycobacterium bovis
GAIPPDGPWGIWASRRIIAGLMGTFGP

SEQ ID NO: 199506 - protein, 18 aa, Mycobacterium bovis
GAIPVMCLPGHRAAELGH

SEQ ID NO: 199507 - protein, 24 aa, Mycobacterium bovis
GAKAIATEIGRPVMVKAQVKIGGR

SEQ ID NO: 199508 - protein, 29 aa, Mycobacterium bovis
GAKTARFVKRYADVGGELRRAAMQYAQEV

SEQ ID NO: 199509 - protein, 17 aa, Mycobacterium bovis
GALAGAMRPPAPPAAPP

SEQ ID NO: 199510 - protein, 19 aa, Mycobacterium bovis
GALARHIAEELPLLGSCTF

SEQ ID NO: 199511 - protein, 22 aa, Mycobacterium bovis
GALARIRLPGGMITAAQLATLA

SEQ ID NO: 199512 - protein, 18 aa, Mycobacterium bovis
GALEAFAIAVAGRRCLDA

SEQ ID NO: 199513 - protein, 17 aa, Mycobacterium bovis
GALEGLDNLTFVINCNL

SEQ ID NO: 199514 - protein, 29 aa, Mycobacterium bovis
GALESRTITFLKIDPAPGIGNSTTNPSSG

SEQ ID NO: 199515 - protein, 18 aa, Mycobacterium bovis
GALKPARLLVSGSAALPV

SEQ ID NO: 199516 - protein, 20 aa, Mycobacterium bovis
GALLARMIADLGIAVHVGTG

SEQ ID NO: 199517 - protein, 17 aa, Mycobacterium bovis
GALLPRLHKLVRADCTT

SEQ ID NO: 199518 - protein, 18 aa, Mycobacterium bovis
GALNRFETALGRAELPEA

SEQ ID NO: 199519 - protein, 19 aa, Mycobacterium bovis
GALPLLAPMSEVAGRLAAQ

SEQ ID NO: 199520 - protein, 18 aa, Mycobacterium bovis
GALRRFLLEHGVLPEAPL

SEQ ID NO: 199521 - protein, 21 aa, Mycobacterium bovis
GALTGGMCWEALNNIAASRRP

SEQ ID NO: 199522 - protein, 18 aa, Mycobacterium bovis
GAMVCPFPPHTTTIRSAK

SEQ ID NO: 199523 - protein, 26 aa, Mycobacterium bovis
GANGNNRSSGSFLAAGGTGGAAGDGG

SEQ ID NO: 199524 - protein, 18 aa, Mycobacterium bovis
GANLARLELRVLFEELLS

SEQ ID NO: 199525 - protein, 18 aa, Mycobacterium bovis
GANLARREIRVAFDELRR

SEQ ID NO: 199526 - protein, 17 aa, Mycobacterium bovis
GAPDAWEVQGRGELALA

SEQ ID NO: 199527 - protein, 22 aa, Mycobacterium bovis
GAPDVLRYVMGFGGTPDSALTG

SEQ ID NO: 199528 - protein, 31 aa, Mycobacterium bovis
GAPGGNGGNAGWLYGRGGVGGAGGIGGGTGG

SEQ ID NO: 199529 - protein, 23 aa, Mycobacterium bovis
GAPGGPGGLLLGNGGNGGSGAPG

SEQ ID NO: 199530 - protein, 23 aa, Mycobacterium bovis
GAPGSDALALGQPGGNGGQGDAG

SEQ ID NO: 199531 - protein, 17 aa, Mycobacterium bovis
GAPQGMRIVNQRQFDRL

SEQ ID NO: 199532 - protein, 18 aa, Mycobacterium bovis
GAPSGAYVRRAGDDVQPG

SEQ ID NO: 199533 - protein, 27 aa, Mycobacterium bovis
GAPSSGIGIVEGWRGTIVHRVEIDVDG

SEQ ID NO: 199534 - protein, 22 aa, Mycobacterium bovis
GAPTPVADRFVRYVNRDNTTAA

SEQ ID NO: 199535 - protein, 21 aa, Mycobacterium bovis
GAPTPVAWTRMRAPRSLMAAI

SEQ ID NO: 199536 - protein, 20 aa, Mycobacterium bovis
GAPYVTPLVRKLASENNIDL

SEQ ID NO: 199537 - protein, 27 aa, Mycobacterium bovis
GAQAFLVDCGRGVLQRAAAVGVGAAGL

SEQ ID NO: 199538 - protein, 20 aa, Mycobacterium bovis
GAQDTRLVWEERRLRREVRA

SEQ ID NO: 199539 - protein, 20 aa, Mycobacterium bovis
GAQPQAAKLTEWLKLALDEP

SEQ ID NO: 199540 - protein, 18 aa, Mycobacterium bovis
GAQVRERLALGFGSSSFR

SEQ ID NO: 199541 - protein, 25 aa, Mycobacterium bovis
GAQWRQAGCSMCLGMNPDQLASGER

SEQ ID NO: 199542 - protein, 24 aa, Mycobacterium bovis
GAQYSQWGALLARTDPSAPKHNGI

SEQ ID NO: 199543 - protein, 25 aa, Mycobacterium bovis
GARASAMAAWLFGRPAAVPEIARSR

SEQ ID NO: 199544 - protein, 21 aa, Mycobacterium bovis
GARCATGILDCWLVHDGDHAE

SEQ ID NO: 199545 - protein, 31 aa, Mycobacterium bovis
GARDFQRFLIGKLKDIREVVATASLDAASKS

SEQ ID NO: 199546 - protein, 20 aa, Mycobacterium bovis
GARGLRAIMEEVLLPVMYDI

SEQ ID NO: 199547 - protein, 25 aa, Mycobacterium bovis
GARGPYRLGPEITRMATTVRLGVVT

SEQ ID NO: 199548 - protein, 19 aa, Mycobacterium bovis
GARGRRLDVRQARTAVHQT

SEQ ID NO: 199549 - protein, 19 aa, Mycobacterium bovis
GARGYAHIGVIQALRERGY

SEQ ID NO: 199550 - protein, 21 aa, Mycobacterium bovis
GARPRGAGMERSDLLEANGAI

SEQ ID NO: 199551 - protein, 17 aa, Mycobacterium bovis
GARRKAYNWAVATLKAD

SEQ ID NO: 199552 - protein, 27 aa, Mycobacterium bovis
GARVVRAHVPLSEMFGYVGDLRSKTQG

SEQ ID NO: 199553 - protein, 19 aa, Mycobacterium bovis
GASGFKLHEDWGSTPAAID

SEQ ID NO: 199554 - protein, 24 aa, Mycobacterium bovis
GASRAEQGLPFAREAALAKRLGSD

SEQ ID NO: 199555 - protein, 28 aa, Mycobacterium bovis
GASRRARRAGKIPAVLYGHGAEPQHLEL

SEQ ID NO: 199556 - protein, 17 aa, Mycobacterium bovis
GASYAARDALAAASYLS

SEQ ID NO: 199557 - protein, 18 aa, Mycobacterium bovis
GATALDFQAKYAAAQQEL

SEQ ID NO: 199558 - protein, 30 aa, Mycobacterium bovis
GATAPRLLLEVVCARLLLPSASDAESALLQ

SEQ ID NO: 199559 - protein, 18 aa, Mycobacterium bovis
GATAWRAVVEHAETADDR

SEQ ID NO: 199560 - protein, 26 aa, Mycobacterium bovis
GATERYQVLVGWDFEPASEYGTKAAI

SEQ ID NO: 199561 - protein, 17 aa, Mycobacterium bovis
GATGLIGSGGFGGAGGA

SEQ ID NO: 199562 - protein, 22 aa, Mycobacterium bovis
GATKRFGLTVTLAERERQLAIA

SEQ ID NO: 199563 - protein, 23 aa, Mycobacterium bovis
GATPFQRLNFMVGKLNRAMQRNP

SEQ ID NO: 199564 - protein, 17 aa, Mycobacterium bovis
GATRPALQLSRALLGNQ

SEQ ID NO: 199565 - protein, 17 aa, Mycobacterium bovis
GATVLAHNYQLPAIQDV

SEQ ID NO: 199566 - protein, 19 aa, Mycobacterium bovis
GAVARRWHENLAELRHHAD

SEQ ID NO: 199567 - protein, 19 aa, Mycobacterium bovis
GAVAVRLGPTVLRTSTAAA

SEQ ID NO: 199568 - protein, 20 aa, Mycobacterium bovis
GAVDAYWNWQSCRAGKRAGK

SEQ ID NO: 199569 - protein, 26 aa, Mycobacterium bovis
GAVELTGAWPGLRCDVDTPADLTAAR

SEQ ID NO: 199570 - protein, 19 aa, Mycobacterium bovis
GAVGCRGSETSGRTCRAGG

SEQ ID NO: 199571 - protein, 26 aa, Mycobacterium bovis
GAVGGVGGNGGWLYGNGGAGGLGGTG

SEQ ID NO: 199572 - protein, 27 aa, Mycobacterium bovis
GAVLDHLRIAMTAAHWQANITRFPQPN

SEQ ID NO: 199573 - protein, 18 aa, Mycobacterium bovis
GAVLPILALYVVAAEEQG

SEQ ID NO: 199574 - protein, 21 aa, Mycobacterium bovis
GAVLREVFVNGIPRRVDRVDL

SEQ ID NO: 199575 - protein, 26 aa, Mycobacterium bovis
GAVMVPRLPPSQARVLLMAALAANSP

SEQ ID NO: 199576 - protein, 25 aa, Mycobacterium bovis
GAVRDWPKPLGFVWGLDDPVATTNV

SEQ ID NO: 199577 - protein, 31 aa, Mycobacterium bovis
GAVSASAQTLLSRPLIGNGANATTPGGNGGD

SEQ ID NO: 199578 - protein, 23 aa, Mycobacterium bovis
GAVSAWVELHARFGRLPFETLFE

SEQ ID NO: 199579 - protein, 18 aa, Mycobacterium bovis
GAVSRAHRGVLFLDECAE

SEQ ID NO: 199580 - protein, 19 aa, Mycobacterium bovis
GAVSVELVHNFSLVHDDLM

SEQ ID NO: 199581 - protein, 23 aa, Mycobacterium bovis
GAVTDVLGAVVKVFVSGVDASDL

SEQ ID NO: 199582 - protein, 29 aa, Mycobacterium bovis
GAVTEPMLFEWTDRDTLLYAIGVGAGTGD

SEQ ID NO: 199583 - protein, 19 aa, Mycobacterium bovis
GAVTMVWQREKLLQVNEIG

SEQ ID NO: 199584 - protein, 20 aa, Mycobacterium bovis
GAYFKGGIAPVSVWVSTEYV

SEQ ID NO: 199585 - protein, 23 aa, Mycobacterium bovis
GCADSRVAAEIIFDQGLGDMFVV

SEQ ID NO: 199586 - protein, 17 aa, Mycobacterium bovis
GCAPDLIYIDLHLVHEV

SEQ ID NO: 199587 - protein, 18 aa, Mycobacterium bovis
GCDHEIRSGTAHVVVWPT

SEQ ID NO: 199588 - protein, 19 aa, Mycobacterium bovis
GCFGLKIPSEYGGLNMSQV

SEQ ID NO: 199589 - protein, 21 aa, Mycobacterium bovis
GCGDGAFRLGTMPIEVESSVA

SEQ ID NO: 199590 - protein, 23 aa, Mycobacterium bovis
GCGEAAISLALAERGHTTVGLDL

SEQ ID NO: 199591 - protein, 31 aa, Mycobacterium bovis
GCGGEYEWTRAKAAYFMIVFSGPIPDDKWLQ

SEQ ID NO: 199592 - protein, 17 aa, Mycobacterium bovis
GCGKTTLLSCLGGILRP

SEQ ID NO: 199593 - protein, 20 aa, Mycobacterium bovis
GCGYAELSLALAADGYTVVG

SEQ ID NO: 199594 - protein, 23 aa, Mycobacterium bovis
GCVQLKAALARHLGPDFAPEHVA

SEQ ID NO: 199595 - protein, 17 aa, Mycobacterium bovis
GCYVGASALEYGPALTE

SEQ ID NO: 199596 - protein, 18 aa, Mycobacterium bovis
GDAAVSLMDAFRSADEVL

SEQ ID NO: 199597 - protein, 17 aa, Mycobacterium bovis
GDAGLFLGAAGTGGQAA

SEQ ID NO: 199598 - protein, 17 aa, Mycobacterium bovis
GDAKPVLMPELGESVTE

SEQ ID NO: 199599 - protein, 24 aa, Mycobacterium bovis
GDAVEFRLGAAIRDKLAAVSRDLG

SEQ ID NO: 199600 - protein, 19 aa, Mycobacterium bovis
GDCAMPFEKAVVVPLDPTS

SEQ ID NO: 199601 - protein, 19 aa, Mycobacterium bovis
GDDDRLHGMLTDRDIVIKG

SEQ ID NO: 199602 - protein, 17 aa, Mycobacterium bovis
GDDGWRDVIDVNLTGVF

SEQ ID NO: 199603 - protein, 25 aa, Mycobacterium bovis
GDDIAEVLALLGVRPVWDDASRRVI

SEQ ID NO: 199604 - protein, 19 aa, Mycobacterium bovis
GDEAILFGPGIRGEPTAQD

SEQ ID NO: 199605 - protein, 23 aa, Mycobacterium bovis
GDEDKRVAGAIARLGELKARGVD

SEQ ID NO: 199606 - protein, 18 aa, Mycobacterium bovis
GDEPLKRKVASTLLESFL

SEQ ID NO: 199607 - protein, 23 aa, Mycobacterium bovis
GDEPRPGAALDVLSEAERQVYEA

SEQ ID NO: 199608 - protein, 26 aa, Mycobacterium bovis
GDERARAALQRWSLMRSDHPVTSVGT

SEQ ID NO: 199609 - protein, 26 aa, Mycobacterium bovis
GDEVQIGKFRLVFLTGPKQGEDDGST

SEQ ID NO: 199610 - protein, 18 aa, Mycobacterium bovis
GDFARRGLDPDLAPLYAQ

SEQ ID NO: 199611 - protein, 19 aa, Mycobacterium bovis
GDFLSYCLVAEGAVDIAAE

SEQ ID NO: 199612 - protein, 21 aa, Mycobacterium bovis
GDGAFGFSGMEWDTLVRHNVA

SEQ ID NO: 199613 - protein, 20 aa, Mycobacterium bovis
GDGEAGSWLLIDTSNAVDTP

SEQ ID NO: 199614 - protein, 23 aa, Mycobacterium bovis
GDGFARYWLHNGWVTMGGEKMSK

SEQ ID NO: 199615 - protein, 23 aa, Mycobacterium bovis
GDGFVSAPGHGRCEVICFSADHT

SEQ ID NO: 199616 - protein, 23 aa, Mycobacterium bovis
GDGGAGPLLIGNGGVGGLGGAGA

SEQ ID NO: 199617 - protein, 18 aa, Mycobacterium bovis
GDGGGRGIFGQFGAGGAG

SEQ ID NO: 199618 - protein, 30 aa, Mycobacterium bovis
GDGGHGGDGFRTAGAGGRGGDGGKGADPGG

SEQ ID NO: 199619 - protein, 25 aa, Mycobacterium bovis
GDGGNGATGTWGHNLGAGGTGGNGG

SEQ ID NO: 199620 - protein, 17 aa, Mycobacterium bovis
GDGGQFGAGGNGGAGGS

SEQ ID NO: 199621 - protein, 25 aa, Mycobacterium bovis
GDGGQGGAGRGLWGTGGAGGHGGQG

SEQ ID NO: 199622 - protein, 25 aa, Mycobacterium bovis
GDGGRGAHGTLFSSLAGTGGTGGNG

SEQ ID NO: 199623 - protein, 17 aa, Mycobacterium bovis
GDGHPVLVLPGLLAGDG

SEQ ID NO: 199624 - protein, 22 aa, Mycobacterium bovis
GDGNVHMAIACKDPEKKKKLMT

SEQ ID NO: 199625 - protein, 21 aa, Mycobacterium bovis
GDGRMRGCPFHNAAVEAAGEM

SEQ ID NO: 199626 - protein, 24 aa, Mycobacterium bovis
GDHRMLPRATFCQPNVASFGLTEQ

SEQ ID NO: 199627 - protein, 17 aa, Mycobacterium bovis
GDIDGLERVRFTSPHPA

SEQ ID NO: 199628 - protein, 24 aa, Mycobacterium bovis
GDIDRGGVFAAFLGTVALLAAEDQ

SEQ ID NO: 199629 - protein, 25 aa, Mycobacterium bovis
GDILTRLTAPVIRGLGIGIVPAATR

SEQ ID NO: 199630 - protein, 18 aa, Mycobacterium bovis
GDISVCLHDPCLPVDLTV

SEQ ID NO: 199631 - protein, 25 aa, Mycobacterium bovis
GDKSNWWAAYALWVFTLFGHADVRL

SEQ ID NO: 199632 - protein, 19 aa, Mycobacterium bovis
GDLAPLWSDDVLKAAIDTA

SEQ ID NO: 199633 - protein, 24 aa, Mycobacterium bovis
GDLARYWHDGTLEFVGRADHRVKI

SEQ ID NO: 199634 - protein, 28 aa, Mycobacterium bovis
GDLATIWRGGCIIRAKFLNHIKEAFDAS

SEQ ID NO: 199635 - protein, 32 aa, Mycobacterium bovis
GDLAYRDSEGWIYLAGRTADWMRVDGENLTAA

SEQ ID NO: 199636 - protein, 21 aa, Mycobacterium bovis
GDLDEGFALLSNDFTYWSIVT

SEQ ID NO: 199637 - protein, 29 aa, Mycobacterium bovis
GDLDFDWLDDGWLTLLRRWLNDAQRAGVS

SEQ ID NO: 199638 - protein, 17 aa, Mycobacterium bovis
GDLGELPGDLAWQPPLW

SEQ ID NO: 199639 - protein, 19 aa, Mycobacterium bovis
GDLLDFTALAKVFGYPTTT

SEQ ID NO: 199640 - protein, 20 aa, Mycobacterium bovis
GDLLLLRQGQLLAHTTPHRL

SEQ ID NO: 199641 - protein, 18 aa, Mycobacterium bovis
GDLPEVGGRVTSPPQPPV

SEQ ID NO: 199642 - protein, 18 aa, Mycobacterium bovis
GDLPRPGAIVTSAADRVE

SEQ ID NO: 199643 - protein, 19 aa, Mycobacterium bovis
GDLRSLFAFLADRGSSLDA

SEQ ID NO: 199644 - protein, 30 aa, Mycobacterium bovis
GDMGNGAFWRGDQQGLFSAGYRVHVPEIPA

SEQ ID NO: 199645 - protein, 22 aa, Mycobacterium bovis
GDMPARYVIHAATMELGGPTSG

SEQ ID NO: 199646 - protein, 19 aa, Mycobacterium bovis
GDNQIGFGALNSGSGNLGF

SEQ ID NO: 199647 - protein, 20 aa, Mycobacterium bovis
GDNQIGFGPLNAGIANMGLF

SEQ ID NO: 199648 - protein, 24 aa, Mycobacterium bovis
GDPDWQRFHLIGATNTVYFALLAR

SEQ ID NO: 199649 - protein, 27 aa, Mycobacterium bovis
GDPGESRFYLSLGDELMRRFNGAALET

SEQ ID NO: 199650 - protein, 17 aa, Mycobacterium bovis
GDPGGSTAIRIPATASV

SEQ ID NO: 199651 - protein, 18 aa, Mycobacterium bovis
GDPLFYSSYMHLHTRLTR

SEQ ID NO: 199652 - protein, 20 aa, Mycobacterium bovis
GDPMGLVNAVGYPLAADVAL

SEQ ID NO: 199653 - protein, 19 aa, Mycobacterium bovis
GDPRSPGWYHNLKANPDVE

SEQ ID NO: 199654 - protein, 22 aa, Mycobacterium bovis
GDPVALRAFRRGAAALAAMIAS

SEQ ID NO: 199655 - protein, 20 aa, Mycobacterium bovis
GDPYRMAVARAREMTALLRA

SEQ ID NO: 199656 - protein, 17 aa, Mycobacterium bovis
GDQLVLGASNPVRDVAL

SEQ ID NO: 199657 - protein, 20 aa, Mycobacterium bovis
GDQQLSFALIDGVRRQWRNG

SEQ ID NO: 199658 - protein, 23 aa, Mycobacterium bovis
GDQRVSLSAGQSWSVTATGPTEV

SEQ ID NO: 199659 - protein, 22 aa, Mycobacterium bovis
GDQTMFRKLFESVLKGHVKVLV

SEQ ID NO: 199660 - protein, 19 aa, Mycobacterium bovis
GDRMWEFLDRLTSIALPRI

SEQ ID NO: 199661 - protein, 21 aa, Mycobacterium bovis
GDRVLLCLPDSPDLVQLLLAC

SEQ ID NO: 199662 - protein, 28 aa, Mycobacterium bovis
GDSRDGLLRFCRYMEALAAYKKYLDPKD

SEQ ID NO: 199663 - protein, 23 aa, Mycobacterium bovis
GDSRPSLDRWTINLATGAVTAEC

SEQ ID NO: 199664 - protein, 21 aa, Mycobacterium bovis
GDSRRANLWAADRYNRAIARG

SEQ ID NO: 199665 - protein, 19 aa, Mycobacterium bovis
GDTAAMRPFLLVASFVNPH

SEQ ID NO: 199666 - protein, 17 aa, Mycobacterium bovis
GDTAVIYGVGGLGINAV

SEQ ID NO: 199667 - protein, 26 aa, Mycobacterium bovis
GDTDLAWSRITYWRALLTSAVDQPPH

SEQ ID NO: 199668 - protein, 19 aa, Mycobacterium bovis
GDTPLPVRTPLPVHLPEPM

SEQ ID NO: 199669 - protein, 18 aa, Mycobacterium bovis
GDTTRSWYVIDATDVVLG

SEQ ID NO: 199670 - protein, 20 aa, Mycobacterium bovis
GDTVVRGRIDAVFVDPDGGA

SEQ ID NO: 199671 - protein, 19 aa, Mycobacterium bovis
GDVALLRLSFGRFGDEPAL

SEQ ID NO: 199672 - protein, 19 aa, Mycobacterium bovis
GDVAYGWAMEDTSGIVKLI

SEQ ID NO: 199673 - protein, 17 aa, Mycobacterium bovis
GDVGAVVGRYAAGGYEV

SEQ ID NO: 199674 - protein, 18 aa, Mycobacterium bovis
GDVLPELIRRAITVKAEV

SEQ ID NO: 199675 - protein, 21 aa, Mycobacterium bovis
GDVMAAARIAGIAAAKRTGDL

SEQ ID NO: 199676 - protein, 19 aa, Mycobacterium bovis
GEAGRTLRIPSPRLCTDNG

SEQ ID NO: 199677 - protein, 17 aa, Mycobacterium bovis
GEAIPAQAIAQVCELTW

SEQ ID NO: 199678 - protein, 25 aa, Mycobacterium bovis
GEALLSGLLRAGRQVKDLVVAERMP

SEQ ID NO: 199679 - protein, 20 aa, Mycobacterium bovis
GEATGLPSMVVLQPATSAVA

SEQ ID NO: 199680 - protein, 17 aa, Mycobacterium bovis
GEAWMHVALSPAVDHKG

SEQ ID NO: 199681 - protein, 25 aa, Mycobacterium bovis
GEEGIKRPFAIQELTLPLALDGEDV

SEQ ID NO: 199682 - protein, 19 aa, Mycobacterium bovis
GEEIRRLVNGAAYLFTNDY

SEQ ID NO: 199683 - protein, 20 aa, Mycobacterium bovis
GEESYVLLVRVASARALEDL

SEQ ID NO: 199684 - protein, 18 aa, Mycobacterium bovis
GEFDEWQRLYLFTRADTI

SEQ ID NO: 199685 - protein, 17 aa, Mycobacterium bovis
GEFIDLIVGGSTYDLAA

SEQ ID NO: 199686 - protein, 22 aa, Mycobacterium bovis
GEFPTSALIASRGAAYPATQPN

SEQ ID NO: 199687 - protein, 19 aa, Mycobacterium bovis
GEGAIGRWRGGRSELTTEC

SEQ ID NO: 199688 - protein, 31 aa, Mycobacterium bovis
GEGARRFGGRWNPPLLFPAIYLADSAQACMV

SEQ ID NO: 199689 - protein, 19 aa, Mycobacterium bovis
GEGGLRAMRNFLSDSPDDT

SEQ ID NO: 199690 - protein, 23 aa, Mycobacterium bovis
GEGKRLYPLTADRAKPAVPFGGA

SEQ ID NO: 199691 - protein, 21 aa, Mycobacterium bovis
GEGSSGMGVLRGRTGSRPRLT

SEQ ID NO: 199692 - protein, 21 aa, Mycobacterium bovis
GEGTLTAASWLSEENVPVVGV

SEQ ID NO: 199693 - protein, 27 aa, Mycobacterium bovis
GEGWAGCFTEDGAFEFDGWVIRGRPAL

SEQ ID NO: 199694 - protein, 22 aa, Mycobacterium bovis
GEGWFINQHIVWQVGDEDVAEM

SEQ ID NO: 199695 - protein, 21 aa, Mycobacterium bovis
GEGYAEDWDLDALWTALKTLY

SEQ ID NO: 199696 - protein, 17 aa, Mycobacterium bovis
GEGYFFGIELVKDQATK

SEQ ID NO: 199697 - protein, 18 aa, Mycobacterium bovis
GEHPMFKAMAAGLSSLAG

SEQ ID NO: 199698 - protein, 17 aa, Mycobacterium bovis
GEHRFPLSDTVVAVPAD

SEQ ID NO: 199699 - protein, 23 aa, Mycobacterium bovis
GEHRKSLTFALRFRAPDRTLTED

SEQ ID NO: 199700 - protein, 19 aa, Mycobacterium bovis
GEINGQFFVEMRMIDGTSL

SEQ ID NO: 199701 - protein, 19 aa, Mycobacterium bovis
GEKLMGFGHRVYRAEDPRA

SEQ ID NO: 199702 - protein, 19 aa, Mycobacterium bovis
GELARMCGVAAVPDSAMVS

SEQ ID NO: 199703 - protein, 20 aa, Mycobacterium bovis
GELDVIALYIASIATGSIAL

SEQ ID NO: 199704 - protein, 17 aa, Mycobacterium bovis
GELFASFDVDAFEVPHG

SEQ ID NO: 199705 - protein, 24 aa, Mycobacterium bovis
GELGEPFTTAGLCYYRDGSDSVAW

SEQ ID NO: 199706 - protein, 23 aa, Mycobacterium bovis
GELKISIPGFEIPQIATTRFLLD

SEQ ID NO: 199707 - protein, 18 aa, Mycobacterium bovis
GELLEWAEIHGGLHRSGT

SEQ ID NO: 199708 - protein, 29 aa, Mycobacterium bovis
GELLKPFARRYFQAIPGVWARRSSEVAQS

SEQ ID NO: 199709 - protein, 18 aa, Mycobacterium bovis
GELLRWLGDGNFLLLGYQ

SEQ ID NO: 199710 - protein, 26 aa, Mycobacterium bovis
GELMRSGERPMVWSLDERLRMVARPM

SEQ ID NO: 199711 - protein, 25 aa, Mycobacterium bovis
GELPTWQWESLISKSTRLVAVNSAS

SEQ ID NO: 199712 - protein, 23 aa, Mycobacterium bovis
GELSVHYPFPIADLVALDDALTY

SEQ ID NO: 199713 - protein, 18 aa, Mycobacterium bovis
GELTEFDVELDLRGTDFQ

SEQ ID NO: 199714 - protein, 23 aa, Mycobacterium bovis
GELTQLAGVFGFADCIDLLANYT

SEQ ID NO: 199715 - protein, 21 aa, Mycobacterium bovis
GELVFPLQVVINLSDPETDYT

SEQ ID NO: 199716 - protein, 17 aa, Mycobacterium bovis
GEMGRLWYENGKLLDKK

SEQ ID NO: 199717 - protein, 19 aa, Mycobacterium bovis
GEMRSRLRALDAAARTGSG

SEQ ID NO: 199718 - protein, 22 aa, Mycobacterium bovis
GENCRRCGAVIRRERFMNRSSF

SEQ ID NO: 199719 - protein, 20 aa, Mycobacterium bovis
GENIPAWLVFDQRYRDRYIF

SEQ ID NO: 199720 - protein, 22 aa, Mycobacterium bovis
GENLFRPLLMRVTSEGVGKGIS

SEQ ID NO: 199721 - protein, 25 aa, Mycobacterium bovis
GENRLKIARLLALIDMLSDRFIGEP

SEQ ID NO: 199722 - protein, 18 aa, Mycobacterium bovis
GENVFFCATGVTDGDLLK

SEQ ID NO: 199723 - protein, 25 aa, Mycobacterium bovis
GEPCRVCGGVIRTALLEGRNVFWCP

SEQ ID NO: 199724 - protein, 17 aa, Mycobacterium bovis
GEPFCVREDARILYHAA

SEQ ID NO: 199725 - protein, 22 aa, Mycobacterium bovis
GEPPMRRAVAFAKDIKTSKQVA

SEQ ID NO: 199726 - protein, 23 aa, Mycobacterium bovis
GEPQEFFQYLPSTGMAPQPREWF

SEQ ID NO: 199727 - protein, 19 aa, Mycobacterium bovis
GEPSLGFTTYGKVKLGNLR

SEQ ID NO: 199728 - protein, 17 aa, Mycobacterium bovis
GEQRWLADHVIAGVVLL

SEQ ID NO: 199729 - protein, 20 aa, Mycobacterium bovis
GERARTAIDAALARVGTTQE

SEQ ID NO: 199730 - protein, 27 aa, Mycobacterium bovis
GERLRLLLREVFTAAGGTHDDWDEYDR

SEQ ID NO: 199731 - protein, 24 aa, Mycobacterium bovis
GERRRVALCKLLLSKPDLLLLDEP

SEQ ID NO: 199732 - protein, 25 aa, Mycobacterium bovis
GESDWNALNLFTGWVDVGLTDKGQA

SEQ ID NO: 199733 - protein, 17 aa, Mycobacterium bovis
GESGFNIARVVAVALGY

SEQ ID NO: 199734 - protein, 36 aa, Mycobacterium bovis
GESLLGKPAVLWFWAPWCPTCQGEAPVVGQVAASHP

SEQ ID NO: 199735 - protein, 26 aa, Mycobacterium bovis
GESVTEGTVIRWLKKIGDSVQVDEPL

SEQ ID NO: 199736 - protein, 25 aa, Mycobacterium bovis
GETRPGDRWRLSGPHGAFRVDRDGG

SEQ ID NO: 199737 - protein, 26 aa, Mycobacterium bovis
GEVFDLRPGAIIRDLNLLRPIYAPTA

SEQ ID NO: 199738 - protein, 19 aa, Mycobacterium bovis
GEVLERSLVHLGLKHYFLV

SEQ ID NO: 199739 - protein, 19 aa, Mycobacterium bovis
GEVQTRLRLGQDREALEAA

SEQ ID NO: 199740 - protein, 23 aa, Mycobacterium bovis
GEVRGAEVVDLLAALNTGHEGGA

SEQ ID NO: 199741 - protein, 22 aa, Mycobacterium bovis
GEWQIAALRAYWELPAMMLQFL

SEQ ID NO: 199742 - protein, 22 aa, Mycobacterium bovis
GEWRYFPGDNYRYPHWDYNPHD

SEQ ID NO: 199743 - protein, 17 aa, Mycobacterium bovis
GEYALRRASCERAAADL

SEQ ID NO: 199744 - protein, 17 aa, Mycobacterium bovis
GEYASWLDSERVVVNVY

SEQ ID NO: 199745 - protein, 24 aa, Mycobacterium bovis
GEYVFWPDPRLVFQSLAQKYGAIV

SEQ ID NO: 199746 - protein, 17 aa, Mycobacterium bovis
GFAAYHWERTVGGADYL

SEQ ID NO: 199747 - protein, 19 aa, Mycobacterium bovis
GFDRLRLIQRITDRLPAKA

SEQ ID NO: 199748 - protein, 21 aa, Mycobacterium bovis
GFERSKYASGEFFDKYTDQIW

SEQ ID NO: 199749 - protein, 20 aa, Mycobacterium bovis
GFETKVCWFPDSGNPGLVAE

SEQ ID NO: 199750 - protein, 20 aa, Mycobacterium bovis
GFFRALDYTLPWDVDTVEDS

SEQ ID NO: 199751 - protein, 20 aa, Mycobacterium bovis
GFFYIKGRSSEMIICGGVNI

SEQ ID NO: 199752 - protein, 21 aa, Mycobacterium bovis
GFGALKYAAKYYGHFASASSH

SEQ ID NO: 199753 - protein, 19 aa, Mycobacterium bovis
GFGEIFLDDVFVPDRDVIG

SEQ ID NO: 199754 - protein, 25 aa, Mycobacterium bovis
GFGEQKARIFLALLGKQYGVTPKGW

SEQ ID NO: 199755 - protein, 17 aa, Mycobacterium bovis
GFGGVEGLRGWLREERI

SEQ ID NO: 199756 - protein, 17 aa, Mycobacterium bovis
GFGRIGRNFYRALLAQQ

SEQ ID NO: 199757 - protein, 28 aa, Mycobacterium bovis
GFHVYARIAPCWSFPQVRLAAQTVAREV

SEQ ID NO: 199758 - protein, 18 aa, Mycobacterium bovis
GFIETRYYVSMNVADKPG

SEQ ID NO: 199759 - protein, 25 aa, Mycobacterium bovis
GFKRDDWSLPLAVLVDGRAVGVQAL

SEQ ID NO: 199760 - protein, 26 aa, Mycobacterium bovis
GFLVSGDYQGLIGLPLLGIPVTPGYF

SEQ ID NO: 199761 - protein, 20 aa, Mycobacterium bovis
GFNIARVVAVALGYDFLPGT

SEQ ID NO: 199762 - protein, 18 aa, Mycobacterium bovis
GFNPGGINTGWFNTGHAN

SEQ ID NO: 199763 - protein, 24 aa, Mycobacterium bovis
GFPESYNRRALMRFVTSVKSGSDY

SEQ ID NO: 199764 - protein, 17 aa, Mycobacterium bovis
GFPRLAIARLMTSYFEL

SEQ ID NO: 199765 - protein, 20 aa, Mycobacterium bovis
GFQVLCEAGLLPGALTRNVG

SEQ ID NO: 199766 - protein, 25 aa, Mycobacterium bovis
GFQVPEFRRKAVVIAVGGVYDPRIH

SEQ ID NO: 199767 - protein, 20 aa, Mycobacterium bovis
GFRFDLASTLARELHDVDRL

SEQ ID NO: 199768 - protein, 20 aa, Mycobacterium bovis
GFRRSHLEALITQRTLSRLR

SEQ ID NO: 199769 - protein, 24 aa, Mycobacterium bovis
GFRSMLWPRVYADLRTAGVRGEDA

SEQ ID NO: 199770 - protein, 19 aa, Mycobacterium bovis
GFSGRAQVGKGMWTMTELM

SEQ ID NO: 199771 - protein, 23 aa, Mycobacterium bovis
GFSHFTLLLVHALRQQFSRVRVF

SEQ ID NO: 199772 - protein, 17 aa, Mycobacterium bovis
GFSRPGIELTKRTLWSG

SEQ ID NO: 199773 - protein, 31 aa, Mycobacterium bovis
GFTIPGGTLIPQLPLGLGLSGGTPPFDLPTV

SEQ ID NO: 199774 - protein, 24 aa, Mycobacterium bovis
GFVPDVAGFDAEFFGITPREAAAM

SEQ ID NO: 199775 - protein, 18 aa, Mycobacterium bovis
GGAAGFAGGVGGAGGEGL

SEQ ID NO: 199776 - protein, 20 aa, Mycobacterium bovis
GGAAGLFGHGGNGGAGGSNA

SEQ ID NO: 199777 - protein, 19 aa, Mycobacterium bovis
GGAAGLWGSGGSGGTGGQG

SEQ ID NO: 199778 - protein, 17 aa, Mycobacterium bovis
GGADLAAIAGFCAQAAV

SEQ ID NO: 199779 - protein, 29 aa, Mycobacterium bovis
GGAELRITLPTPRPPFHEELPRITSSDTK

SEQ ID NO: 199780 - protein, 27 aa, Mycobacterium bovis
GGAFILPPSIFHWLNYSVTAYQTGATV

SEQ ID NO: 199781 - protein, 24 aa, Mycobacterium bovis
GGAGAIGMHYARYLAEHGARRIVL

SEQ ID NO: 199782 - protein, 23 aa, Mycobacterium bovis
GGAGGAGGWLLGNGGAGGPGGPT

SEQ ID NO: 199783 - protein, 31 aa, Mycobacterium bovis
GGAGGAGPVLFGHGGAGGMGGQGGTGGMGGA

SEQ ID NO: 199784 - protein, 25 aa, Mycobacterium bovis
GGAGGDGGLFFGVGGAGGAGGTGTN

SEQ ID NO: 199785 - protein, 26 aa, Mycobacterium bovis
GGAGGDGGNAGFFGNGGNGGMGGAGA

SEQ ID NO: 199786 - protein, 26 aa, Mycobacterium bovis
GGAGGDRAGALVGRDGGPGGNGGAGG

SEQ ID NO: 199787 - protein, 20 aa, Mycobacterium bovis
GGAGGFSFSTAGGAGGAGGA

SEQ ID NO: 199788 - protein, 34 aa, Mycobacterium bovis
GGAGGHGGAGGWLYGNGGAGGFGGAGAVGGNGGA

SEQ ID NO: 199789 - protein, 32 aa, Mycobacterium bovis
GGAGGLFGAGGMGGAGGFGDHGTLGTGGAGGD

SEQ ID NO: 199790 - protein, 19 aa, Mycobacterium bovis
GGAGGLLFGTAGAGGNGGL

SEQ ID NO: 199791 - protein, 22 aa, Mycobacterium bovis
GGAGGNALMFGIGGNGGAGGAA

SEQ ID NO: 199792 - protein, 21 aa, Mycobacterium bovis
GGAGGNAWLFGNGGAGGLGAA

SEQ ID NO: 199793 - protein, 27 aa, Mycobacterium bovis
GGAGGNGAHGFNAVLVSDGGNGGDGGA

SEQ ID NO: 199794 - protein, 25 aa, Mycobacterium bovis
GGAGGRSGLFEVLAAGGAGGTGGLS

SEQ ID NO: 199795 - protein, 22 aa, Mycobacterium bovis
GGAGGSAMLFGAGGAGGAGGAA

SEQ ID NO: 199796 - protein, 21 aa, Mycobacterium bovis
GGAGSIGFNASAPGAAGSPGG

SEQ ID NO: 199797 - protein, 17 aa, Mycobacterium bovis
GGANGAFELNVYIPMMA

SEQ ID NO: 199798 - protein, 26 aa, Mycobacterium bovis
GGAPKGWGWVAPYIGMIWPNGDSTKL

SEQ ID NO: 199799 - protein, 18 aa, Mycobacterium bovis
GGATAFWDAAAFGLIDKR

SEQ ID NO: 199800 - protein, 26 aa, Mycobacterium bovis
GGAVEWHKMGAGWSWTRTSRKAGTDV

SEQ ID NO: 199801 - protein, 23 aa, Mycobacterium bovis
GGAYALGSARGYRGLAAQLAAAA

SEQ ID NO: 199802 - protein, 19 aa, Mycobacterium bovis
GGCELAMMCDVLIAADTAK

SEQ ID NO: 199803 - protein, 24 aa, Mycobacterium bovis
GGCELATACDVCIATDDARFGIPL

SEQ ID NO: 199804 - protein, 24 aa, Mycobacterium bovis
GGCLPKDIRAFMARAGELGADQAL

SEQ ID NO: 199805 - protein, 19 aa, Mycobacterium bovis
GGDAWVRAMMLVDAGVDVL

SEQ ID NO: 199806 - protein, 22 aa, Mycobacterium bovis
GGDGRCKLVPYARRTPRMARTR

SEQ ID NO: 199807 - protein, 33 aa, Mycobacterium bovis
GGDLDVRQYSRWALRLRVPFTVPVEAKSLQLNE

SEQ ID NO: 199808 - protein, 18 aa, Mycobacterium bovis
GGDLEFADELTLGRALAG

SEQ ID NO: 199809 - protein, 20 aa, Mycobacterium bovis
GGDLRRMGISAATVAALGQA

SEQ ID NO: 199810 - protein, 23 aa, Mycobacterium bovis
GGDSDWSHGMWKGEKFVERRTYD

SEQ ID NO: 199811 - protein, 19 aa, Mycobacterium bovis
GGDVPVTVCQWGEAAAKDL

SEQ ID NO: 199812 - protein, 18 aa, Mycobacterium bovis
GGDVVELRAPDAAMVARG

SEQ ID NO: 199813 - protein, 25 aa, Mycobacterium bovis
GGEDRRPTLSWPRNLPIDGEPAEVV

SEQ ID NO: 199814 - protein, 20 aa, Mycobacterium bovis
GGEGGEVGGAGGTGGAAGNG

SEQ ID NO: 199815 - protein, 20 aa, Mycobacterium bovis
GGELAVALHASFPPERITLH

SEQ ID NO: 199816 - protein, 19 aa, Mycobacterium bovis
GGELPDWYRRCYDPVVALA

SEQ ID NO: 199817 - protein, 18 aa, Mycobacterium bovis
GGEQRRWLQAELANARRD

SEQ ID NO: 199818 - protein, 23 aa, Mycobacterium bovis
GGERNRLNLALTLKQGGNLILLD

SEQ ID NO: 199819 - protein, 23 aa, Mycobacterium bovis
GGESARSRVCFTMAEVRETVAEL

SEQ ID NO: 199820 - protein, 19 aa, Mycobacterium bovis
GGESSRPGATRVDPAVETS

SEQ ID NO: 199821 - protein, 19 aa, Mycobacterium bovis
GGFGHLLILGFDYSDNPGP

SEQ ID NO: 199822 - protein, 17 aa, Mycobacterium bovis
GGFGILGAVAHSPKRLE

SEQ ID NO: 199823 - protein, 20 aa, Mycobacterium bovis
GGFPGTAAGFARRIARNTQL

SEQ ID NO: 199824 - protein, 23 aa, Mycobacterium bovis
GGGAGMFSQPGVHGAGGTGGQGG

SEQ ID NO: 199825 - protein, 20 aa, Mycobacterium bovis
GGGAHFCLGANLARREIRVA

SEQ ID NO: 199826 - protein, 29 aa, Mycobacterium bovis
GGGAIRIPLISIPAAPGFGNSTTNPSSGF

SEQ ID NO: 199827 - protein, 25 aa, Mycobacterium bovis
GGGGNFGVTTSMTFARFPTADCDVV

SEQ ID NO: 199828 - protein, 30 aa, Mycobacterium bovis
GGGHGGNGGNPGWLLGTAGGGGNGGAGSTG

SEQ ID NO: 199829 - protein, 20 aa, Mycobacterium bovis
GGGICHWFHSDVMYRSVLAL

SEQ ID NO: 199830 - protein, 24 aa, Mycobacterium bovis
GGGLPIGACLAVGPAAELLTPGLH

SEQ ID NO: 199831 - protein, 31 aa, Mycobacterium bovis
GGGNGGHGGNGGWLLGNGGNGGLGGDGDGGT

SEQ ID NO: 199832 - protein, 19 aa, Mycobacterium bovis
GGGSSGVWNSGLSSAIGNS

SEQ ID NO: 199833 - protein, 20 aa, Mycobacterium bovis
GGGTMTHAWLLTGPPGSGRS

SEQ ID NO: 199834 - protein, 23 aa, Mycobacterium bovis
GGGVRRCLGFGFALTEGAVILQE

SEQ ID NO: 199835 - protein, 17 aa, Mycobacterium bovis
GGIARAIYVGSLSVPQG

SEQ ID NO: 199836 - protein, 31 aa, Mycobacterium bovis
GGIGGGPGGNGGWLLGNGGHGGAGGIGGGSG

SEQ ID NO: 199837 - protein, 23 aa, Mycobacterium bovis
GGISRKADKWVPLLENRTPVVPA

SEQ ID NO: 199838 - protein, 23 aa, Mycobacterium bovis
GGKALKFYASVRMDVRRVETLKD

SEQ ID NO: 199839 - protein, 18 aa, Mycobacterium bovis
GGKARPDIGPLFYEPTVL

SEQ ID NO: 199840 - protein, 27 aa, Mycobacterium bovis
GGKGADPGGLFPIPGAGGKGGTGGTGG

SEQ ID NO: 199841 - protein, 19 aa, Mycobacterium bovis
GGLGHRSKHRGPRHLTDSR

SEQ ID NO: 199842 - protein, 21 aa, Mycobacterium bovis
GGLHPRVALMLDVESGGNPPG

SEQ ID NO: 199843 - protein, 22 aa, Mycobacterium bovis
GGLKVTTANAWFAARPSGTEDV

SEQ ID NO: 199844 - protein, 19 aa, Mycobacterium bovis
GGLLHHAPSLLAFTNPTVN

SEQ ID NO: 199845 - protein, 27 aa, Mycobacterium bovis
GGLLIACLQFDLPIRLFEIGSSAGLNL

SEQ ID NO: 199846 - protein, 21 aa, Mycobacterium bovis
GGLLLPLGVRSLRAYGPTRNA

SEQ ID NO: 199847 - protein, 17 aa, Mycobacterium bovis
GGLPPESGFTYLDDVPA

SEQ ID NO: 199848 - protein, 18 aa, Mycobacterium bovis
GGMGLRLKGSDTLYSCLP

SEQ ID NO: 199849 - protein, 22 aa, Mycobacterium bovis
GGMQRFAPLNSWPDNASLDKAR

SEQ ID NO: 199850 - protein, 22 aa, Mycobacterium bovis
GGMRRRVRLASVLRRCTVLDAH

SEQ ID NO: 199851 - protein, 20 aa, Mycobacterium bovis
GGNADFRYNTVITEETCAGR

SEQ ID NO: 199852 - protein, 22 aa, Mycobacterium bovis
GGNAGAGGTGFTQGADGNAGNG

SEQ ID NO: 199853 - protein, 26 aa, Mycobacterium bovis
GGNAVIPGDGVGKAPHGGAGGSGGDG

SEQ ID NO: 199854 - protein, 25 aa, Mycobacterium bovis
GGNGGSAGLWGNGGAGGAGGSGGAA

SEQ ID NO: 199855 - protein, 28 aa, Mycobacterium bovis
GGNGSKGLPGLGRLGNPGLDGGTGGNGG

SEQ ID NO: 199856 - protein, 19 aa, Mycobacterium bovis
GGNTSGLWNLASAASGVSG

SEQ ID NO: 199857 - protein, 19 aa, Mycobacterium bovis
GGPPLVFQLLWYPTTMADL

SEQ ID NO: 199858 - protein, 17 aa, Mycobacterium bovis
GGPRKVSPLAVQMIMPN

SEQ ID NO: 199859 - protein, 24 aa, Mycobacterium bovis
GGPRPSMVPWVISARSAEALTAQA

SEQ ID NO: 199860 - protein, 17 aa, Mycobacterium bovis
GGPVTRWAEETDRNPPR

SEQ ID NO: 199861 - protein, 24 aa, Mycobacterium bovis
GGQAGNIARLSWLAAGYPEEVPGV

SEQ ID NO: 199862 - protein, 18 aa, Mycobacterium bovis
GGQLRWYGLDGVEHTGGP

SEQ ID NO: 199863 - protein, 23 aa, Mycobacterium bovis
GGQTLRPAPVGAYPAGASACGAE

SEQ ID NO: 199864 - protein, 21 aa, Mycobacterium bovis
GGRLIKLPVFGSVAEAMEKTG

SEQ ID NO: 199865 - protein, 25 aa, Mycobacterium bovis
GGRRICIGQSFALMEMVLMAAIMSQ

SEQ ID NO: 199866 - protein, 19 aa, Mycobacterium bovis
GGRRSFILVPGIDVPFHSR

SEQ ID NO: 199867 - protein, 18 aa, Mycobacterium bovis
GGSCGRKVLGEGWGDVLV

SEQ ID NO: 199868 - protein, 30 aa, Mycobacterium bovis
GGSGGAGGNGGWLLGNGGIGGAGGTGGGAG

SEQ ID NO: 199869 - protein, 18 aa, Mycobacterium bovis
GGSGGAWAGNGGTGGAGG

SEQ ID NO: 199870 - protein, 21 aa, Mycobacterium bovis
GGSGRWLRRVTALTQAGVRRR

SEQ ID NO: 199871 - protein, 18 aa, Mycobacterium bovis
GGSGTPIPSARYVELANA

SEQ ID NO: 199872 - protein, 24 aa, Mycobacterium bovis
GGSIPEYNRDALVSTFQDLYGPAQ

SEQ ID NO: 199873 - protein, 18 aa, Mycobacterium bovis
GGSTARSGGGVWIPNNEV

SEQ ID NO: 199874 - protein, 20 aa, Mycobacterium bovis
GGTAGLFGVGGAGGAGGNGI

SEQ ID NO: 199875 - protein, 21 aa, Mycobacterium bovis
GGTCPLWNVYETFANPGKILV

SEQ ID NO: 199876 - protein, 24 aa, Mycobacterium bovis
GGTDLRWSGSFTEKVRGTGPVMRA

SEQ ID NO: 199877 - protein, 22 aa, Mycobacterium bovis
GGTGGDALGLIGAGIGGVGGVG

SEQ ID NO: 199878 - protein, 27 aa, Mycobacterium bovis
GGTGGNGALLFGFGGAGGAGGHGGAAL

SEQ ID NO: 199879 - protein, 18 aa, Mycobacterium bovis
GGTPFPLQLATQVDAPPG

SEQ ID NO: 199880 - protein, 17 aa, Mycobacterium bovis
GGTRIALSRGLRPDRFV

SEQ ID NO: 199881 - protein, 17 aa, Mycobacterium bovis
GGTRRCVGAAFANMEMD

SEQ ID NO: 199882 - protein, 24 aa, Mycobacterium bovis
GGTWKGQRSGFVMVPDRNFAMTVL

SEQ ID NO: 199883 - protein, 17 aa, Mycobacterium bovis
GGVAGLFGDGGNGGNAG

SEQ ID NO: 199884 - protein, 23 aa, Mycobacterium bovis
GGVATRFPGISFPSLGVTATGAT

SEQ ID NO: 199885 - protein, 25 aa, Mycobacterium bovis
GGVGGMGGTGGWLMGNGGMGGAGGV

SEQ ID NO: 199886 - protein, 18 aa, Mycobacterium bovis
GGVHKCIGMVFGQLEIKT

SEQ ID NO: 199887 - protein, 18 aa, Mycobacterium bovis
GGVLKPILWGPGKATAVQ

SEQ ID NO: 199888 - protein, 19 aa, Mycobacterium bovis
GGVPVGWEVASALGAELDV

SEQ ID NO: 199889 - protein, 17 aa, Mycobacterium bovis
GGVTIVIPGHENVTLPH

SEQ ID NO: 199890 - protein, 18 aa, Mycobacterium bovis
GGVTLGLLSAWRGPNGQD

SEQ ID NO: 199891 - protein, 25 aa, Mycobacterium bovis
GGVVDVVCPLGWPATPARLPFTLGA

SEQ ID NO: 199892 - protein, 20 aa, Mycobacterium bovis
GGVVPPDLTVVSWLPLYHDM

SEQ ID NO: 199893 - protein, 17 aa, Mycobacterium bovis
GGVYLDIPGDVLGQAVE

SEQ ID NO: 199894 - protein, 25 aa, Mycobacterium bovis
GGYHVLRAAWPHFREQSYGRVVVAT

SEQ ID NO: 199895 - protein, 18 aa, Mycobacterium bovis
GHAGFLGIERIRELVTDA

SEQ ID NO: 199896 - protein, 18 aa, Mycobacterium bovis
GHALLLGARGRRLDVRQA

SEQ ID NO: 199897 - protein, 22 aa, Mycobacterium bovis
GHAVLCGLSALPDDYAGNVVVT

SEQ ID NO: 199898 - protein, 17 aa, Mycobacterium bovis
GHAYEYIATDAIARFKR

SEQ ID NO: 199899 - protein, 24 aa, Mycobacterium bovis
GHDHQRIAPLVGELADTLGRTIDV

SEQ ID NO: 199900 - protein, 23 aa, Mycobacterium bovis
GHDLPACHVYRTFDDLDAIRAGA

SEQ ID NO: 199901 - protein, 27 aa, Mycobacterium bovis
GHDPRRFATDLLERFRDLIVLQSVPDA

SEQ ID NO: 199902 - protein, 19 aa, Mycobacterium bovis
GHEVLRCRFDRDAMALVAQ

SEQ ID NO: 199903 - protein, 19 aa, Mycobacterium bovis
GHFATMRHAASHWRGLSKA

SEQ ID NO: 199904 - protein, 23 aa, Mycobacterium bovis
GHGRSPWAAPWTIDANVSALAAL

SEQ ID NO: 199905 - protein, 19 aa, Mycobacterium bovis
GHHLRRASAVLQQVSGECE

SEQ ID NO: 199906 - protein, 19 aa, Mycobacterium bovis
GHHSWEDLDDLLLATYSEL

SEQ ID NO: 199907 - protein, 18 aa, Mycobacterium bovis
GHIEFPYVYLDATYLNVR

SEQ ID NO: 199908 - protein, 24 aa, Mycobacterium bovis
GHIPRNLHFTRWNPAIDASATRLF

SEQ ID NO: 199909 - protein, 24 aa, Mycobacterium bovis
GHIWRRIRAANLPIALSDRLTLDT

SEQ ID NO: 199910 - protein, 21 aa, Mycobacterium bovis
GHNPIAIIVPCHRVIGASGKL

SEQ ID NO: 199911 - protein, 22 aa, Mycobacterium bovis
GHPESLVNWDALAALTGTIVLL

SEQ ID NO: 199912 - protein, 19 aa, Mycobacterium bovis
GHPLFAHITLLRSERSPIA

SEQ ID NO: 199913 - protein, 20 aa, Mycobacterium bovis
GHPTPGWWDGVAGPGAPIDT

SEQ ID NO: 199914 - protein, 17 aa, Mycobacterium bovis
GHREALVDMVARRRFNY

SEQ ID NO: 199915 - protein, 33 aa, Mycobacterium bovis
GHRFFREYPYRDAYLLREARLFRAELTIPLILL

SEQ ID NO: 199916 - protein, 26 aa, Mycobacterium bovis
GHRNGGVVLLMWAGILAYLDRYGYDY

SEQ ID NO: 199917 - protein, 25 aa, Mycobacterium bovis
GHRRGFLQFRWQRVSRELTEADGPT

SEQ ID NO: 199918 - protein, 25 aa, Mycobacterium bovis
GHSLGGGVAMQFAYQFPQLVDRLIL

SEQ ID NO: 199919 - protein, 19 aa, Mycobacterium bovis
GHTKRALVRAGFLAGDALR

SEQ ID NO: 199920 - protein, 20 aa, Mycobacterium bovis
GHTYAFDDTVAWLAVACSKT

SEQ ID NO: 199921 - protein, 23 aa, Mycobacterium bovis
GHVGDPEFLPLLRRLGRFLPADV

SEQ ID NO: 199922 - protein, 20 aa, Mycobacterium bovis
GHWPGMGAVAYRELPTYRTA

SEQ ID NO: 199923 - protein, 22 aa, Mycobacterium bovis
GHYSFLNVFKLFGPRNQAPLSF

SEQ ID NO: 199924 - protein, 23 aa, Mycobacterium bovis
GIAFLRAPCRVVYVIDEPDVRGF

SEQ ID NO: 199925 - protein, 17 aa, Mycobacterium bovis
GIAHPPRGGLGHRSKHR

SEQ ID NO: 199926 - protein, 24 aa, Mycobacterium bovis
GIAKRELRGVPARAVKSPADLDEL

SEQ ID NO: 199927 - protein, 17 aa, Mycobacterium bovis
GIALLRYLSAQAQQIEW

SEQ ID NO: 199928 - protein, 19 aa, Mycobacterium bovis
GIATWPARAGLAAADTGLN

SEQ ID NO: 199929 - protein, 18 aa, Mycobacterium bovis
GICNGFQVLCEAGLLPGA

SEQ ID NO: 199930 - protein, 19 aa, Mycobacterium bovis
GIDEPRPITSMPGVVQHTR

SEQ ID NO: 199931 - protein, 20 aa, Mycobacterium bovis
GIDNARRAELIERFGLDPTK

SEQ ID NO: 199932 - protein, 24 aa, Mycobacterium bovis
GIDPDLYSGFAFGMGLERTLQFRN

SEQ ID NO: 199933 - protein, 20 aa, Mycobacterium bovis
GIDRFPLEMVQRYVNDQRGD

SEQ ID NO: 199934 - protein, 18 aa, Mycobacterium bovis
GIDTETWYPAGPARTGSV

SEQ ID NO: 199935 - protein, 19 aa, Mycobacterium bovis
GIEFCKLSFAETRVRAQHL

SEQ ID NO: 199936 - protein, 17 aa, Mycobacterium bovis
GIELPRRIFAHGFLHNR

SEQ ID NO: 199937 - protein, 24 aa, Mycobacterium bovis
GIETKGGVMTRLIERNTTIPTKRS

SEQ ID NO: 199938 - protein, 19 aa, Mycobacterium bovis
GIGEGLRFVYTGNVHDAVG

SEQ ID NO: 199939 - protein, 21 aa, Mycobacterium bovis
GIGGAAINILANAGAGGAGGA

SEQ ID NO: 199940 - protein, 23 aa, Mycobacterium bovis
GIGKRVALAYVEAGAQVAIAARH

SEQ ID NO: 199941 - protein, 19 aa, Mycobacterium bovis
GIGRRLLRELLDFARGGVV

SEQ ID NO: 199942 - protein, 21 aa, Mycobacterium bovis
GIGSTLIRLFGHDNVTVFAAR

SEQ ID NO: 199943 - protein, 18 aa, Mycobacterium bovis
GIGVRRVTTDRGVPIELL

SEQ ID NO: 199944 - protein, 17 aa, Mycobacterium bovis
GIIAAVSTFLARAGANI

SEQ ID NO: 199945 - protein, 25 aa, Mycobacterium bovis
GIKECQQRFPFPMTVFDSDCGGEFI

SEQ ID NO: 199946 - protein, 20 aa, Mycobacterium bovis
GILGEVWEFITNALNGLKEL

SEQ ID NO: 199947 - protein, 21 aa, Mycobacterium bovis
GIPKLRIEEAAARTQARIDSG

SEQ ID NO: 199948 - protein, 24 aa, Mycobacterium bovis
GIPMTARAAWAWFRHLHRLADRTL

SEQ ID NO: 199949 - protein, 17 aa, Mycobacterium bovis
GIPQIEVTFDIDANGIV

SEQ ID NO: 199950 - protein, 18 aa, Mycobacterium bovis
GIPSYACPTYKRIRILGG

SEQ ID NO: 199951 - protein, 19 aa, Mycobacterium bovis
GIQLLPLWRRVHSHVLRIS

SEQ ID NO: 199952 - protein, 20 aa, Mycobacterium bovis
GIRGFDCWLEGHLQQLRHAP

SEQ ID NO: 199953 - protein, 18 aa, Mycobacterium bovis
GIRLKLNPLKEVIRGKRL

SEQ ID NO: 199954 - protein, 21 aa, Mycobacterium bovis
GIRRRVAADLQILKRFAQTVE

SEQ ID NO: 199955 - protein, 23 aa, Mycobacterium bovis
GIRTDFALVHAWQGDRHGNLMYR

SEQ ID NO: 199956 - protein, 24 aa, Mycobacterium bovis
GIRVDGNDVLACYAVMAEAAARAR

SEQ ID NO: 199957 - protein, 26 aa, Mycobacterium bovis
GISTNARMLIQFGFIERLAVAGDRRT

SEQ ID NO: 199958 - protein, 19 aa, Mycobacterium bovis
GITARGAWEAVKRHFREIG

SEQ ID NO: 199959 - protein, 26 aa, Mycobacterium bovis
GITGDHQMGFGGFNSGSGNIGFGNSG

SEQ ID NO: 199960 - protein, 23 aa, Mycobacterium bovis
GITLEQINFGFTIDIAGIPLLAG

SEQ ID NO: 199961 - protein, 19 aa, Mycobacterium bovis
GIVEVLRLITDRGDPVIVN

SEQ ID NO: 199962 - protein, 24 aa, Mycobacterium bovis
GIVYTYARPNWWANANTVRSMIDA

SEQ ID NO: 199963 - protein, 20 aa, Mycobacterium bovis
GIWLHCLYALSGINLRESVR

SEQ ID NO: 199964 - protein, 21 aa, Mycobacterium bovis
GIYQCRACGAELFRSTEKFES

SEQ ID NO: 199965 - protein, 22 aa, Mycobacterium bovis
GKAFTANILMYGRVVVVADPQL

SEQ ID NO: 199966 - protein, 18 aa, Mycobacterium bovis
GKANRWHTDVTFAANYPA

SEQ ID NO: 199967 - protein, 23 aa, Mycobacterium bovis
GKARWYRNRWVRTPAVCAALGEP

SEQ ID NO: 199968 - protein, 19 aa, Mycobacterium bovis
GKDISCNLGSLNIAKTMDS

SEQ ID NO: 199969 - protein, 24 aa, Mycobacterium bovis
GKDRPELASALGAAGQVFTTGVPV

SEQ ID NO: 199970 - protein, 20 aa, Mycobacterium bovis
GKGFAGTMKRHGFRGQGASH

SEQ ID NO: 199971 - protein, 22 aa, Mycobacterium bovis
GKGGASGMLIGNGGNGGSGGVG

SEQ ID NO: 199972 - protein, 27 aa, Mycobacterium bovis
GKGGEGGVGSILGGPGGNGGTGGNASA

SEQ ID NO: 199973 - protein, 22 aa, Mycobacterium bovis
GKGGEYFLRHLLGTDSNVQSDP

SEQ ID NO: 199974 - protein, 23 aa, Mycobacterium bovis
GKHLGVGVTSIYWYFRKKDDLLN

SEQ ID NO: 199975 - protein, 18 aa, Mycobacterium bovis
GKICDALLDGARKVAAGC

SEQ ID NO: 199976 - protein, 20 aa, Mycobacterium bovis
GKIRRAACVEQYRLQQFTRL

SEQ ID NO: 199977 - protein, 18 aa, Mycobacterium bovis
GKIVARMPAAELFDAICK

SEQ ID NO: 199978 - protein, 26 aa, Mycobacterium bovis
GKKCYSLRIASAMAHDEGWLAEHMLI

SEQ ID NO: 199979 - protein, 23 aa, Mycobacterium bovis
GKLADLVLWEPAFFGVRPHVVLK

SEQ ID NO: 199980 - protein, 25 aa, Mycobacterium bovis
GKLEALLRVLEPFGIREIAQSGMVS

SEQ ID NO: 199981 - protein, 17 aa, Mycobacterium bovis
GKLQWILENVDGVRAAA

SEQ ID NO: 199982 - protein, 33 aa, Mycobacterium bovis
GKMAAVAKRRGWPILKFNSRGGVGIRRQLRTLA

SEQ ID NO: 199983 - protein, 23 aa, Mycobacterium bovis
GKNNPGLVVLLTFGTGIGSAVIH

SEQ ID NO: 199984 - protein, 24 aa, Mycobacterium bovis
GKNTFHGLLLLRHVADLVMTGWPV

SEQ ID NO: 199985 - protein, 20 aa, Mycobacterium bovis
GKPDYRWAKEQTEARPADDV

SEQ ID NO: 199986 - protein, 17 aa, Mycobacterium bovis
GKPFGLRPSAILPAYGM

SEQ ID NO: 199987 - protein, 23 aa, Mycobacterium bovis
GKPVVRRRILLPEHKDFGRIAPD

SEQ ID NO: 199988 - protein, 23 aa, Mycobacterium bovis
GKQALDRWISWAQRCRIPVFVEL

SEQ ID NO: 199989 - protein, 32 aa, Mycobacterium bovis
GKRVTFAAFPWRWVGGDGCIVRLVAIVDPTGS

SEQ ID NO: 199990 - protein, 21 aa, Mycobacterium bovis
GKSATTAWLIERLQRPTLVMA

SEQ ID NO: 199991 - protein, 17 aa, Mycobacterium bovis
GKSRLALQIGAQIAHEF

SEQ ID NO: 199992 - protein, 25 aa, Mycobacterium bovis
GKSTLLLEVAHRWAQSGRRALYVSG

SEQ ID NO: 199993 - protein, 17 aa, Mycobacterium bovis
GKTAFVFAGQGSQWLGM

SEQ ID NO: 199994 - protein, 33 aa, Mycobacterium bovis
GKTALVAALCRQLRGELSLAVLTNDIYTTEDAD

SEQ ID NO: 199995 - protein, 20 aa, Mycobacterium bovis
GKTLAAFLWALDSLAGSEPM

SEQ ID NO: 199996 - protein, 18 aa, Mycobacterium bovis
GKTTLLSCLGGILRPKSG

SEQ ID NO: 199997 - protein, 25 aa, Mycobacterium bovis
GKTVVCAALASAARQAGIDVAVCKP

SEQ ID NO: 199998 - protein, 19 aa, Mycobacterium bovis
GKTYTRWGAFLDDATGFDA

SEQ ID NO: 199999 - protein, 27 aa, Mycobacterium bovis
GKVLPAMLKRQLQLLLPLVEDRFVESV

SEQ ID NO: 200000 - protein, 26 aa, Mycobacterium bovis
GKVTKLVPFGAFVRVEEGIEGLVHIS

SEQ ID NO: 200001 - protein, 19 aa, Mycobacterium bovis
GLAAALCYGAAGVAMGTRF

SEQ ID NO: 200002 - protein, 23 aa, Mycobacterium bovis
GLAAFCDICVRAFADFAVVKPQV

SEQ ID NO: 200003 - protein, 20 aa, Mycobacterium bovis
GLAAWPRVPRHIEWKHGVCD

SEQ ID NO: 200004 - protein, 21 aa, Mycobacterium bovis
GLADGCADLGIPVTGGNVSFY

SEQ ID NO: 200005 - protein, 18 aa, Mycobacterium bovis
GLADIEWTVQLLQLQHAH

SEQ ID NO: 200006 - protein, 18 aa, Mycobacterium bovis
GLAESLGARVFVEVGPGA

SEQ ID NO: 200007 - protein, 19 aa, Mycobacterium bovis
GLAGQRCVDRLVMGASRST

SEQ ID NO: 200008 - protein, 20 aa, Mycobacterium bovis
GLAGRPRLLIADEPTSALDV

SEQ ID NO: 200009 - protein, 22 aa, Mycobacterium bovis
GLALPMRLALPGSVNRGNAAQA

SEQ ID NO: 200010 - protein, 26 aa, Mycobacterium bovis
GLASPVRSAGPWAAWAATARSAQLAG

SEQ ID NO: 200011 - protein, 25 aa, Mycobacterium bovis
GLAVARRLADEGCHVLCADIDGDAA

SEQ ID NO: 200012 - protein, 31 aa, Mycobacterium bovis; identical to SEQ ID NO: 80303

SEQ ID NO: 200013 - protein, 20 aa, Mycobacterium bovis
GLCNSAGFGTSGRFWELPFA

SEQ ID NO: 200014 - protein, 24 aa, Mycobacterium bovis
GLCTYGMTCKAIVDALLDSDATAV

SEQ ID NO: 200015 - protein, 24 aa, Mycobacterium bovis
GLDAIEDLHIWTAESVRADRLDFR

SEQ ID NO: 200016 - protein, 24 aa, Mycobacterium bovis
GLDARGYRLPWPADTTVFEVDQPR

SEQ ID NO: 200017 - protein, 19 aa, Mycobacterium bovis
GLDNLTFVINCNLQRLDGP

SEQ ID NO: 200018 - protein, 23 aa, Mycobacterium bovis
GLDREADDFFAFIADVSGANNNE

SEQ ID NO: 200019 - protein, 18 aa, Mycobacterium bovis
GLDRYGVRFRIEARDGDR

SEQ ID NO: 200020 - protein, 28 aa, Mycobacterium bovis
GLDSRAFRLQWPIGTTIFELDRPQVLDF

SEQ ID NO: 200021 - protein, 29 aa, Mycobacterium bovis
GLDSRAYRLDWPAGTIVYEIDQPKVLSYK

SEQ ID NO: 200022 - protein, 27 aa, Mycobacterium bovis
GLDSRAYRLPWPDGTTVFELDRPQVLD

SEQ ID NO: 200023 - protein, 27 aa, Mycobacterium bovis
GLDTRAYRLPWPPGTVVYEIDQPAVIK

SEQ ID NO: 200024 - protein, 25 aa, Mycobacterium bovis
GLEGGRFAIYIKMHHSLIDGYTGQK

SEQ ID NO: 200025 - protein, 27 aa, Mycobacterium bovis
GLEKCIGCELCAWACPADAIYVEGADN

SEQ ID NO: 200026 - protein, 24 aa, Mycobacterium bovis
GLEQPRSEILTFLATREAAHHRLF

SEQ ID NO: 200027 - protein, 20 aa, Mycobacterium bovis
GLETLSLRIERHVANAQRVA

SEQ ID NO: 200028 - protein, 17 aa, Mycobacterium bovis
GLFAGITARYLALVATT

SEQ ID NO: 200029 - protein, 27 aa, Mycobacterium bovis
GLFDPRLKRPIPYLPNMIGLITGRASA

SEQ ID NO: 200030 - protein, 27 aa, Mycobacterium bovis
GLFLSGDYQGLVGLNLVIDMPLPISLG

SEQ ID NO: 200031 - protein, 18 aa, Mycobacterium bovis
GLFLSLPGVSQWRTLQRV

SEQ ID NO: 200032 - protein, 17 aa, Mycobacterium bovis
GLGEKDLSLALALGEVV

SEQ ID NO: 200033 - protein, 20 aa, Mycobacterium bovis
GLGFSMKWNMGWMHDTLDYV

SEQ ID NO: 200034 - protein, 26 aa, Mycobacterium bovis
GLGGAGGAGGWLIGQSGSTGGGGAGG

SEQ ID NO: 200035 - protein, 20 aa, Mycobacterium bovis
GLGGRAGLIGHGGAGGNGGD

SEQ ID NO: 200036 - protein, 18 aa, Mycobacterium bovis
GLGLRSAISSGLGSTAPA

SEQ ID NO: 200037 - protein, 24 aa, Mycobacterium bovis
GLGRRELLPYSDLDVLLLHDGKPA

SEQ ID NO: 200038 - protein, 26 aa, Mycobacterium bovis
GLGRRVRRLAVSHAFHSVLMDPMVEE

SEQ ID NO: 200039 - protein, 23 aa, Mycobacterium bovis
GLHFICRDVWLRVASTSTAWTSR

SEQ ID NO: 200040 - protein, 25 aa, Mycobacterium bovis
GLHLPGVAFGHDWLTGTSRYSGLLE

SEQ ID NO: 200041 - protein, 17 aa, Mycobacterium bovis
GLHPVVAIYSTFLNRAF

SEQ ID NO: 200042 - protein, 22 aa, Mycobacterium bovis
GLIKTILCLKNKALPATLHYTS

SEQ ID NO: 200043 - protein, 27 aa, Mycobacterium bovis
GLKAREFPVNFDVWWFKLPREGDAEFS

SEQ ID NO: 200044 - protein, 26 aa, Mycobacterium bovis
GLKDPKRPSGSFIFAGPSGVGKTELS

SEQ ID NO: 200045 - protein, 17 aa, Mycobacterium bovis
GLLAARHGLLGAVVEQP

SEQ ID NO: 200046 - protein, 17 aa, Mycobacterium bovis
GLLGILGSGSSWLDKLW

SEQ ID NO: 200047 - protein, 25 aa, Mycobacterium bovis
GLLGSLRFGNRFVHTGKPTPAGYAQ

SEQ ID NO: 200048 - protein, 18 aa, Mycobacterium bovis
GLLGSRWLAHYTATSAFL

SEQ ID NO: 200049 - protein, 31 aa, Mycobacterium bovis
GLLIGAAGLGGCGGGAFTAGVTTGGAGGTGG

SEQ ID NO: 200050 - protein, 22 aa, Mycobacterium bovis
GLLKRPAIDFLDALVSLDLLAR

SEQ ID NO: 200051 - protein, 20 aa, Mycobacterium bovis
GLLLARAGVQVTLLEKHGDF

SEQ ID NO: 200052 - protein, 18 aa, Mycobacterium bovis
GLLPIKIPLIDIPAAPGF

SEQ ID NO: 200053 - protein, 17 aa, Mycobacterium bovis
GLLPYLPGDAADRLFDM

SEQ ID NO: 200054 - protein, 17 aa, Mycobacterium bovis
GLLQRLSSAASVSWSNP

SEQ ID NO: 200055 - protein, 19 aa, Mycobacterium bovis
GLLSGMALASLAARGTTGG

SEQ ID NO: 200056 - protein, 26 aa, Mycobacterium bovis
GLNAVIRAVVRTCHARYGSSVVGFQN

SEQ ID NO: 200057 - protein, 22 aa, Mycobacterium bovis
GLNIPTGIPLRYDLDSAMRPLV

SEQ ID NO: 200058 - protein, 18 aa, Mycobacterium bovis
GLNLVGGLRRSMAKAGYC

SEQ ID NO: 200059 - protein, 24 aa, Mycobacterium bovis
GLPDIPGYAAKVFRAVADADVNID

SEQ ID NO: 200060 - protein, 18 aa, Mycobacterium bovis
GLPDKLAGRRAWGLAVQL

SEQ ID NO: 200061 - protein, 19 aa, Mycobacterium bovis
GLPGGRCAVYVKVHHALAD

SEQ ID NO: 200062 - protein, 29 aa, Mycobacterium bovis
GLPGNPGAVPGRAGGAGGLGGSGSDTSEG

SEQ ID NO: 200063 - protein, 18 aa, Mycobacterium bovis
GLPILGHMIEMLRGGPDY

SEQ ID NO: 200064 - protein, 31 aa, Mycobacterium bovis
GLPLPAGAVGEIWLRGTTVVRGYLGDPTITA

SEQ ID NO: 200065 - protein, 20 aa, Mycobacterium bovis
GLPRRLRWVSPLVPLVAGPL

SEQ ID NO: 200066 - protein, 25 aa, Mycobacterium bovis
GLPRTAFKPSYGIAEATLLVATIDH

SEQ ID NO: 200067 - protein, 28 aa, Mycobacterium bovis
GLPTSRLDSLLVRLSRDAGFQIVLARHE

SEQ ID NO: 200068 - protein, 25 aa, Mycobacterium bovis
GLPYLGLEHRAAWVEAEADGTITSM

SEQ ID NO: 200069 - protein, 21 aa, Mycobacterium bovis
GLQSLRLWREGSFLDGLGPQL

SEQ ID NO: 200070 - protein, 24 aa, Mycobacterium bovis
GLQSYEIPRDFIIETTPFTLENGL

SEQ ID NO: 200071 - protein, 21 aa, Mycobacterium bovis
GLRAGMPTLILWDVADQPIWA

SEQ ID NO: 200072 - protein, 22 aa, Mycobacterium bovis
GLRAGRNGGFALVIAVDAHGDA

SEQ ID NO: 200073 - protein, 20 aa, Mycobacterium bovis
GLRDLHAPGYVRAYAYDQDE

SEQ ID NO: 200074 - protein, 17 aa, Mycobacterium bovis
GLREIRVPGRLEQIDRG

SEQ ID NO: 200075 - protein, 23 aa, Mycobacterium bovis
GLREPRGPWGPGRPVEAADAFEA

SEQ ID NO: 200076 - protein, 17 aa, Mycobacterium bovis
GLRGVEKGYVLGPQAED

SEQ ID NO: 200077 - protein, 22 aa, Mycobacterium bovis
GLRLRRRSVLASAARRVLGVLP

SEQ ID NO: 200078 - protein, 17 aa, Mycobacterium bovis
GLRQWRSLDWGTVEVFL

SEQ ID NO: 200079 - protein, 19 aa, Mycobacterium bovis
GLRRSMAKAGYCDLKEFQK

SEQ ID NO: 200080 - protein, 24 aa, Mycobacterium bovis
GLRTRLFAAPGWLVSPGVRTALPA

SEQ ID NO: 200081 - protein, 25 aa, Mycobacterium bovis
GLRVRRRAKVWYDRLNAEDPTRKPE

SEQ ID NO: 200082 - protein, 24 aa, Mycobacterium bovis
GLSHPMGPLRLSDLVGLDTLKLIA

SEQ ID NO: 200083 - protein, 31 aa, Mycobacterium bovis
GLSLPLLRSLVQRCGLSVAALWAGNAGGPAH

SEQ ID NO: 200084 - protein, 19 aa, Mycobacterium bovis
GLTAIRLAAMAPDLVGELV

SEQ ID NO: 200085 - protein, 17 aa, Mycobacterium bovis
GLTEVLRAAAQHRGAAL

SEQ ID NO: 200086 - protein, 18 aa, Mycobacterium bovis
GLTGQAWQGPASAAMAAA

SEQ ID NO: 200087 - protein, 19 aa, Mycobacterium bovis
GLTIPVLLIRGKLSDVVSS

SEQ ID NO: 200088 - protein, 26 aa, Mycobacterium bovis
GLTRFAEAMAPFGFDAGAVLPSYGLA

SEQ ID NO: 200089 - protein, 17 aa, Mycobacterium bovis
GLTRVALVEGSRVVNSS

SEQ ID NO: 200090 - protein, 30 aa, Mycobacterium bovis
GLTVCYDIRFPALYTELARRGAQLIAVCAS

SEQ ID NO: 200091 - protein, 21 aa, Mycobacterium bovis
GLVAGALRLTADYVANRKQFG

SEQ ID NO: 200092 - protein, 26 aa, Mycobacterium bovis
GLVDDIRINWVWNPPWGPDKITEDGR

SEQ ID NO: 200093 - protein, 19 aa, Mycobacterium bovis
GLVGHGFGGSAAVFAAAGL

SEQ ID NO: 200094 - protein, 19 aa, Mycobacterium bovis
GLVGLPWHAAYSASKYGLR

SEQ ID NO: 200095 - protein, 22 aa, Mycobacterium bovis
GLVRAAACTMFFGETAESLAAE

SEQ ID NO: 200096 - protein, 19 aa, Mycobacterium bovis
GLVRGRTGILLVDTGTTLG

SEQ ID NO: 200097 - protein, 22 aa, Mycobacterium bovis
GLWANLACRKRFIGDKLDEALG

SEQ ID NO: 200098 - protein, 24 aa, Mycobacterium bovis
GLYAKARAGEITHFTGIDSPYQRP

SEQ ID NO: 200099 - protein, 20 aa, Mycobacterium bovis
GMAATDCALRAMLRPGDHVV

SEQ ID NO: 200100 - protein, 24 aa, Mycobacterium bovis
GMAAVQLARLWGLEVFATASRGKW

SEQ ID NO: 200101 - protein, 17 aa, Mycobacterium bovis
GMADGRAAMLLHVSHAV

SEQ ID NO: 200102 - protein, 24 aa, Mycobacterium bovis
GMATGDLLGCFGLTEPDVGSDPAA

SEQ ID NO: 200103 - protein, 25 aa, Mycobacterium bovis
GMELFCAGTHPFARWSAQKLTDAPR

SEQ ID NO: 200104 - protein, 17 aa, Mycobacterium bovis
GMFVRASGMALPLADDS

SEQ ID NO: 200105 - protein, 24 aa, Mycobacterium bovis
GMGGSIPFIAEFAAAFPQATILVT

SEQ ID NO: 200106 - protein, 22 aa, Mycobacterium bovis
GMIWRYPDYFIVGREQCREFAR

SEQ ID NO: 200107 - protein, 17 aa, Mycobacterium bovis
GMLKYGFDDARPVLERA

SEQ ID NO: 200108 - protein, 23 aa, Mycobacterium bovis
GMQRVFFGWAQIWRTKSRAAEAI

SEQ ID NO: 200109 - protein, 23 aa, Mycobacterium bovis
GMRARSALTTALLRSRTNGPCRA

SEQ ID NO: 200110 - protein, 24 aa, Mycobacterium bovis
GMRFDKGYISGYFVTDPERQEAVL

SEQ ID NO: 200111 - protein, 25 aa, Mycobacterium bovis
GMRPYDPPWCRPLLGVRRSVTHAAC

SEQ ID NO: 200112 - protein, 18 aa, Mycobacterium bovis
GMRSHPGVTATFCEALAA

SEQ ID NO: 200113 - protein, 18 aa, Mycobacterium bovis
GMSKSGLFRHFGAKEQLQ

SEQ ID NO: 200114 - protein, 21 aa, Mycobacterium bovis
GMSLRSPARFLASAERLVQLW

SEQ ID NO: 200115 - protein, 18 aa, Mycobacterium bovis
GNAGLLFGAAGVGGAGGF

SEQ ID NO: 200116 - protein, 18 aa, Mycobacterium bovis
GNAGQVFGDGGTGGTGGA

SEQ ID NO: 200117 - protein, 19 aa, Mycobacterium bovis
GNARLVLRRETVDDLLSLE

SEQ ID NO: 200118 - protein, 26 aa, Mycobacterium bovis
GNELLRRLKGLPGFGEQKARIFLALL

SEQ ID NO: 200119 - protein, 17 aa, Mycobacterium bovis
GNFDWTQGRFPGFTTPD

SEQ ID NO: 200120 - protein, 22 aa, Mycobacterium bovis
GNFGGGASGFWNLASATSGLSG

SEQ ID NO: 200121 - protein, 34 aa, Mycobacterium bovis
GNFSNGILWRGNYEGLAGFSFGYPIPLFPAVGAD

SEQ ID NO: 200122 - protein, 31 aa, Mycobacterium bovis
GNGAHGTVGAQFVPATSLPTPNGGAGGNGGT

SEQ ID NO: 200123 - protein, 23 aa, Mycobacterium bovis
GNGDCVAFFWFADAPDRVPGLSS

SEQ ID NO: 200124 - protein, 23 aa, Mycobacterium bovis
GNGGAGGLFMNGGDGGAGGQGGD

SEQ ID NO: 200125 - protein, 19 aa, Mycobacterium bovis
GNGGIGITVGGAGGAGGNG

SEQ ID NO: 200126 - protein, 18 aa, Mycobacterium bovis
GNGGLPFIGSTNAGNGGS

SEQ ID NO: 200127 - protein, 22 aa, Mycobacterium bovis
GNGGLSLGLGVAGGAGGAGGSG

SEQ ID NO: 200128 - protein, 25 aa, Mycobacterium bovis
GNGGNGAQGGWLIGNGGQGGDSGAG

SEQ ID NO: 200129 - protein, 25 aa, Mycobacterium bovis
GNGGRGADATGFGQTGASGGRGGDG

SEQ ID NO: 200130 - protein, 29 aa, Mycobacterium bovis
GNGGSGGRGDMAFKDGDGGAGGDGGDPGA

SEQ ID NO: 200131 - protein, 25 aa, Mycobacterium bovis
GNGGSGGSLFGFGGAGGTGGSSGIG

SEQ ID NO: 200132 - protein, 18 aa, Mycobacterium bovis
GNGLNLVGVPGTAGGGAD

SEQ ID NO: 200133 - protein, 17 aa, Mycobacterium bovis
GNIFLITGIGYYPNLGV

SEQ ID NO: 200134 - protein, 33 aa, Mycobacterium bovis
GNIGVPGTLFGSVRSGLNTGLFNMGTAISGLFN

SEQ ID NO: 200135 - protein, 26 aa, Mycobacterium bovis
GNKGTGLFSGFMSGFGNTGFLQSGFG

SEQ ID NO: 200136 - protein, 29 aa, Mycobacterium bovis
GNLMLYSRLRLATAASWSIRYVVERRAIG

SEQ ID NO: 200137 - protein, 18 aa, Mycobacterium bovis
GNLPIAAIERFCQITDPA

SEQ ID NO: 200138 - protein, 17 aa, Mycobacterium bovis
GNLRAGDTAVIYGVGGL

SEQ ID NO: 200139 - protein, 32 aa, Mycobacterium bovis
GNLRARPQLAVTFRNGWQWATVEGRAQLVGPD

SEQ ID NO: 200140 - protein, 23 aa, Mycobacterium bovis
GNMPQSLVNRACLDIQRGRAGVV

SEQ ID NO: 200141 - protein, 31 aa, Mycobacterium bovis
GNNPVGGLLARFPGFYIPFLDVPFNGATPAN

SEQ ID NO: 200142 - protein, 22 aa, Mycobacterium bovis
GNPDEYGALVLHIIENPMLNGE

SEQ ID NO: 200143 - protein, 26 aa, Mycobacterium bovis
GNPEGGWTLVSWDGIPVGPASLPTAL

SEQ ID NO: 200144 - protein, 24 aa, Mycobacterium bovis
GNPHVARLLGAYQFGRPNRSPTDA

SEQ ID NO: 200145 - protein, 29 aa, Mycobacterium bovis
GNPNRPDGGILTRFGFSIPQLGFTLSGAT

SEQ ID NO: 200146 - protein, 23 aa, Mycobacterium bovis
GNPSRLAALYGLQLAHESQCCQM

SEQ ID NO: 200147 - protein, 23 aa, Mycobacterium bovis
GNPVCAAAALAVLRVLASDGLVR

SEQ ID NO: 200148 - protein, 21 aa, Mycobacterium bovis
GNRSLPFPTLVSILLTDIRVE

SEQ ID NO: 200149 - protein, 26 aa, Mycobacterium bovis
GNSLITSWRALGWIGPEAAEAAAAAP

SEQ ID NO: 200150 - protein, 36 aa, Mycobacterium bovis
GNTAALAAICRFEFAEVYPLLDWAAPYQEMMGPFGT

SEQ ID NO: 200151 - protein, 18 aa, Mycobacterium bovis
GNTFEWDPNSTYVRKPPY

SEQ ID NO: 200152 - protein, 19 aa, Mycobacterium bovis
GNVFVAGFIGSPAMNLFRL

SEQ ID NO: 200153 - protein, 31 aa, Mycobacterium bovis
GNVTRRNGAVWKRVHTTSRLWAFQLQSILAR

SEQ ID NO: 200154 - protein, 35 aa, Mycobacterium bovis
GNYSNGVLWRGDYQGLLGFSYRPAVLPQTPFLDLT

SEQ ID NO: 200155 - protein, 17 aa, Mycobacterium bovis
GPACPQPAIPNMPLDLG

SEQ ID NO: 200156 - protein, 24 aa, Mycobacterium bovis
GPADLPARLSLFGHTRLACTDVQL

SEQ ID NO: 200157 - protein, 17 aa, Mycobacterium bovis
GPAEKIYDPGIILDKDR

SEQ ID NO: 200158 - protein, 17 aa, Mycobacterium bovis
GPAELLSAVGALAEATR

SEQ ID NO: 200159 - protein, 17 aa, Mycobacterium bovis
GPAGIGMLQLWVQQPGD

SEQ ID NO: 200160 - protein, 17 aa, Mycobacterium bovis
GPAGPVLVEASRDAEMI

SEQ ID NO: 200161 - protein, 24 aa, Mycobacterium bovis
GPAPMLAAAVAWDGLAAELGMAAA

SEQ ID NO: 200162 - protein, 25 aa, Mycobacterium bovis
GPARTGCLECGCCMTGCRHGAKNTL

SEQ ID NO: 200163 - protein, 25 aa, Mycobacterium bovis
GPASLPTALFVDVRELITAPQYAAY

SEQ ID NO: 200164 - protein, 37 aa, Mycobacterium bovis
GPASRVAILLPAHWQTAAVLFGVWWIGAQAILDDSPA

SEQ ID NO: 200165 - protein, 19 aa, Mycobacterium bovis
GPCPPRQDMAYSIEADIYL

SEQ ID NO: 200166 - protein, 17 aa, Mycobacterium bovis
GPDLALVVHWYAGDLDR

SEQ ID NO: 200167 - protein, 21 aa, Mycobacterium bovis
GPDLVLRWAALLHDIGKPATR

SEQ ID NO: 200168 - protein, 25 aa, Mycobacterium bovis
GPDPLRMARDLVRRGLDASALDVYR

SEQ ID NO: 200169 - protein, 18 aa, Mycobacterium bovis
GPDRSLIRAQSWDIDLPN

SEQ ID NO: 200170 - protein, 21 aa, Mycobacterium bovis
GPEARYRRWLAALRGSARLVI

SEQ ID NO: 200171 - protein, 18 aa, Mycobacterium bovis
GPEFHRLSFGEAVERGLL

SEQ ID NO: 200172 - protein, 25 aa, Mycobacterium bovis
GPEPLRMARDLVRVGLDALALDIYR

SEQ ID NO: 200173 - protein, 20 aa, Mycobacterium bovis
GPERLWDFLTEKKCAITAYP

SEQ ID NO: 200174 - protein, 18 aa, Mycobacterium bovis
GPEVEVEGIISLKTGGCP

SEQ ID NO: 200175 - protein, 28 aa, Mycobacterium bovis
GPGAGRLQGHRCGACRIEIGRGELAQIS

SEQ ID NO: 200176 - protein, 26 aa, Mycobacterium bovis
GPGFADHFLPVAFDRFTRADTARGGR

SEQ ID NO: 200177 - protein, 25 aa, Mycobacterium bovis
GPGGHGGSVLSGPVGDSGNGGAGGD

SEQ ID NO: 200178 - protein, 24 aa, Mycobacterium bovis
GPGQPGGPGGLLYGNGGHGGAGAA

SEQ ID NO: 200179 - protein, 17 aa, Mycobacterium bovis
GPGSIVVEGRDIGTVVF

SEQ ID NO: 200180 - protein, 32 aa, Mycobacterium bovis
GPGTGKCQQVWCPLCALAALVTGEQHPLLTVI

SEQ ID NO: 200181 - protein, 30 aa, Mycobacterium bovis
GPGTPGSPMVAPPPPTPITQVQQGGDGGAG

SEQ ID NO: 200182 - protein, 23 aa, Mycobacterium bovis
GPGTRLDGAVIFDGVRVEAGCVI

SEQ ID NO: 200183 - protein, 22 aa, Mycobacterium bovis
GPHGLLRGLPLGSRITRRSGAF

SEQ ID NO: 200184 - protein, 22 aa, Mycobacterium bovis
GPHKNFAVGLGCDLAHAHKLVY

SEQ ID NO: 200185 - protein, 24 aa, Mycobacterium bovis
GPIHIGLPLSLTIPGFTIPGGTLI

SEQ ID NO: 200186 - protein, 29 aa, Mycobacterium bovis
GPISIPIIDLRPAPGFFNATTGPSSGFLN

SEQ ID NO: 200187 - protein, 19 aa, Mycobacterium bovis
GPITLGFQVPGSVNAITLF

SEQ ID NO: 200188 - protein, 25 aa, Mycobacterium bovis
GPKTAETAAEFGLRVDVQPDTAAIG

SEQ ID NO: 200189 - protein, 24 aa, Mycobacterium bovis
GPLAHPGLVCDVAIGQSTLATQRV

SEQ ID NO: 200190 - protein, 24 aa, Mycobacterium bovis
GPLCLDCADLGHLVFLPSGDAALT

SEQ ID NO: 200191 - protein, 25 aa, Mycobacterium bovis
GPLDWAVELDERWVIVGPNGAGKTS

SEQ ID NO: 200192 - protein, 21 aa, Mycobacterium bovis
GPLDWRWRRRGFFGDHGGRWC

SEQ ID NO: 200193 - protein, 17 aa, Mycobacterium bovis
GPLEASRPWATKDVVGA

SEQ ID NO: 200194 - protein, 24 aa, Mycobacterium bovis
GPLLDAMGLTVGWITADSTPDERR

SEQ ID NO: 200195 - protein, 23 aa, Mycobacterium bovis
GPLLLPRIVASVFANEPRCRRIM

SEQ ID NO: 200196 - protein, 18 aa, Mycobacterium bovis
GPLPPRWVTVHPNNPERA

SEQ ID NO: 200197 - protein, 17 aa, Mycobacterium bovis
GPLRPWPDDVRRAIRES

SEQ ID NO: 200198 - protein, 24 aa, Mycobacterium bovis
GPLRRLSEGIALLITTGFLPQRFR

SEQ ID NO: 200199 - protein, 20 aa, Mycobacterium bovis
GPLTECLADVVARFLPYFTD

SEQ ID NO: 200200 - protein, 24 aa, Mycobacterium bovis
GPMDRFHRRLLWPIRTSAGEVVGF

SEQ ID NO: 200201 - protein, 22 aa, Mycobacterium bovis
GPPGCGKTLIAKAVANSLAKKM

SEQ ID NO: 200202 - protein, 23 aa, Mycobacterium bovis
GPPGELLLYVFGRRAVARVEVSG

SEQ ID NO: 200203 - protein, 17 aa, Mycobacterium bovis
GPPHVQGAFTIGENIGD

SEQ ID NO: 200204 - protein, 22 aa, Mycobacterium bovis
GPPRELQPIWSKAIQTAPVQDA

SEQ ID NO: 200205 - protein, 23 aa, Mycobacterium bovis
GPRGCGKTSSARILARSLNCAQG

SEQ ID NO: 200206 - protein, 32 aa, Mycobacterium bovis
GPRLPRYLQSVLYLRFREWFLPAMHRKYGDVF

SEQ ID NO: 200207 - protein, 21 aa, Mycobacterium bovis
GPRRKGVRYFGPYSHAWAIRE

SEQ ID NO: 200208 - protein, 18 aa, Mycobacterium bovis
GPRVYELLYGDPFPSGVQ

SEQ ID NO: 200209 - protein, 29 aa, Mycobacterium bovis
GPSASFGTLWIKSPANMLGYWNNPERTAE

SEQ ID NO: 200210 - protein, 20 aa, Mycobacterium bovis
GPTLMVSDLFDFSLYVDARI

SEQ ID NO: 200211 - protein, 18 aa, Mycobacterium bovis
GPVAALFLDLDRLKAIND

SEQ ID NO: 200212 - protein, 28 aa, Mycobacterium bovis
GPVAARLVSRGGFTRGFGRIFSPAHPLS

SEQ ID NO: 200213 - protein, 18 aa, Mycobacterium bovis
GPVARFLGINNMLTNKFE

SEQ ID NO: 200214 - protein, 26 aa, Mycobacterium bovis
GPVGDGTCYWKRMGNPDGALIDNALS

SEQ ID NO: 200215 - protein, 19 aa, Mycobacterium bovis
GPVIEKAYGAGPCSGHLTD

SEQ ID NO: 200216 - protein, 20 aa, Mycobacterium bovis
GPVPAGWRTIGRVLDGPARV

SEQ ID NO: 200217 - protein, 20 aa, Mycobacterium bovis
GPVVGVWRRAPLQALARLHM

SEQ ID NO: 200218 - protein, 42 aa, Mycobacterium bovis
GPWGREVIGIAAGVVRFIGVNGYRWMIRCVVNGPQETVDALT

SEQ ID NO: 200219 - protein, 24 aa, Mycobacterium bovis
GPWIADRLLELGVELAHITICGDR

SEQ ID NO: 200220 - protein, 18 aa, Mycobacterium bovis
GPWLRTGDLGVISDGELF

SEQ ID NO: 200221 - protein, 31 aa, Mycobacterium bovis
GPYTFPGVLPPSGVPYLLGIQSVLVTQNGQG

SEQ ID NO: 200222 - protein, 21 aa, Mycobacterium bovis
GQAALSQNFIGAGGTAGAGGT

SEQ ID NO: 200223 - protein, 17 aa, Mycobacterium bovis
GQAAWAMDQIMTGNARP

SEQ ID NO: 200224 - protein, 23 aa, Mycobacterium bovis
GQAGGKGWDGGPIGNGQVGEQHG

SEQ ID NO: 200225 - protein, 18 aa, Mycobacterium bovis
GQAKLANLLFTYELQRRL

SEQ ID NO: 200226 - protein, 17 aa, Mycobacterium bovis
GQAVWLGAVPKDAPTGG

SEQ ID NO: 200227 - protein, 20 aa, Mycobacterium bovis
GQCDRRVIAVIGDGALTGGV

SEQ ID NO: 200228 - protein, 23 aa, Mycobacterium bovis
GQDAALFPGSWSEWSSDPTRPVG

SEQ ID NO: 200229 - protein, 20 aa, Mycobacterium bovis
GQDAEAMYGYAATAATATEA

SEQ ID NO: 200230 - protein, 24 aa, Mycobacterium bovis
GQDKLRLLLEFANELPALPSHLAE

SEQ ID NO: 200231 - protein, 17 aa, Mycobacterium bovis
GQFFPRWTYEKTEPRDG

SEQ ID NO: 200232 - protein, 18 aa, Mycobacterium bovis
GQFGKWLQGARDWSISRN

SEQ ID NO: 200233 - protein, 24 aa, Mycobacterium bovis
GQFSDEFLRWLAGVRFTGDVWAAP

SEQ ID NO: 200234 - protein, 19 aa, Mycobacterium bovis
GQGESPCALGSVKTNIGHL

SEQ ID NO: 200235 - protein, 25 aa, Mycobacterium bovis
GQGFGRAVPQYGFRPNFVARPPAAG

SEQ ID NO: 200236 - protein, 17 aa, Mycobacterium bovis
GQGFLALVDYAHKPEAL

SEQ ID NO: 200237 - protein, 25 aa, Mycobacterium bovis
GQGLMKNAYVGRTFIQPSQTIRQLG

SEQ ID NO: 200238 - protein, 17 aa, Mycobacterium bovis
GQIGFGSFNSGSGNIGL

SEQ ID NO: 200239 - protein, 17 aa, Mycobacterium bovis
GQIGFGSLNSGSGNIGL

SEQ ID NO: 200240 - protein, 17 aa, Mycobacterium bovis
GQINLGFGNTGSGNIGN

SEQ ID NO: 200241 - protein, 17 aa, Mycobacterium bovis
GQLAEFADFLINVPSRD

SEQ ID NO: 200242 - protein, 18 aa, Mycobacterium bovis
GQLCLPLYGALVTNCGLD

SEQ ID NO: 200243 - protein, 23 aa, Mycobacterium bovis
GQLLPRRAAQKFADFANARTAAN

SEQ ID NO: 200244 - protein, 22 aa, Mycobacterium bovis
GQLRIGMAASFVRCEDPTLLAQ

SEQ ID NO: 200245 - protein, 19 aa, Mycobacterium bovis
GQLSKWSRMDAELIAEHAE

SEQ ID NO: 200246 - protein, 17 aa, Mycobacterium bovis
GQLSTGWFNSATTSTGW

SEQ ID NO: 200247 - protein, 21 aa, Mycobacterium bovis
GQLTRSGLLPGDRVALRMGSN

SEQ ID NO: 200248 - protein, 22 aa, Mycobacterium bovis
GQLTRWTRFSAQPVATMDPTRR

SEQ ID NO: 200249 - protein, 23 aa, Mycobacterium bovis
GQPRLRPPFPAVAGLYGCPTVIN

SEQ ID NO: 200250 - protein, 24 aa, Mycobacterium bovis
GQPRVNPLYFLRDGGRVIVAASKG

SEQ ID NO: 200251 - protein, 19 aa, Mycobacterium bovis
GQPVKGRLTVPPSAPTTKP

SEQ ID NO: 200252 - protein, 22 aa, Mycobacterium bovis
GQQQLLCLARTLAVNPEVLLLD

SEQ ID NO: 200253 - protein, 23 aa, Mycobacterium bovis
GQRALRLPFSRLLATLPISATPD

SEQ ID NO: 200254 - protein, 21 aa, Mycobacterium bovis
GQRLLYPIHERRWRGKWHGQC

SEQ ID NO: 200255 - protein, 24 aa, Mycobacterium bovis
GQRPGEFVFVLGYLGHVRAIVGNC

SEQ ID NO: 200256 - protein, 17 aa, Mycobacterium bovis
GQRPSWAPLPVQYADYS

SEQ ID NO: 200257 - protein, 22 aa, Mycobacterium bovis
GQRRFWFMWDDLVRGAIGAIVL

SEQ ID NO: 200258 - protein, 17 aa, Mycobacterium bovis
GQSIPAIAAELYVAPST

SEQ ID NO: 200259 - protein, 17 aa, Mycobacterium bovis
GQSRGAGGFGGVGQAGG

SEQ ID NO: 200260 - protein, 25 aa, Mycobacterium bovis
GQSYFATGMAQFFASIAQQLTFGPG

SEQ ID NO: 200261 - protein, 19 aa, Mycobacterium bovis
GQTQFAAPVWMPRAKRTSI

SEQ ID NO: 200262 - protein, 18 aa, Mycobacterium bovis
GQVFTTGVPVQWSAVFAG

SEQ ID NO: 200263 - protein, 28 aa, Mycobacterium bovis
GQVLKEIRSRLGFLLDVGLEYLSLSRAA

SEQ ID NO: 200264 - protein, 19 aa, Mycobacterium bovis
GQYAAGWQGGEKVVGLLDE

SEQ ID NO: 200265 - protein, 19 aa, Mycobacterium bovis
GRAAGALLFTCNGRGRRMF

SEQ ID NO: 200266 - protein, 20 aa, Mycobacterium bovis
GRAAVPVLVHPAPRGVLGGL

SEQ ID NO: 200267 - protein, 18 aa, Mycobacterium bovis
GRADGVCAGIAFRNPQSL

SEQ ID NO: 200268 - protein, 19 aa, Mycobacterium bovis
GRADTYFDFGGVHAAFADP

SEQ ID NO: 200269 - protein, 18 aa, Mycobacterium bovis
GRADVAVCELVLMELYQL

SEQ ID NO: 200270 - protein, 19 aa, Mycobacterium bovis
GRAGGLADVRAWVGELDAA

SEQ ID NO: 200271 - protein, 25 aa, Mycobacterium bovis
GRAKIKALAVREGPAALPWGDLGVD

SEQ ID NO: 200272 - protein, 24 aa, Mycobacterium bovis
GRAKIVKFSGCYHGHVDALLADAG

SEQ ID NO: 200273 - protein, 24 aa, Mycobacterium bovis
GRALGCPQPLIAVASAATRWVWVS

SEQ ID NO: 200274 - protein, 18 aa, Mycobacterium bovis
GRANRFGWRAYLGDADAR

SEQ ID NO: 200275 - protein, 23 aa, Mycobacterium bovis
GRAPKPGELFTFPDHAATLEKIA

SEQ ID NO: 200276 - protein, 21 aa, Mycobacterium bovis
GRAPLDLAVFRAWKLHDELGL

SEQ ID NO: 200277 - protein, 25 aa, Mycobacterium bovis
GRAYDPRFLFAWPSAKSAVMGGAQL

SEQ ID NO: 200278 - protein, 25 aa, Mycobacterium bovis
GRAYLDFGEPLPLRKRLQEMRADKS

SEQ ID NO: 200279 - protein, 32 aa, Mycobacterium bovis
GRAYSPRFLWMWPNARISVMGGEQAASVLATV

SEQ ID NO: 200280 - protein, 22 aa, Mycobacterium bovis
GRCKRARVALPGGDAIGSRPLD

SEQ ID NO: 200281 - protein, 20 aa, Mycobacterium bovis
GRDDLALRIAVQPGGCAGLR

SEQ ID NO: 200282 - protein, 21 aa, Mycobacterium bovis
GRDLAPGMLHRHSAHNEAVAR

SEQ ID NO: 200283 - protein, 25 aa, Mycobacterium bovis
GRELFVDKVWDWKRESGGAIGGQMR

SEQ ID NO: 200284 - protein, 22 aa, Mycobacterium bovis
GRELKKLVPITTFLRRSPYLAA

SEQ ID NO: 200285 - protein, 17 aa, Mycobacterium bovis
GRFASIYDRVHAWASVP

SEQ ID NO: 200286 - protein, 25 aa, Mycobacterium bovis
GRFLPDRWVYEFGRRRNIAIQRKLY

SEQ ID NO: 200287 - protein, 24 aa, Mycobacterium bovis
GRFPYRNDGALGWVGTSPVGRFPA

SEQ ID NO: 200288 - protein, 20 aa, Mycobacterium bovis
GRGAGPLKDYVYIDVRHLGE

SEQ ID NO: 200289 - protein, 21 aa, Mycobacterium bovis
GRGDEALQWFLRSAAADIDGV

SEQ ID NO: 200290 - protein, 20 aa, Mycobacterium bovis
GRGEGFCAGFDLSAYAEGSS

SEQ ID NO: 200291 - protein, 20 aa, Mycobacterium bovis
GRGFDRCVAVFLNGEAITAP

SEQ ID NO: 200292 - protein, 19 aa, Mycobacterium bovis
GRGGFPGMHLGSVSRAVVN

SEQ ID NO: 200293 - protein, 20 aa, Mycobacterium bovis
GRGGFSGMLLGSVSSAVAHS

SEQ ID NO: 200294 - protein, 29 aa, Mycobacterium bovis
GRGGLRARVLRRWSVPPVRPPVTVVQALP

SEQ ID NO: 200295 - protein, 26 aa, Mycobacterium bovis
GRGGNGGHGGLWIGNGGDGGAGGVGG

SEQ ID NO: 200296 - protein, 17 aa, Mycobacterium bovis
GRGGPRCMSCPAARDPL

SEQ ID NO: 200297 - protein, 18 aa, Mycobacterium bovis
GRGNPGLNEVGWRQVGAA

SEQ ID NO: 200298 - protein, 24 aa, Mycobacterium bovis
GRGRPGRPPLMFRAVRRTDSTGTR

SEQ ID NO: 200299 - protein, 18 aa, Mycobacterium bovis
GRGTDVWADLHPTADQQV

SEQ ID NO: 200300 - protein, 19 aa, Mycobacterium bovis
GRHDAELIAAVWGADLRIE

SEQ ID NO: 200301 - protein, 20 aa, Mycobacterium bovis
GRIHKLLRIFANPKLPTIGD

SEQ ID NO: 200302 - protein, 22 aa, Mycobacterium bovis
GRIKDLVVRGGENISPREIEEL

SEQ ID NO: 200303 - protein, 22 aa, Mycobacterium bovis
GRILGVKGRVLPMCPVALQIEA

SEQ ID NO: 200304 - protein, 22 aa, Mycobacterium bovis
GRILRVRGRGVPKRSGGSGDLL

SEQ ID NO: 200305 - protein, 21 aa, Mycobacterium bovis
GRKAFARFAGYSSAMHAIAGF

SEQ ID NO: 200306 - protein, 25 aa, Mycobacterium bovis
GRKEVFRLRLASGREVEATGSHPFM

SEQ ID NO: 200307 - protein, 26 aa, Mycobacterium bovis
GRKPAALRFIRSCSAPLTAQAALALQ

SEQ ID NO: 200308 - protein, 18 aa, Mycobacterium bovis
GRKPLRFTSFGDQSTPAL

SEQ ID NO: 200309 - protein, 21 aa, Mycobacterium bovis
GRKRPGSGPLMIGSIKPNIGH

SEQ ID NO: 200310 - protein, 18 aa, Mycobacterium bovis
GRKVLAREVDIRDDAELR

SEQ ID NO: 200311 - protein, 21 aa, Mycobacterium bovis
GRKVLGEGWGDVLVGAVGRGE

SEQ ID NO: 200312 - protein, 19 aa, Mycobacterium bovis
GRLAAQVGAYHLMRTQGGR

SEQ ID NO: 200313 - protein, 18 aa, Mycobacterium bovis
GRLAARGFAAYGTAKAAL

SEQ ID NO: 200314 - protein, 23 aa, Mycobacterium bovis
GRLAEIKSAPAFFDAENMAVTQY

SEQ ID NO: 200315 - protein, 21 aa, Mycobacterium bovis
GRLAVRPGRCVVVSAHSAGVT

SEQ ID NO: 200316 - protein, 29 aa, Mycobacterium bovis
GRLFAEGVAVDWSSVFAGLGGRRVELPTY

SEQ ID NO: 200317 - protein, 30 aa, Mycobacterium bovis
GRLGAWAGPPPQWWAQRFGIEPDLAEALVC

SEQ ID NO: 200318 - protein, 21 aa, Mycobacterium bovis
GRLILADAIVRACEDKPDYLI

SEQ ID NO: 200319 - protein, 17 aa, Mycobacterium bovis
GRLLGSVSSGLLRHAHC

SEQ ID NO: 200320 - protein, 17 aa, Mycobacterium bovis
GRLLVAAAISFIEDVAR

SEQ ID NO: 200321 - protein, 19 aa, Mycobacterium bovis
GRLPDPLPCEAYCHSLTDP

SEQ ID NO: 200322 - protein, 18 aa, Mycobacterium bovis
GRLPRPLTLDSFADLPTA

SEQ ID NO: 200323 - protein, 24 aa, Mycobacterium bovis
GRLSDDELFFFAVLLLVAGYESTA

SEQ ID NO: 200324 - protein, 17 aa, Mycobacterium bovis
GRLTFGIVYTYARPNWW

SEQ ID NO: 200325 - protein, 18 aa, Mycobacterium bovis
GRMVEMANHTTGWVRMDF

SEQ ID NO: 200326 - protein, 20 aa, Mycobacterium bovis
GRNDIRIEAALAKLWSSEMA

SEQ ID NO: 200327 - protein, 19 aa, Mycobacterium bovis
GRNPFWDRLSRAMYRLARP

SEQ ID NO: 200328 - protein, 19 aa, Mycobacterium bovis
GRNQLRVAMFPAVEPDDVS

SEQ ID NO: 200329 - protein, 19 aa, Mycobacterium bovis
GRPASWEQRALHVTSLRDP

SEQ ID NO: 200330 - protein, 20 aa, Mycobacterium bovis
GRPDVLTAWMDAAVIDENDP

SEQ ID NO: 200331 - protein, 23 aa, Mycobacterium bovis
GRPGRGCPGRRDRDLGGLRRGFR

SEQ ID NO: 200332 - protein, 20 aa, Mycobacterium bovis
GRPNPLAQWSSSWTTVPSCG

SEQ ID NO: 200333 - protein, 19 aa, Mycobacterium bovis
GRPPRAIPDPTPRSSHGPA

SEQ ID NO: 200334 - protein, 18 aa, Mycobacterium bovis
GRQGCGKTTALVAIGEAV

SEQ ID NO: 200335 - protein, 23 aa, Mycobacterium bovis
GRQRCIQEFSWAYIAEQTLDIYR

SEQ ID NO: 200336 - protein, 20 aa, Mycobacterium bovis
GRQRWCVRLVQGGGFAGPLF

SEQ ID NO: 200337 - protein, 25 aa, Mycobacterium bovis
GRRDLFRPAVFRSLWGRVEDAISAG

SEQ ID NO: 200338 - protein, 24 aa, Mycobacterium bovis
GRRGEPGPPFFAAYGEWMATPPPT

SEQ ID NO: 200339 - protein, 23 aa, Mycobacterium bovis
GRRLSGTVTPVFGGRTVSVTYSK

SEQ ID NO: 200340 - protein, 24 aa, Mycobacterium bovis
GRRPRPTRELSWVRGAPADAGSFG

SEQ ID NO: 200341 - protein, 17 aa, Mycobacterium bovis
GRRRALLTGTVAVVGLG

SEQ ID NO: 200342 - protein, 25 aa, Mycobacterium bovis
GRRRRCGWFDAVIARYAARVNGITD

SEQ ID NO: 200343 - protein, 24 aa, Mycobacterium bovis
GRRRVAMLRDWLDAELAEPSVTVL

SEQ ID NO: 200344 - protein, 24 aa, Mycobacterium bovis
GRRVGFPRFKSGRRDPGRVRFTTG

SEQ ID NO: 200345 - protein, 17 aa, Mycobacterium bovis
GRRVHRLAVSHAFHSAL

SEQ ID NO: 200346 - protein, 32 aa, Mycobacterium bovis
GRRVQLEIFTKFNIPINIARVFHRDQKFRFHR

SEQ ID NO: 200347 - protein, 21 aa, Mycobacterium bovis
GRRYLDMFTFVASSALGMNPP

SEQ ID NO: 200348 - protein, 19 aa, Mycobacterium bovis
GRSEFAYGSFVRTVSLPVG

SEQ ID NO: 200349 - protein, 29 aa, Mycobacterium bovis
GRSGEPFPYPVTVGYMYIMKLHHLVDDKI

SEQ ID NO: 200350 - protein, 18 aa, Mycobacterium bovis
GRSGGKRVLVRDISEYTA

SEQ ID NO: 200351 - protein, 20 aa, Mycobacterium bovis
GRSGRARWVVGTAPGRAIPF

SEQ ID NO: 200352 - protein, 26 aa, Mycobacterium bovis
GRSLALEHPEIWGGIIDLDDSMPAEL

SEQ ID NO: 200353 - protein, 20 aa, Mycobacterium bovis
GRSPRLWLVTGGGLSVADDE

SEQ ID NO: 200354 - protein, 18 aa, Mycobacterium bovis
GRSPSAWTPEYFGGNAVP

SEQ ID NO: 200355 - protein, 19 aa, Mycobacterium bovis
GRSRVLAITVRRNGTRIDA

SEQ ID NO: 200356 - protein, 28 aa, Mycobacterium bovis
GRSVLRPDVDLRRTVGWFTTYYPVPLAC

SEQ ID NO: 200357 - protein, 23 aa, Mycobacterium bovis
GRTLTFPGFLKAYVETVDELVGG

SEQ ID NO: 200358 - protein, 19 aa, Mycobacterium bovis
GRVADGWQAPGVHLMARCS

SEQ ID NO: 200359 - protein, 27 aa, Mycobacterium bovis
GRVDRRGRLLWSLPKGHIELGETAEQT

SEQ ID NO: 200360 - protein, 27 aa, Mycobacterium bovis
GRVERMHRACLILTFGGGTNEVQRDII

SEQ ID NO: 200361 - protein, 18 aa, Mycobacterium bovis
GRVITCPFIPGRVPEDLL

SEQ ID NO: 200362 - protein, 17 aa, Mycobacterium bovis
GRVLKCPQPPPQAESTG

SEQ ID NO: 200363 - protein, 19 aa, Mycobacterium bovis
GRVLPMCPVALQIEADVSG

SEQ ID NO: 200364 - protein, 17 aa, Mycobacterium bovis
GRVRGQRGWIVEKPGEP

SEQ ID NO: 200365 - protein, 19 aa, Mycobacterium bovis
GRVTYPLSTMVGRFDETAA

SEQ ID NO: 200366 - protein, 24 aa, Mycobacterium bovis
GRYDEPRKGMAVLLDALPKVVQRF

SEQ ID NO: 200367 - protein, 20 aa, Mycobacterium bovis
GRYSPFAVYLPRGDPGRLAP

SEQ ID NO: 200368 - protein, 20 aa, Mycobacterium bovis
GRYVRARPALDVVDVGYSLV

SEQ ID NO: 200369 - protein, 21 aa, Mycobacterium bovis
GSAALFAWGLNQLVFLGLRPP

SEQ ID NO: 200370 - protein, 19 aa, Mycobacterium bovis
GSAALPVPVFDKLVQLTGH

SEQ ID NO: 200371 - protein, 18 aa, Mycobacterium bovis
GSACRPLYYLEMPPALFA

SEQ ID NO: 200372 - protein, 24 aa, Mycobacterium bovis
GSADYRGGDHGVEFVKVAMQPGMP

SEQ ID NO: 200373 - protein, 20 aa, Mycobacterium bovis
GSAGLLINGCKTWISNARRS

SEQ ID NO: 200374 - protein, 22 aa, Mycobacterium bovis
GSAGRRLAAWLVDETGSQTASD

SEQ ID NO: 200375 - protein, 28 aa, Mycobacterium bovis
GSAHALGCTIKLLSICERITTDEGSQRV

SEQ ID NO: 200376 - protein, 24 aa, Mycobacterium bovis
GSAKRITAVMPFYPYARQDKKHRG

SEQ ID NO: 200377 - protein, 20 aa, Mycobacterium bovis
GSALAWLLTMAHRRAVDRVR

SEQ ID NO: 200378 - protein, 18 aa, Mycobacterium bovis
GSALLWGDGGAGGAGGVG

SEQ ID NO: 200379 - protein, 18 aa, Mycobacterium bovis
GSAMMRRAGYMYGTVLAR

SEQ ID NO: 200380 - protein, 18 aa, Mycobacterium bovis
GSAMQAVWIVAQQHGLAV

SEQ ID NO: 200381 - protein, 25 aa, Mycobacterium bovis
GSAPMCYPRADFLVGDRDILLGVLD

SEQ ID NO: 200382 - protein, 22 aa, Mycobacterium bovis
GSAPMLAAAAAWDDLASELHCA

SEQ ID NO: 200383 - protein, 26 aa, Mycobacterium bovis
GSASRARFGDVLPFLVKVLAADEPLS

SEQ ID NO: 200384 - protein, 21 aa, Mycobacterium bovis
GSCSWKIYVKDGIITWETQQT

SEQ ID NO: 200385 - protein, 20 aa, Mycobacterium bovis
GSCVPLLKQLLEAEGVEQSK

SEQ ID NO: 200386 - protein, 21 aa, Mycobacterium bovis
GSDAWDRLFAGPRPTELHPFV

SEQ ID NO: 200387 - protein, 32 aa, Mycobacterium bovis
GSDKPFSCLMLNAIPDLAFWGSSNGQFFPRWT

SEQ ID NO: 200388 - protein, 24 aa, Mycobacterium bovis
GSDRPAWATGFGRLIDHADARIAA

SEQ ID NO: 200389 - protein, 21 aa, Mycobacterium bovis
GSDSLLRMRLDLEECATGVTK

SEQ ID NO: 200390 - protein, 24 aa, Mycobacterium bovis
GSEFAFSLVYEVSFGTPGEEQKAS

SEQ ID NO: 200391 - protein, 18 aa, Mycobacterium bovis
GSELMDKWVGSSEKAVRE

SEQ ID NO: 200392 - protein, 32 aa, Mycobacterium bovis
GSGFAIAQARLGPGRIHHCMRALGAAERALAL

SEQ ID NO: 200393 - protein, 27 aa, Mycobacterium bovis
GSGGAGGHGGWLWGNGGVGGSGGAGVG

SEQ ID NO: 200394 - protein, 26 aa, Mycobacterium bovis
GSGGAGGLIGWAGAAGGTGAGGTGGQ

SEQ ID NO: 200395 - protein, 25 aa, Mycobacterium bovis
GSGGDGGNGGWLFGSGASGGNGGQG

SEQ ID NO: 200396 - protein, 26 aa, Mycobacterium bovis
GSGGGGGTGGFGFAAGGQGGVGGSAG

SEQ ID NO: 200397 - protein, 31 aa, Mycobacterium bovis
GSGGIRGPIGLGFRVPCFVISPYSRGPQMVH

SEQ ID NO: 200398 - protein, 26 aa, Mycobacterium bovis
GSGGNGGAGGWIYGHGGHGGAGGNGG

SEQ ID NO: 200399 - protein, 18 aa, Mycobacterium bovis
GSGGPVFGALDGGYQVLL

SEQ ID NO: 200400 - protein, 25 aa, Mycobacterium bovis
GSGGVGGVFGNGGFGGAGGLGAAGG

SEQ ID NO: 200401 - protein, 22 aa, Mycobacterium bovis
GSGLLVPLGVRRVRAYAPVRTA

SEQ ID NO: 200402 - protein, 19 aa, Mycobacterium bovis
GSGPAYFFLLVEALVDAGV

SEQ ID NO: 200403 - protein, 24 aa, Mycobacterium bovis
GSGPLRPAAAQVFAAVQAAAIPVV

SEQ ID NO: 200404 - protein, 19 aa, Mycobacterium bovis
GSGPMLAAASAWDGLATEL

SEQ ID NO: 200405 - protein, 17 aa, Mycobacterium bovis
GSGPVGLILTRQGVPVL

SEQ ID NO: 200406 - protein, 20 aa, Mycobacterium bovis
GSGRPGFYRPPGRPEVIAKL

SEQ ID NO: 200407 - protein, 25 aa, Mycobacterium bovis
GSGRPPGPCPIPLSAGDDGPGRGIG

SEQ ID NO: 200408 - protein, 24 aa, Mycobacterium bovis
GSGSSWLDKLWALLDPNSNFWNTI

SEQ ID NO: 200409 - protein, 23 aa, Mycobacterium bovis
GSGVNTWTAIRWTFAEDSPYVGT

SEQ ID NO: 200410 - protein, 29 aa, Mycobacterium bovis
GSGVSGFANRGILPFSVASVVSGFANIGT

SEQ ID NO: 200411 - protein, 20 aa, Mycobacterium bovis
GSIDRCGQVLFIDARELGDL

SEQ ID NO: 200412 - protein, 20 aa, Mycobacterium bovis
GSIDRLAVWNMVATVDAFLS

SEQ ID NO: 200413 - protein, 17 aa, Mycobacterium bovis
GSIGLFLEPFRLSDPFI

SEQ ID NO: 200414 - protein, 29 aa, Mycobacterium bovis
GSILADKALRLAIAKGIDRYTIARVAQYG

SEQ ID NO: 200415 - protein, 18 aa, Mycobacterium bovis
GSILRYTTFTPKHMGVMF

SEQ ID NO: 200416 - protein, 22 aa, Mycobacterium bovis
GSIVIRKLFWRNLPDEQPGLAP

SEQ ID NO: 200417 - protein, 20 aa, Mycobacterium bovis
GSKHPWRVLMHYEKDAKILL

SEQ ID NO: 200418 - protein, 22 aa, Mycobacterium bovis
GSLHVKMGWAFAADIPLTSITK

SEQ ID NO: 200419 - protein, 17 aa, Mycobacterium bovis
GSLRAGERVLIHAAAGG

SEQ ID NO: 200420 - protein, 19 aa, Mycobacterium bovis
GSLRARMFAANLGVTEDEA

SEQ ID NO: 200421 - protein, 19 aa, Mycobacterium bovis
GSLSIQFGASGGDGGQGGV

SEQ ID NO: 200422 - protein, 29 aa, Mycobacterium bovis
GSNMSGFFGGPPVFNLGLANRGVVNILGN

SEQ ID NO: 200423 - protein, 25 aa, Mycobacterium bovis
GSNSLPELLVFGARAGRAAADYAAR

SEQ ID NO: 200424 - protein, 24 aa, Mycobacterium bovis
GSPAAVCPHVEWALSSTLQAKANL

SEQ ID NO: 200425 - protein, 24 aa, Mycobacterium bovis
GSPDRIGARIVLPGRGSLHPGARY

SEQ ID NO: 200426 - protein, 21 aa, Mycobacterium bovis
GSPGLMIAMGPGFCSELVLLR

SEQ ID NO: 200427 - protein, 25 aa, Mycobacterium bovis
GSPLLAGDFVRWCRQVLDLLDQVRN

SEQ ID NO: 200428 - protein, 26 aa, Mycobacterium bovis
GSQALRPAMFSTFLMWVLADLFTFLP

SEQ ID NO: 200429 - protein, 20 aa, Mycobacterium bovis
GSRMRPDVVIAFMDQFGDVI

SEQ ID NO: 200430 - protein, 17 aa, Mycobacterium bovis
GSRSHFWAPVSTASADG

SEQ ID NO: 200431 - protein, 25 aa, Mycobacterium bovis
GSSCLPEGVPSNWTIFFGAEDVDET

SEQ ID NO: 200432 - protein, 26 aa, Mycobacterium bovis
GSSGTVFALDLSWGGAGGNGGAATTG

SEQ ID NO: 200433 - protein, 18 aa, Mycobacterium bovis
GSSIQLLGKEASYASLRM

SEQ ID NO: 200434 - protein, 20 aa, Mycobacterium bovis
GSSRPPRLVRLIHRGSRLAK

SEQ ID NO: 200435 - protein, 27 aa, Mycobacterium bovis
GSSSGFKVRPSFSFFAVGPDGMPGGEV

SEQ ID NO: 200436 - protein, 21 aa, Mycobacterium bovis
GSSVLDSWGPTIFAGPRASPS

SEQ ID NO: 200437 - protein, 24 aa, Mycobacterium bovis
GSTGERGLHHLIWEVVDNAVDEAM

SEQ ID NO: 200438 - protein, 27 aa, Mycobacterium bovis
GSTLSFFRLALRLRRERNEFDGDVDWL

SEQ ID NO: 200439 - protein, 25 aa, Mycobacterium bovis
GSVARLRFGPATHRKVKKWLAHGDF

SEQ ID NO: 200440 - protein, 18 aa, Mycobacterium bovis
GSVCWYAPELGPGTGTVF

SEQ ID NO: 200441 - protein, 28 aa, Mycobacterium bovis
GSVEHFNWLEGLGFQFERSYFPGKAVIQ

SEQ ID NO: 200442 - protein, 19 aa, Mycobacterium bovis
GSVEYLVDAVFNYPTFSEA

SEQ ID NO: 200443 - protein, 17 aa, Mycobacterium bovis
GSVFAAAGHELYLVGGS

SEQ ID NO: 200444 - protein, 19 aa, Mycobacterium bovis
GSVTAGLVGGSWQGRSSVA

SEQ ID NO: 200445 - protein, 19 aa, Mycobacterium bovis
GSVTRRPIHLMGLDKTFRL

SEQ ID NO: 200446 - protein, 18 aa, Mycobacterium bovis
GSWFPRYARNLGTPEPIL

SEQ ID NO: 200447 - protein, 21 aa, Mycobacterium bovis
GSWGGFPLRDRVAAAVPGVPV

SEQ ID NO: 200448 - protein, 29 aa, Mycobacterium bovis
GTAAAYWLGRHGYSVTMVERHPGLRPGGQ

SEQ ID NO: 200449 - protein, 23 aa, Mycobacterium bovis
GTAFPRLYGVQTRFFDDFFNCAD

SEQ ID NO: 200450 - protein, 25 aa, Mycobacterium bovis
GTAGCNLACKFCQNWDISKSREIDV

SEQ ID NO: 200451 - protein, 19 aa, Mycobacterium bovis
GTALHPRFGPDSSARHRRS

SEQ ID NO: 200452 - protein, 24 aa, Mycobacterium bovis
GTALPRRHKLVLSRGPYGYHDEFA

SEQ ID NO: 200453 - protein, 24 aa, Mycobacterium bovis
GTAPMLAAAAAWDGLAEELGTAAQ

SEQ ID NO: 200454 - protein, 19 aa, Mycobacterium bovis
GTAVQFHFIARLVLVLLDE

SEQ ID NO: 200455 - protein, 17 aa, Mycobacterium bovis
GTAVRFALDYPARAGRL

SEQ ID NO: 200456 - protein, 19 aa, Mycobacterium bovis
GTCRARGLLDAVIGAAAER

SEQ ID NO: 200457 - protein, 22 aa, Mycobacterium bovis
GTEARLITAMIVREDSMTLYGF

SEQ ID NO: 200458 - protein, 32 aa, Mycobacterium bovis
GTELEFTEGIGFDKGFLSAYFVTDFDNQQAVL

SEQ ID NO: 200459 - protein, 18 aa, Mycobacterium bovis
GTELVSYRTGHRGDALLI

SEQ ID NO: 200460 - protein, 19 aa, Mycobacterium bovis
GTEMGRAPLDLAVFRAWKL

SEQ ID NO: 200461 - protein, 22 aa, Mycobacterium bovis
GTEMRAAVLYFAFAELEAQVAT

SEQ ID NO: 200462 - protein, 26 aa, Mycobacterium bovis
GTEPLRMARDLVRRGLDTVAFNIYRT

SEQ ID NO: 200463 - protein, 24 aa, Mycobacterium bovis
GTETLRAPMWLEHIRRRGWQAVAA

SEQ ID NO: 200464 - protein, 20 aa, Mycobacterium bovis
GTEVCPWLADHKVFGQPIMP

SEQ ID NO: 200465 - protein, 21 aa, Mycobacterium bovis
GTFRLIDKVFTRWDVQYTPVR

SEQ ID NO: 200466 - protein, 27 aa, Mycobacterium bovis
GTGAAGGAGGWLFGNGGNGGHGATNTA

SEQ ID NO: 200467 - protein, 25 aa, Mycobacterium bovis
GTGADGAPGGWLIGNGGAGGSGAAG

SEQ ID NO: 200468 - protein, 25 aa, Mycobacterium bovis
GTGADGAPGGWLIGNGGAGGSGAAN

SEQ ID NO: 200469 - protein, 26 aa, Mycobacterium bovis
GTGADGGAGGWLFGNGGNGGHGATGA

SEQ ID NO: 200470 - protein, 26 aa, Mycobacterium bovis
GTGAGVSGLWLLSGMRDDGVLTTIDI

SEQ ID NO: 200471 - protein, 25 aa, Mycobacterium bovis
GTGANGGDAGWLIGNGGAGGSGAKG

SEQ ID NO: 200472 - protein, 26 aa, Mycobacterium bovis
GTGEAGGPGGWLLGNGGNGGSGAPGQ

SEQ ID NO: 200473 - protein, 20 aa, Mycobacterium bovis
GTGGFAGFGGTAGNGGSGGT

SEQ ID NO: 200474 - protein, 30 aa, Mycobacterium bovis
GTGGFAVAPDFIGFGAAYGGAGGLGGAATG

SEQ ID NO: 200475 - protein, 25 aa, Mycobacterium bovis
GTGGNGGNGALLIGGGGLGGAGGMG

SEQ ID NO: 200476 - protein, 17 aa, Mycobacterium bovis
GTGGVFVSDGFGVVHRK

SEQ ID NO: 200477 - protein, 23 aa, Mycobacterium bovis
GTGKSVFLKSLIGLLRPERGSII

SEQ ID NO: 200478 - protein, 26 aa, Mycobacterium bovis
GTGKTFTALKIAERIAADNGGSARIL

SEQ ID NO: 200479 - protein, 24 aa, Mycobacterium bovis
GTGQAGGDGGLLFGNGGNGGSGAP

SEQ ID NO: 200480 - protein, 25 aa, Mycobacterium bovis
GTGQAGGNGGWLWGNGGNGGSGAPG

SEQ ID NO: 200481 - protein, 26 aa, Mycobacterium bovis
GTGQPGGPGGLLWGNGGNGGSGVAGV

SEQ ID NO: 200482 - protein, 28 aa, Mycobacterium bovis
GTHRLLQTGVRWKDLGLVVVDEEQRFGV

SEQ ID NO: 200483 - protein, 24 aa, Mycobacterium bovis
GTIEMADWWAYLNGVRKTYPLSYG

SEQ ID NO: 200484 - protein, 20 aa, Mycobacterium bovis
GTIGCPSFWNPIATGGASRQ

SEQ ID NO: 200485 - protein, 19 aa, Mycobacterium bovis
GTIPYQRFRGAEIAGLTAG

SEQ ID NO: 200486 - protein, 25 aa, Mycobacterium bovis
GTKGKRYALPHARILMHQPLGGVTG

SEQ ID NO: 200487 - protein, 18 aa, Mycobacterium bovis
GTKILNFLADVTVNNPYG

SEQ ID NO: 200488 - protein, 27 aa, Mycobacterium bovis
GTLEARGKIAMLAKVRRAPALIKVESV

SEQ ID NO: 200489 - protein, 18 aa, Mycobacterium bovis
GTLLRRDLPLIAEAAQQV

SEQ ID NO: 200490 - protein, 17 aa, Mycobacterium bovis
GTLNFGFIGCRDTLPHL

SEQ ID NO: 200491 - protein, 23 aa, Mycobacterium bovis
GTLSTFFGVPLVLTYATLGAPFA

SEQ ID NO: 200492 - protein, 17 aa, Mycobacterium bovis
GTLTYQMMFELRDLGFS

SEQ ID NO: 200493 - protein, 17 aa, Mycobacterium bovis
GTMPIEVESSVARVAGA

SEQ ID NO: 200494 - protein, 47 aa, Mycobacterium bovis
GTNGFAGFGGSAGGGGWVGAVNFGPISVQGFGLFGHGGDGGNGGDVG

SEQ ID NO: 200495 - protein, 28 aa, Mycobacterium bovis
GTPEIPAIPPFFPGFPPDYVTVSGQIGP

SEQ ID NO: 200496 - protein, 18 aa, Mycobacterium bovis
GTPFRPLFTVLAAQLGSD

SEQ ID NO: 200497 - protein, 25 aa, Mycobacterium bovis
GTPHCAAVGRIAYLLGLRGPAVAVD

SEQ ID NO: 200498 - protein, 17 aa, Mycobacterium bovis
GTPITWRDIASQIHAIS

SEQ ID NO: 200499 - protein, 20 aa, Mycobacterium bovis
GTPLLNWLRQRGVDEVDVVG

SEQ ID NO: 200500 - protein, 19 aa, Mycobacterium bovis
GTPLRSRVGHSYIKALMAE

SEQ ID NO: 200501 - protein, 24 aa, Mycobacterium bovis
GTPRPRWRSAQALTSRSCNGSLDT

SEQ ID NO: 200502 - protein, 23 aa, Mycobacterium bovis
GTPRRLSVLLSDGPVVLFFYPAA

SEQ ID NO: 200503 - protein, 25 aa, Mycobacterium bovis
GTPTFSRYVEIGVDFEAHRPVVESV

SEQ ID NO: 200504 - protein, 20 aa, Mycobacterium bovis
GTQACRVLRAEGLQVSLVNS

SEQ ID NO: 200505 - protein, 19 aa, Mycobacterium bovis
GTRGAPTVRIRGFSLGGDV

SEQ ID NO: 200506 - protein, 25 aa, Mycobacterium bovis
GTSGLPAGGWTRGRAVLAVVDGDGA

SEQ ID NO: 200507 - protein, 18 aa, Mycobacterium bovis
GTSLGEGPARAWERGRFA

SEQ ID NO: 200508 - protein, 18 aa, Mycobacterium bovis
GTSTLVWRDAAQLPLALL

SEQ ID NO: 200509 - protein, 25 aa, Mycobacterium bovis
GTTKGEAECARWVAEQLAEVGYQPE

SEQ ID NO: 200510 - protein, 27 aa, Mycobacterium bovis
GTTRLLLRAVGDWLVRPGAQLQAVGSA

SEQ ID NO: 200511 - protein, 17 aa, Mycobacterium bovis
GTTSFGPKHEFRCDQSL

SEQ ID NO: 200512 - protein, 26 aa, Mycobacterium bovis
GTVALRPDAGPSWLRPLVDNVGQIPD

SEQ ID NO: 200513 - protein, 23 aa, Mycobacterium bovis
GTVAQRRLPLLIASGADVHVIAP

SEQ ID NO: 200514 - protein, 23 aa, Mycobacterium bovis
GTVDYRTAWQLQRELADARVAGG

SEQ ID NO: 200515 - protein, 18 aa, Mycobacterium bovis
GTVGEIWVQGDNVGLGYW

SEQ ID NO: 200516 - protein, 18 aa, Mycobacterium bovis
GTVIWTLPGNQTYVTTPG

SEQ ID NO: 200517 - protein, 19 aa, Mycobacterium bovis
GTVRAARLLAEIGDCRARF

SEQ ID NO: 200518 - protein, 18 aa, Mycobacterium bovis
GTVTRWLKQEGDTVELDE

SEQ ID NO: 200519 - protein, 19 aa, Mycobacterium bovis
GTYSLPLIGSWHGTDGGYL

SEQ ID NO: 200520 - protein, 26 aa, Mycobacterium bovis
GVAKQALKIAREWSVERVQWGKPVGQ

SEQ ID NO: 200521 - protein, 18 aa, Mycobacterium bovis
GVALSLVYREGRLTRAST

SEQ ID NO: 200522 - protein, 17 aa, Mycobacterium bovis
GVAQRLAATVADAVSTA

SEQ ID NO: 200523 - protein, 24 aa, Mycobacterium bovis
GVASVAFLPWPLRAVAGPFNLFAT

SEQ ID NO: 200524 - protein, 25 aa, Mycobacterium bovis
GVAWVIAYRWFRAGLLPVPAQRVGR

SEQ ID NO: 200525 - protein, 23 aa, Mycobacterium bovis
GVDEARALYEWNHAKQILRIQAG

SEQ ID NO: 200526 - protein, 20 aa, Mycobacterium bovis
GVDQVRYFLLREVPFGQDGS

SEQ ID NO: 200527 - protein, 25 aa, Mycobacterium bovis
GVDRMQFCSEFEWIAPSGRGLLTHY

SEQ ID NO: 200528 - protein, 17 aa, Mycobacterium bovis
GVEGALVTLDWLGAHGF

SEQ ID NO: 200529 - protein, 25 aa, Mycobacterium bovis
GVFGDAVALLPSWETLPHERLSPGV

SEQ ID NO: 200530 - protein, 19 aa, Mycobacterium bovis
GVFTDRHALALGPSKALLD

SEQ ID NO: 200531 - protein, 27 aa, Mycobacterium bovis
GVGGAGGAGWLVGNGGAGGFGGVGTTV

SEQ ID NO: 200532 - protein, 20 aa, Mycobacterium bovis
GVGGHGGTAILFGDGGAGGA

SEQ ID NO: 200533 - protein, 20 aa, Mycobacterium bovis
GVGPGDVVGIMLRNSPSTVL

SEQ ID NO: 200534 - protein, 23 aa, Mycobacterium bovis
GVGRAKTGYFLELEDPVKISLMR

SEQ ID NO: 200535 - protein, 24 aa, Mycobacterium bovis
GVGRPQFSAVLECASAARQLGGHI

SEQ ID NO: 200536 - protein, 19 aa, Mycobacterium bovis
GVGSAENFSVVEALADSLG

SEQ ID NO: 200537 - protein, 24 aa, Mycobacterium bovis
GVHLGYKCSIRKPWWSTPSLWMPD

SEQ ID NO: 200538 - protein, 17 aa, Mycobacterium bovis
GVHRVQRVPVTESQGRV

SEQ ID NO: 200539 - protein, 18 aa, Mycobacterium bovis
GVHTLPMLYALRESGPDC

SEQ ID NO: 200540 - protein, 25 aa, Mycobacterium bovis
GVIANGSFAPSFVGFGGNGGNGVNG

SEQ ID NO: 200541 - protein, 17 aa, Mycobacterium bovis
GVISAPLTPPVKASAYR

SEQ ID NO: 200542 - protein, 17 aa, Mycobacterium bovis
GVKAAGVVMEFANEFGL

SEQ ID NO: 200543 - protein, 38 aa, Mycobacterium bovis
GVLERGLLLRLRFELDHHINLRPARLYPGVASPLSGNP

SEQ ID NO: 200544 - protein, 25 aa, Mycobacterium bovis
GVLLRRLEPNWSITLIERLDAVAAE

SEQ ID NO: 200545 - protein, 17 aa, Mycobacterium bovis
GVLPTPAVAYLTGAYDA

SEQ ID NO: 200546 - protein, 19 aa, Mycobacterium bovis
GVLRRAGVVAARRDGNAMI

SEQ ID NO: 200547 - protein, 23 aa, Mycobacterium bovis
GVLVRGRHVAVSAVTLLPGATIT

SEQ ID NO: 200548 - protein, 18 aa, Mycobacterium bovis
GVMNECWVRHLGTESGVG

SEQ ID NO: 200549 - protein, 25 aa, Mycobacterium bovis
GVNDFPKYPLNVFATANAIAGILFL

SEQ ID NO: 200550 - protein, 19 aa, Mycobacterium bovis
GVPDLRRLFPTGFDEQRRA

SEQ ID NO: 200551 - protein, 19 aa, Mycobacterium bovis
GVPGLRHVAGRLVMVDLDA

SEQ ID NO: 200552 - protein, 24 aa, Mycobacterium bovis
GVPGRSVSRWGGFLDDVAGFDAEF

SEQ ID NO: 200553 - protein, 27 aa, Mycobacterium bovis
GVPISRIPLTINIRIPVNITLNELPFN

SEQ ID NO: 200554 - protein, 25 aa, Mycobacterium bovis
GVPIWGDVELAWRLDAAGCYGPPRS

SEQ ID NO: 200555 - protein, 18 aa, Mycobacterium bovis
GVPLIEIVTKPIVGAGAR

SEQ ID NO: 200556 - protein, 29 aa, Mycobacterium bovis
GVPPPRWSISVPVLYALGALGSLRARLTG

SEQ ID NO: 200557 - protein, 19 aa, Mycobacterium bovis
GVPPTRLRLIYLADGQLLD

SEQ ID NO: 200558 - protein, 19 aa, Mycobacterium bovis
GVPTPGLGRISGVRLQING

SEQ ID NO: 200559 - protein, 21 aa, Mycobacterium bovis
GVQVWDCAAGALIAAEAGARV

SEQ ID NO: 200560 - protein, 23 aa, Mycobacterium bovis
GVRDELKLSLAAVTVLRERYLLH

SEQ ID NO: 200561 - protein, 25 aa, Mycobacterium bovis
GVREFKRLAKATGIDEPRLGLILEI

SEQ ID NO: 200562 - protein, 21 aa, Mycobacterium bovis
GVREIFEFATVTALAGHIDTL

SEQ ID NO: 200563 - protein, 23 aa, Mycobacterium bovis
GVRRRLGVDLAEVAGLRPEIAAA

SEQ ID NO: 200564 - protein, 17 aa, Mycobacterium bovis
GVRRVRAYAPVRTARYC

SEQ ID NO: 200565 - protein, 23 aa, Mycobacterium bovis
GVRVICRRSKLMATIAGSAAMAS

SEQ ID NO: 200566 - protein, 19 aa, Mycobacterium bovis
GVSARFAIAAAETVAAAAR

SEQ ID NO: 200567 - protein, 25 aa, Mycobacterium bovis
GVSFWASLFPAVWSFCLALRSRGLG

SEQ ID NO: 200568 - protein, 25 aa, Mycobacterium bovis
GVSQRKAAVVARDLLEKVGMADRER

SEQ ID NO: 200569 - protein, 18 aa, Mycobacterium bovis
GVTDWLVETGIGYDVSGM

SEQ ID NO: 200570 - protein, 18 aa, Mycobacterium bovis
GVTFRPVALESLSHFPVT

SEQ ID NO: 200571 - protein, 24 aa, Mycobacterium bovis
GVTGWPATVSHDFDAELPAADAVL

SEQ ID NO: 200572 - protein, 21 aa, Mycobacterium bovis
GVTLMEFHLMYAALVGGHAPL

SEQ ID NO: 200573 - protein, 19 aa, Mycobacterium bovis
GVTPVEHGLVLPSGPLIHG

SEQ ID NO: 200574 - protein, 28 aa, Mycobacterium bovis
GVTSCLGCADLHRSDRDAAWPAIAAQLR

SEQ ID NO: 200575 - protein, 17 aa, Mycobacterium bovis
GVVARAVSRLVTIATGL

SEQ ID NO: 200576 - protein, 21 aa, Mycobacterium bovis
GVVLGNTWFWPADTLAMKAFS

SEQ ID NO: 200577 - protein, 23 aa, Mycobacterium bovis
GVVREFSIDPALRDDFARAAAAH

SEQ ID NO: 200578 - protein, 26 aa, Mycobacterium bovis
GVVVSGRWPFCSGINHADIMFAGCFV

SEQ ID NO: 200579 - protein, 23 aa, Mycobacterium bovis
GVVWGIDSFDQWGVELGKTQAKA

SEQ ID NO: 200580 - protein, 20 aa, Mycobacterium bovis
GVWLRPFRNLVYAMPPYICT

SEQ ID NO: 200581 - protein, 18 aa, Mycobacterium bovis
GVWYCADAPFGGYKQSGI

SEQ ID NO: 200582 - protein, 18 aa, Mycobacterium bovis
GVYPGLDGAAPVIGGECV

SEQ ID NO: 200583 - protein, 18 aa, Mycobacterium bovis
GWAALGWDTLGNKLLIFQ

SEQ ID NO: 200584 - protein, 24 aa, Mycobacterium bovis
GWADPETGSAFGYVHNRLLTLLLF

SEQ ID NO: 200585 - protein, 20 aa, Mycobacterium bovis
GWCGEAGFRSFEVIPLAGGS

SEQ ID NO: 200586 - protein, 19 aa, Mycobacterium bovis
GWCVQAFRFTLDPTAEQAH

SEQ ID NO: 200587 - protein, 19 aa, Mycobacterium bovis
GWCVQAFRFTLDPTEDQAR

SEQ ID NO: 200588 - protein, 19 aa, Mycobacterium bovis
GWCVQAFRFTLNPTQTQAA

SEQ ID NO: 200589 - protein, 19 aa, Mycobacterium bovis
GWDKPSFAKELFLGRFPLG

SEQ ID NO: 200590 - protein, 25 aa, Mycobacterium bovis
GWEDKRLGIIIAGFDRRRIPLVAEI

SEQ ID NO: 200591 - protein, 21 aa, Mycobacterium bovis
GWFWPAAAAHPSLPRGALLQI

SEQ ID NO: 200592 - protein, 18 aa, Mycobacterium bovis
GWGEFGAFVEYQSAQACA

SEQ ID NO: 200593 - protein, 18 aa, Mycobacterium bovis
GWGLPYAALMAGADLVLP

SEQ ID NO: 200594 - protein, 25 aa, Mycobacterium bovis
GWKVDAAKGVPDWAARLPDELLEAQ

SEQ ID NO: 200595 - protein, 23 aa, Mycobacterium bovis
GWLRELWGGPFMLKGVMRVDDAK

SEQ ID NO: 200596 - protein, 17 aa, Mycobacterium bovis
GWMSLAGAMGGHTVVAK

SEQ ID NO: 200597 - protein, 18 aa, Mycobacterium bovis
GWPVPAAAAAVIGPAGVL

SEQ ID NO: 200598 - protein, 20 aa, Mycobacterium bovis
GWRHLPDWPPATTERAWYLQ

SEQ ID NO: 200599 - protein, 17 aa, Mycobacterium bovis
GWRLHGRTARWIEIAAE

SEQ ID NO: 200600 - protein, 21 aa, Mycobacterium bovis
GWRVVELDVSYGPRTGGKSKV

SEQ ID NO: 200601 - protein, 25 aa, Mycobacterium bovis
GWSAYPRVLDFAAFRSIADEVGAKL

SEQ ID NO: 200602 - protein, 27 aa, Mycobacterium bovis
GWSPDSDLKGFDGFDGGSGGAGGDGGA

SEQ ID NO: 200603 - protein, 28 aa, Mycobacterium bovis
GWVQGVGFRWWTRCRALELGLTGYAANH

SEQ ID NO: 200604 - protein, 17 aa, Mycobacterium bovis
GYAEAMRRFGTDKPDLR

SEQ ID NO: 200605 - protein, 27 aa, Mycobacterium bovis
GYDESLWRLLCEQVGAAALVIPEELGG

SEQ ID NO: 200606 - protein, 18 aa, Mycobacterium bovis
GYDMVQRLTAQPKYVQAG

SEQ ID NO: 200607 - protein, 21 aa, Mycobacterium bovis
GYEIRSAAVAGNIPCITTVQG

SEQ ID NO: 200608 - protein, 18 aa, Mycobacterium bovis
GYEPMGGDALAYATYTSG

SEQ ID NO: 200609 - protein, 39 aa, Mycobacterium bovis
GYFRPDLDVDLVYRFIRDTTWVSVRWYRPGGPLTAQQVG

SEQ ID NO: 200610 - protein, 19 aa, Mycobacterium bovis
GYGADLIACVARQVIAVDY

SEQ ID NO: 200611 - protein, 32 aa, Mycobacterium bovis
GYGGDGGGGGDGFDGTMAGLGGTGGSGGTGGD

SEQ ID NO: 200612 - protein, 19 aa, Mycobacterium bovis
GYGHIGLGGTIGWADPETG

SEQ ID NO: 200613 - protein, 18 aa, Mycobacterium bovis
GYGSLGLMTSVLMTADGK

SEQ ID NO: 200614 - protein, 18 aa, Mycobacterium bovis
GYHGDTFLAMSICDPHGG

SEQ ID NO: 200615 - protein, 18 aa, Mycobacterium bovis
GYIGTALRLLERKIAQLP

SEQ ID NO: 200616 - protein, 26 aa, Mycobacterium bovis
GYIPILGAPWLADLVRRSPWGEMFAS

SEQ ID NO: 200617 - protein, 34 aa, Mycobacterium bovis
GYIPSLACGRCRAIARCRSCTGPLSLQGAGSPGA

SEQ ID NO: 200618 - protein, 24 aa, Mycobacterium bovis
GYLHCGPCGSGHFVKMVHNGIEYG

SEQ ID NO: 200619 - protein, 26 aa, Mycobacterium bovis
GYLQRMSTVLSRRLWENAGSPEVDTN

SEQ ID NO: 200620 - protein, 20 aa, Mycobacterium bovis
GYLTAKWPLGQWEFVDPEAS

SEQ ID NO: 200621 - protein, 24 aa, Mycobacterium bovis
GYPALVAPLTFLAIAGRRVQLEIF

SEQ ID NO: 200622 - protein, 22 aa, Mycobacterium bovis
GYRDTEIMRWLFTPDPSLTITR

SEQ ID NO: 200623 - protein, 17 aa, Mycobacterium bovis
GYRELREADRWPDKPGR

SEQ ID NO: 200624 - protein, 26 aa, Mycobacterium bovis
GYRLAISELTGAYWAGPAAASMVAAV

SEQ ID NO: 200625 - protein, 18 aa, Mycobacterium bovis
GYSAADCVALLREAALTA

SEQ ID NO: 200626 - protein, 24 aa, Mycobacterium bovis
GYTPRMRIGIHTGRPQRLAADWLG

SEQ ID NO: 200627 - protein, 18 aa, Mycobacterium bovis
GYTYGGRIAALADAAREN

SEQ ID NO: 200628 - protein, 24 aa, Mycobacterium bovis
GYVPGDGGGLVLLKPVQAALDDGD

SEQ ID NO: 200629 - protein, 23 aa, Mycobacterium bovis
GYYQIRGGIPYAIAKSLAAAPFA

SEQ ID NO: 200630 - protein, 26 aa, Mycobacterium bovis
HAAADRCGRLALPRRTHVSVLTGTEA

SEQ ID NO: 200631 - protein, 19 aa, Mycobacterium bovis
HAAGRLDEFAHWAKSLTQR

SEQ ID NO: 200632 - protein, 20 aa, Mycobacterium bovis
HAALPDYFVSGGRAVPIPYN

SEQ ID NO: 200633 - protein, 17 aa, Mycobacterium bovis
HAALPGMVKRGAGAVLN

SEQ ID NO: 200634 - protein, 20 aa, Mycobacterium bovis
HAARWDLARIISALGDEVAF

SEQ ID NO: 200635 - protein, 18 aa, Mycobacterium bovis
HAASHWRGLSKAGKAPKD

SEQ ID NO: 200636 - protein, 20 aa, Mycobacterium bovis
HAASRASIRRRFERIDRTFD

SEQ ID NO: 200637 - protein, 33 aa, Mycobacterium bovis
HAAVAVDAGHRWVLHCGDAFYHRGTLDGRFRVP

SEQ ID NO: 200638 - protein, 23 aa, Mycobacterium bovis
HAAVLWRYALRLTGDAAQAEDVV

SEQ ID NO: 200639 - protein, 24 aa, Mycobacterium bovis
HADFIRHRVGALLATDRDIATRVS

SEQ ID NO: 200640 - protein, 23 aa, Mycobacterium bovis
HAEAALLRLVEERHIPVLMNGMA

SEQ ID NO: 200641 - protein, 18 aa, Mycobacterium bovis
HAEACRWEHVMSEDVERR

SEQ ID NO: 200642 - protein, 19 aa, Mycobacterium bovis
HAEGAWRRDDVTALSTASL

SEQ ID NO: 200643 - protein, 23 aa, Mycobacterium bovis
HAEGDRVAAFWAQAMRLRDLLKF

SEQ ID NO: 200644 - protein, 18 aa, Mycobacterium bovis
HAEGIIITTGCPSGEVQT

SEQ ID NO: 200645 - protein, 20 aa, Mycobacterium bovis
HAEPGAWLLISTCDATDLVA

SEQ ID NO: 200646 - protein, 22 aa, Mycobacterium bovis
HAFAGSLLRDYGLLLPLEPDTR

SEQ ID NO: 200647 - protein, 23 aa, Mycobacterium bovis
HAFEELRMLSLLPSRATTLNDDE

SEQ ID NO: 200648 - protein, 22 aa, Mycobacterium bovis
HAGEGNHILGFVMGEHSVLMTD

SEQ ID NO: 200649 - protein, 22 aa, Mycobacterium bovis
HAGGAAAAYRWLAKSLVANDVD

SEQ ID NO: 200650 - protein, 25 aa, Mycobacterium bovis
HAGLSSRAEWLPAWEEGLRRASAAI

SEQ ID NO: 200651 - protein, 21 aa, Mycobacterium bovis
HAGRGSYPWLPTDNANWHMIG

SEQ ID NO: 200652 - protein, 17 aa, Mycobacterium bovis
HAIDVLGVIVSRIEDAP

SEQ ID NO: 200653 - protein, 23 aa, Mycobacterium bovis
HAIRLAAAHLKAALDTELVASFA

SEQ ID NO: 200654 - protein, 24 aa, Mycobacterium bovis
HAKAEVLKLINWELASSQSGPKDA

SEQ ID NO: 200655 - protein, 21 aa, Mycobacterium bovis
HAKGKLTARERIYALLDEDSF

SEQ ID NO: 200656 - protein, 22 aa, Mycobacterium bovis
HALAQGADWVWLADDDGHAQDA

SEQ ID NO: 200657 - protein, 22 aa, Mycobacterium bovis
HALKERYSRITVHDKGKRFNTD

SEQ ID NO: 200658 - protein, 21 aa, Mycobacterium bovis
HAMAVAIPRERTMPAVLSNLD

SEQ ID NO: 200659 - protein, 23 aa, Mycobacterium bovis
HAPDRRKVLEEAFRVLRPGGELI

SEQ ID NO: 200660 - protein, 19 aa, Mycobacterium bovis
HAPKLGGHDSWRLHIHGAK

SEQ ID NO: 200661 - protein, 28 aa, Mycobacterium bovis
HAPPERLLRCIEAVLACREALAVNVKPK

SEQ ID NO: 200662 - protein, 18 aa, Mycobacterium bovis
HARARPRGSSAAHPSPHR

SEQ ID NO: 200663 - protein, 19 aa, Mycobacterium bovis
HARFGRLPFETLFEPAISY

SEQ ID NO: 200664 - protein, 21 aa, Mycobacterium bovis
HARSRAAVVLRALERERRRRL

SEQ ID NO: 200665 - protein, 17 aa, Mycobacterium bovis
HARVRYTTIQNWSNNVY

SEQ ID NO: 200666 - protein, 27 aa, Mycobacterium bovis
HAVAVDLRNDWPTALKNAGFDPARPTA

SEQ ID NO: 200667 - protein, 19 aa, Mycobacterium bovis
HAVSYSFARGHRVQYSVIG

SEQ ID NO: 200668 - protein, 19 aa, Mycobacterium bovis
HAVVVGAGFIGCEVAASLR

SEQ ID NO: 200669 - protein, 20 aa, Mycobacterium bovis
HAWGGPPIGAMVFRDPSVMN

SEQ ID NO: 200670 - protein, 20 aa, Mycobacterium bovis
HAYRNALRYVELEYHGEVQL

SEQ ID NO: 200671 - protein, 24 aa, Mycobacterium bovis
HCFAGKDRTGFVVALVLEAVGLDR

SEQ ID NO: 200672 - protein, 22 aa, Mycobacterium bovis
HCFGCGEGGDVYAFIQKIEHVS

SEQ ID NO: 200673 - protein, 30 aa, Mycobacterium bovis
HDAHLYLRRAHGIGGFLGGSGRWLRRVTAL

SEQ ID NO: 200674 - protein, 18 aa, Mycobacterium bovis
HDALRGWASSLTTTAELG

SEQ ID NO: 200675 - protein, 19 aa, Mycobacterium bovis
HDATMWRVGDDVAHPELGH

SEQ ID NO: 200676 - protein, 25 aa, Mycobacterium bovis
HDAYQWLRARGYRPEQIVLAGDSAG

SEQ ID NO: 200677 - protein, 23 aa, Mycobacterium bovis
HDEGWLAEHMLILKLISPENKAY

SEQ ID NO: 200678 - protein, 23 aa, Mycobacterium bovis
HDETRKSFSIAGTRVVDAIKLSV

SEQ ID NO: 200679 - protein, 21 aa, Mycobacterium bovis
HDHHSRRGLLLLVGRRRRLIK

SEQ ID NO: 200680 - protein, 21 aa, Mycobacterium bovis
HDITRLMSFDRGFDSYPGIKR

SEQ ID NO: 200681 - protein, 17 aa, Mycobacterium bovis
HDLRRWTHDVHHSVDDA

SEQ ID NO: 200682 - protein, 17 aa, Mycobacterium bovis
HDMGLAFVLSAALAGAP

SEQ ID NO: 200683 - protein, 24 aa, Mycobacterium bovis
HDSAKRICKEAHYHGAGTVEYLVG

SEQ ID NO: 200684 - protein, 24 aa, Mycobacterium bovis
HDTLPRIAQAVVVAATRNYGVPDN

SEQ ID NO: 200685 - protein, 28 aa, Mycobacterium bovis
HDYFWRWDTDWFWCSRSFGAQNPRLRRW

SEQ ID NO: 200686 - protein, 23 aa, Mycobacterium bovis
HEARGHGYLAYMHDPLAAAVAMD

SEQ ID NO: 200687 - protein, 20 aa, Mycobacterium bovis
HEDLKRFFDGFPRNAHPMPV

SEQ ID NO: 200688 - protein, 24 aa, Mycobacterium bovis
HEEFPRIDPAVICLVHDGADRAVL

SEQ ID NO: 200689 - protein, 21 aa, Mycobacterium bovis
HEFWPDALSFAGVEVAGVVGH

SEQ ID NO: 200690 - protein, 24 aa, Mycobacterium bovis
HEGKPFFGSLLEFITSGPVVAAIV

SEQ ID NO: 200691 - protein, 19 aa, Mycobacterium bovis
HEGLRRWGVDAEVRDRFLG

SEQ ID NO: 200692 - protein, 22 aa, Mycobacterium bovis
HELCGAATRIGPAVWATSQHLC

SEQ ID NO: 200693 - protein, 21 aa, Mycobacterium bovis
HELIAEAFGGKGYHVSTPTEL

SEQ ID NO: 200694 - protein, 22 aa, Mycobacterium bovis
HELQRWYQPMFRGVYVSRRSVP

SEQ ID NO: 200695 - protein, 22 aa, Mycobacterium bovis
HEPRVYRRAVAYGMPGVSVDGN

SEQ ID NO: 200696 - protein, 21 aa, Mycobacterium bovis
HERAESIALPVVYVNVPEMSV

SEQ ID NO: 200697 - protein, 29 aa, Mycobacterium bovis
HERGLPMSFTFARFLKFIVTEIFPGGRLP

SEQ ID NO: 200698 - protein, 21 aa, Mycobacterium bovis
HETAFKRLLTNGGSNGESGES

SEQ ID NO: 200699 - protein, 21 aa, Mycobacterium bovis
HETGETFIFVEQWADAEALKA

SEQ ID NO: 200700 - protein, 21 aa, Mycobacterium bovis
HEWIRRSGDDTVRVGITDYAQ

SEQ ID NO: 200701 - protein, 29 aa, Mycobacterium bovis
HFDYALVCGGGDWRRAGIPARSAQFSHPL

SEQ ID NO: 200702 - protein, 19 aa, Mycobacterium bovis
HFFRSVLRWLQVGYPEGVP

SEQ ID NO: 200703 - protein, 24 aa, Mycobacterium bovis
HFGARRKAFNWGLAQVKADLDAKA

SEQ ID NO: 200704 - protein, 21 aa, Mycobacterium bovis
HFGQSGGFIWVDPKADLALVV

SEQ ID NO: 200705 - protein, 23 aa, Mycobacterium bovis
HFLPRILSGEHRWCQGFSEPEAG

SEQ ID NO: 200706 - protein, 25 aa, Mycobacterium bovis
HGAIARLKHRGVDVVEIVGGDAHDA

SEQ ID NO: 200707 - protein, 25 aa, Mycobacterium bovis
HGANLHGRYLLPHFLIHDIADVAAD

SEQ ID NO: 200708 - protein, 17 aa, Mycobacterium bovis
HGARKGLADTALRTADS

SEQ ID NO: 200709 - protein, 25 aa, Mycobacterium bovis
HGARLRPGATVSLPCAPFLHLFVAY

SEQ ID NO: 200710 - protein, 20 aa, Mycobacterium bovis
HGAVQGHDALRGWASSLTTT

SEQ ID NO: 200711 - protein, 21 aa, Mycobacterium bovis
HGEFRAIGYTSIYEDVEHVAL

SEQ ID NO: 200712 - protein, 17 aa, Mycobacterium bovis
HGERPLWAWLVLEPGDI

SEQ ID NO: 200713 - protein, 20 aa, Mycobacterium bovis
HGESGKVIGIRVFSREDEDE

SEQ ID NO: 200714 - protein, 21 aa, Mycobacterium bovis
HGFHLDIWALNYAGPRHEVSG

SEQ ID NO: 200715 - protein, 25 aa, Mycobacterium bovis
HGFSRGSLNVIARRAGVAKGSLFQY

SEQ ID NO: 200716 - protein, 20 aa, Mycobacterium bovis
HGGAALTSIQQGGAGGAGGN

SEQ ID NO: 200717 - protein, 34 aa, Mycobacterium bovis
HGGAHGGHVLFVRDGRLHYVYNFLGERQQLVSSS

SEQ ID NO: 200718 - protein, 23 aa, Mycobacterium bovis
HGGDACALGAVKTNIGHLEAAAG

SEQ ID NO: 200719 - protein, 17 aa, Mycobacterium bovis
HGGILLITHYTRILRYI

SEQ ID NO: 200720 - protein, 19 aa, Mycobacterium bovis
HGGITWRVAATSARSARSL

SEQ ID NO: 200721 - protein, 17 aa, Mycobacterium bovis
HGHAYVMQAPHDLITNL

SEQ ID NO: 200722 - protein, 18 aa, Mycobacterium bovis
HGHFSRAVITRWVQLPLA

SEQ ID NO: 200723 - protein, 18 aa, Mycobacterium bovis
HGHSAWREDGNYSPQLNS

SEQ ID NO: 200724 - protein, 23 aa, Mycobacterium bovis
HGHTEWLPPPHLDHGQPWTNTFH

SEQ ID NO: 200725 - protein, 17 aa, Mycobacterium bovis
HGIGRRTGLPGSPTRGP

SEQ ID NO: 200726 - protein, 18 aa, Mycobacterium bovis
HGIRVTWAVLNDGQMSAS

SEQ ID NO: 200727 - protein, 25 aa, Mycobacterium bovis
HGKNTVLWCGYTWQYWLTTRSVNPA

SEQ ID NO: 200728 - protein, 17 aa, Mycobacterium bovis
HGLPGLRAIFAELLGIA

SEQ ID NO: 200729 - protein, 27 aa, Mycobacterium bovis
HGLPLTLWLARFLKFIATEIFPGGQPP

SEQ ID NO: 200730 - protein, 24 aa, Mycobacterium bovis
HGLRSKVIRCLYRVSEGGAGLAAA

SEQ ID NO: 200731 - protein, 21 aa, Mycobacterium bovis
HGLSWGFDRIFAASANHSVWF

SEQ ID NO: 200732 - protein, 17 aa, Mycobacterium bovis
HGMLTDRDIVIKGLAAG

SEQ ID NO: 200733 - protein, 21 aa, Mycobacterium bovis
HGMPGVPGVPVAAGRASGVLP

SEQ ID NO: 200734 - protein, 17 aa, Mycobacterium bovis
HGMPIGNVMPGFGHVGL

SEQ ID NO: 200735 - protein, 19 aa, Mycobacterium bovis
HGMSSMFRSFVAGQLATLR

SEQ ID NO: 200736 - protein, 22 aa, Mycobacterium bovis
HGNRLRCYVVGVTRGAREPLIT

SEQ ID NO: 200737 - protein, 22 aa, Mycobacterium bovis
HGPAPRPTIPMRGGLDSGTLLE

SEQ ID NO: 200738 - protein, 20 aa, Mycobacterium bovis
HGQLPNMRAIVGFAAETGDA

SEQ ID NO: 200739 - protein, 26 aa, Mycobacterium bovis
HGRDEIWRFTPLRRLRGLHDGSARAT

SEQ ID NO: 200740 - protein, 42 aa, Mycobacterium bovis
HGRDKPALMERLYKTSWRFAPFLWQEIEEGILPALYAAATPQ

SEQ ID NO: 200741 - protein, 21 aa, Mycobacterium bovis
HGRPLLRHRVELGAGSLADDV

SEQ ID NO: 200742 - protein, 21 aa, Mycobacterium bovis
HGRRLLRIAASSAFAEHAAPG

SEQ ID NO: 200743 - protein, 19 aa, Mycobacterium bovis
HGTLFFGVPTVWSRVAADQ

SEQ ID NO: 200744 - protein, 19 aa, Mycobacterium bovis
HGTVLLAVCGLRIGTGVSE

SEQ ID NO: 200745 - protein, 20 aa, Mycobacterium bovis
HGTVLLAVRGLRMGTGTSER

SEQ ID NO: 200746 - protein, 21 aa, Mycobacterium bovis
HGVAFCMGKASSFVALCRAAG

SEQ ID NO: 200747 - protein, 18 aa, Mycobacterium bovis
HHGCTSPDGTPCRLQGKG

SEQ ID NO: 200748 - protein, 19 aa, Mycobacterium bovis
HHHELGWFARQALRLFDDL

SEQ ID NO: 200749 - protein, 22 aa, Mycobacterium bovis
HHTRLRKIISRGFTPRAVGRLH

SEQ ID NO: 200750 - protein, 25 aa, Mycobacterium bovis
HHVFKEWADRYAGRFDMGYERYREI

SEQ ID NO: 200751 - protein, 22 aa, Mycobacterium bovis
HHWPQGRLSKAYAAYSTPFWRA

SEQ ID NO: 200752 - protein, 27 aa, Mycobacterium bovis
HIAEELPLLGSCTFKAAGHVIEIRGTS

SEQ ID NO: 200753 - protein, 24 aa, Mycobacterium bovis
HIDITADLGAPVYFCDSRSPWQRA

SEQ ID NO: 200754 - protein, 19 aa, Mycobacterium bovis
HIDTAILPNGWRDRLVSWT

SEQ ID NO: 200755 - protein, 35 aa, Mycobacterium bovis
HIGHVRSGVAFDILRRWLLARGYDVAFIRNVTDIE

SEQ ID NO: 200756 - protein, 18 aa, Mycobacterium bovis
HILDGFAGTGTFITRLLQ

SEQ ID NO: 200757 - protein, 23 aa, Mycobacterium bovis
HIPRCVRPAFVKRVSIIGPESTG

SEQ ID NO: 200758 - protein, 17 aa, Mycobacterium bovis
HIPSIPLGFAAIGHIGP

SEQ ID NO: 200759 - protein, 29 aa, Mycobacterium bovis
HISTLLLTLLFRFMRPLIENGHVFLAQPP

SEQ ID NO: 200760 - protein, 18 aa, Mycobacterium bovis
HIVAPVVVGWPVGQLYAN

SEQ ID NO: 200761 - protein, 27 aa, Mycobacterium bovis
HIVIDGWSLPLFVSELLALYRAGGHVA

SEQ ID NO: 200762 - protein, 25 aa, Mycobacterium bovis
HIVRHYRPIVVVLFLSAEIAAFENA

SEQ ID NO: 200763 - protein, 19 aa, Mycobacterium bovis
HKERRLAEIAASGVTRIGG

SEQ ID NO: 200764 - protein, 28 aa, Mycobacterium bovis
HKGARLTTQVSLAGRFLVYVPGASSTGI

SEQ ID NO: 200765 - protein, 22 aa, Mycobacterium bovis
HKLPPRILAAVVEFAFGDLSRE

SEQ ID NO: 200766 - protein, 23 aa, Mycobacterium bovis
HKLVPRKEFRGVAQARLTEVGLW

SEQ ID NO: 200767 - protein, 18 aa, Mycobacterium bovis
HKTFCIPHGGGGPGVGPV

SEQ ID NO: 200768 - protein, 17 aa, Mycobacterium bovis
HLAASWQALPIVEIDDE

SEQ ID NO: 200769 - protein, 17 aa, Mycobacterium bovis
HLAATFYLLAESFDEDP

SEQ ID NO: 200770 - protein, 19 aa, Mycobacterium bovis
HLATRLSAMFRTRRFRVYT

SEQ ID NO: 200771 - protein, 18 aa, Mycobacterium bovis
HLCVDPMIVGVLFIEIHM

SEQ ID NO: 200772 - protein, 20 aa, Mycobacterium bovis
HLDLPSWDLDPVLGVSVITA

SEQ ID NO: 200773 - protein, 28 aa, Mycobacterium bovis
HLGQGRVALDWLDRVDVIGHSRSSGRFG

SEQ ID NO: 200774 - protein, 23 aa, Mycobacterium bovis
HLGSWRPGLSYRQLARELTDYIV

SEQ ID NO: 200775 - protein, 19 aa, Mycobacterium bovis
HLIDAARPFIFDTGLAPAA

SEQ ID NO: 200776 - protein, 18 aa, Mycobacterium bovis
HLNPRIPEDLAFAESRIR

SEQ ID NO: 200777 - protein, 23 aa, Mycobacterium bovis
HLPPRARDVAMVFQNYALYPNMT

SEQ ID NO: 200778 - protein, 19 aa, Mycobacterium bovis
HLQAARPGEDWTGSQQFSG

SEQ ID NO: 200779 - protein, 18 aa, Mycobacterium bovis
HLRDGHYSGAAALGNAQG

SEQ ID NO: 200780 - protein, 21 aa, Mycobacterium bovis
HLRGWTLDRLPAVDRAILRVS

SEQ ID NO: 200781 - protein, 28 aa, Mycobacterium bovis
HLRTSGPHLGGWAVVSGVLHWRHSGKFA

SEQ ID NO: 200782 - protein, 19 aa, Mycobacterium bovis
HLRVRSLAIQRLAGRCHHR

SEQ ID NO: 200783 - protein, 19 aa, Mycobacterium bovis
HLSCLRGCGLVVATYEGRQ

SEQ ID NO: 200784 - protein, 17 aa, Mycobacterium bovis
HLSRLVPQHLMRRLFFT

SEQ ID NO: 200785 - protein, 25 aa, Mycobacterium bovis
HLSSKEWPGMLAFYRNLAMALVGDH

SEQ ID NO: 200786 - protein, 19 aa, Mycobacterium bovis
HLTLVPALRDALAQVGRPD

SEQ ID NO: 200787 - protein, 20 aa, Mycobacterium bovis
HMGRRYGRRLTVMADRPNVG

SEQ ID NO: 200788 - protein, 18 aa, Mycobacterium bovis
HMLDTLRAFDAVAHELSG

SEQ ID NO: 200789 - protein, 25 aa, Mycobacterium bovis
HNGELPAVRVGRSFRVHAKAVHDML

SEQ ID NO: 200790 - protein, 18 aa, Mycobacterium bovis
HNLAALGMEADLCRADVL

SEQ ID NO: 200791 - protein, 19 aa, Mycobacterium bovis
HNLIHGFILAAAHLVPDGT

SEQ ID NO: 200792 - protein, 22 aa, Mycobacterium bovis
HNQARLPYLVYLRHPTTGGVFA

SEQ ID NO: 200793 - protein, 18 aa, Mycobacterium bovis
HNRVPALDGQRFLLTAGF

SEQ ID NO: 200794 - protein, 18 aa, Mycobacterium bovis
HNSQPWRWIAEDHTVALF

SEQ ID NO: 200795 - protein, 17 aa, Mycobacterium bovis
HNTWRFGLDRILTGVAM

SEQ ID NO: 200796 - protein, 19 aa, Mycobacterium bovis
HPAGCLVSFATQTSVQPPS

SEQ ID NO: 200797 - protein, 21 aa, Mycobacterium bovis
HPAIARRWLSSVAQRVSTAQI

SEQ ID NO: 200798 - protein, 17 aa, Mycobacterium bovis
HPAVCAAVSALSYEGRL

SEQ ID NO: 200799 - protein, 17 aa, Mycobacterium bovis
HPDRCAGVVGISVPFAG

SEQ ID NO: 200800 - protein, 21 aa, Mycobacterium bovis
HPECGCATSALYLAGEGAFPA

SEQ ID NO: 200801 - protein, 18 aa, Mycobacterium bovis
HPHWDPRHLWLVPITQAV

SEQ ID NO: 200802 - protein, 18 aa, Mycobacterium bovis
HPIKRARTTFTYVAVAVA

SEQ ID NO: 200803 - protein, 25 aa, Mycobacterium bovis
HPLAHLRAFVLIPWIAVDPTAQLTV

SEQ ID NO: 200804 - protein, 24 aa, Mycobacterium bovis
HPLGATGLAQCAELTWQLRGTAEA

SEQ ID NO: 200805 - protein, 24 aa, Mycobacterium bovis
HPMAVPAFALALMRRSLAGSNIGG

SEQ ID NO: 200806 - protein, 20 aa, Mycobacterium bovis
HPPFRWQRRYAEGFSDQVAA

SEQ ID NO: 200807 - protein, 19 aa, Mycobacterium bovis
HPPVGVVVFVGGASSRLDD

SEQ ID NO: 200808 - protein, 19 aa, Mycobacterium bovis
HPRCRGVGAGHRRHIGDCA

SEQ ID NO: 200809 - protein, 24 aa, Mycobacterium bovis
HPRPGRDAWEFALLRGALQRGMPV

SEQ ID NO: 200810 - protein, 24 aa, Mycobacterium bovis
HPRPRLFSLLHEFVHVVLHTEGLC

SEQ ID NO: 200811 - protein, 20 aa, Mycobacterium bovis
HPTFPRTRLTPICQLPTAAI

SEQ ID NO: 200812 - protein, 24 aa, Mycobacterium bovis
HPTSRFRELICSRAVDIAIGPASE

SEQ ID NO: 200813 - protein, 18 aa, Mycobacterium bovis
HPVDAIIYGTGFAIADQV

SEQ ID NO: 200814 - protein, 20 aa, Mycobacterium bovis
HQHLPDILGHSGHRAGNGVF

SEQ ID NO: 200815 - protein, 28 aa, Mycobacterium bovis
HQISRAGWSGVRWRNLTGGIVALHAGYK

SEQ ID NO: 200816 - protein, 31 aa, Mycobacterium bovis
HQPRVGKKAARRRAVELLDLVGISQPQRRSR

SEQ ID NO: 200817 - protein, 27 aa, Mycobacterium bovis
HQVVLWCMGEAHAGVVLDTLANRYGVS

SEQ ID NO: 200818 - protein, 25 aa, Mycobacterium bovis
HRADIEFPAPALIYGYGAYEICEDP

SEQ ID NO: 200819 - protein, 18 aa, Mycobacterium bovis
HRAEFCIDKLYSPDSARG

SEQ ID NO: 200820 - protein, 17 aa, Mycobacterium bovis
HRDCGSYASGGFATGTD

SEQ ID NO: 200821 - protein, 18 aa, Mycobacterium bovis
HRDRFCWFGSEYVEAALV

SEQ ID NO: 200822 - protein, 25 aa, Mycobacterium bovis
HRDWLLIELRTDWTVATTRYTAGSL

SEQ ID NO: 200823 - protein, 18 aa, Mycobacterium bovis
HREQWPVAGRMMGRLGWY

SEQ ID NO: 200824 - protein, 17 aa, Mycobacterium bovis
HRETTRIGRTLAAEVQL

SEQ ID NO: 200825 - protein, 17 aa, Mycobacterium bovis
HRGRLNVLANIVGKPYS

SEQ ID NO: 200826 - protein, 25 aa, Mycobacterium bovis
HRHLLSVLIDREWRHGVRVGVETAL

SEQ ID NO: 200827 - protein, 26 aa, Mycobacterium bovis
HRHLLSVLIDREWRHGVRVGVETALL

SEQ ID NO: 200828 - protein, 20 aa, Mycobacterium bovis
HRIHAAIHFDDLQWERRYNR

SEQ ID NO: 200829 - protein, 25 aa, Mycobacterium bovis
HRKVVVFRPLYAVGGQELGYLPGSE

SEQ ID NO: 200830 - protein, 18 aa, Mycobacterium bovis
HRLDSGTWGVMGIGMGYA

SEQ ID NO: 200831 - protein, 21 aa, Mycobacterium bovis
HRLFLQCAWHALEDAGADPAR

SEQ ID NO: 200832 - protein, 23 aa, Mycobacterium bovis
HRLSKLGEWEAMGGLIDDEMLGA

SEQ ID NO: 200833 - protein, 21 aa, Mycobacterium bovis
HRPCNSAEWTAAVAGFAGSSA

SEQ ID NO: 200834 - protein, 18 aa, Mycobacterium bovis
HRQECERLGLPVFVKPAR

SEQ ID NO: 200835 - protein, 24 aa, Mycobacterium bovis
HRQPRCLPQRIAVPVTKLKTCRLG

SEQ ID NO: 200836 - protein, 17 aa, Mycobacterium bovis
HRQSLSASASWAANGKI

SEQ ID NO: 200837 - protein, 23 aa, Mycobacterium bovis
HRRAFRDKIKWRTGSEGRINHLK

SEQ ID NO: 200838 - protein, 19 aa, Mycobacterium bovis
HRRGIRIITDLVMNHTSES

SEQ ID NO: 200839 - protein, 18 aa, Mycobacterium bovis
HRRIMSLVAIGAAVENVK

SEQ ID NO: 200840 - protein, 18 aa, Mycobacterium bovis
HRRLAITGVNEYPNLGEP

SEQ ID NO: 200841 - protein, 24 aa, Mycobacterium bovis
HRRSWRVPVTAFWQAHRDAAAVYS

SEQ ID NO: 200842 - protein, 18 aa, Mycobacterium bovis
HRSSEPGHGLALAALGLD

SEQ ID NO: 200843 - protein, 29 aa, Mycobacterium bovis
HRTVLPLEFARLAGYYLAEGHACLTNGCE

SEQ ID NO: 200844 - protein, 18 aa, Mycobacterium bovis
HRVGSIGMYRQLRDDPSQ

SEQ ID NO: 200845 - protein, 24 aa, Mycobacterium bovis
HRVPCAGLVALVMSACSLAVCREV

SEQ ID NO: 200846 - protein, 23 aa, Mycobacterium bovis
HSAACTTMRWPLHDDQLAAADQL

SEQ ID NO: 200847 - protein, 27 aa, Mycobacterium bovis
HSAIGRAFMKKVWLRDSRNPSQFTDEV

SEQ ID NO: 200848 - protein, 32 aa, Mycobacterium bovis
HSASLSFSSLSGWARLGLRERFIGLTDTVWRV

SEQ ID NO: 200849 - protein, 24 aa, Mycobacterium bovis
HSDPEFAAAAGFPRPILHGLCTYG

SEQ ID NO: 200850 - protein, 23 aa, Mycobacterium bovis
HSDVMYRSVLALLMLTGSMGRNG

SEQ ID NO: 200851 - protein, 21 aa, Mycobacterium bovis
HSEAPPFFVLHGEKDPMVPSA

SEQ ID NO: 200852 - protein, 23 aa, Mycobacterium bovis
HSFLGAPFWVGRGFGLNLSVVTD

SEQ ID NO: 200853 - protein, 30 aa, Mycobacterium bovis
HSGWWRAPLRWTLRGSLALRSHLMVRRSRR

SEQ ID NO: 200854 - protein, 25 aa, Mycobacterium bovis
HSIRLAKACAAEGAHGLLVVTPYYS

SEQ ID NO: 200855 - protein, 24 aa, Mycobacterium bovis
HSLWPVFADIPAGWRVVHGEASRA

SEQ ID NO: 200856 - protein, 23 aa, Mycobacterium bovis
HSNGLLWRGDNQGLIDLAIGVDI

SEQ ID NO: 200857 - protein, 31 aa, Mycobacterium bovis; identical to SEQ ID NO: 80871

SEQ ID NO: 200858 - protein, 24 aa, Mycobacterium bovis
HSRVLRVGVAEFRRSLDRVMPRDA

SEQ ID NO: 200859 - protein, 21 aa, Mycobacterium bovis
HSRYHTPVSLIGWSLGGIFAR

SEQ ID NO: 200860 - protein, 19 aa, Mycobacterium bovis
HSSIGRWWLFGKRDDRGLG

SEQ ID NO: 200861 - protein, 21 aa, Mycobacterium bovis
HSSVRFNTPFGGFKQSGVGRE

SEQ ID NO: 200862 - protein, 17 aa, Mycobacterium bovis
HSYWSKFSDKGYYFAGD

SEQ ID NO: 200863 - protein, 32 aa, Mycobacterium bovis
HTAKAEAEIACGRASAVIAELEALTFEHPYRE

SEQ ID NO: 200864 - protein, 26 aa, Mycobacterium bovis
HTDPRVRDGLAWCYARVQIMRYRGYR

SEQ ID NO: 200865 - protein, 20 aa, Mycobacterium bovis
HTGGALPRTRPFRVSYGTTT

SEQ ID NO: 200866 - protein, 24 aa, Mycobacterium bovis
HTGTAKFAYSWAVGPAVGRSGKAP

SEQ ID NO: 200867 - protein, 18 aa, Mycobacterium bovis
HTHELRQTVLALLAGHDL

SEQ ID NO: 200868 - protein, 17 aa, Mycobacterium bovis
HTLRADIDYGLYEAKTT

SEQ ID NO: 200869 - protein, 19 aa, Mycobacterium bovis
HTMMFQEMVNRVGADVPGL

SEQ ID NO: 200870 - protein, 17 aa, Mycobacterium bovis
HTMVLFRAGLLTEEQRD

SEQ ID NO: 200871 - protein, 24 aa, Mycobacterium bovis
HTPPPHWRPDVLLVAVGAMSRPCM

SEQ ID NO: 200872 - protein, 22 aa, Mycobacterium bovis
HTQSYVRACHLVGYQHPDLTAY

SEQ ID NO: 200873 - protein, 19 aa, Mycobacterium bovis
HTRRLGVLIDAVFNHLGPS

SEQ ID NO: 200874 - protein, 17 aa, Mycobacterium bovis
HTTAYGFALGYRHNRSN

SEQ ID NO: 200875 - protein, 26 aa, Mycobacterium bovis
HTVEMWCPVIGDGAFQRVLDVEVTSE

SEQ ID NO: 200876 - protein, 22 aa, Mycobacterium bovis
HTVRPALEIIKTVPGISTVSSI

SEQ ID NO: 200877 - protein, 17 aa, Mycobacterium bovis
HTYAFDDTVAWLAVACS

SEQ ID NO: 200878 - protein, 22 aa, Mycobacterium bovis
HVAEALTLLRCSPGIGKAKNVV

SEQ ID NO: 200879 - protein, 24 aa, Mycobacterium bovis
HVAQRLCALAGESDERVALAVAVA

SEQ ID NO: 200880 - protein, 24 aa, Mycobacterium bovis
HVATVRRFIERFAPYNLSPTAIRP

SEQ ID NO: 200881 - protein, 19 aa, Mycobacterium bovis
HVDGVPCCTHIGPDGSGHF

SEQ ID NO: 200882 - protein, 18 aa, Mycobacterium bovis
HVDLYFEAAVAGAIPVIR

SEQ ID NO: 200883 - protein, 21 aa, Mycobacterium bovis
HVDVPELLRVLDFAPTPKARL

SEQ ID NO: 200884 - protein, 19 aa, Mycobacterium bovis
HVEGFRPATLHQAYLALRA

SEQ ID NO: 200885 - protein, 17 aa, Mycobacterium bovis
HVFSTRNSANWATMPMD

SEQ ID NO: 200886 - protein, 36 aa, Mycobacterium bovis
HVGGMSPNGCWGTFVTCDARLAATLPPGLGDAQAAA

SEQ ID NO: 200887 - protein, 21 aa, Mycobacterium bovis
HVHVVPRWGGDANFITIIGGS

SEQ ID NO: 200888 - protein, 22 aa, Mycobacterium bovis
HVINISSVFGLFSAPGQAAYNS

SEQ ID NO: 200889 - protein, 22 aa, Mycobacterium bovis
HVKEVRLSTRLTESPACLITDA

SEQ ID NO: 200890 - protein, 19 aa, Mycobacterium bovis
HVLVAFGLAGAQPILLGAG

SEQ ID NO: 200891 - protein, 33 aa, Mycobacterium bovis
HVNKLRGRHVPKLRQVIGCVFQDFRLLQQKTVY

SEQ ID NO: 200892 - protein, 20 aa, Mycobacterium bovis
HVQEIGWAEHWQCDSCSASH

SEQ ID NO: 200893 - protein, 17 aa, Mycobacterium bovis
HVRHAVGGEIAMLPETM

SEQ ID NO: 200894 - protein, 18 aa, Mycobacterium bovis
HVSLSKHPYQIGVFGSGT

SEQ ID NO: 200895 - protein, 17 aa, Mycobacterium bovis
HVTRPGQYEAPLGITLR

SEQ ID NO: 200896 - protein, 20 aa, Mycobacterium bovis
HVVDVPAFRIGRVPVTNGEW

SEQ ID NO: 200897 - protein, 17 aa, Mycobacterium bovis
HVVFKPGTIEQIRSVIR

SEQ ID NO: 200898 - protein, 24 aa, Mycobacterium bovis
HVVRAVHRCLLAGRFATALGADDD

SEQ ID NO: 200899 - protein, 19 aa, Mycobacterium bovis
HVYAKLGLASRVQLVDEAA

SEQ ID NO: 200900 - protein, 18 aa, Mycobacterium bovis
HWGDAMMTDGRWDPGKDF

SEQ ID NO: 200901 - protein, 17 aa, Mycobacterium bovis
HWGVFTARVHGGDIAAV

SEQ ID NO: 200902 - protein, 22 aa, Mycobacterium bovis
HWVDELRPLTGQHPAVRDYVLH

SEQ ID NO: 200903 - protein, 23 aa, Mycobacterium bovis
HYDFRLERDGVLVSWAVPKNLPD

SEQ ID NO: 200904 - protein, 30 aa, Mycobacterium bovis
HYDKSNEFFKLWLDPSMTYSCAYFERPDMT

SEQ ID NO: 200905 - protein, 23 aa, Mycobacterium bovis
HYLESWLLPSLGLRATVFHFNPS

SEQ ID NO: 200906 - protein, 19 aa, Mycobacterium bovis
HYNPWDQRLCLVPNGDLFR

SEQ ID NO: 200907 - protein, 25 aa, Mycobacterium bovis
HYQKLTGYENLRFFASLYAGATADP

SEQ ID NO: 200908 - protein, 19 aa, Mycobacterium bovis
HYTRLAALDLCPRVRVNAI

SEQ ID NO: 200909 - protein, 28 aa, Mycobacterium bovis
IAAACTLRGWLGMWSLRVAQTRAAPHLA

SEQ ID NO: 200910 - protein, 26 aa, Mycobacterium bovis
IAAAEARYAEMWAQDAAAMYGYAGSS

SEQ ID NO: 200911 - protein, 26 aa, Mycobacterium bovis
IAAALALGAEGVWCGSVWLTTEEAET

SEQ ID NO: 200912 - protein, 26 aa, Mycobacterium bovis
IAAEFAHVFSALGVRVTLVIRGSCLL

SEQ ID NO: 200913 - protein, 25 aa, Mycobacterium bovis
IAAELPMQMICILLGVPETDRHWLF

SEQ ID NO: 200914 - protein, 25 aa, Mycobacterium bovis
IAAFSAVKPSLAWAETYPGTLSYYL

SEQ ID NO: 200915 - protein, 24 aa, Mycobacterium bovis
IAAHNKLLGSFELTGIPPAPRGIP

SEQ ID NO: 200916 - protein, 25 aa, Mycobacterium bovis
IAAHWRYKEAKGRNGVLHPHAAAEI

SEQ ID NO: 200917 - protein, 17 aa, Mycobacterium bovis
IAAIAARAADLDVLGAD

SEQ ID NO: 200918 - protein, 24 aa, Mycobacterium bovis
IAAIGPRAEQRWGVSAGDRVAVEV

SEQ ID NO: 200919 - protein, 25 aa, Mycobacterium bovis
IAAKHAQGLNVRWWSPQQVTQRRGF

SEQ ID NO: 200920 - protein, 23 aa, Mycobacterium bovis
IAALSRLGAVAVVMRPDTDLSAS

SEQ ID NO: 200921 - protein, 25 aa, Mycobacterium bovis
IAANRARLTSLVTHNVFGQNTASIA

SEQ ID NO: 200922 - protein, 18 aa, Mycobacterium bovis
IAANRVRPVIGTRLPIQQ

SEQ ID NO: 200923 - protein, 29 aa, Mycobacterium bovis
IAAQVVPWASLLQRFPGLGAGATGATGGE

SEQ ID NO: 200924 - protein, 18 aa, Mycobacterium bovis
IAASADGSVYVLASSIPL

SEQ ID NO: 200925 - protein, 23 aa, Mycobacterium bovis
IAASGRPGAVLVDIPKDVLQGQC

SEQ ID NO: 200926 - protein, 17 aa, Mycobacterium bovis
IAASSAFAEHAAPGLIE

SEQ ID NO: 200927 - protein, 25 aa, Mycobacterium bovis
IAATEARYGEMWAQDASAMYGYAAA

SEQ ID NO: 200928 - protein, 18 aa, Mycobacterium bovis
IAATMGFVVGKLAKAPDG

SEQ ID NO: 200929 - protein, 22 aa, Mycobacterium bovis
IACAVLRRPDHRDTYDAMFDLW

SEQ ID NO: 200930 - protein, 19 aa, Mycobacterium bovis
IACGIEAMSRVGLGANAGP

SEQ ID NO: 200931 - protein, 24 aa, Mycobacterium bovis
IACLDLLADMARQFGSQCIVLSVD

SEQ ID NO: 200932 - protein, 25 aa, Mycobacterium bovis
IADALIELCGLLGYDARRDTDPADT

SEQ ID NO: 200933 - protein, 23 aa, Mycobacterium bovis
IADGCMRAGCALLGGETAEHPGL

SEQ ID NO: 200934 - protein, 18 aa, Mycobacterium bovis
IADGEFLVLVGPSGCGKS

SEQ ID NO: 200935 - protein, 17 aa, Mycobacterium bovis
IADLRAAGLQVLATAVD

SEQ ID NO: 200936 - protein, 23 aa, Mycobacterium bovis
IADPRAGLPAAIRVVKQSPLLAI

SEQ ID NO: 200937 - protein, 21 aa, Mycobacterium bovis
IADRELETWLVVDMSASLDFG

SEQ ID NO: 200938 - protein, 23 aa, Mycobacterium bovis
IAEAEGLQVLGWRSVPTDDSSLG

SEQ ID NO: 200939 - protein, 18 aa, Mycobacterium bovis
IAEANVLALKAGWNYGET

SEQ ID NO: 200940 - protein, 23 aa, Mycobacterium bovis
IAEELWLRLGNTTSLAHGPFPKA

SEQ ID NO: 200941 - protein, 17 aa, Mycobacterium bovis
IAEICAALDKLAAGGGV

SEQ ID NO: 200942 - protein, 26 aa, Mycobacterium bovis
IAEVSARAGVEVTVFEPAEALITAGR

SEQ ID NO: 200943 - protein, 20 aa, Mycobacterium bovis
IAFETSWLDPFTEFRFPRIG

SEQ ID NO: 200944 - protein, 17 aa, Mycobacterium bovis
IAGELVSLYAKRQASPG

SEQ ID NO: 200945 - protein, 24 aa, Mycobacterium bovis
IAGFYASICNAVWDGNVSLAGKDE

SEQ ID NO: 200946 - protein, 18 aa, Mycobacterium bovis
IAGITYRQLDYWARTSLV

SEQ ID NO: 200947 - protein, 25 aa, Mycobacterium bovis
IAGLLRPDAGLVRLGDRVLTDTEAG

SEQ ID NO: 200948 - protein, 30 aa, Mycobacterium bovis
IAGNYSNGVLWRGDYQGLIGADIALEIPAI

SEQ ID NO: 200949 - protein, 26 aa, Mycobacterium bovis
IAGPAALFDARFQKLGLHPGGGATWM

SEQ ID NO: 200950 - protein, 17 aa, Mycobacterium bovis
IAGPGVYICDECIDLCN

SEQ ID NO: 200951 - protein, 18 aa, Mycobacterium bovis
IAGPRGVGVLAVRPELME

SEQ ID NO: 200952 - protein, 25 aa, Mycobacterium bovis
IAGQRAHFGPITIPNITVVGPTTTV

SEQ ID NO: 200953 - protein, 17 aa, Mycobacterium bovis
IAGQRWIAAGLFDPAVR

SEQ ID NO: 200954 - protein, 18 aa, Mycobacterium bovis
IAGSQVLKKAAALAQPVI

SEQ ID NO: 200955 - protein, 25 aa, Mycobacterium bovis
IAGVKLLPTLMAFKKGKLVFKQAGI

SEQ ID NO: 200956 - protein, 17 aa, Mycobacterium bovis
IAGVVLLAGAAFVELAL

SEQ ID NO: 200957 - protein, 23 aa, Mycobacterium bovis
IAGYKVPRSLWFVDEVKRSPAGK

SEQ ID NO: 200958 - protein, 18 aa, Mycobacterium bovis
IAHTLGLHGPAMTFDTAC

SEQ ID NO: 200959 - protein, 18 aa, Mycobacterium bovis
IAIARAVRGWAVTNPARW

SEQ ID NO: 200960 - protein, 17 aa, Mycobacterium bovis
IAIDLSVTTPFIPINEQ

SEQ ID NO: 200961 - protein, 21 aa, Mycobacterium bovis
IAIELACPLVYGAAVSLEPRD

SEQ ID NO: 200962 - protein, 17 aa, Mycobacterium bovis
IAIERGTHFKGFERSKY

SEQ ID NO: 200963 - protein, 25 aa, Mycobacterium bovis
IAIRAFRAAYELGVGTVAVYPYEDR

SEQ ID NO: 200964 - protein, 19 aa, Mycobacterium bovis
IAKFREVLETEYLKRPLID

SEQ ID NO: 200965 - protein, 17 aa, Mycobacterium bovis
IALAACSGMASDQPLAR

SEQ ID NO: 200966 - protein, 17 aa, Mycobacterium bovis
IALGMAAFRPGRPSRTP

SEQ ID NO: 200967 - protein, 20 aa, Mycobacterium bovis
IALRSQRYFRLLDALDALVS

SEQ ID NO: 200968 - protein, 23 aa, Mycobacterium bovis
IALSLPLGAGRLTREWLPDDPPG

SEQ ID NO: 200969 - protein, 18 aa, Mycobacterium bovis
IALTPARLLMVVITDSGR

SEQ ID NO: 200970 - protein, 19 aa, Mycobacterium bovis
IALTPRPAPTVATEHLHEL

SEQ ID NO: 200971 - protein, 20 aa, Mycobacterium bovis
IALTRPGGVVLYATCSPHLA

SEQ ID NO: 200972 - protein, 21 aa, Mycobacterium bovis
IAMNMGMDGAWGQWVNRWTAE

SEQ ID NO: 200973 - protein, 17 aa, Mycobacterium bovis
IAMTRWQALVNWSGTDP

SEQ ID NO: 200974 - protein, 28 aa, Mycobacterium bovis
IANGIDAPALWPGLPIRPVKGEVLRLRW

SEQ ID NO: 200975 - protein, 20 aa, Mycobacterium bovis
IANRLCAQILLLAAEDASKD

SEQ ID NO: 200976 - protein, 24 aa, Mycobacterium bovis
IANSDFYAVCGWDAVNEAIGRPED

SEQ ID NO: 200977 - protein, 23 aa, Mycobacterium bovis
IAPEELCALPGIQEVLGLHAVGE

SEQ ID NO: 200978 - protein, 19 aa, Mycobacterium bovis
IAPQHWRLTVGGLVDNPLT

SEQ ID NO: 200979 - protein, 19 aa, Mycobacterium bovis
IAPQWHLRMQAAVQRHVEA

SEQ ID NO: 200980 - protein, 19 aa, Mycobacterium bovis
IAPSRFHVVPVLAYSPDPG

SEQ ID NO: 200981 - protein, 23 aa, Mycobacterium bovis
IAQGIPRVHRWARGVDVQRFAPS

SEQ ID NO: 200982 - protein, 18 aa, Mycobacterium bovis
IAQLLVQRVELVELVEVS

SEQ ID NO: 200983 - protein, 18 aa, Mycobacterium bovis
IAQVHGWCVGGASDYALC

SEQ ID NO: 200984 - protein, 25 aa, Mycobacterium bovis
IAREPRGDGGFGYDPVFVPYGDDRT

SEQ ID NO: 200985 - protein, 21 aa, Mycobacterium bovis
IARPRDVHVVPELPKTRSGKI

SEQ ID NO: 200986 - protein, 24 aa, Mycobacterium bovis
IARSFAAALGLDFTRVQFTPDLLP

SEQ ID NO: 200987 - protein, 17 aa, Mycobacterium bovis
IARSRRRVRVEYRGDGG

SEQ ID NO: 200988 - protein, 22 aa, Mycobacterium bovis
IASDIPPLSWFLGNSPPPLLNS

SEQ ID NO: 200989 - protein, 26 aa, Mycobacterium bovis
IASEIYPVLCGSAFKNKGVQPMLDAV

SEQ ID NO: 200990 - protein, 17 aa, Mycobacterium bovis
IASGYLLHRHERLEQIR

SEQ ID NO: 200991 - protein, 20 aa, Mycobacterium bovis
IASLEMQRFTAMGGAAPSAS

SEQ ID NO: 200992 - protein, 18 aa, Mycobacterium bovis
IASLGRYGYGWADSDVAG

SEQ ID NO: 200993 - protein, 18 aa, Mycobacterium bovis
IASLPATAVGDGFVEGVD

SEQ ID NO: 200994 - protein, 20 aa, Mycobacterium bovis
IASPLDAVVTRWTRSTTVID

SEQ ID NO: 200995 - protein, 25 aa, Mycobacterium bovis
IATDHLMRFPGRFSEQLLPEHLHKV

SEQ ID NO: 200996 - protein, 20 aa, Mycobacterium bovis
IATFEMRYLQSLPAHLRPGL

SEQ ID NO: 200997 - protein, 20 aa, Mycobacterium bovis
IATGFGRTGALFAADHAGVS

SEQ ID NO: 200998 - protein, 24 aa, Mycobacterium bovis
IATVVDWMLLAAINALIAGDQSGA

SEQ ID NO: 200999 - protein, 21 aa, Mycobacterium bovis
IATWQRIAAALKRDPYGRTAR

SEQ ID NO: 201000 - protein, 17 aa, Mycobacterium bovis
IAVDICEQIASVPYPLS

SEQ ID NO: 201001 - protein, 23 aa, Mycobacterium bovis
IAVESRSGIAPVTIDLSAVTHLG

SEQ ID NO: 201002 - protein, 19 aa, Mycobacterium bovis
IAVGLALRGFVPVPEIQFD

SEQ ID NO: 201003 - protein, 25 aa, Mycobacterium bovis
IAVPDRHTAGWAMRELVVLHEVAHH

SEQ ID NO: 201004 - protein, 23 aa, Mycobacterium bovis
IAVTRLGVTSVRFTGGEPLLAHH

SEQ ID NO: 201005 - protein, 20 aa, Mycobacterium bovis
IAYALAGTMDFDFQTQPLGQ

SEQ ID NO: 201006 - protein, 24 aa, Mycobacterium bovis
IAYLLEILPALSYLHSIGLVYNDL

SEQ ID NO: 201007 - protein, 17 aa, Mycobacterium bovis
ICAPILGGYPAVLTSPV

SEQ ID NO: 201008 - protein, 19 aa, Mycobacterium bovis
ICDARGGSMSPAITGHYRS

SEQ ID NO: 201009 - protein, 25 aa, Mycobacterium bovis
ICEPVAVVGIGCRFPGNVTGPESFW

SEQ ID NO: 201010 - protein, 30 aa, Mycobacterium bovis
ICGLRPGQKLRIVKYLAYGWSSLRSRPALR

SEQ ID NO: 201011 - protein, 19 aa, Mycobacterium bovis
ICSTEGGFLTSWQPDEFDA

SEQ ID NO: 201012 - protein, 25 aa, Mycobacterium bovis
ICVIATEFELVMPFVERAQSKGLEV

SEQ ID NO: 201013 - protein, 18 aa, Mycobacterium bovis
ICVSYRITGDIDLARLRD

SEQ ID NO: 201014 - protein, 20 aa, Mycobacterium bovis
IDAAGLKAAYRAHREAYQRI

SEQ ID NO: 201015 - protein, 21 aa, Mycobacterium bovis
IDAITLFPGGLTFPANSLLNL

SEQ ID NO: 201016 - protein, 24 aa, Mycobacterium bovis
IDALRWLAANVPIYAVNVLLSTAT

SEQ ID NO: 201017 - protein, 23 aa, Mycobacterium bovis
IDCVQLPSRLGGVPVITPARVRG

SEQ ID NO: 201018 - protein, 18 aa, Mycobacterium bovis
IDDFAEWLQRFEASLGAL

SEQ ID NO: 201019 - protein, 26 aa, Mycobacterium bovis
IDDKWTLCQILYWRGVGTCISGDPNA

SEQ ID NO: 201020 - protein, 26 aa, Mycobacterium bovis
IDEFGFPVAPWMFGAAGREHMKKYGT

SEQ ID NO: 201021 - protein, 25 aa, Mycobacterium bovis
IDEIKPARLYARFPAGFAGMPALLD

SEQ ID NO: 201022 - protein, 23 aa, Mycobacterium bovis
IDELRYGRIPARVSGPDPVPGCL

SEQ ID NO: 201023 - protein, 17 aa, Mycobacterium bovis
IDGLSVRDVRLATVLSR

SEQ ID NO: 201024 - protein, 19 aa, Mycobacterium bovis
IDGNYHWQGTVFDSLPETS

SEQ ID NO: 201025 - protein, 22 aa, Mycobacterium bovis
IDGSCRRFGAGAGNAPVEALIG

SEQ ID NO: 201026 - protein, 18 aa, Mycobacterium bovis
IDGVGLGLLLQHKRIRRT

SEQ ID NO: 201027 - protein, 17 aa, Mycobacterium bovis
IDGVLRWADEARARLAQ

SEQ ID NO: 201028 - protein, 21 aa, Mycobacterium bovis
IDGVLVLSWRAIPGAAETVRQ

SEQ ID NO: 201029 - protein, 18 aa, Mycobacterium bovis
IDIGKNGQINLGFGNTGS

SEQ ID NO: 201030 - protein, 17 aa, Mycobacterium bovis
IDIPGMSLFDVHEIVEI

SEQ ID NO: 201031 - protein, 21 aa, Mycobacterium bovis
IDIPITGSFTDLVVDNFTIPI

SEQ ID NO: 201032 - protein, 19 aa, Mycobacterium bovis
IDLEMRRPTYVFAAVDHTG

SEQ ID NO: 201033 - protein, 21 aa, Mycobacterium bovis
IDLERRRISLSLKQANEDYTE

SEQ ID NO: 201034 - protein, 20 aa, Mycobacterium bovis
IDLEVEWPAEELIDATIVDT

SEQ ID NO: 201035 - protein, 20 aa, Mycobacterium bovis
IDLIMPIGKGQRALIVSPPK

SEQ ID NO: 201036 - protein, 24 aa, Mycobacterium bovis
IDLQTCGLVAVGHRVVHGGTEFHQ

SEQ ID NO: 201037 - protein, 25 aa, Mycobacterium bovis
IDLVRRYAPKLALIVTSHQHFDHWQ

SEQ ID NO: 201038 - protein, 31 aa, Mycobacterium bovis
IDLYLRIAPELFLKRCIVGGFDKVFELNRVF

SEQ ID NO: 201039 - protein, 19 aa, Mycobacterium bovis
IDMGLRLVELLVSREAAEA

SEQ ID NO: 201040 - protein, 25 aa, Mycobacterium bovis
IDMLRGGFELAYRLLSYPKPVVMAC

SEQ ID NO: 201041 - protein, 19 aa, Mycobacterium bovis
IDMVIDIGAALCGDIDAVR

SEQ ID NO: 201042 - protein, 24 aa, Mycobacterium bovis
IDNRLQWYIDLGIRRENLRLWEHP

SEQ ID NO: 201043 - protein, 33 aa, Mycobacterium bovis
IDPDAVELPAWYRPNPGLARDLAFIAFSSADGD

SEQ ID NO: 201044 - protein, 26 aa, Mycobacterium bovis
IDPELRRPITELGMVKSIDTGPDGSV

SEQ ID NO: 201045 - protein, 19 aa, Mycobacterium bovis
IDPETGEVRHVPPGDMPGG

SEQ ID NO: 201046 - protein, 25 aa, Mycobacterium bovis
IDPQQRLLLETSWEAMEHAGLTQQT

SEQ ID NO: 201047 - protein, 22 aa, Mycobacterium bovis
IDPRTRWLLRELVYALLVKKDH

SEQ ID NO: 201048 - protein, 24 aa, Mycobacterium bovis
IDPYLRPLYDALYDMMDPELIPKL

SEQ ID NO: 201049 - protein, 18 aa, Mycobacterium bovis
IDRATLQPGPTFVRQFRE

SEQ ID NO: 201050 - protein, 25 aa, Mycobacterium bovis
IDRDWSPKVFGSWNLHRATLGQPLD

SEQ ID NO: 201051 - protein, 17 aa, Mycobacterium bovis
IDRLRCAERAIAVARRG

SEQ ID NO: 201052 - protein, 23 aa, Mycobacterium bovis
IDRMGRRPGVRWAADLLSAADAL

SEQ ID NO: 201053 - protein, 25 aa, Mycobacterium bovis
IDRPLRPSFVDGLRNEIQIVVTILS

SEQ ID NO: 201054 - protein, 23 aa, Mycobacterium bovis
IDRRPDLPTGKALVIAEGVLVVQ

SEQ ID NO: 201055 - protein, 30 aa, Mycobacterium bovis
IDSFAPRLSFFWGIGMNFFMEVAKLRAGRL

SEQ ID NO: 201056 - protein, 17 aa, Mycobacterium bovis
IDSTRGTVHLVIGGGGT

SEQ ID NO: 201057 - protein, 18 aa, Mycobacterium bovis
IDTIYVWTHDSIGLGEDG

SEQ ID NO: 201058 - protein, 23 aa, Mycobacterium bovis
IDTKLEGGQAFTAEDQPRLLDEP

SEQ ID NO: 201059 - protein, 24 aa, Mycobacterium bovis
IDTRTARMDLVFSLAERFSEGSEP

SEQ ID NO: 201060 - protein, 21 aa, Mycobacterium bovis
IDTVLRAKVDAAWNLHQATSD

SEQ ID NO: 201061 - protein, 19 aa, Mycobacterium bovis
IDVAYRYFATPKRKFIIAD

SEQ ID NO: 201062 - protein, 25 aa, Mycobacterium bovis
IDVGSRFALTHFGLFGFAVMSCGTL

SEQ ID NO: 201063 - protein, 17 aa, Mycobacterium bovis
IDVGWSLVKTRAMFEHR

SEQ ID NO: 201064 - protein, 17 aa, Mycobacterium bovis
IDVHNVMTFGGNMITVT

SEQ ID NO: 201065 - protein, 18 aa, Mycobacterium bovis
IDVRGRRSAVSAQPGTLG

SEQ ID NO: 201066 - protein, 19 aa, Mycobacterium bovis
IDVSPEYGYELVAVSDPVG

SEQ ID NO: 201067 - protein, 30 aa, Mycobacterium bovis
IDVSSIKELCRRWYPRIYFGQPPKGLTHRA

SEQ ID NO: 201068 - protein, 17 aa, Mycobacterium bovis
IDWVVVCMHQTAISTAD

SEQ ID NO: 201069 - protein, 24 aa, Mycobacterium bovis
IDYPEPDRAAAIVRRTVPGATAPL

SEQ ID NO: 201070 - protein, 20 aa, Mycobacterium bovis
IEAAEALMLAIVGRLSAYVP

SEQ ID NO: 201071 - protein, 17 aa, Mycobacterium bovis
IEAFELVVVNLYPFSQT

SEQ ID NO: 201072 - protein, 25 aa, Mycobacterium bovis
IEAQLRFMAEQGVDLIVTSGGLGPT

SEQ ID NO: 201073 - protein, 24 aa, Mycobacterium bovis
IEARCVSMVADLFHAEGLRDHDPT

SEQ ID NO: 201074 - protein, 22 aa, Mycobacterium bovis
IECLRSIFTGARVEYSGRHVNS

SEQ ID NO: 201075 - protein, 26 aa, Mycobacterium bovis
IEDFSGSMSLSFSDPRFDDVKAPVDE

SEQ ID NO: 201076 - protein, 17 aa, Mycobacterium bovis
IEEHLRFISPIQNICRT

SEQ ID NO: 201077 - protein, 18 aa, Mycobacterium bovis
IEEIVRWTSPSPSKRRTA

SEQ ID NO: 201078 - protein, 20 aa, Mycobacterium bovis
IEEMLRWTAPVKNMCRVLTA

SEQ ID NO: 201079 - protein, 20 aa, Mycobacterium bovis
IEFGTRYGGSAVYFANIMRQ

SEQ ID NO: 201080 - protein, 19 aa, Mycobacterium bovis
IEGLPARLRKVTNRWTLRP

SEQ ID NO: 201081 - protein, 19 aa, Mycobacterium bovis
IEGPAGWGEFGAFVEYQSA

SEQ ID NO: 201082 - protein, 18 aa, Mycobacterium bovis
IEGVKRFISGGDVGNTAE

SEQ ID NO: 201083 - protein, 25 aa, Mycobacterium bovis
IEGVLGRDCLLSWCMTSNQLPGAVA

SEQ ID NO: 201084 - protein, 24 aa, Mycobacterium bovis
IEHAELPPGWVLTTSGRISGVTEP

SEQ ID NO: 201085 - protein, 25 aa, Mycobacterium bovis
IEKLDYLVDLGIDFVELMPVNSFAG

SEQ ID NO: 201086 - protein, 23 aa, Mycobacterium bovis
IEKMLACGAAYVIDREMGEYQDI

SEQ ID NO: 201087 - protein, 25 aa, Mycobacterium bovis
IELAKRLGNRFDVRAVRLDSGDLDE

SEQ ID NO: 201088 - protein, 24 aa, Mycobacterium bovis
IELALRLGATVERVAEASGVDPWF

SEQ ID NO: 201089 - protein, 25 aa, Mycobacterium bovis
IELDGLRLITWRGASRAEQGLPFAR

SEQ ID NO: 201090 - protein, 27 aa, Mycobacterium bovis
IELPHEIHRLRALIVELERLYNHAADL

SEQ ID NO: 201091 - protein, 17 aa, Mycobacterium bovis
IELRPDVDWDKGKTLLW

SEQ ID NO: 201092 - protein, 29 aa, Mycobacterium bovis
IELRVYRFGGSLHLDWWYDTRRIPAATAE

SEQ ID NO: 201093 - protein, 19 aa, Mycobacterium bovis
IELTLEMAAETGLQVDEIG

SEQ ID NO: 201094 - protein, 18 aa, Mycobacterium bovis
IEMIPIPMLQDGPDVDLI

SEQ ID NO: 201095 - protein, 22 aa, Mycobacterium bovis
IEMPASVARYVVEKGSITVDGI

SEQ ID NO: 201096 - protein, 23 aa, Mycobacterium bovis
IENPCPPTGLGSVVVARDELVVV

SEQ ID NO: 201097 - protein, 17 aa, Mycobacterium bovis
IEPCAAVGLELQRRGHD

SEQ ID NO: 201098 - protein, 23 aa, Mycobacterium bovis
IEPLEPGFGYTLGNSLRRTLLSS

SEQ ID NO: 201099 - protein, 26 aa, Mycobacterium bovis
IEQFRLLVLRTAWLIDKHHDYQKVRR

SEQ ID NO: 201100 - protein, 18 aa, Mycobacterium bovis
IEQGLKGVEFIAINTDAQ

SEQ ID NO: 201101 - protein, 24 aa, Mycobacterium bovis
IEQMPLDAGHSWRRNIALSADDVL

SEQ ID NO: 201102 - protein, 19 aa, Mycobacterium bovis
IERGLWLTALLQATLSTVR

SEQ ID NO: 201103 - protein, 28 aa, Mycobacterium bovis
IERLVRARGCAKWLASEDFSQAIDHLRQ

SEQ ID NO: 201104 - protein, 25 aa, Mycobacterium bovis
IERTWRYLKVPCVIEFWDENGGAAS

SEQ ID NO: 201105 - protein, 25 aa, Mycobacterium bovis
IESAGLRPGADVALALDAAATEFFT

SEQ ID NO: 201106 - protein, 23 aa, Mycobacterium bovis
IESIASMAAFAWLNSHGEGGSVV

SEQ ID NO: 201107 - protein, 18 aa, Mycobacterium bovis
IESWDSSGSVYARLMDIE

SEQ ID NO: 201108 - protein, 21 aa, Mycobacterium bovis
IESYAPLMAYLVRSMQSGGEL

SEQ ID NO: 201109 - protein, 26 aa, Mycobacterium bovis
IETNVEFWAAVVLDFARVPANMMPAM

SEQ ID NO: 201110 - protein, 26 aa, Mycobacterium bovis
IEVAVCSTGLIGDRLPMDKLLAGVAH

SEQ ID NO: 201111 - protein, 24 aa, Mycobacterium bovis
IEVIPDVLRHRLVLTYDALADEIS

SEQ ID NO: 201112 - protein, 33 aa, Mycobacterium bovis; identical to SEQ ID NO: 81075

SEQ ID NO: 201113 - protein, 18 aa, Mycobacterium bovis
IEYEIKDPGLAGVTITDA

SEQ ID NO: 201114 - protein, 17 aa, Mycobacterium bovis
IEYLASVVMTRDGVAYP

SEQ ID NO: 201115 - protein, 26 aa, Mycobacterium bovis
IEYPCVFDHRGQRFMLYSGDGYGRTG

SEQ ID NO: 201116 - protein, 17 aa, Mycobacterium bovis
IFAGAGLGPMLAAASAW

SEQ ID NO: 201117 - protein, 39 aa, Mycobacterium bovis
IFALYCLPLNWLRRKHGLSSLGWDLCRIFTDGDYTLYAD

SEQ ID NO: 201118 - protein, 17 aa, Mycobacterium bovis
IFDSVYDIYRGVVTYVR

SEQ ID NO: 201119 - protein, 17 aa, Mycobacterium bovis
IFGAYGRQCQVLSAQAS

SEQ ID NO: 201120 - protein, 17 aa, Mycobacterium bovis
IFGNRIEQMAGLLEPGR

SEQ ID NO: 201121 - protein, 17 aa, Mycobacterium bovis
IFHRACEAVMPGGVLAW

SEQ ID NO: 201122 - protein, 23 aa, Mycobacterium bovis
IFKDTLIMSYEWPEDRQSLSWTL

SEQ ID NO: 201123 - protein, 23 aa, Mycobacterium bovis
IFPGGLTIPAMNPLSINLSGGTG

SEQ ID NO: 201124 - protein, 24 aa, Mycobacterium bovis
IFSRADAQAGWLLHAEGILRPGSV

SEQ ID NO: 201125 - protein, 18 aa, Mycobacterium bovis
IGAARGRLLISAMAAGAA

SEQ ID NO: 201126 - protein, 19 aa, Mycobacterium bovis
IGAGDGFSAIGAVDKPVVR

SEQ ID NO: 201127 - protein, 18 aa, Mycobacterium bovis
IGAGSGWRQLDVVAQTGS

SEQ ID NO: 201128 - protein, 25 aa, Mycobacterium bovis
IGAGTFPWVLAITMPYSDAAQRGAF

SEQ ID NO: 201129 - protein, 19 aa, Mycobacterium bovis
IGAILPLLAGVADPSNFGA

SEQ ID NO: 201130 - protein, 18 aa, Mycobacterium bovis
IGALKGRLHGGANEAVMH

SEQ ID NO: 201131 - protein, 20 aa, Mycobacterium bovis
IGALNSGIGNLGFGNSGNNN

SEQ ID NO: 201132 - protein, 21 aa, Mycobacterium bovis
IGAPANVSGMFNIGSNLAGFF

SEQ ID NO: 201133 - protein, 34 aa, Mycobacterium bovis
IGAPSFVEALRWGAEVYHALKSVLKKEGLSTGLG

SEQ ID NO: 201134 - protein, 17 aa, Mycobacterium bovis
IGATMSAYATAWVGDSP

SEQ ID NO: 201135 - protein, 17 aa, Mycobacterium bovis
IGCKLHLEVPMYHHHVD

SEQ ID NO: 201136 - protein, 21 aa, Mycobacterium bovis
IGDLFGGLFGRGGSARPSRPR

SEQ ID NO: 201137 - protein, 26 aa, Mycobacterium bovis
IGDSMVEAAICDGDWVVVRQQNVADN

SEQ ID NO: 201138 - protein, 28 aa, Mycobacterium bovis
IGDTARPARAWLFTVARNMIIDERRSAR

SEQ ID NO: 201139 - protein, 34 aa, Mycobacterium bovis
IGEACRRARRRGTKVAHAHLRYLNPFPANLGEVL

SEQ ID NO: 201140 - protein, 20 aa, Mycobacterium bovis
IGEAHIKVIRALFRPPARRG

SEQ ID NO: 201141 - protein, 24 aa, Mycobacterium bovis
IGERSSHTWFVLTHLLGKADVRNY

SEQ ID NO: 201142 - protein, 20 aa, Mycobacterium bovis
IGFDAGDGFLGRLRGSDITR

SEQ ID NO: 201143 - protein, 18 aa, Mycobacterium bovis
IGFEPLQWVRALAAEDPV

SEQ ID NO: 201144 - protein, 19 aa, Mycobacterium bovis
IGFRGWLAAAEGWGLANEL

SEQ ID NO: 201145 - protein, 18 aa, Mycobacterium bovis
IGFYSSFMVADKVQLLTR

SEQ ID NO: 201146 - protein, 25 aa, Mycobacterium bovis
IGGADWVEWGGCGMVHPNVLRATGI

SEQ ID NO: 201147 - protein, 24 aa, Mycobacterium bovis
IGGAGGGGGWLHGDGGAGGHGGQG

SEQ ID NO: 201148 - protein, 20 aa, Mycobacterium bovis
IGGGFGNKVPIYPGYVCAIV

SEQ ID NO: 201149 - protein, 22 aa, Mycobacterium bovis
IGGGLRRFLDELGELPNKSLIV

SEQ ID NO: 201150 - protein, 33 aa, Mycobacterium bovis
IGGGTGGAGGHAWLFGHGGTGGIGGGPGGNGGW

SEQ ID NO: 201151 - protein, 19 aa, Mycobacterium bovis
IGGICAALGAAYGGALGVT

SEQ ID NO: 201152 - protein, 19 aa, Mycobacterium bovis
IGGLPRGRVIEIYGPESSG

SEQ ID NO: 201153 - protein, 24 aa, Mycobacterium bovis
IGGMPAPPPLAWAVNEMIYCANPS

SEQ ID NO: 201154 - protein, 25 aa, Mycobacterium bovis
IGGPVKRDAALCLAVLRVGADPEGV

SEQ ID NO: 201155 - protein, 17 aa, Mycobacterium bovis
IGGSFWPRGIYSVVNHA

SEQ ID NO: 201156 - protein, 25 aa, Mycobacterium bovis
IGGSMGRYGGVWAHDETRKSFSIAG

SEQ ID NO: 201157 - protein, 20 aa, Mycobacterium bovis
IGIADARRVLVALRAVGGHR

SEQ ID NO: 201158 - protein, 21 aa, Mycobacterium bovis
IGILPRHIPLVAQLVDDAMVR

SEQ ID NO: 201159 - protein, 18 aa, Mycobacterium bovis
IGKDIIRFHAVYWPAFLM

SEQ ID NO: 201160 - protein, 25 aa, Mycobacterium bovis
IGLDPVLRVELWDRFTALARRGTTL

SEQ ID NO: 201161 - protein, 18 aa, Mycobacterium bovis
IGLGRGYRWLQLFDAAGL

SEQ ID NO: 201162 - protein, 18 aa, Mycobacterium bovis
IGLLANMRLCPNVPAQHA

SEQ ID NO: 201163 - protein, 19 aa, Mycobacterium bovis
IGLLGKFMPNYLFAPDSTL

SEQ ID NO: 201164 - protein, 19 aa, Mycobacterium bovis
IGLLPRLEGTVHINIGLLG

SEQ ID NO: 201165 - protein, 18 aa, Mycobacterium bovis
IGMGYAIAAAVETGRPVV

SEQ ID NO: 201166 - protein, 19 aa, Mycobacterium bovis
IGNSGRFNTGIGNSGTAST

SEQ ID NO: 201167 - protein, 19 aa, Mycobacterium bovis
IGNTGNWNIGIGITGNGQI

SEQ ID NO: 201168 - protein, 18 aa, Mycobacterium bovis
IGNVMPGFGHVGLGGSIG

SEQ ID NO: 201169 - protein, 18 aa, Mycobacterium bovis
IGPTRIGTVLGILKAYTT

SEQ ID NO: 201170 - protein, 17 aa, Mycobacterium bovis
IGRACDEIRPGYRKLSA

SEQ ID NO: 201171 - protein, 18 aa, Mycobacterium bovis
IGRLLLRCHDRPGIIAAV

SEQ ID NO: 201172 - protein, 27 aa, Mycobacterium bovis
IGRMSGVPPSVWGGLAAARFQDVVDRW

SEQ ID NO: 201173 - protein, 28 aa, Mycobacterium bovis
IGRQLVEVPVGFKWFVDGLIGATLGFGG

SEQ ID NO: 201174 - protein, 17 aa, Mycobacterium bovis
IGRRLAKALGVGLLDTD

SEQ ID NO: 201175 - protein, 22 aa, Mycobacterium bovis
IGRVAPVERIRLVNSGTEATMS

SEQ ID NO: 201176 - protein, 18 aa, Mycobacterium bovis
IGSEGVFGVITRVRLRVH

SEQ ID NO: 201177 - protein, 18 aa, Mycobacterium bovis
IGSPASWTSAVEAQQQSK

SEQ ID NO: 201178 - protein, 22 aa, Mycobacterium bovis
IGSRCVVGAGALLLGDADADGV

SEQ ID NO: 201179 - protein, 20 aa, Mycobacterium bovis
IGTHRARFADLMLALIDQKV

SEQ ID NO: 201180 - protein, 17 aa, Mycobacterium bovis
IGTMIKQLLEEVRAAPL

SEQ ID NO: 201181 - protein, 18 aa, Mycobacterium bovis
IGTTCCFATQDKVWVTGP

SEQ ID NO: 201182 - protein, 17 aa, Mycobacterium bovis
IGVAPAIISLTLLPKLS

SEQ ID NO: 201183 - protein, 23 aa, Mycobacterium bovis
IGVKNYPFYFGFLKSKLRTGGLL

SEQ ID NO: 201184 - protein, 33 aa, Mycobacterium bovis
IGVLYGRRELLAQMPPFLTGGSMIETVTMEGAT

SEQ ID NO: 201185 - protein, 18 aa, Mycobacterium bovis
IGVPDWIVGGLNNVLKPL

SEQ ID NO: 201186 - protein, 17 aa, Mycobacterium bovis
IGVSRLVAVVAEQHHDE

SEQ ID NO: 201187 - protein, 17 aa, Mycobacterium bovis
IGVVGLLNVQYALKDDV

SEQ ID NO: 201188 - protein, 23 aa, Mycobacterium bovis
IGWLTDCDYEWTQHWRVASGLGV

SEQ ID NO: 201189 - protein, 23 aa, Mycobacterium bovis
IGYSCAGTVEFLLDERGEYVFIE

SEQ ID NO: 201190 - protein, 21 aa, Mycobacterium bovis
IGYTGAGTVEFLADDSPGREG

SEQ ID NO: 201191 - protein, 17 aa, Mycobacterium bovis
IHASRLAVESVFDALAG

SEQ ID NO: 201192 - protein, 22 aa, Mycobacterium bovis
IHELARGDAYWDTVVEITSIGD

SEQ ID NO: 201193 - protein, 19 aa, Mycobacterium bovis
IHETREWILRNSPVPVGTV

SEQ ID NO: 201194 - protein, 20 aa, Mycobacterium bovis
IHFEPRIHRVIGLRDHSALT

SEQ ID NO: 201195 - protein, 18 aa, Mycobacterium bovis
IHGGYGYSTEYDVERYFR

SEQ ID NO: 201196 - protein, 20 aa, Mycobacterium bovis
IHIRAGSLFVDRPLGDTRAR

SEQ ID NO: 201197 - protein, 17 aa, Mycobacterium bovis
IHLATLYHDDVMDEAQV

SEQ ID NO: 201198 - protein, 23 aa, Mycobacterium bovis
IHPVAACATAAVSVEEGVDKIRL

SEQ ID NO: 201199 - protein, 35 aa, Mycobacterium bovis
IHQARAAMIAAVLEKHARLAIAVNDIYLSTVGGMR

SEQ ID NO: 201200 - protein, 17 aa, Mycobacterium bovis
IHRAMALPGGIEGALGV

SEQ ID NO: 201201 - protein, 18 aa, Mycobacterium bovis
IHRVPAWSTNLSRKVIRR

SEQ ID NO: 201202 - protein, 23 aa, Mycobacterium bovis
IHVELPLSVTIGPFVSPEITIPQ

SEQ ID NO: 201203 - protein, 24 aa, Mycobacterium bovis
IIADHSRTAAILIGDGVSPGNDGR

SEQ ID NO: 201204 - protein, 19 aa, Mycobacterium bovis
IIAGHCVGGAPSVRSQAHM

SEQ ID NO: 201205 - protein, 18 aa, Mycobacterium bovis
IIELWPFSQGERAGIADG

SEQ ID NO: 201206 - protein, 19 aa, Mycobacterium bovis
IIENPAWYTAYTPYQPEIS

SEQ ID NO: 201207 - protein, 18 aa, Mycobacterium bovis
IIIADTKFEFGIDRHGNL

SEQ ID NO: 201208 - protein, 25 aa, Mycobacterium bovis
IIIAGAGAIGMEFGYVLKNYGVDVT

SEQ ID NO: 201209 - protein, 21 aa, Mycobacterium bovis
IINSGFGWHEARVPTIVTSVP

SEQ ID NO: 201210 - protein, 18 aa, Mycobacterium bovis
IIRELRPHVVVTYDPNGG

SEQ ID NO: 201211 - protein, 28 aa, Mycobacterium bovis
IIRFHAVYWPAFLMSAGIELPRRIFAHG

SEQ ID NO: 201212 - protein, 17 aa, Mycobacterium bovis
IISCGAVLDHLRIAMTA

SEQ ID NO: 201213 - protein, 25 aa, Mycobacterium bovis
IIYDEVHLLPAPVFRMTADLQSKRR

SEQ ID NO: 201214 - protein, 19 aa, Mycobacterium bovis
IIYRMGVTPPQAKQILSTG

SEQ ID NO: 201215 - protein, 26 aa, Mycobacterium bovis
IKAGKAGLVPAHLRDGHYSGAAALGN

SEQ ID NO: 201216 - protein, 18 aa, Mycobacterium bovis
IKAITGRIDLVHCNDSRD

SEQ ID NO: 201217 - protein, 19 aa, Mycobacterium bovis
IKAQAYRLQTFGTVTRLAA

SEQ ID NO: 201218 - protein, 24 aa, Mycobacterium bovis
IKDGRPVDFGSFLIPRSEYEIKDV

SEQ ID NO: 201219 - protein, 23 aa, Mycobacterium bovis
IKDWQIKICDTIADNASAAGFVL

SEQ ID NO: 201220 - protein, 20 aa, Mycobacterium bovis
IKELFSMSATRYYQVLNALV

SEQ ID NO: 201221 - protein, 17 aa, Mycobacterium bovis
IKELLVVDGANHYPEDI

SEQ ID NO: 201222 - protein, 21 aa, Mycobacterium bovis
IKEQMIHWWGPIIDEYYASSE

SEQ ID NO: 201223 - protein, 17 aa, Mycobacterium bovis
IKGILGEVWEFITNALN

SEQ ID NO: 201224 - protein, 17 aa, Mycobacterium bovis
IKGLARLAREAGAAHPR

SEQ ID NO: 201225 - protein, 25 aa, Mycobacterium bovis
IKIPLIDIPAAPGFGNSTTTPSSGF

SEQ ID NO: 201226 - protein, 21 aa, Mycobacterium bovis
IKKGVLELADIVVVNKADGEH

SEQ ID NO: 201227 - protein, 25 aa, Mycobacterium bovis
IKKHARLNMMAHLLSTIDYADVEKP

SEQ ID NO: 201228 - protein, 17 aa, Mycobacterium bovis
IKLHQLGLSLKDSPPSF

SEQ ID NO: 201229 - protein, 19 aa, Mycobacterium bovis
IKNGLKFYEMTGFAKSNAA

SEQ ID NO: 201230 - protein, 18 aa, Mycobacterium bovis
IKPPADPDIVGWEVDEFV

SEQ ID NO: 201231 - protein, 27 aa, Mycobacterium bovis
IKPQRGRISTWPLPEAFNGVTVNGVLA

SEQ ID NO: 201232 - protein, 22 aa, Mycobacterium bovis
IKPSHLAGGYGQHAFAFNYLGP

SEQ ID NO: 201233 - protein, 21 aa, Mycobacterium bovis
IKQEILAGIGGVRAIRAYTAV

SEQ ID NO: 201234 - protein, 24 aa, Mycobacterium bovis
IKQLKYRYLRALDTKHWDDFTDTL

SEQ ID NO: 201235 - protein, 17 aa, Mycobacterium bovis
IKRSAAVPDRDGTSHAA

SEQ ID NO: 201236 - protein, 19 aa, Mycobacterium bovis
IKSAGTRLVCQIQNRTQAE

SEQ ID NO: 201237 - protein, 20 aa, Mycobacterium bovis
IKSQDLLTANGFQPFEDEEV

SEQ ID NO: 201238 - protein, 18 aa, Mycobacterium bovis
IKTRARIGPEYTELKNLV

SEQ ID NO: 201239 - protein, 19 aa, Mycobacterium bovis
IKTWSRRSTIIPDFIGHTF

SEQ ID NO: 201240 - protein, 20 aa, Mycobacterium bovis
IKVIVLRGAGRAFSGGYDFG

SEQ ID NO: 201241 - protein, 23 aa, Mycobacterium bovis
ILAHAAVVYGYFPAVSEGNDIVV

SEQ ID NO: 201242 - protein, 24 aa, Mycobacterium bovis
ILAQALIKGGLRLVAAGVNPIALG

SEQ ID NO: 201243 - protein, 27 aa, Mycobacterium bovis
ILATGRPPRWVRPIVDALGFAPMAVCA

SEQ ID NO: 201244 - protein, 27 aa, Mycobacterium bovis
ILAVMPWNFPLWQAVRFAAPALMAGNV

SEQ ID NO: 201245 - protein, 22 aa, Mycobacterium bovis
ILCDPWVNPAYFASWFPFPDNS

SEQ ID NO: 201246 - protein, 34 aa, Mycobacterium bovis
ILDALIRRLDEWRCLECIRALRANQQAAQRLRGL

SEQ ID NO: 201247 - protein, 19 aa, Mycobacterium bovis
ILDRTPWRAEEVTVIVAPM

SEQ ID NO: 201248 - protein, 27 aa, Mycobacterium bovis
ILDTVARQEPGLSWAAGLRDNGQTTLL

SEQ ID NO: 201249 - protein, 18 aa, Mycobacterium bovis
ILEREVFDVVAARLRADY

SEQ ID NO: 201250 - protein, 24 aa, Mycobacterium bovis
ILERRARIGGTWDLFRYPGVRSDS

SEQ ID NO: 201251 - protein, 23 aa, Mycobacterium bovis
ILESLPLAGWMTIETTPLSPHPD

SEQ ID NO: 201252 - protein, 17 aa, Mycobacterium bovis
ILFLEWTANSAVSRVDD

SEQ ID NO: 201253 - protein, 17 aa, Mycobacterium bovis
ILGEVFRRVTGRTVGQY

SEQ ID NO: 201254 - protein, 21 aa, Mycobacterium bovis
ILGSYRFSAFRSDKTAPKDAG

SEQ ID NO: 201255 - protein, 25 aa, Mycobacterium bovis
ILLNSKTRRPSVCNAAETLLVDAAI

SEQ ID NO: 201256 - protein, 18 aa, Mycobacterium bovis
ILMQTNWARHISVRQVEV

SEQ ID NO: 201257 - protein, 24 aa, Mycobacterium bovis
ILNDFPLFWDPRLLERDVHLPRFY

SEQ ID NO: 201258 - protein, 17 aa, Mycobacterium bovis
ILPYLDIRLDYYDLGIE

SEQ ID NO: 201259 - protein, 27 aa, Mycobacterium bovis
ILQRYKDLQDIIAILGIDELSEEDKQL

SEQ ID NO: 201260 - protein, 24 aa, Mycobacterium bovis
ILRAMEALDLLPLTDRRHLIEKLG

SEQ ID NO: 201261 - protein, 17 aa, Mycobacterium bovis
ILRFFPTPACARLTEQN

SEQ ID NO: 201262 - protein, 21 aa, Mycobacterium bovis
ILRGRTGALIVLGHDENVEAI

SEQ ID NO: 201263 - protein, 19 aa, Mycobacterium bovis
ILSAATVFVCPSVYEPLGI

SEQ ID NO: 201264 - protein, 23 aa, Mycobacterium bovis
ILTEHPDRFRAMIVESGNPAHSL

SEQ ID NO: 201265 - protein, 18 aa, Mycobacterium bovis
ILYGYEWELTKSPAGAWQ

SEQ ID NO: 201266 - protein, 17 aa, Mycobacterium bovis
ILYHAALAHASNHIVTV

SEQ ID NO: 201267 - protein, 18 aa, Mycobacterium bovis
IMAARPGAHVTLQQLDLC

SEQ ID NO: 201268 - protein, 17 aa, Mycobacterium bovis
IMADFNVTDGRRFGFDV

SEQ ID NO: 201269 - protein, 19 aa, Mycobacterium bovis
IMEHGRPASWEQRALHVTS

SEQ ID NO: 201270 - protein, 18 aa, Mycobacterium bovis
IMTPEITTPPFAIDPIGL

SEQ ID NO: 201271 - protein, 17 aa, Mycobacterium bovis
INAEPGAIITGRIRDYV

SEQ ID NO: 201272 - protein, 18 aa, Mycobacterium bovis
INAIGYPLAATVGLGTID

SEQ ID NO: 201273 - protein, 27 aa, Mycobacterium bovis
INAPAAALSGRPFIGNGTNGAPGTGEA

SEQ ID NO: 201274 - protein, 23 aa, Mycobacterium bovis
INDEYPFLLGHEAAGIIEAVGPG

SEQ ID NO: 201275 - protein, 24 aa, Mycobacterium bovis
INDIYRCHPALWSLDTTPEGYSWI

SEQ ID NO: 201276 - protein, 18 aa, Mycobacterium bovis
INEAASLVQDAAHPDANI

SEQ ID NO: 201277 - protein, 25 aa, Mycobacterium bovis
INEPTEALTGRPLIGNGDSGTPGTG

SEQ ID NO: 201278 - protein, 18 aa, Mycobacterium bovis
INIGSWGGFPLRDRVAAA

SEQ ID NO: 201279 - protein, 21 aa, Mycobacterium bovis
INKEIKRRSRVVGIFPNPAAV

SEQ ID NO: 201280 - protein, 24 aa, Mycobacterium bovis
INKEINLRFVLGYTPLEFRDTLHM

SEQ ID NO: 201281 - protein, 27 aa, Mycobacterium bovis
INLELIDSPTLPTCERIAVLSQSGVNL

SEQ ID NO: 201282 - protein, 26 aa, Mycobacterium bovis
INMFEFARPVLEACGQRWPKMRISGP

SEQ ID NO: 201283 - protein, 22 aa, Mycobacterium bovis
INPEAWRWYRDVIGGGRTPLVD

SEQ ID NO: 201284 - protein, 17 aa, Mycobacterium bovis
INPEDIISGAFELAQQV

SEQ ID NO: 201285 - protein, 20 aa, Mycobacterium bovis
INRHIKRGGKVWINIFPDRP

SEQ ID NO: 201286 - protein, 19 aa, Mycobacterium bovis
INTMPGFTTISMYPRMWAA

SEQ ID NO: 201287 - protein, 17 aa, Mycobacterium bovis
IPAIPGIDHPMVLTYAE

SEQ ID NO: 201288 - protein, 17 aa, Mycobacterium bovis
IPANLLGQMALGSMTGG

SEQ ID NO: 201289 - protein, 19 aa, Mycobacterium bovis
IPARPVIIGPITFLLLSKA

SEQ ID NO: 201290 - protein, 22 aa, Mycobacterium bovis
IPAVIKNAIDWLSRPFGDGALK

SEQ ID NO: 201291 - protein, 25 aa, Mycobacterium bovis
IPAVLGLAFDGGWWVLGIRTPTAAE

SEQ ID NO: 201292 - protein, 20 aa, Mycobacterium bovis
IPCRTFAAFLDLRYWIKTFT

SEQ ID NO: 201293 - protein, 26 aa, Mycobacterium bovis
IPDFVKLAEALGCVGLRCEREEDVVD

SEQ ID NO: 201294 - protein, 19 aa, Mycobacterium bovis
IPDMAQWGIFLRNHDELTL

SEQ ID NO: 201295 - protein, 21 aa, Mycobacterium bovis
IPDPPPPGAVVVFSAHGVSPA

SEQ ID NO: 201296 - protein, 29 aa, Mycobacterium bovis
IPEAASDEWTDWRWNRILIEGSNCRDIID

SEQ ID NO: 201297 - protein, 17 aa, Mycobacterium bovis
IPEADAVEQGRAVDFDD

SEQ ID NO: 201298 - protein, 21 aa, Mycobacterium bovis
IPEALDLVYSLGFTLTGLLPC

SEQ ID NO: 201299 - protein, 25 aa, Mycobacterium bovis
IPEGLLNYLALLGWSIADDHDLFGL

SEQ ID NO: 201300 - protein, 18 aa, Mycobacterium bovis
IPERVNVIRVLMMELNRI

SEQ ID NO: 201301 - protein, 22 aa, Mycobacterium bovis
IPESKKAVVVFPTYEDYAAVMR

SEQ ID NO: 201302 - protein, 20 aa, Mycobacterium bovis
IPFAAALHGPCDTNAFAAAI

SEQ ID NO: 201303 - protein, 19 aa, Mycobacterium bovis
IPFENLDPLLGVPVDDLSP

SEQ ID NO: 201304 - protein, 17 aa, Mycobacterium bovis
IPGAGLAVERIGERAHD

SEQ ID NO: 201305 - protein, 19 aa, Mycobacterium bovis
IPGEAALSETLRRRRASGG

SEQ ID NO: 201306 - protein, 25 aa, Mycobacterium bovis
IPGEPTIVAGLRLRRMVASIVGADL

SEQ ID NO: 201307 - protein, 22 aa, Mycobacterium bovis
IPGFTIPGGTLIPTLPLGLALS

SEQ ID NO: 201308 - protein, 21 aa, Mycobacterium bovis
IPGWAWSDVLEHFRAIETDLD

SEQ ID NO: 201309 - protein, 20 aa, Mycobacterium bovis
IPGWNICVDFPIKDGLGKFV

SEQ ID NO: 201310 - protein, 18 aa, Mycobacterium bovis
IPHTLAALDWGGITCQSG

SEQ ID NO: 201311 - protein, 17 aa, Mycobacterium bovis
IPIIDVPAVPGFGNTTT

SEQ ID NO: 201312 - protein, 17 aa, Mycobacterium bovis
IPIIHIPATPGFGNSTG

SEQ ID NO: 201313 - protein, 17 aa, Mycobacterium bovis
IPIPAIHIGINGVVTVG

SEQ ID NO: 201314 - protein, 19 aa, Mycobacterium bovis
IPIPDEFKSRLSTAVNAIA

SEQ ID NO: 201315 - protein, 18 aa, Mycobacterium bovis
IPIVPIVIRNAEIVASRN

SEQ ID NO: 201316 - protein, 17 aa, Mycobacterium bovis
IPKANFELWSFAVSAIN

SEQ ID NO: 201317 - protein, 25 aa, Mycobacterium bovis
IPKGSAAALRFEVLGLVDGVPAVVL

SEQ ID NO: 201318 - protein, 20 aa, Mycobacterium bovis
IPKSSLGAGLGLRSGLSAGL

SEQ ID NO: 201319 - protein, 20 aa, Mycobacterium bovis
IPLAIEFAAARVRSMSPLEI

SEQ ID NO: 201320 - protein, 18 aa, Mycobacterium bovis
IPLALRLIEEGFALYGDQ

SEQ ID NO: 201321 - protein, 17 aa, Mycobacterium bovis
IPLDVAEGDTVIYSKYG

SEQ ID NO: 201322 - protein, 19 aa, Mycobacterium bovis
IPLGASVLLVSGRASFELT

SEQ ID NO: 201323 - protein, 17 aa, Mycobacterium bovis
IPLGFAAIGHIGPISIP

SEQ ID NO: 201324 - protein, 19 aa, Mycobacterium bovis
IPLGLRLGSDTTLLDAALA

SEQ ID NO: 201325 - protein, 20 aa, Mycobacterium bovis
IPLLEYAARFITPVHPGYTA

SEQ ID NO: 201326 - protein, 23 aa, Mycobacterium bovis
IPLLLEMPMVYTGRALTQATCLF

SEQ ID NO: 201327 - protein, 19 aa, Mycobacterium bovis
IPLTAHFLGGAVIGDDPEH

SEQ ID NO: 201328 - protein, 34 aa, Mycobacterium bovis
IPMQPKLDVLDFWSIIKPELAGVHGLCTQVTAFM

SEQ ID NO: 201329 - protein, 18 aa, Mycobacterium bovis
IPNPFAVTYYLIKGSLQA

SEQ ID NO: 201330 - protein, 23 aa, Mycobacterium bovis
IPPELRPMVQLDGGRFATSDLND

SEQ ID NO: 201331 - protein, 18 aa, Mycobacterium bovis
IPPLDWDPDEAFDRLQSE

SEQ ID NO: 201332 - protein, 17 aa, Mycobacterium bovis
IPPLVAVAQQLGVCGAE

SEQ ID NO: 201333 - protein, 19 aa, Mycobacterium bovis
IPQFPIRITTTGGIGPIVI

SEQ ID NO: 201334 - protein, 21 aa, Mycobacterium bovis
IPRAHRGIVAVNELPDLAERI

SEQ ID NO: 201335 - protein, 22 aa, Mycobacterium bovis
IPRTKRGVISYAARDIGERLDA

SEQ ID NO: 201336 - protein, 20 aa, Mycobacterium bovis
IPRVVGFRLTGEIQPGVTAT

SEQ ID NO: 201337 - protein, 18 aa, Mycobacterium bovis
IPSPAAALQATRLAAAPI

SEQ ID NO: 201338 - protein, 24 aa, Mycobacterium bovis
IPSWMARMGFQMMDPLKTAKARVD

SEQ ID NO: 201339 - protein, 24 aa, Mycobacterium bovis
IPTDWGRCVLTIGVFDGVHRGHAE

SEQ ID NO: 201340 - protein, 18 aa, Mycobacterium bovis
IPTKMFVYAAEVAKTIRG

SEQ ID NO: 201341 - protein, 24 aa, Mycobacterium bovis
IPTPRRVQLPLVHCGGAATREQEM

SEQ ID NO: 201342 - protein, 18 aa, Mycobacterium bovis
IPVGVGLGVRSRAQAAQI

SEQ ID NO: 201343 - protein, 19 aa, Mycobacterium bovis
IPVMAKVRIGHFVEAQILQ

SEQ ID NO: 201344 - protein, 22 aa, Mycobacterium bovis
IPVRRVRATHAFHTSAMDPMLG

SEQ ID NO: 201345 - protein, 17 aa, Mycobacterium bovis
IPVTPGYFNLTGGPSSG

SEQ ID NO: 201346 - protein, 21 aa, Mycobacterium bovis
IPVTVKFRIGIDDAHHTHLDA

SEQ ID NO: 201347 - protein, 24 aa, Mycobacterium bovis
IPVVLRPAVLAKLMAGRTTLMVTG

SEQ ID NO: 201348 - protein, 21 aa, Mycobacterium bovis
IPWSDPRLRRAATLHLGGTRD

SEQ ID NO: 201349 - protein, 19 aa, Mycobacterium bovis
IPYPAGHSALLHRIAQHGV

SEQ ID NO: 201350 - protein, 24 aa, Mycobacterium bovis
IQAIKGVEIGDGFQTARRRGSRAH

SEQ ID NO: 201351 - protein, 29 aa, Mycobacterium bovis
IQAPAALGLICPWADLAVDIEATRPALRD

SEQ ID NO: 201352 - protein, 25 aa, Mycobacterium bovis
IQAQDFFFRKIVRDKGVALAHVSGQ

SEQ ID NO: 201353 - protein, 18 aa, Mycobacterium bovis
IQGLRAAFEVSQTSRSAP

SEQ ID NO: 201354 - protein, 19 aa, Mycobacterium bovis
IQHADLLVVRRGEKVVVEV

SEQ ID NO: 201355 - protein, 25 aa, Mycobacterium bovis
IQIPVGPRLGNVVVEVDHLDKGYDG

SEQ ID NO: 201356 - protein, 26 aa, Mycobacterium bovis
IQKVIRRYRVKGAREAVNLALRTLLG

SEQ ID NO: 201357 - protein, 20 aa, Mycobacterium bovis
IQLAEWEWPANPRFLMCTPL

SEQ ID NO: 201358 - protein, 25 aa, Mycobacterium bovis
IQPDLRVLVDLGYGYGYADVPTPAS

SEQ ID NO: 201359 - protein, 27 aa, Mycobacterium bovis
IQPFINWLTNLPFLQAMFSGFDPWLPS

SEQ ID NO: 201360 - protein, 21 aa, Mycobacterium bovis
IQPLPPKRAGLLIRALYRIAK

SEQ ID NO: 201361 - protein, 19 aa, Mycobacterium bovis
IRAALLAHKVVFFRGQHQL

SEQ ID NO: 201362 - protein, 21 aa, Mycobacterium bovis
IRAFWPGALSLVVVQAPSLQW

SEQ ID NO: 201363 - protein, 24 aa, Mycobacterium bovis
IRAGEGVSYGHTWIAPRDTNLALL

SEQ ID NO: 201364 - protein, 21 aa, Mycobacterium bovis
IRAILRAPVDLLFNGGIGTYI

SEQ ID NO: 201365 - protein, 20 aa, Mycobacterium bovis
IRALAARAAPLVAILWGRDA

SEQ ID NO: 201366 - protein, 21 aa, Mycobacterium bovis
IRALHEVGVELSVFGTQGRKG

SEQ ID NO: 201367 - protein, 18 aa, Mycobacterium bovis
IRALVPRRDVNGIMDELA

SEQ ID NO: 201368 - protein, 26 aa, Mycobacterium bovis
IRAQLLERFGMFGIRMSIAVLAAGVT

SEQ ID NO: 201369 - protein, 19 aa, Mycobacterium bovis
IRDKGGRAVANYDSVATED

SEQ ID NO: 201370 - protein, 23 aa, Mycobacterium bovis
IRDMAKVPSAIWVVDTNKEHIAV

SEQ ID NO: 201371 - protein, 19 aa, Mycobacterium bovis
IRDVTELWCQGYSEPGAGS

SEQ ID NO: 201372 - protein, 21 aa, Mycobacterium bovis
IREGARIALNPSPEWIEELDR

SEQ ID NO: 201373 - protein, 23 aa, Mycobacterium bovis
IRELRFYRRTAFVPQPGPSTSEI

SEQ ID NO: 201374 - protein, 26 aa, Mycobacterium bovis
IRFSDAFDIPLVFVVDTPGFLPGVEQ

SEQ ID NO: 201375 - protein, 17 aa, Mycobacterium bovis
IRFSERLAEAGIQPSVG

SEQ ID NO: 201376 - protein, 18 aa, Mycobacterium bovis
IRGEVLRILAGVDGEIRR

SEQ ID NO: 201377 - protein, 19 aa, Mycobacterium bovis
IRGRIKELINRGGEKISPE

SEQ ID NO: 201378 - protein, 18 aa, Mycobacterium bovis
IRGTGSFDMAVRALQNLA

SEQ ID NO: 201379 - protein, 17 aa, Mycobacterium bovis
IRHPRDVALALAAGASN

SEQ ID NO: 201380 - protein, 18 aa, Mycobacterium bovis
IRIAPSFPSVPDLRNAVD

SEQ ID NO: 201381 - protein, 31 aa, Mycobacterium bovis
IRILPETRRYLGWRLSLLDLIGADTAANLAD

SEQ ID NO: 201382 - protein, 17 aa, Mycobacterium bovis
IRKEGKIGRVYYPAPYM

SEQ ID NO: 201383 - protein, 21 aa, Mycobacterium bovis
IRLARLSWRIQGLKITVTGVD

SEQ ID NO: 201384 - protein, 17 aa, Mycobacterium bovis
IRLFEIGSSAGLNLRPD

SEQ ID NO: 201385 - protein, 19 aa, Mycobacterium bovis
IRLGGTWKKPGTSDIEIVC

SEQ ID NO: 201386 - protein, 17 aa, Mycobacterium bovis
IRLLTRIAFGFRSPQAL

SEQ ID NO: 201387 - protein, 19 aa, Mycobacterium bovis
IRLLTRIAFGFRSPQALIA

SEQ ID NO: 201388 - protein, 18 aa, Mycobacterium bovis
IRLPGRYNVANCLVALAI

SEQ ID NO: 201389 - protein, 18 aa, Mycobacterium bovis
IRLQCYEGLTANEALYDW

SEQ ID NO: 201390 - protein, 20 aa, Mycobacterium bovis
IRLQPQVGWEVNDPDGDLRK

SEQ ID NO: 201391 - protein, 17 aa, Mycobacterium bovis
IRPALVFVAAEAAGADP

SEQ ID NO: 201392 - protein, 18 aa, Mycobacterium bovis
IRPDRSYVNIGFWSSVPV

SEQ ID NO: 201393 - protein, 18 aa, Mycobacterium bovis
IRPGDIVVVNTGWHHKYA

SEQ ID NO: 201394 - protein, 17 aa, Mycobacterium bovis
IRPRVGFGRGRRAPVSS

SEQ ID NO: 201395 - protein, 19 aa, Mycobacterium bovis
IRQLARMGAKTIVAMARKP

SEQ ID NO: 201396 - protein, 19 aa, Mycobacterium bovis
IRQRIVGIAGIDTRGVVRH

SEQ ID NO: 201397 - protein, 22 aa, Mycobacterium bovis
IRRAPGPSWYHFTLNGAPGSIL

SEQ ID NO: 201398 - protein, 22 aa, Mycobacterium bovis
IRRRLKSFTVFRQRGDAFADRL

SEQ ID NO: 201399 - protein, 24 aa, Mycobacterium bovis
IRSACARAGGALLVVEREDPVPVP

SEQ ID NO: 201400 - protein, 25 aa, Mycobacterium bovis
IRSGLPFGTCLDAAYLHPCGSDEFK

SEQ ID NO: 201401 - protein, 23 aa, Mycobacterium bovis
IRSKGVGVFFCTQLPTDLPNDVL

SEQ ID NO: 201402 - protein, 17 aa, Mycobacterium bovis
IRSTGRWRGRPKNQDAY

SEQ ID NO: 201403 - protein, 24 aa, Mycobacterium bovis
IRTETSTYCPFKGEASYYSVTTDA

SEQ ID NO: 201404 - protein, 22 aa, Mycobacterium bovis
IRTICRRAGLSVRYFYESFTDK

SEQ ID NO: 201405 - protein, 21 aa, Mycobacterium bovis
IRTMKHSLAWVDRSGSLAELN

SEQ ID NO: 201406 - protein, 22 aa, Mycobacterium bovis
IRTRLDRVLDWLGRADVDVLAM

SEQ ID NO: 201407 - protein, 17 aa, Mycobacterium bovis
IRVDTRCELRAGVQKAL

SEQ ID NO: 201408 - protein, 17 aa, Mycobacterium bovis
IRVFPGDHFYLNDNLPE

SEQ ID NO: 201409 - protein, 17 aa, Mycobacterium bovis
IRVLRYGSVPGETMAAT

SEQ ID NO: 201410 - protein, 19 aa, Mycobacterium bovis
IRWNWAPGDVAIWDNRATQ

SEQ ID NO: 201411 - protein, 17 aa, Mycobacterium bovis
IRYFPTLLPEVSDEDPL

SEQ ID NO: 201412 - protein, 18 aa, Mycobacterium bovis
IRYLTPRLHEEMMSELRW

SEQ ID NO: 201413 - protein, 20 aa, Mycobacterium bovis
ISAAIAALFGAHGRAYQAAS

SEQ ID NO: 201414 - protein, 17 aa, Mycobacterium bovis
ISAALGFGDRFDLARTL

SEQ ID NO: 201415 - protein, 22 aa, Mycobacterium bovis
ISAERAAAMVIRGLVEKPARID

SEQ ID NO: 201416 - protein, 23 aa, Mycobacterium bovis
ISALRWGGSAPRVIFLHGGGQNA

SEQ ID NO: 201417 - protein, 26 aa, Mycobacterium bovis
ISARWGRPGPLWSVSIERFLDTAWWV

SEQ ID NO: 201418 - protein, 24 aa, Mycobacterium bovis
ISAVRGRNFLGWIHPAATATAPAR

SEQ ID NO: 201419 - protein, 31 aa, Mycobacterium bovis
ISAVVGLAGRWLRPGGLFAVEHDDTTSSSTV

SEQ ID NO: 201420 - protein, 20 aa, Mycobacterium bovis
ISDDFFALFLDPTWVYTCAY

SEQ ID NO: 201421 - protein, 17 aa, Mycobacterium bovis
ISDGELFIMGRIKDLLI

SEQ ID NO: 201422 - protein, 20 aa, Mycobacterium bovis
ISDRAALFFDGRLVEEGPTE

SEQ ID NO: 201423 - protein, 25 aa, Mycobacterium bovis
ISDVIRLARHANHYLAIFDRGKALA

SEQ ID NO: 201424 - protein, 18 aa, Mycobacterium bovis
ISDVRQGKRFELEVDDTV

SEQ ID NO: 201425 - protein, 19 aa, Mycobacterium bovis
ISELARRGLMPGRVEADDG

SEQ ID NO: 201426 - protein, 25 aa, Mycobacterium bovis
ISGDLRVDFPWLGTVVQAYLRRTLA

SEQ ID NO: 201427 - protein, 21 aa, Mycobacterium bovis
ISGLTGDDWLGPSALSMAAAA

SEQ ID NO: 201428 - protein, 33 aa, Mycobacterium bovis
ISGNYSNGILWRGDYQGLIGYSYALTIPEIPAH

SEQ ID NO: 201429 - protein, 31 aa, Mycobacterium bovis
ISGSYSNGFLWSGNYQGLIGLHAALAIPEIA

SEQ ID NO: 201430 - protein, 17 aa, Mycobacterium bovis
ISHAFNLRGPSIAVQTA

SEQ ID NO: 201431 - protein, 18 aa, Mycobacterium bovis
ISHDRWFLDRTCTHILAW

SEQ ID NO: 201432 - protein, 17 aa, Mycobacterium bovis
ISLAPGEAIFLPAGNLH

SEQ ID NO: 201433 - protein, 23 aa, Mycobacterium bovis
ISLELRQGRTLGIVGESGSGKST

SEQ ID NO: 201434 - protein, 20 aa, Mycobacterium bovis
ISMYPRMWAASGVDYPTLLA

SEQ ID NO: 201435 - protein, 20 aa, Mycobacterium bovis
ISNVPGAREPLYFNGARMVG

SEQ ID NO: 201436 - protein, 35 aa, Mycobacterium bovis
ISPAGLLYLVGPIAWTLGFPIVPMLAPGSTDVNGI

SEQ ID NO: 201437 - protein, 17 aa, Mycobacterium bovis
ISPAGSVEWLCVPRPDS

SEQ ID NO: 201438 - protein, 18 aa, Mycobacterium bovis
ISPHPTIPLAPTVAERAA

SEQ ID NO: 201439 - protein, 18 aa, Mycobacterium bovis
ISPIARPRDVHVVPELPK

SEQ ID NO: 201440 - protein, 23 aa, Mycobacterium bovis
ISQGRLEALLNFQTLVTDLTGLE

SEQ ID NO: 201441 - protein, 24 aa, Mycobacterium bovis
ISQNWRLSGLAGEYITPVPAQQRL

SEQ ID NO: 201442 - protein, 21 aa, Mycobacterium bovis
ISRDELIAGLAYHGPLNYRPL

SEQ ID NO: 201443 - protein, 24 aa, Mycobacterium bovis
ISRKRNLVEYGFRLPSACDNRPLT

SEQ ID NO: 201444 - protein, 26 aa, Mycobacterium bovis
ISRMHMPGVSICYGMTETSPVSTQTR

SEQ ID NO: 201445 - protein, 17 aa, Mycobacterium bovis
ISRTAFLHVDYRRITPI

SEQ ID NO: 201446 - protein, 22 aa, Mycobacterium bovis
ISRTSWDGIVVVCPPRANDESM

SEQ ID NO: 201447 - protein, 23 aa, Mycobacterium bovis
ISTAQWCGVRLADILQAADVHID

SEQ ID NO: 201448 - protein, 22 aa, Mycobacterium bovis
ISTLKRNYGWNRSCIDGTEGTR

SEQ ID NO: 201449 - protein, 25 aa, Mycobacterium bovis
ISTPRWTELKSRVRDYLGTKIEFRL

SEQ ID NO: 201450 - protein, 19 aa, Mycobacterium bovis
ISTVRCFQDNALLKSVLSQ

SEQ ID NO: 201451 - protein, 25 aa, Mycobacterium bovis
ITARGPAVVEFNCRFGDPETQAVLA

SEQ ID NO: 201452 - protein, 17 aa, Mycobacterium bovis
ITARPPSGFGISARAVT

SEQ ID NO: 201453 - protein, 19 aa, Mycobacterium bovis
ITATPAWDALRRHHDQIGN

SEQ ID NO: 201454 - protein, 22 aa, Mycobacterium bovis
ITDGRWSCVQWGLRKPPFCPDP

SEQ ID NO: 201455 - protein, 28 aa, Mycobacterium bovis
ITERRAGWRAARWLAVVINYRAERWSDV

SEQ ID NO: 201456 - protein, 24 aa, Mycobacterium bovis
ITFDFEPGEFVALLGQSGSGKSTL

SEQ ID NO: 201457 - protein, 24 aa, Mycobacterium bovis
ITGWDYPACEAIGLLKMDFLGLRN

SEQ ID NO: 201458 - protein, 28 aa, Mycobacterium bovis
ITIPEIPYRYDLSVPIDIPITGTVVATT

SEQ ID NO: 201459 - protein, 26 aa, Mycobacterium bovis
ITIPQLPLGLALSGATPAFAFPLEIT

SEQ ID NO: 201460 - protein, 20 aa, Mycobacterium bovis
ITKRAGVSVGALFRHFETMG

SEQ ID NO: 201461 - protein, 18 aa, Mycobacterium bovis
ITLARMMSRRQFGQTLFE

SEQ ID NO: 201462 - protein, 23 aa, Mycobacterium bovis
ITLEAAVGLGAMPIYRFGTEEQK

SEQ ID NO: 201463 - protein, 19 aa, Mycobacterium bovis
ITLGTALARLGMFAPALSY

SEQ ID NO: 201464 - protein, 21 aa, Mycobacterium bovis
ITLRPEMWVRKIAGADVVSEL

SEQ ID NO: 201465 - protein, 18 aa, Mycobacterium bovis
ITPFNFPAMIPLWKAGPA

SEQ ID NO: 201466 - protein, 18 aa, Mycobacterium bovis
ITPHHLWLRAVAAGGQGR

SEQ ID NO: 201467 - protein, 17 aa, Mycobacterium bovis
ITPLALWNARAAGHDAE

SEQ ID NO: 201468 - protein, 25 aa, Mycobacterium bovis
ITPWNFPMVIASWAIAPALAAGNAV

SEQ ID NO: 201469 - protein, 23 aa, Mycobacterium bovis
ITQEFDATVCWMADNAVLEPGRD

SEQ ID NO: 201470 - protein, 23 aa, Mycobacterium bovis
ITQVKVRSVLTCATSTGVCATCY

SEQ ID NO: 201471 - protein, 23 aa, Mycobacterium bovis
ITRASARLAPAFTDTWVATTDND

SEQ ID NO: 201472 - protein, 17 aa, Mycobacterium bovis
ITTPALISGFFNTGSNM

SEQ ID NO: 201473 - protein, 17 aa, Mycobacterium bovis
ITTTGGIGPIVIPDTTI

SEQ ID NO: 201474 - protein, 21 aa, Mycobacterium bovis
ITVDGPLRFELIDIATATSCG

SEQ ID NO: 201475 - protein, 20 aa, Mycobacterium bovis
ITVGRISYLLGLRGPAVAVD

SEQ ID NO: 201476 - protein, 24 aa, Mycobacterium bovis
ITVSAADRPAHWRATDVAPTDAGG

SEQ ID NO: 201477 - protein, 20 aa, Mycobacterium bovis
IVAIDMRRRRGLPPIAPHSG

SEQ ID NO: 201478 - protein, 19 aa, Mycobacterium bovis
IVDDIALVRDCCAPGSRFA

SEQ ID NO: 201479 - protein, 23 aa, Mycobacterium bovis
IVDEFTGRVLIGRRYNEGMHQAI

SEQ ID NO: 201480 - protein, 17 aa, Mycobacterium bovis
IVDRPLYRFPVFGFFAL

SEQ ID NO: 201481 - protein, 24 aa, Mycobacterium bovis
IVEEPPEHLIFIFATTEPEKVLPT

SEQ ID NO: 201482 - protein, 18 aa, Mycobacterium bovis
IVEIGPFTIPQVDVPAIP

SEQ ID NO: 201483 - protein, 25 aa, Mycobacterium bovis
IVELLRSRVFFDWFDAMGVDDIPAV

SEQ ID NO: 201484 - protein, 25 aa, Mycobacterium bovis
IVEPKYWGGVCLNVGCIPSKALLRN

SEQ ID NO: 201485 - protein, 23 aa, Mycobacterium bovis
IVERGRMLGGVCVNTGTIPSKTL

SEQ ID NO: 201486 - protein, 25 aa, Mycobacterium bovis
IVETRGRFGTFISRFDPTDAAMAAA

SEQ ID NO: 201487 - protein, 18 aa, Mycobacterium bovis
IVGALGRLGHLGISDVRQ

SEQ ID NO: 201488 - protein, 29 aa, Mycobacterium bovis
IVGHDRLRLALLLCAVRPEIGGALIRGEK

SEQ ID NO: 201489 - protein, 33 aa, Mycobacterium bovis
IVGLERIGLRFVLEIRVPAGVDGRITWSNWIDE

SEQ ID NO: 201490 - protein, 18 aa, Mycobacterium bovis
IVHDLRQPLPVKTGSIDG

SEQ ID NO: 201491 - protein, 34 aa, Mycobacterium bovis; identical to SEQ ID NO: 81328

SEQ ID NO: 201492 - protein, 22 aa, Mycobacterium bovis
IVIPAFGGGIGIPINIGPLTIT

SEQ ID NO: 201493 - protein, 18 aa, Mycobacterium bovis
IVLQTGARLSRRGRRLGL

SEQ ID NO: 201494 - protein, 24 aa, Mycobacterium bovis
IVNGRGGPQFLPLGPSSAGGDTIA

SEQ ID NO: 201495 - protein, 23 aa, Mycobacterium bovis
IVNRLKIACGHKALRVDHIGSTA

SEQ ID NO: 201496 - protein, 17 aa, Mycobacterium bovis
IVPYPGTPLYQAYSDAG

SEQ ID NO: 201497 - protein, 20 aa, Mycobacterium bovis
IVRLKARLWFVHRGIEKLFH

SEQ ID NO: 201498 - protein, 18 aa, Mycobacterium bovis
IVTSMLFSMHGELYKAIA

SEQ ID NO: 201499 - protein, 19 aa, Mycobacterium bovis
IVVREGLSADLARALHDDA

SEQ ID NO: 201500 - protein, 25 aa, Mycobacterium bovis
IVVRGELFTAFVPFAARWPVEVHIY

SEQ ID NO: 201501 - protein, 18 aa, Mycobacterium bovis
IVWYPGGHTGFFQSRPVR

SEQ ID NO: 201502 - protein, 17 aa, Mycobacterium bovis
IWADGGIRHPRDVALAL

SEQ ID NO: 201503 - protein, 26 aa, Mycobacterium bovis
IWFGRAHLREGLSWFNSILEDQRFHR

SEQ ID NO: 201504 - protein, 19 aa, Mycobacterium bovis
IWGFPKIMADFNVTDGRRF

SEQ ID NO: 201505 - protein, 17 aa, Mycobacterium bovis
IWHEGWFANTIHAATPA

SEQ ID NO: 201506 - protein, 19 aa, Mycobacterium bovis
IWPIAAARFVDNVVAVDSA

SEQ ID NO: 201507 - protein, 18 aa, Mycobacterium bovis
IWTRLFGVRLVKLLYRLE

SEQ ID NO: 201508 - protein, 27 aa, Mycobacterium bovis
IYAELTRLCRYPLLVVDEVGYIPFEPE

SEQ ID NO: 201509 - protein, 18 aa, Mycobacterium bovis
IYAESFRGPQHLVEVQQT

SEQ ID NO: 201510 - protein, 23 aa, Mycobacterium bovis
IYDEGRVSHQVSMWVNRYQHQTT

SEQ ID NO: 201511 - protein, 24 aa, Mycobacterium bovis
IYRALRPGGVLLMVDIKASSQLED

SEQ ID NO: 201512 - protein, 24 aa, Mycobacterium bovis
IYRFNGQTSVFWPGRGPCYRCLHP

SEQ ID NO: 201513 - protein, 18 aa, Mycobacterium bovis
IYRRSFAVIRAEADLARF

SEQ ID NO: 201514 - protein, 20 aa, Mycobacterium bovis
IYRTRFGALLTAAADRRAAL

SEQ ID NO: 201515 - protein, 21 aa, Mycobacterium bovis
IYSNGLWRDAPLRRREAMRPG

SEQ ID NO: 201516 - protein, 23 aa, Mycobacterium bovis
IYSRTRGGEFCRHATAKVEQSPR

SEQ ID NO: 201517 - protein, 18 aa, Mycobacterium bovis
IYTKRMQKALNFEGDDVP

SEQ ID NO: 201518 - protein, 24 aa, Mycobacterium bovis
IYVRKRLRCGNRHPLQRVKRRLLA

SEQ ID NO: 201519 - protein, 26 aa, Mycobacterium bovis
KAAAAGRPWWEWAATHERAFTAAYDA

SEQ ID NO: 201520 - protein, 25 aa, Mycobacterium bovis
KAAAEGRLKGILKYYDAPIVSSDIV

SEQ ID NO: 201521 - protein, 20 aa, Mycobacterium bovis
KAAAGGWLMQHRGGNTCSAT

SEQ ID NO: 201522 - protein, 21 aa, Mycobacterium bovis
KAAGVVMEFANEFGLNMPIAR

SEQ ID NO: 201523 - protein, 19 aa, Mycobacterium bovis
KAAVIHLTKAMAVELAPHK

SEQ ID NO: 201524 - protein, 18 aa, Mycobacterium bovis
KAERCRRRGVDVRLVSRD

SEQ ID NO: 201525 - protein, 17 aa, Mycobacterium bovis
KAFNWTVTALKADIKAW

SEQ ID NO: 201526 - protein, 24 aa, Mycobacterium bovis
KAGEGDAFISAGVETVSRFAKGNS

SEQ ID NO: 201527 - protein, 23 aa, Mycobacterium bovis
KAGFDGVELVKALLFSVFEGGLR

SEQ ID NO: 201528 - protein, 23 aa, Mycobacterium bovis
KAGIATHVAAFWAHGGRPPVGVT

SEQ ID NO: 201529 - protein, 21 aa, Mycobacterium bovis
KAGQLWDAAGIEWAATSALSA

SEQ ID NO: 201530 - protein, 18 aa, Mycobacterium bovis
KAIGYGMPGIRVDGNDVL

SEQ ID NO: 201531 - protein, 25 aa, Mycobacterium bovis
KAIWWQRAVAVWPDYASYQTKTDRQ

SEQ ID NO: 201532 - protein, 24 aa, Mycobacterium bovis
KAKKLRVRLPLPKLIVAVENPQLL

SEQ ID NO: 201533 - protein, 20 aa, Mycobacterium bovis
KALDLPGGQGQHFFFDAGNG

SEQ ID NO: 201534 - protein, 18 aa, Mycobacterium bovis
KALGHAYGGGSQYFSMWV

SEQ ID NO: 201535 - protein, 17 aa, Mycobacterium bovis
KALPPKTSHLIVRMYNA

SEQ ID NO: 201536 - protein, 23 aa, Mycobacterium bovis
KAMARPTLRHRVMLRPEAELEGA

SEQ ID NO: 201537 - protein, 18 aa, Mycobacterium bovis
KAMLQDMAILTGGQVISE

SEQ ID NO: 201538 - protein, 20 aa, Mycobacterium bovis
KANFELWSFAVSAINGCSHC

SEQ ID NO: 201539 - protein, 21 aa, Mycobacterium bovis
KANPAVRVRIGGRWRSGTAYL

SEQ ID NO: 201540 - protein, 24 aa, Mycobacterium bovis
KAPEIPYYSATLFDPREAPACDAR

SEQ ID NO: 201541 - protein, 21 aa, Mycobacterium bovis
KAPTRGAPLCGFRQTSRILAG

SEQ ID NO: 201542 - protein, 18 aa, Mycobacterium bovis
KAQFEAAGLTYEHRLIDD

SEQ ID NO: 201543 - protein, 22 aa, Mycobacterium bovis
KAQKQARRWSRDTVATAMRLVA

SEQ ID NO: 201544 - protein, 22 aa, Mycobacterium bovis
KAREVILRLFGPLLDAAPTLGA

SEQ ID NO: 201545 - protein, 23 aa, Mycobacterium bovis
KARLRPPIRREGLGLVFETPTDE

SEQ ID NO: 201546 - protein, 25 aa, Mycobacterium bovis
KARVRALGVAGAFHTEFMAPALDGF

SEQ ID NO: 201547 - protein, 20 aa, Mycobacterium bovis
KARYLRPLLDGEITSCYSMT

SEQ ID NO: 201548 - protein, 24 aa, Mycobacterium bovis
KASAYRCGEAWSTLVHHRPSGRRL

SEQ ID NO: 201549 - protein, 20 aa, Mycobacterium bovis
KATGLPIDFTGFISDRHAVA

SEQ ID NO: 201550 - protein, 21 aa, Mycobacterium bovis
KATPEMVAFMVRYTSGYLCVP

SEQ ID NO: 201551 - protein, 26 aa, Mycobacterium bovis
KATQEDPWRHFARTHAIGQIVPGKVT

SEQ ID NO: 201552 - protein, 17 aa, Mycobacterium bovis
KATRDEIFGDLKPRVAA

SEQ ID NO: 201553 - protein, 26 aa, Mycobacterium bovis
KAVAGIRLALSLGFRVRVAATVASPA

SEQ ID NO: 201554 - protein, 24 aa, Mycobacterium bovis
KAVAPRVACDVIDRAIQVHGAAGV

SEQ ID NO: 201555 - protein, 31 aa, Mycobacterium bovis
KAVARGSFFPVIPVCSSTGVGTLELLEVATR

SEQ ID NO: 201556 - protein, 17 aa, Mycobacterium bovis
KAVGIADLVPHGLRHTT

SEQ ID NO: 201557 - protein, 21 aa, Mycobacterium bovis
KAVIVSEPFLVAIPILEQKGM

SEQ ID NO: 201558 - protein, 24 aa, Mycobacterium bovis
KAVQRSAGAIAIGPVLQGLRKPVN

SEQ ID NO: 201559 - protein, 25 aa, Mycobacterium bovis
KAVVDARRGKMFARLIKNIEVAARV

SEQ ID NO: 201560 - protein, 24 aa, Mycobacterium bovis
KAYRVAGYRAGWLAITGPKEHASS

SEQ ID NO: 201561 - protein, 17 aa, Mycobacterium bovis
KCPSCQAGMRNLCDLGA

SEQ ID NO: 201562 - protein, 19 aa, Mycobacterium bovis
KDAEGGSVFGRLVNTSSEA

SEQ ID NO: 201563 - protein, 17 aa, Mycobacterium bovis
KDARACRNALAEAGIPA

SEQ ID NO: 201564 - protein, 17 aa, Mycobacterium bovis
KDARLTILEVMAEAIDR

SEQ ID NO: 201565 - protein, 22 aa, Mycobacterium bovis
KDGKNVFLRDIWPSQQDVSDTI

SEQ ID NO: 201566 - protein, 20 aa, Mycobacterium bovis
KDGKRSLVVAGIKRCETMRF

SEQ ID NO: 201567 - protein, 24 aa, Mycobacterium bovis
KDGRPKPVPIWAALDTDRGDRLLV

SEQ ID NO: 201568 - protein, 20 aa, Mycobacterium bovis
KDGRQLVIRDLFYDAQSTRQ

SEQ ID NO: 201569 - protein, 19 aa, Mycobacterium bovis
KDGYGRNFLLPRGLAIVAS

SEQ ID NO: 201570 - protein, 18 aa, Mycobacterium bovis
KDHIEAIANWDPKAEPSI

SEQ ID NO: 201571 - protein, 21 aa, Mycobacterium bovis
KDIAKQRLVWRLCQRYPRAAR

SEQ ID NO: 201572 - protein, 23 aa, Mycobacterium bovis
KDIPLRVKAAAVGLAADEYHAQD

SEQ ID NO: 201573 - protein, 20 aa, Mycobacterium bovis
KDLADAFAFNVGTAHALTVA

SEQ ID NO: 201574 - protein, 22 aa, Mycobacterium bovis
KDLLRNTIVSFLRYIDANRASW

SEQ ID NO: 201575 - protein, 17 aa, Mycobacterium bovis
KDLRIAVDGGFLSVTEE

SEQ ID NO: 201576 - protein, 21 aa, Mycobacterium bovis
KDLRRARAAALNIVPTSTGAA

SEQ ID NO: 201577 - protein, 18 aa, Mycobacterium bovis
KDLSLALALGEVVSVDLP

SEQ ID NO: 201578 - protein, 17 aa, Mycobacterium bovis
KDMPTKPAPVLIFVPGG

SEQ ID NO: 201579 - protein, 17 aa, Mycobacterium bovis
KDQVVAHILNLLLTGKL

SEQ ID NO: 201580 - protein, 18 aa, Mycobacterium bovis
KDRDIAMVFQSYALYPHM

SEQ ID NO: 201581 - protein, 27 aa, Mycobacterium bovis
KDRFGAEIRTHYPLELEAEMGVIVQEA

SEQ ID NO: 201582 - protein, 25 aa, Mycobacterium bovis
KDRGCSFPNCDVPGYLTEVHHVTDF

SEQ ID NO: 201583 - protein, 19 aa, Mycobacterium bovis
KDSPLARALAKLGVAADDV

SEQ ID NO: 201584 - protein, 19 aa, Mycobacterium bovis
KDTHAHAWALRMSPDGNVW

SEQ ID NO: 201585 - protein, 24 aa, Mycobacterium bovis
KDTRGIIRVHQFDKVEGFVYCTPA

SEQ ID NO: 201586 - protein, 18 aa, Mycobacterium bovis
KDVAPSKELREWYHHQPE

SEQ ID NO: 201587 - protein, 27 aa, Mycobacterium bovis
KDVLQGQCTFSWPPRMELPGYKPNTKP

SEQ ID NO: 201588 - protein, 20 aa, Mycobacterium bovis
KDVSTAWQLDAYRFEIPVVA

SEQ ID NO: 201589 - protein, 19 aa, Mycobacterium bovis
KDVVIDMLCYRRRGHNEGD

SEQ ID NO: 201590 - protein, 17 aa, Mycobacterium bovis
KDWQVWSGAKVADLVQL

SEQ ID NO: 201591 - protein, 19 aa, Mycobacterium bovis
KEAMVRQWALRFRDDANQR

SEQ ID NO: 201592 - protein, 19 aa, Mycobacterium bovis
KEELARWTPILEQEEVRQV

SEQ ID NO: 201593 - protein, 21 aa, Mycobacterium bovis
KEESVGFLFNVTVEAVPAPPV

SEQ ID NO: 201594 - protein, 27 aa, Mycobacterium bovis
KEFELLKYLAQHAGRVFTRAQLLHEVW

SEQ ID NO: 201595 - protein, 18 aa, Mycobacterium bovis
KEFMVRNTYIYPPKPSMR

SEQ ID NO: 201596 - protein, 22 aa, Mycobacterium bovis
KEHKALVIKGGYMDGHPLTVAE

SEQ ID NO: 201597 - protein, 21 aa, Mycobacterium bovis
KEIQARIRAGASVEQVAAASG

SEQ ID NO: 201598 - protein, 17 aa, Mycobacterium bovis
KELAEAYASMDVFVHSG

SEQ ID NO: 201599 - protein, 20 aa, Mycobacterium bovis
KELAHLGIRVNAIAPGLIRS

SEQ ID NO: 201600 - protein, 20 aa, Mycobacterium bovis
KELERVRMASARAAATNAAA

SEQ ID NO: 201601 - protein, 27 aa, Mycobacterium bovis
KELFLGRFPLGLIHPFPKPSDAEEART

SEQ ID NO: 201602 - protein, 18 aa, Mycobacterium bovis
KELWRRMSAAGDIYLDNY

SEQ ID NO: 201603 - protein, 23 aa, Mycobacterium bovis
KEMQRTEGFTALIDANRGCFAAF

SEQ ID NO: 201604 - protein, 19 aa, Mycobacterium bovis
KENDGWRLITTQLNNERVM

SEQ ID NO: 201605 - protein, 18 aa, Mycobacterium bovis
KEPLYRLYELRLRQGLAA

SEQ ID NO: 201606 - protein, 22 aa, Mycobacterium bovis
KEPWFLDAYQRAWEWADAVHWR

SEQ ID NO: 201607 - protein, 22 aa, Mycobacterium bovis
KESRGVHALRARGALIRIGHDA

SEQ ID NO: 201608 - protein, 23 aa, Mycobacterium bovis
KEVKGFAGFPIGGRFLRAGNPAL

SEQ ID NO: 201609 - protein, 27 aa, Mycobacterium bovis
KEVLEYHWGPDWVCWDADQTFQQHGQH

SEQ ID NO: 201610 - protein, 22 aa, Mycobacterium bovis
KEVVAAHLVNLVWNGLTHLEAD

SEQ ID NO: 201611 - protein, 19 aa, Mycobacterium bovis
KEYLGWVTGPISWDHNTDL

SEQ ID NO: 201612 - protein, 29 aa, Mycobacterium bovis
KFARCSWRAGPCGMPILDDAAAWFIGRTA

SEQ ID NO: 201613 - protein, 24 aa, Mycobacterium bovis
KFGKSTGGGSLWLDPQMTSPYAWY

SEQ ID NO: 201614 - protein, 32 aa, Mycobacterium bovis; identical to SEQ ID NO: 81420

SEQ ID NO: 201615 - protein, 18 aa, Mycobacterium bovis
KFQLVEPVAGMSRAAGIV

SEQ ID NO: 201616 - protein, 18 aa, Mycobacterium bovis
KGAISSWKAFAPAHAGKV

SEQ ID NO: 201617 - protein, 20 aa, Mycobacterium bovis
KGANVAPPLTWSSPAGAAEL

SEQ ID NO: 201618 - protein, 20 aa, Mycobacterium bovis
KGASEGWCPYCGSPYSFLPQ

SEQ ID NO: 201619 - protein, 18 aa, Mycobacterium bovis
KGFKSFAAPTTLRFEPGI

SEQ ID NO: 201620 - protein, 32 aa, Mycobacterium bovis
KGGDGADAVNVVFMPTEPQAATGTAGSAGDPT

SEQ ID NO: 201621 - protein, 20 aa, Mycobacterium bovis
KGGGHKRAYRMIDFRRNDKD

SEQ ID NO: 201622 - protein, 24 aa, Mycobacterium bovis
KGGPGMREMLAITGAIKGAGLGKD

SEQ ID NO: 201623 - protein, 18 aa, Mycobacterium bovis
KGHPVVRQGASYVVTGGL

SEQ ID NO: 201624 - protein, 23 aa, Mycobacterium bovis
KGIALQFKRRYPEMFTAYEKACK

SEQ ID NO: 201625 - protein, 19 aa, Mycobacterium bovis
KGISIRRAPGPSWYHFTLN

SEQ ID NO: 201626 - protein, 18 aa, Mycobacterium bovis
KGKAAVICSETTATTPDG

SEQ ID NO: 201627 - protein, 33 aa, Mycobacterium bovis
KGLEVIETHLLFGIPYDRIDVVVHPQSIIHSMV

SEQ ID NO: 201628 - protein, 20 aa, Mycobacterium bovis
KGLPGARARRRGLSDSALGT

SEQ ID NO: 201629 - protein, 21 aa, Mycobacterium bovis
KGLPLPFGATLTFCSRADADK

SEQ ID NO: 201630 - protein, 20 aa, Mycobacterium bovis
KGLPVRAGWIHLPCLPSVAA

SEQ ID NO: 201631 - protein, 24 aa, Mycobacterium bovis
KGLQFPIVYLPFAFNRNVRSDDIL

SEQ ID NO: 201632 - protein, 18 aa, Mycobacterium bovis
KGLRLRATDLDWTIGTGP

SEQ ID NO: 201633 - protein, 22 aa, Mycobacterium bovis
KGMPNRIKWTIVRYKPPEGMTL

SEQ ID NO: 201634 - protein, 32 aa, Mycobacterium bovis
KGNPDYGLRLSWNFLARSTAGLWEWAERLGDE

SEQ ID NO: 201635 - protein, 17 aa, Mycobacterium bovis
KGQLLSLHLGRLKDRVG

SEQ ID NO: 201636 - protein, 17 aa, Mycobacterium bovis
KGQQVAWIRQVDGQQTV

SEQ ID NO: 201637 - protein, 19 aa, Mycobacterium bovis
KGQVFDWAPGVTLSLGLAA

SEQ ID NO: 201638 - protein, 23 aa, Mycobacterium bovis
KGRAALQKAVPLWRGVQAEVTAS

SEQ ID NO: 201639 - protein, 19 aa, Mycobacterium bovis
KGRGRRALESLPRGLALQI

SEQ ID NO: 201640 - protein, 22 aa, Mycobacterium bovis
KGSPQRRGVCTRVYTTTPKKPN

SEQ ID NO: 201641 - protein, 20 aa, Mycobacterium bovis
KGTSGMRKNELIAAIEEIRR

SEQ ID NO: 201642 - protein, 18 aa, Mycobacterium bovis
KGVDAVVVPGGFSYGDYL

SEQ ID NO: 201643 - protein, 18 aa, Mycobacterium bovis
KHAFDVCYYPCLDTTRGR

SEQ ID NO: 201644 - protein, 27 aa, Mycobacterium bovis
KHGAKMVTAVACARVPKLTVVIGGSYG

SEQ ID NO: 201645 - protein, 27 aa, Mycobacterium bovis
KHLVLAGARSPVSFFAYPGMPSDLVPA

SEQ ID NO: 201646 - protein, 18 aa, Mycobacterium bovis
KHMGVMFGAPGGDYCHAL

SEQ ID NO: 201647 - protein, 19 aa, Mycobacterium bovis
KHRMADLYVTIAAARAVVA

SEQ ID NO: 201648 - protein, 25 aa, Mycobacterium bovis
KHTPLKMCWVPGYSDYYPEAPGGRP

SEQ ID NO: 201649 - protein, 20 aa, Mycobacterium bovis
KHTQVFRMWLDAVGISEDLH

SEQ ID NO: 201650 - protein, 21 aa, Mycobacterium bovis
KHYRSRFVFFGSGYYNYDEGY

SEQ ID NO: 201651 - protein, 20 aa, Mycobacterium bovis
KIAAACVEFVFGPLLNNPHR

SEQ ID NO: 201652 - protein, 25 aa, Mycobacterium bovis
KIARRIEADIVRRGWPIGASLGSES

SEQ ID NO: 201653 - protein, 19 aa, Mycobacterium bovis
KIFRTRALRVPGVGTGAPG

SEQ ID NO: 201654 - protein, 23 aa, Mycobacterium bovis
KIGWACGPAELIAGVRAAKQYLS

SEQ ID NO: 201655 - protein, 18 aa, Mycobacterium bovis
KIKEKLGIGAVVTDDPSN

SEQ ID NO: 201656 - protein, 25 aa, Mycobacterium bovis
KINEPRFPSFKGIMAAKKKEVTVLT

SEQ ID NO: 201657 - protein, 19 aa, Mycobacterium bovis
KIRLGRFASGATHWAEGET

SEQ ID NO: 201658 - protein, 20 aa, Mycobacterium bovis
KIRPSDVYRPIGEVWDEINR

SEQ ID NO: 201659 - protein, 19 aa, Mycobacterium bovis
KITVLCCAKDAKKRALHGA

SEQ ID NO: 201660 - protein, 22 aa, Mycobacterium bovis
KKCGHLGGKVLIPTQQHIRTLT

SEQ ID NO: 201661 - protein, 20 aa, Mycobacterium bovis
KKFYTSLFGWGYDDNPVPGG

SEQ ID NO: 201662 - protein, 22 aa, Mycobacterium bovis
KLADLALDIGRSVGCSAYENDF

SEQ ID NO: 201663 - protein, 23 aa, Mycobacterium bovis
KLAELRERLELAKEPGGEKAAAK

SEQ ID NO: 201664 - protein, 23 aa, Mycobacterium bovis
KLAGLPRLTWRADAWHRQRAALA

SEQ ID NO: 201665 - protein, 17 aa, Mycobacterium bovis
KLAINYGLNKVRFPAPV

SEQ ID NO: 201666 - protein, 24 aa, Mycobacterium bovis
KLAQEYTYRYLAAALTWFVDDADA

SEQ ID NO: 201667 - protein, 18 aa, Mycobacterium bovis
KLAWPADLQVGPDGLGNS

SEQ ID NO: 201668 - protein, 31 aa, Mycobacterium bovis
KLDDLAERVGWRWRLVWYRAVAELLTGDYDS

SEQ ID NO: 201669 - protein, 20 aa, Mycobacterium bovis
KLDRSRPLWELWVIEGVEGG

SEQ ID NO: 201670 - protein, 28 aa, Mycobacterium bovis
KLEETFMFYLPRICEHCLNPSCVASCPS

SEQ ID NO: 201671 - protein, 18 aa, Mycobacterium bovis
KLFESVLKGHVKVLVGRK

SEQ ID NO: 201672 - protein, 18 aa, Mycobacterium bovis
KLFGLSRERVRQIERDVM

SEQ ID NO: 201673 - protein, 19 aa, Mycobacterium bovis
KLFGPRNQAPLSFPIPGWN

SEQ ID NO: 201674 - protein, 17 aa, Mycobacterium bovis
KLGKSVAIVERGRMLGG

SEQ ID NO: 201675 - protein, 19 aa, Mycobacterium bovis
KLGPDFLVELLEIRAALGP

SEQ ID NO: 201676 - protein, 19 aa, Mycobacterium bovis
KLGRRWHRETVYGVAVRGY

SEQ ID NO: 201677 - protein, 17 aa, Mycobacterium bovis
KLGWLDRVVSPEPVLTT

SEQ ID NO: 201678 - protein, 17 aa, Mycobacterium bovis
KLGYTVAPMEQRAELVV

SEQ ID NO: 201679 - protein, 17 aa, Mycobacterium bovis
KLIADKMFEEFKEPHYG

SEQ ID NO: 201680 - protein, 19 aa, Mycobacterium bovis
KLKELIPRQQFEVPVQAAI

SEQ ID NO: 201681 - protein, 24 aa, Mycobacterium bovis
KLKWQRSDPEFAYSDRERDGLLEA

SEQ ID NO: 201682 - protein, 18 aa, Mycobacterium bovis
KLLFKKGIHLLDCGTSGG

SEQ ID NO: 201683 - protein, 24 aa, Mycobacterium bovis
KLLYKEDCRGFGWLPNIQNRAFLF

SEQ ID NO: 201684 - protein, 26 aa, Mycobacterium bovis
KLNVSGGVLYRFAVDPDRSAQFLLVV

SEQ ID NO: 201685 - protein, 24 aa, Mycobacterium bovis
KLPVANWPALGGMGNASWTQLSGH

SEQ ID NO: 201686 - protein, 20 aa, Mycobacterium bovis
KLQHKMVYRHSGYPGGLHKR

SEQ ID NO: 201687 - protein, 24 aa, Mycobacterium bovis
KLQLWVAACLYRYFVDQHEFLYGP

SEQ ID NO: 201688 - protein, 24 aa, Mycobacterium bovis
KLQPARYRQLLQHILQHVADGKLE

SEQ ID NO: 201689 - protein, 25 aa, Mycobacterium bovis
KLRALKRLKVVAAFQQSGNSPMGMV

SEQ ID NO: 201690 - protein, 20 aa, Mycobacterium bovis
KLRGEGMVGLEPHRGHVVLP

SEQ ID NO: 201691 - protein, 22 aa, Mycobacterium bovis
KLRHGLPGAVFVSARTGDGIDA

SEQ ID NO: 201692 - protein, 25 aa, Mycobacterium bovis
KLRSPISISTGVLWRDPTAGVVKAG

SEQ ID NO: 201693 - protein, 23 aa, Mycobacterium bovis
KLSEPVAVVGMGCRYPGGVDSPE

SEQ ID NO: 201694 - protein, 30 aa, Mycobacterium bovis
KLSFETARFIKFIVTEIFPGGRLPSTEMMV

SEQ ID NO: 201695 - protein, 18 aa, Mycobacterium bovis
KLTCRGRDLPTAVSRARR

SEQ ID NO: 201696 - protein, 18 aa, Mycobacterium bovis
KLTGVPMLGISVLGEAHD

SEQ ID NO: 201697 - protein, 24 aa, Mycobacterium bovis
KLVLRRRGGYCFEHNGLMGYVLAE

SEQ ID NO: 201698 - protein, 25 aa, Mycobacterium bovis
KLYGYKWPTLDGMFAPHASDVVFDI

SEQ ID NO: 201699 - protein, 18 aa, Mycobacterium bovis
KMIIAGWSAYPRQLDFAR

SEQ ID NO: 201700 - protein, 18 aa, Mycobacterium bovis
KMMSSMLGGMGIPGIGRK

SEQ ID NO: 201701 - protein, 19 aa, Mycobacterium bovis
KMTVYRLVHNGELPAVRVG

SEQ ID NO: 201702 - protein, 25 aa, Mycobacterium bovis
KNATRFGMQDVIWRGAYYTPNGART

SEQ ID NO: 201703 - protein, 23 aa, Mycobacterium bovis
KNGIEPCIARAKAYAPFADLIWM

SEQ ID NO: 201704 - protein, 21 aa, Mycobacterium bovis
KNGTRKGRRVGFPRFKSGRRD

SEQ ID NO: 201705 - protein, 19 aa, Mycobacterium bovis
KNPDCAICGDAPTITELVD

SEQ ID NO: 201706 - protein, 26 aa, Mycobacterium bovis
KNVAFGPQCRRGMFGSGRARTRASAL

SEQ ID NO: 201707 - protein, 26 aa, Mycobacterium bovis
KNVDAFLAVCRKWEVLATVIGEVTDG

SEQ ID NO: 201708 - protein, 24 aa, Mycobacterium bovis
KNYVSRLLAKLGMERRTQAAVFAT

SEQ ID NO: 201709 - protein, 24 aa, Mycobacterium bovis
KPDGLPLFRECLAPGTSISHRVVV

SEQ ID NO: 201710 - protein, 20 aa, Mycobacterium bovis
KPGDHVVCSFIPNCGTCRYC

SEQ ID NO: 201711 - protein, 28 aa, Mycobacterium bovis
KPGVLARVAALFSRRGFNIESLAVGATE

SEQ ID NO: 201712 - protein, 17 aa, Mycobacterium bovis
KPLGGVTAIGVWGARHA

SEQ ID NO: 201713 - protein, 17 aa, Mycobacterium bovis
KPLPNPFIVAATQNPIE

SEQ ID NO: 201714 - protein, 25 aa, Mycobacterium bovis
KPLQNLAGLPAWLASGAPAAAMTAA

SEQ ID NO: 201715 - protein, 25 aa, Mycobacterium bovis
KPNRKCLRITVGGGRNKVTATFFNA

SEQ ID NO: 201716 - protein, 20 aa, Mycobacterium bovis
KPPWPYTFNLCVSNVPGPED

SEQ ID NO: 201717 - protein, 19 aa, Mycobacterium bovis
KPRFGHGVVTELGAGVRLL

SEQ ID NO: 201718 - protein, 22 aa, Mycobacterium bovis
KPRPGRIVFVGSGPGDPGLLTT

SEQ ID NO: 201719 - protein, 17 aa, Mycobacterium bovis
KPSFYTGRGTFSLRLSE

SEQ ID NO: 201720 - protein, 26 aa, Mycobacterium bovis
KPSRGRLPLEPEYRRLPVGIVANGVL

SEQ ID NO: 201721 - protein, 17 aa, Mycobacterium bovis
KPTEFRPSRFLDGSVAP

SEQ ID NO: 201722 - protein, 24 aa, Mycobacterium bovis
KPTLAGAVPTIWNDVMHYLEKDPD

SEQ ID NO: 201723 - protein, 33 aa, Mycobacterium bovis
KPTSVPAFRPGAQFKAVVSGAQRLPAEGPAVKR

SEQ ID NO: 201724 - protein, 20 aa, Mycobacterium bovis
KPVLCRQMEVYAGFLEYTDH

SEQ ID NO: 201725 - protein, 19 aa, Mycobacterium bovis
KPVPVGVVGDVYYGGGPAV

SEQ ID NO: 201726 - protein, 21 aa, Mycobacterium bovis
KPWGSRFPLISIRDQVQADVA

SEQ ID NO: 201727 - protein, 27 aa, Mycobacterium bovis
KQAEAYRAISLLLRRPPGREAYPGDVF

SEQ ID NO: 201728 - protein, 19 aa, Mycobacterium bovis
KQARISTDIGAPGILDLRR

SEQ ID NO: 201729 - protein, 20 aa, Mycobacterium bovis
KQDGQWRIAYRRLRNDRLVS

SEQ ID NO: 201730 - protein, 25 aa, Mycobacterium bovis
KQEPVWRARCIVSAPWMGLAGVPSA

SEQ ID NO: 201731 - protein, 24 aa, Mycobacterium bovis
KQIGPRIVPIIPDEARTFGMDSWF

SEQ ID NO: 201732 - protein, 21 aa, Mycobacterium bovis
KQPDAVRHWNVDKADLDGLLD

SEQ ID NO: 201733 - protein, 25 aa, Mycobacterium bovis
KQPQRVLGLHFFNPVPVLPLVELVR

SEQ ID NO: 201734 - protein, 19 aa, Mycobacterium bovis
KQQLDHWARVGRAVSNQHT

SEQ ID NO: 201735 - protein, 22 aa, Mycobacterium bovis
KQRAFEVLDKMRLIDISNNLGD

SEQ ID NO: 201736 - protein, 25 aa, Mycobacterium bovis
KQRGEPVSCFLLRVEDNMESIGRSI

SEQ ID NO: 201737 - protein, 21 aa, Mycobacterium bovis
KQYKVAVGDVVKVEKLESEQG

SEQ ID NO: 201738 - protein, 22 aa, Mycobacterium bovis
KRAEDLLIRVNLGERMKHRPGD

SEQ ID NO: 201739 - protein, 19 aa, Mycobacterium bovis
KRAESSALFAMLSGQHAVD

SEQ ID NO: 201740 - protein, 19 aa, Mycobacterium bovis
KRAGTVLTLDDLVEAIGVD

SEQ ID NO: 201741 - protein, 18 aa, Mycobacterium bovis
KRARRETRQVLRRLIDGM

SEQ ID NO: 201742 - protein, 26 aa, Mycobacterium bovis
KRCLVPMDGWYEWRVDPDATPGRPNA

SEQ ID NO: 201743 - protein, 25 aa, Mycobacterium bovis
KRDSEWMGRVHRFLGLQVGVILATM

SEQ ID NO: 201744 - protein, 23 aa, Mycobacterium bovis
KRELDALGWRRSGAFREKDGRQL

SEQ ID NO: 201745 - protein, 20 aa, Mycobacterium bovis
KRFSLEGAESVIPMMDAAID

SEQ ID NO: 201746 - protein, 24 aa, Mycobacterium bovis
KRFVKGISAEAVFQKRAPANRPDW

SEQ ID NO: 201747 - protein, 18 aa, Mycobacterium bovis
KRKIIGRQFIRAFEGAVR

SEQ ID NO: 201748 - protein, 20 aa, Mycobacterium bovis
KRKVRFLPYGIAVSVLDDPV

SEQ ID NO: 201749 - protein, 19 aa, Mycobacterium bovis
KRLASPAQRIMLYAKDSGC

SEQ ID NO: 201750 - protein, 21 aa, Mycobacterium bovis
KRLCDPMAQQISTVWASSLPE

SEQ ID NO: 201751 - protein, 19 aa, Mycobacterium bovis
KRLGDGIMAVFRNPTVALR

SEQ ID NO: 201752 - protein, 21 aa, Mycobacterium bovis
KRMALPNARVLIHQPSLSGVI

SEQ ID NO: 201753 - protein, 20 aa, Mycobacterium bovis
KRMGIEAIYLGGWATSAKGS

SEQ ID NO: 201754 - protein, 19 aa, Mycobacterium bovis
KRNGWLSGLHATELLGAVQ

SEQ ID NO: 201755 - protein, 20 aa, Mycobacterium bovis
KRPEFGKLTPLYPNQRLRLE

SEQ ID NO: 201756 - protein, 25 aa, Mycobacterium bovis
KRPPECLYGSLKMWAHLQRQGFRWP

SEQ ID NO: 201757 - protein, 19 aa, Mycobacterium bovis
KRPTSGWGALTPTELEVAL

SEQ ID NO: 201758 - protein, 19 aa, Mycobacterium bovis
KRRDMLFDHVGALAATVMG

SEQ ID NO: 201759 - protein, 25 aa, Mycobacterium bovis
KRSPAGKPDYRWAKEQTEARPADDV

SEQ ID NO: 201760 - protein, 24 aa, Mycobacterium bovis
KRSPEEVRFLMGFNRDVVRRRRDT

SEQ ID NO: 201761 - protein, 25 aa, Mycobacterium bovis
KRTGELIPLCHPLGIEAVTVTLEPQ

SEQ ID NO: 201762 - protein, 17 aa, Mycobacterium bovis
KRVALVFSAYPTKHARI

SEQ ID NO: 201763 - protein, 33 aa, Mycobacterium bovis
KRWAYYPWRRMVVAILGPRGFRAVRLDRNRHLI

SEQ ID NO: 201764 - protein, 19 aa, Mycobacterium bovis
KRWRNLRKITIAQVHGAVL

SEQ ID NO: 201765 - protein, 17 aa, Mycobacterium bovis
KSAKWKVGEEAAFRQLG

SEQ ID NO: 201766 - protein, 26 aa, Mycobacterium bovis
KSASSLGLDGTEVFDITGIDVLNDGK

SEQ ID NO: 201767 - protein, 19 aa, Mycobacterium bovis
KSCEQRDNLSIKFVAHEGE

SEQ ID NO: 201768 - protein, 31 aa, Mycobacterium bovis
KSDLPRHIAVLCDGNRRWARSAGYDDVSYGY

SEQ ID NO: 201769 - protein, 20 aa, Mycobacterium bovis
KSDVLAGLFAVWHSLDALLD

SEQ ID NO: 201770 - protein, 23 aa, Mycobacterium bovis
KSEIEEALRYGVVKMNVDTDTQY

SEQ ID NO: 201771 - protein, 18 aa, Mycobacterium bovis
KSKDMALVLTDAAKALLA

SEQ ID NO: 201772 - protein, 27 aa, Mycobacterium bovis
KSKHPGDALFAFLRSMVLQWGATDRGL

SEQ ID NO: 201773 - protein, 23 aa, Mycobacterium bovis
KSLDDLRLFKALVDAASGYAGRQ

SEQ ID NO: 201774 - protein, 19 aa, Mycobacterium bovis
KSLHLILSHFQMPGFQVPE

SEQ ID NO: 201775 - protein, 17 aa, Mycobacterium bovis
KSLLEALLNPVPTGDLN

SEQ ID NO: 201776 - protein, 18 aa, Mycobacterium bovis
KSLYEKSGSVLIEEHKHS

SEQ ID NO: 201777 - protein, 27 aa, Mycobacterium bovis
KSPHLEAFKAKGYEVLLLTDPVDEVWV

SEQ ID NO: 201778 - protein, 17 aa, Mycobacterium bovis
KSPRLVKPEMLASARFR

SEQ ID NO: 201779 - protein, 19 aa, Mycobacterium bovis
KSRRFAYPPNLYVVDGGAP

SEQ ID NO: 201780 - protein, 20 aa, Mycobacterium bovis
KSTHFDWVLAPYDLTASRAH

SEQ ID NO: 201781 - protein, 19 aa, Mycobacterium bovis
KSTTLRILLGLVKADGGSV

SEQ ID NO: 201782 - protein, 18 aa, Mycobacterium bovis
KSVMPLRSSIHPVAPTLR

SEQ ID NO: 201783 - protein, 17 aa, Mycobacterium bovis
KSVYLCCRAALRHMVLA

SEQ ID NO: 201784 - protein, 17 aa, Mycobacterium bovis
KSYRFRRLELARFLAAL

SEQ ID NO: 201785 - protein, 17 aa, Mycobacterium bovis
KTAAFAIPMLSKIDITS

SEQ ID NO: 201786 - protein, 26 aa, Mycobacterium bovis
KTAHFCSMCGPKFCSMRITQDVREYA

SEQ ID NO: 201787 - protein, 23 aa, Mycobacterium bovis
KTALLRLVGRYGIGEDDVDDLLR

SEQ ID NO: 201788 - protein, 23 aa, Mycobacterium bovis
KTEPALDVLAGWLASRIEGPVRR

SEQ ID NO: 201789 - protein, 28 aa, Mycobacterium bovis
KTFVGAAARGGRRLVIAMMYGLVKEGGP

SEQ ID NO: 201790 - protein, 25 aa, Mycobacterium bovis
KTGKAEKCTLCYPRIEVGLPTVCSE

SEQ ID NO: 201791 - protein, 21 aa, Mycobacterium bovis
KTGLARLALHTGVPVIPVAMI

SEQ ID NO: 201792 - protein, 20 aa, Mycobacterium bovis
KTGMDVCLWLLRNDVCPDKL

SEQ ID NO: 201793 - protein, 30 aa, Mycobacterium bovis
KTIAEVVNGFGWRGPLGVTYPGVVTHGVVR

SEQ ID NO: 201794 - protein, 18 aa, Mycobacterium bovis
KTLKAVAVKGPYFGDRRK

SEQ ID NO: 201795 - protein, 26 aa, Mycobacterium bovis
KTPEGLRWLYNFIKAQGERNFGKIYV

SEQ ID NO: 201796 - protein, 24 aa, Mycobacterium bovis
KTRAEAMAALDIWRDRYPGAAALL

SEQ ID NO: 201797 - protein, 24 aa, Mycobacterium bovis
KTRARRDGPDWVITGGKMWITNGS

SEQ ID NO: 201798 - protein, 25 aa, Mycobacterium bovis
KTRELRVSPLVLKRTKIDNICYEMG

SEQ ID NO: 201799 - protein, 17 aa, Mycobacterium bovis
KTRGFPLGPGYLLDGLP

SEQ ID NO: 201800 - protein, 20 aa, Mycobacterium bovis
KTSFALRIAAELLRYHTVEQ

SEQ ID NO: 201801 - protein, 18 aa, Mycobacterium bovis
KTTALRMINRMVDPTSGT

SEQ ID NO: 201802 - protein, 23 aa, Mycobacterium bovis
KTVGETWGLPSPEEAAAAEAEVF

SEQ ID NO: 201803 - protein, 17 aa, Mycobacterium bovis
KTVKALLDVAGVMVTRF

SEQ ID NO: 201804 - protein, 18 aa, Mycobacterium bovis
KTVRGHLDGIVRMLESDA

SEQ ID NO: 201805 - protein, 22 aa, Mycobacterium bovis
KVAEGRVAGVHFLMKKNKITEI

SEQ ID NO: 201806 - protein, 21 aa, Mycobacterium bovis
KVAEVKSGFGPEYTVTDVTPR

SEQ ID NO: 201807 - protein, 19 aa, Mycobacterium bovis
KVAVASFFAKNFLPLLTST

SEQ ID NO: 201808 - protein, 26 aa, Mycobacterium bovis
KVDFAKAFWNVVNWADVQSRYAAATS

SEQ ID NO: 201809 - protein, 19 aa, Mycobacterium bovis
KVDGGWLLNGQKIWSSRAP

SEQ ID NO: 201810 - protein, 24 aa, Mycobacterium bovis
KVDRSAAYAMRWVAKNVVAAGLAE

SEQ ID NO: 201811 - protein, 18 aa, Mycobacterium bovis
KVFDAFPLTHYVECVALL

SEQ ID NO: 201812 - protein, 17 aa, Mycobacterium bovis
KVFRIGRLCTKRDARGQ

SEQ ID NO: 201813 - protein, 21 aa, Mycobacterium bovis
KVGLGSVRFLMSVGDLIIGWL

SEQ ID NO: 201814 - protein, 28 aa, Mycobacterium bovis
KVGLYCRNRIEIVIAMLGIVKAGAILVN

SEQ ID NO: 201815 - protein, 17 aa, Mycobacterium bovis
KVGPFALQDFSLFQVLR

SEQ ID NO: 201816 - protein, 26 aa, Mycobacterium bovis
KVIAQLRFPGYFLVVHDITRFCRDND

SEQ ID NO: 201817 - protein, 18 aa, Mycobacterium bovis
KVIGWAFERDRIPLGASV

SEQ ID NO: 201818 - protein, 26 aa, Mycobacterium bovis
KVIRALFRPPARRGGCVHPPGRRSRP

SEQ ID NO: 201819 - protein, 23 aa, Mycobacterium bovis
KVISRLLAGPALAFAQAKNAINA

SEQ ID NO: 201820 - protein, 18 aa, Mycobacterium bovis
KVLASRMVRDYVEHYYAP

SEQ ID NO: 201821 - protein, 24 aa, Mycobacterium bovis
KVLICGYGDVGKGCAEAMKGQGAR

SEQ ID NO: 201822 - protein, 24 aa, Mycobacterium bovis
KVLRLPRGEGLGVPASGYEIHHGR

SEQ ID NO: 201823 - protein, 17 aa, Mycobacterium bovis
KVLTEYNNKAALEPVNP

SEQ ID NO: 201824 - protein, 17 aa, Mycobacterium bovis
KVPGVLTARIVPGATAL

SEQ ID NO: 201825 - protein, 21 aa, Mycobacterium bovis
KVPSWISDIANIFNIGAGNWA

SEQ ID NO: 201826 - protein, 21 aa, Mycobacterium bovis
KVSELKPAFRPNGTVTAGNAC

SEQ ID NO: 201827 - protein, 21 aa, Mycobacterium bovis
KVSHPIVFGHAVRIFYKDAFA

SEQ ID NO: 201828 - protein, 19 aa, Mycobacterium bovis
KVSIEGGKITGERETDEGV

SEQ ID NO: 201829 - protein, 24 aa, Mycobacterium bovis
KVTSRPASPLTEWVARGTVDNIAF

SEQ ID NO: 201830 - protein, 20 aa, Mycobacterium bovis
KVVDDEFPGRVLLAEANQWP

SEQ ID NO: 201831 - protein, 19 aa, Mycobacterium bovis
KVVGCGALHVLWSDLGEIR

SEQ ID NO: 201832 - protein, 23 aa, Mycobacterium bovis
KVVREIVSGLGLKEAKDLVDGAP

SEQ ID NO: 201833 - protein, 18 aa, Mycobacterium bovis
KVWKGIRYAAPPLGDLRF

SEQ ID NO: 201834 - protein, 19 aa, Mycobacterium bovis
KVWRGETKLGETYDTVEIP

SEQ ID NO: 201835 - protein, 22 aa, Mycobacterium bovis
KVYLDLRVKVAKNWQRDPKQLG

SEQ ID NO: 201836 - protein, 22 aa, Mycobacterium bovis
KWDPGNLSMDWFRAEVAKDTRG

SEQ ID NO: 201837 - protein, 19 aa, Mycobacterium bovis
KYADWARSHMAAMSHLAVG

SEQ ID NO: 201838 - protein, 30 aa, Mycobacterium bovis
KYKKCHLGREALPLAERVDWLYAKASQHAL

SEQ ID NO: 201839 - protein, 24 aa, Mycobacterium bovis
KYKSQPWARLGVNVDADFEPLYII

SEQ ID NO: 201840 - protein, 24 aa, Mycobacterium bovis
KYLNRLSDLLFILSRVANPDGDVL

SEQ ID NO: 201841 - protein, 20 aa, Mycobacterium bovis
KYMKMITPAALLRCLVEGAD

SEQ ID NO: 201842 - protein, 20 aa, Mycobacterium bovis
KYPDRLTVLHWLESLQGLPS

SEQ ID NO: 201843 - protein, 25 aa, Mycobacterium bovis
KYTGLKLGGVYGFYPRFTGPQRSTV

SEQ ID NO: 201844 - protein, 18 aa, Mycobacterium bovis
KYVLKEYVGYVVEKRFNL

SEQ ID NO: 201845 - protein, 18 aa, Mycobacterium bovis
LAAAAAWDGLATELQSTA

SEQ ID NO: 201846 - protein, 22 aa, Mycobacterium bovis
LAAAAKGKWSLASVNVDVAPRV

SEQ ID NO: 201847 - protein, 24 aa, Mycobacterium bovis
LAAAFPGDGWLGSAADKYAGKNRN

SEQ ID NO: 201848 - protein, 19 aa, Mycobacterium bovis
LAAAGCGRIVLTARSQPNP

SEQ ID NO: 201849 - protein, 17 aa, Mycobacterium bovis
LAAAIDSDAAWQAPAND

SEQ ID NO: 201850 - protein, 24 aa, Mycobacterium bovis
LAAEAPGALFGEMALSSLAGRALA

SEQ ID NO: 201851 - protein, 24 aa, Mycobacterium bovis
LAAELCLPLVLVIDAAGPALSAAA

SEQ ID NO: 201852 - protein, 21 aa, Mycobacterium bovis
LAAEVMRRFGLTTKRAAVDLA

SEQ ID NO: 201853 - protein, 21 aa, Mycobacterium bovis
LAAGGLYRQWALARRAQGDLW

SEQ ID NO: 201854 - protein, 19 aa, Mycobacterium bovis
LAAGGYRLAISELTGAYWA

SEQ ID NO: 201855 - protein, 17 aa, Mycobacterium bovis
LAAGHGRVDVVDDQTGS

SEQ ID NO: 201856 - protein, 27 aa, Mycobacterium bovis
LAALDLCPRVRVNAIAPGSILTSALEV

SEQ ID NO: 201857 - protein, 23 aa, Mycobacterium bovis
LAALEAFFSAVVWTLVTEDIARI

SEQ ID NO: 201858 - protein, 23 aa, Mycobacterium bovis
LAAMPGNVFLPATTTRLPRDSVV

SEQ ID NO: 201859 - protein, 25 aa, Mycobacterium bovis
LAANARIALHVRVLYGRDPHHITEA

SEQ ID NO: 201860 - protein, 23 aa, Mycobacterium bovis
LAAPSLDIGIPWRQYLRVQQGIR

SEQ ID NO: 201861 - protein, 19 aa, Mycobacterium bovis
LAARCSFEQVAFLLWRGEL

SEQ ID NO: 201862 - protein, 25 aa, Mycobacterium bovis
LAARMACPYLNPGRYVQGRPLVQGM

SEQ ID NO: 201863 - protein, 24 aa, Mycobacterium bovis
LAARVGAPLVLRGIGVRRVTTDRG

SEQ ID NO: 201864 - protein, 17 aa, Mycobacterium bovis
LACAKLGAIAVMADGNL

SEQ ID NO: 201865 - protein, 26 aa, Mycobacterium bovis
LADAIRRSGLPKVPTSVLSRGVCGVA

SEQ ID NO: 201866 - protein, 19 aa, Mycobacterium bovis
LADAWARRLHIGRSELLRD

SEQ ID NO: 201867 - protein, 19 aa, Mycobacterium bovis
LADCGYAGATVRHLLDMRS

SEQ ID NO: 201868 - protein, 18 aa, Mycobacterium bovis
LADGLPAYGSCAGMILLA

SEQ ID NO: 201869 - protein, 29 aa, Mycobacterium bovis
LADGRELLFFSLPGPRTSGTAAERVARHA

SEQ ID NO: 201870 - protein, 19 aa, Mycobacterium bovis
LADHLLRSLAIIGAAAGAQ

SEQ ID NO: 201871 - protein, 25 aa, Mycobacterium bovis
LADHVVNGVVLFPGAGFVELVIRAG

SEQ ID NO: 201872 - protein, 25 aa, Mycobacterium bovis
LADLERRVADFLGFATVFNSVGQVY

SEQ ID NO: 201873 - protein, 24 aa, Mycobacterium bovis
LADLFLPRPLRWLAGATRSAVLRR

SEQ ID NO: 201874 - protein, 20 aa, Mycobacterium bovis
LADLRESGCLTASTRILRAD

SEQ ID NO: 201875 - protein, 22 aa, Mycobacterium bovis
LADPRRGFGMFTFVAASDVLGT

SEQ ID NO: 201876 - protein, 19 aa, Mycobacterium bovis
LADRGLRVLILDQENRANV

SEQ ID NO: 201877 - protein, 23 aa, Mycobacterium bovis
LADVRRYGATYANYVGKPLSYVL

SEQ ID NO: 201878 - protein, 24 aa, Mycobacterium bovis
LADYRGRRVIVYFYPAASTPGCTK

SEQ ID NO: 201879 - protein, 18 aa, Mycobacterium bovis
LAEALVCAAARETFEESG

SEQ ID NO: 201880 - protein, 24 aa, Mycobacterium bovis
LAEHAGRRLIGFSAELGGKNPMIV

SEQ ID NO: 201881 - protein, 22 aa, Mycobacterium bovis
LAEKPQATRIVAWTDEDHDLTV

SEQ ID NO: 201882 - protein, 20 aa, Mycobacterium bovis
LAELDRVWGHLPFGAQWYSA

SEQ ID NO: 201883 - protein, 30 aa, Mycobacterium bovis
LAELGYRVRRFAARVVWKLAPDAPLPPQTH

SEQ ID NO: 201884 - protein, 18 aa, Mycobacterium bovis
LAELTVRAVGGCHAVIHP

SEQ ID NO: 201885 - protein, 19 aa, Mycobacterium bovis
LAELWSRYHNVLVEGHRQY

SEQ ID NO: 201886 - protein, 23 aa, Mycobacterium bovis
LAEPRGYCAGVDRAVETVERALQ

SEQ ID NO: 201887 - protein, 24 aa, Mycobacterium bovis
LAERKRLASLAFQHIAEYDIAVAS

SEQ ID NO: 201888 - protein, 24 aa, Mycobacterium bovis
LAERLMEFFGGIPILDGIGSTEVG

SEQ ID NO: 201889 - protein, 23 aa, Mycobacterium bovis
LAERRGEAWFDPDGLILAFGDSP

SEQ ID NO: 201890 - protein, 17 aa, Mycobacterium bovis
LAERVEVQVAYAIGKAA

SEQ ID NO: 201891 - protein, 33 aa, Mycobacterium bovis
LAEYSLDLFALLPLGELWVAAARMRQVDQLQHT

SEQ ID NO: 201892 - protein, 30 aa, Mycobacterium bovis
LAEYWHRRIREELKFSGDRAMAAEDPEAKE

SEQ ID NO: 201893 - protein, 26 aa, Mycobacterium bovis
LAFPSLSSSVPILGPYEDLIANTVAN

SEQ ID NO: 201894 - protein, 23 aa, Mycobacterium bovis
LAFQCVDDLIGIWGDPGVTGKPV

SEQ ID NO: 201895 - protein, 18 aa, Mycobacterium bovis
LAGAQPILLGAGWEGGWR

SEQ ID NO: 201896 - protein, 19 aa, Mycobacterium bovis
LAGAWAAVRTFGWETRRLG

SEQ ID NO: 201897 - protein, 17 aa, Mycobacterium bovis
LAGCGYSVCDTADEISV

SEQ ID NO: 201898 - protein, 18 aa, Mycobacterium bovis
LAGDAWHGPASLAMTRAA

SEQ ID NO: 201899 - protein, 26 aa, Mycobacterium bovis
LAGELDRWVLRRACNEFSEWQSAGLG

SEQ ID NO: 201900 - protein, 23 aa, Mycobacterium bovis
LAGEPRPRIALAAPTGKAAARLA

SEQ ID NO: 201901 - protein, 21 aa, Mycobacterium bovis
LAGGARPGGRVMFYDDVAPVA

SEQ ID NO: 201902 - protein, 17 aa, Mycobacterium bovis
LAGGCFWGLQDLIRNQP

SEQ ID NO: 201903 - protein, 19 aa, Mycobacterium bovis
LAGGWLRANLPAVDAVLCS

SEQ ID NO: 201904 - protein, 20 aa, Mycobacterium bovis
LAGIRSALSASYAAAAGPTT

SEQ ID NO: 201905 - protein, 24 aa, Mycobacterium bovis
LAGLARAIADIAARARSGNLKPDE

SEQ ID NO: 201906 - protein, 25 aa, Mycobacterium bovis
LAGLCGALRRYHEALGVPISTLPMA

SEQ ID NO: 201907 - protein, 19 aa, Mycobacterium bovis
LAGLIDRIARDEVRHEEFF

SEQ ID NO: 201908 - protein, 24 aa, Mycobacterium bovis
LAGLKLLALGGRFIEIGKRDIYSN

SEQ ID NO: 201909 - protein, 20 aa, Mycobacterium bovis
LAGLLDEWTPVIAGAELGEH

SEQ ID NO: 201910 - protein, 24 aa, Mycobacterium bovis
LAGLRTVGDVVAYIQKLEEENPEA

SEQ ID NO: 201911 - protein, 24 aa, Mycobacterium bovis
LAGLSSPRIVGWIMRTDSSDLPWH

SEQ ID NO: 201912 - protein, 17 aa, Mycobacterium bovis
LAGPLVRSSYRAGRLYE

SEQ ID NO: 201913 - protein, 17 aa, Mycobacterium bovis
LAGQPLDRPFAWALIKL

SEQ ID NO: 201914 - protein, 38 aa, Mycobacterium bovis
LAGSDPLLAVPFSYPASLPTPFGPVTMTLNGSFDPLTQ

SEQ ID NO: 201915 - protein, 25 aa, Mycobacterium bovis
LAGSDSLREPVVWQRLHQVDPAHLW

SEQ ID NO: 201916 - protein, 21 aa, Mycobacterium bovis
LAGSVWNSGGCRSWYLDEHGK

SEQ ID NO: 201917 - protein, 23 aa, Mycobacterium bovis
LAHKLEWPSNVWMGVSVENVDAF

SEQ ID NO: 201918 - protein, 32 aa, Mycobacterium bovis
LAHLLKFDSILGRLPCDVGLEGDDTIVVGRAK

SEQ ID NO: 201919 - protein, 23 aa, Mycobacterium bovis
LAHPDRRLAVVFGAGGDRDPGKR

SEQ ID NO: 201920 - protein, 23 aa, Mycobacterium bovis
LAHQIHWLLLRFGVGSTVRDYDP

SEQ ID NO: 201921 - protein, 17 aa, Mycobacterium bovis
LAHVAGLHHRSVKIADL

SEQ ID NO: 201922 - protein, 18 aa, Mycobacterium bovis
LAHWTRLYPEVRVDRAIA

SEQ ID NO: 201923 - protein, 24 aa, Mycobacterium bovis
LAIELARSGAKVAISDVDTDGLAD

SEQ ID NO: 201924 - protein, 24 aa, Mycobacterium bovis
LAIFDRGKALALYHTKRLASPAQR

SEQ ID NO: 201925 - protein, 18 aa, Mycobacterium bovis
LAIGQRFVAEGARVVLGD

SEQ ID NO: 201926 - protein, 17 aa, Mycobacterium bovis
LAIPFDVVVAGVRRQPY

SEQ ID NO: 201927 - protein, 24 aa, Mycobacterium bovis
LAKAAELRYGRIPEVEKKLDAALP

SEQ ID NO: 201928 - protein, 28 aa, Mycobacterium bovis
LAKAMDRKVWLPSGGTLVIDRTEAMTVI

SEQ ID NO: 201929 - protein, 18 aa, Mycobacterium bovis
LAKLEGDAAFFWAPGGNT

SEQ ID NO: 201930 - protein, 17 aa, Mycobacterium bovis
LAKRGWVPLPQTRDMNP

SEQ ID NO: 201931 - protein, 19 aa, Mycobacterium bovis
LAKSLRIAAKIYSEADEAW

SEQ ID NO: 201932 - protein, 21 aa, Mycobacterium bovis
LAKTIKGYALGKHFEGRNATH

SEQ ID NO: 201933 - protein, 26 aa, Mycobacterium bovis
LALAAGERFGPDRVRTAENLRDAIDV

SEQ ID NO: 201934 - protein, 19 aa, Mycobacterium bovis
LALACDFILASDSAFFMLA

SEQ ID NO: 201935 - protein, 25 aa, Mycobacterium bovis
LALAHEVRMRWCGPEVEVEGIISLK

SEQ ID NO: 201936 - protein, 18 aa, Mycobacterium bovis
LALITIADLIEWRRKHEK

SEQ ID NO: 201937 - protein, 21 aa, Mycobacterium bovis
LALKPRKAFSPIRVAATGTTV

SEQ ID NO: 201938 - protein, 17 aa, Mycobacterium bovis
LALLEADVSLPVVRAFI

SEQ ID NO: 201939 - protein, 20 aa, Mycobacterium bovis
LALQEVRQILAIHDRGEAPC

SEQ ID NO: 201940 - protein, 33 aa, Mycobacterium bovis
LALRAEPALPRLLRRLVIMGGMFDGQPITEWNI

SEQ ID NO: 201941 - protein, 18 aa, Mycobacterium bovis
LALTALWRSYGVTPDAVI

SEQ ID NO: 201942 - protein, 24 aa, Mycobacterium bovis
LALVAQRRGYKCVFVCPDKVSEDK

SEQ ID NO: 201943 - protein, 28 aa, Mycobacterium bovis
LALVRPTELCFVPRIWDMVFAEFHSEVD

SEQ ID NO: 201944 - protein, 27 aa, Mycobacterium bovis
LAMLQRLVADGALWPVNGTAFAVTPTL

SEQ ID NO: 201945 - protein, 26 aa, Mycobacterium bovis
LAMLRRLMMDDSFFRGELIYVFDGDE

SEQ ID NO: 201946 - protein, 26 aa, Mycobacterium bovis
LAMSRELGVQFARQGIRVNALCPGPV

SEQ ID NO: 201947 - protein, 21 aa, Mycobacterium bovis
LANAIGYPIAASVALVTPAAG

SEQ ID NO: 201948 - protein, 19 aa, Mycobacterium bovis
LANHAFYYGALRGLSEADP

SEQ ID NO: 201949 - protein, 18 aa, Mycobacterium bovis
LANHLVDQGCDGLVVSGT

SEQ ID NO: 201950 - protein, 22 aa, Mycobacterium bovis
LANTGRPLIGNGANGAPGTGAD

SEQ ID NO: 201951 - protein, 22 aa, Mycobacterium bovis
LAPECCAVVAYGALLGGPLLAV

SEQ ID NO: 201952 - protein, 21 aa, Mycobacterium bovis
LAPEFRAMMQLEWSQAQQRRF

SEQ ID NO: 201953 - protein, 17 aa, Mycobacterium bovis
LAPEVPGELHAMMLDMR

SEQ ID NO: 201954 - protein, 18 aa, Mycobacterium bovis
LAPGPARCCVVLKRCSAH

SEQ ID NO: 201955 - protein, 17 aa, Mycobacterium bovis
LAPGTGLRDGLERILRG

SEQ ID NO: 201956 - protein, 19 aa, Mycobacterium bovis
LAPHALEWDAAKHFPVDVL

SEQ ID NO: 201957 - protein, 19 aa, Mycobacterium bovis
LAPLHGWGLDPYLTPGFTE

SEQ ID NO: 201958 - protein, 17 aa, Mycobacterium bovis
LAPLQCYVSVDIEDGYS

SEQ ID NO: 201959 - protein, 17 aa, Mycobacterium bovis
LAPMLDAAAAWDGLADE

SEQ ID NO: 201960 - protein, 18 aa, Mycobacterium bovis
LAPNFKGSILRYTTFTPK

SEQ ID NO: 201961 - protein, 17 aa, Mycobacterium bovis
LAPRFGVGIVATTGAHF

SEQ ID NO: 201962 - protein, 22 aa, Mycobacterium bovis
LAPRPALLVRRRLDLVAWATGL

SEQ ID NO: 201963 - protein, 24 aa, Mycobacterium bovis
LAPVRFFNPIAMRFAQKATREDID

SEQ ID NO: 201964 - protein, 19 aa, Mycobacterium bovis
LAQLCGKDVVLPMNSDAEA

SEQ ID NO: 201965 - protein, 23 aa, Mycobacterium bovis
LAQLRPQPILQLPDTNSGWRLVA

SEQ ID NO: 201966 - protein, 17 aa, Mycobacterium bovis
LAQRAVQVLRRLYDRVG

SEQ ID NO: 201967 - protein, 18 aa, Mycobacterium bovis
LAQRCFELLTPALTRYYP

SEQ ID NO: 201968 - protein, 21 aa, Mycobacterium bovis
LAQTEVIRLPDRITRERLDAV

SEQ ID NO: 201969 - protein, 24 aa, Mycobacterium bovis
LAQTRISGVLIDLRPYRPPDAARR

SEQ ID NO: 201970 - protein, 17 aa, Mycobacterium bovis
LARAAGLAIGDRGGVLT

SEQ ID NO: 201971 - protein, 26 aa, Mycobacterium bovis
LARAFLMYVTQRWPDVLSTAAEDLPP

SEQ ID NO: 201972 - protein, 22 aa, Mycobacterium bovis
LARALFGPGHPVPWERFADDYD

SEQ ID NO: 201973 - protein, 25 aa, Mycobacterium bovis
LARAWLYAIWHCWQDGAAYHPANHR

SEQ ID NO: 201974 - protein, 19 aa, Mycobacterium bovis
LARAWTRAAAQDMTGAIAA

SEQ ID NO: 201975 - protein, 17 aa, Mycobacterium bovis
LARAYGIEVSDFEDEPV

SEQ ID NO: 201976 - protein, 20 aa, Mycobacterium bovis
LAREDLSVWVVTGDGDALSI

SEQ ID NO: 201977 - protein, 22 aa, Mycobacterium bovis
LARELACAYDLDFVDPASNSRV

SEQ ID NO: 201978 - protein, 27 aa, Mycobacterium bovis
LARGDLALRMGLPVLAVVAFAQSFGDG

SEQ ID NO: 201979 - protein, 17 aa, Mycobacterium bovis
LARHHLHRFLPGASTRR

SEQ ID NO: 201980 - protein, 22 aa, Mycobacterium bovis
LARLKEVGVHIAIDDFGTGYSA

SEQ ID NO: 201981 - protein, 19 aa, Mycobacterium bovis
LARLSRMSVLGPLGESFGR

SEQ ID NO: 201982 - protein, 24 aa, Mycobacterium bovis
LARLWPSLLADRYGRGFSVARRLA

SEQ ID NO: 201983 - protein, 24 aa, Mycobacterium bovis
LARPKRYIAGFAVELEDESQLPAA

SEQ ID NO: 201984 - protein, 20 aa, Mycobacterium bovis
LARRTDLMFDQGLVEEVRTL

SEQ ID NO: 201985 - protein, 25 aa, Mycobacterium bovis
LASDPEGWIRCQLDGVPTEQSLRFT

SEQ ID NO: 201986 - protein, 18 aa, Mycobacterium bovis
LASDRGAGVLGFAGTAGK

SEQ ID NO: 201987 - protein, 18 aa, Mycobacterium bovis
LASGERFAGVAIDGGVQV

SEQ ID NO: 201988 - protein, 18 aa, Mycobacterium bovis
LASIPRGPVHIALPRDLV

SEQ ID NO: 201989 - protein, 18 aa, Mycobacterium bovis
LASIRSAINAANAAAAAQ

SEQ ID NO: 201990 - protein, 18 aa, Mycobacterium bovis
LASLHLVHDWNREFVRTS

SEQ ID NO: 201991 - protein, 18 aa, Mycobacterium bovis
LASMPGIDFDALYRGESP

SEQ ID NO: 201992 - protein, 17 aa, Mycobacterium bovis
LASQAWQGPAAAAMAAA

SEQ ID NO: 201993 - protein, 17 aa, Mycobacterium bovis
LASTLARELHDVDRLSA

SEQ ID NO: 201994 - protein, 20 aa, Mycobacterium bovis
LASVCGSTGWVSSIVGVHNW

SEQ ID NO: 201995 - protein, 18 aa, Mycobacterium bovis
LASWLQRLQSIPGAASLD

SEQ ID NO: 201996 - protein, 22 aa, Mycobacterium bovis
LATAAARMVTAWRRQRGQQTPA

SEQ ID NO: 201997 - protein, 26 aa, Mycobacterium bovis
LATALQSAAPWLAKSGGEFIVAGQSA

SEQ ID NO: 201998 - protein, 18 aa, Mycobacterium bovis
LATESWYLATLRDKPAVA

SEQ ID NO: 201999 - protein, 20 aa, Mycobacterium bovis
LATFRDAQGLTFPLLSDPDR

SEQ ID NO: 202000 - protein, 18 aa, Mycobacterium bovis
LATGLAVDFSSLKRRTRN

SEQ ID NO: 202001 - protein, 18 aa, Mycobacterium bovis
LATGWVLEEVHDFEEGEL

SEQ ID NO: 202002 - protein, 20 aa, Mycobacterium bovis
LATLLQHWGISPDFLIGHSV

SEQ ID NO: 202003 - protein, 24 aa, Mycobacterium bovis
LATMAGYHLGWWNADRSTAAGSSG

SEQ ID NO: 202004 - protein, 21 aa, Mycobacterium bovis
LATRRKIFIPILRVAAIEPHA

SEQ ID NO: 202005 - protein, 20 aa, Mycobacterium bovis
LATTKFRLERAINEAESAGG

SEQ ID NO: 202006 - protein, 18 aa, Mycobacterium bovis
LATTRWLVAILENHQRPD

SEQ ID NO: 202007 - protein, 25 aa, Mycobacterium bovis
LATVLSRNTFHWVLAFADSGLLTSA

SEQ ID NO: 202008 - protein, 19 aa, Mycobacterium bovis
LAVAASWFGSVTSGLADAA

SEQ ID NO: 202009 - protein, 24 aa, Mycobacterium bovis
LAVCGLRIGTGVSERDKHNRVLNE

SEQ ID NO: 202010 - protein, 19 aa, Mycobacterium bovis
LAVCLRALTTMPIPVIAAV

SEQ ID NO: 202011 - protein, 17 aa, Mycobacterium bovis
LAVDGCVPLDVDTWDDY

SEQ ID NO: 202012 - protein, 23 aa, Mycobacterium bovis
LAVDPRFAGVTGQYFAGAKAIRS

SEQ ID NO: 202013 - protein, 20 aa, Mycobacterium bovis
LAVLQRLVSRWDRPLRDVDI

SEQ ID NO: 202014 - protein, 25 aa, Mycobacterium bovis
LAVLTARHLDCWVLGTVCKGGKQGP

SEQ ID NO: 202015 - protein, 33 aa, Mycobacterium bovis
LAVPPHGWVNLHFSLLPAWRGAAPVQAAIAAGD

SEQ ID NO: 202016 - protein, 20 aa, Mycobacterium bovis
LAVQVLKLPRLKAVAHATDC

SEQ ID NO: 202017 - protein, 18 aa, Mycobacterium bovis
LAVSHAFHSLLMEPMLAE

SEQ ID NO: 202018 - protein, 17 aa, Mycobacterium bovis
LAYAGGVLFVAENPSRS

SEQ ID NO: 202019 - protein, 23 aa, Mycobacterium bovis
LAYGDMGLALPILAPGGVASALT

SEQ ID NO: 202020 - protein, 24 aa, Mycobacterium bovis
LAYMDLRPGTAMREIAVDAVFVGS

SEQ ID NO: 202021 - protein, 20 aa, Mycobacterium bovis
LCAMAKRYVTDTCFEVADQA

SEQ ID NO: 202022 - protein, 18 aa, Mycobacterium bovis
LCASRVPMSIAAIAGKLG

SEQ ID NO: 202023 - protein, 18 aa, Mycobacterium bovis
LCDHFLTISPGEYAKVAG

SEQ ID NO: 202024 - protein, 20 aa, Mycobacterium bovis
LCDIFARYDVTFSLGDGLRP

SEQ ID NO: 202025 - protein, 21 aa, Mycobacterium bovis
LCDKRKIPLLFLQNIAGFMVG

SEQ ID NO: 202026 - protein, 23 aa, Mycobacterium bovis
LCEIKDVQIRDGLHILGQNPTGE

SEQ ID NO: 202027 - protein, 19 aa, Mycobacterium bovis
LCELKDIIDRSAAAGDPCG

SEQ ID NO: 202028 - protein, 21 aa, Mycobacterium bovis
LCGIAAEWTRGAVKTVPPRWL

SEQ ID NO: 202029 - protein, 18 aa, Mycobacterium bovis
LCGPVAMVDAARTWLDHN

SEQ ID NO: 202030 - protein, 19 aa, Mycobacterium bovis
LCGYGPIPAAVARTMVASA

SEQ ID NO: 202031 - protein, 18 aa, Mycobacterium bovis
LCINPFFHNFGYKAGILA

SEQ ID NO: 202032 - protein, 21 aa, Mycobacterium bovis
LCMDNGMPILVFNLLTDGNIA

SEQ ID NO: 202033 - protein, 20 aa, Mycobacterium bovis
LCPDPGIADTAAILLAAEQI

SEQ ID NO: 202034 - protein, 27 aa, Mycobacterium bovis
LCPRRSRCTGCGVTHVLLPVSALLRRA

SEQ ID NO: 202035 - protein, 30 aa, Mycobacterium bovis
LCSERPAIHRFPGSMAKRIQALAQIIVDRY

SEQ ID NO: 202036 - protein, 27 aa, Mycobacterium bovis
LCTPIPHPDCDLDWMRLMHSDLGNFQR

SEQ ID NO: 202037 - protein, 29 aa, Mycobacterium bovis
LDAELRYKMCVDAVAFARHIGYSCAGTVE

SEQ ID NO: 202038 - protein, 20 aa, Mycobacterium bovis
LDAFSFPNISIVLPNIGINL

SEQ ID NO: 202039 - protein, 23 aa, Mycobacterium bovis
LDALTLSVLRSWLAATAGAGAAR

SEQ ID NO: 202040 - protein, 24 aa, Mycobacterium bovis
LDAMCRRLRSQGVRLVYETARRGT

SEQ ID NO: 202041 - protein, 17 aa, Mycobacterium bovis
LDAPPARIVVWAHNSHV

SEQ ID NO: 202042 - protein, 22 aa, Mycobacterium bovis
LDAPVVLGWAGFRDVAQRYSLG

SEQ ID NO: 202043 - protein, 18 aa, Mycobacterium bovis
LDAQRWARERAQRAVSGM

SEQ ID NO: 202044 - protein, 18 aa, Mycobacterium bovis
LDAQVGQMLGGWRGASGS

SEQ ID NO: 202045 - protein, 27 aa, Mycobacterium bovis
LDARAYRLPWPAGTVVYEIDQPQVIDF

SEQ ID NO: 202046 - protein, 26 aa, Mycobacterium bovis
LDARLRLVLEVPTLREVPTWHRLSSY

SEQ ID NO: 202047 - protein, 18 aa, Mycobacterium bovis
LDARQWFQSFPAVAGSSL

SEQ ID NO: 202048 - protein, 26 aa, Mycobacterium bovis
LDASTFLGRLALIRIYNGRIRKGQQV

SEQ ID NO: 202049 - protein, 30 aa, Mycobacterium bovis
LDATARFGLLPLRWALACLLIDIGTVTFSA

SEQ ID NO: 202050 - protein, 24 aa, Mycobacterium bovis
LDAVAEHYLHFGGVSPINGINRTL

SEQ ID NO: 202051 - protein, 24 aa, Mycobacterium bovis
LDAVPRMRGMLTLFEGVATGAADG

SEQ ID NO: 202052 - protein, 28 aa, Mycobacterium bovis
LDCPDFGLRLARWQGLGILGPVAVIARN

SEQ ID NO: 202053 - protein, 24 aa, Mycobacterium bovis
LDCSCPDYAVPCKHLAATFYLLAE

SEQ ID NO: 202054 - protein, 21 aa, Mycobacterium bovis
LDDARLASYDGVNRVNPPLRE

SEQ ID NO: 202055 - protein, 23 aa, Mycobacterium bovis
LDDEVRLALLIMLERLGPAERVV

SEQ ID NO: 202056 - protein, 19 aa, Mycobacterium bovis
LDDEVRWVLTKGKLPTSLW

SEQ ID NO: 202057 - protein, 26 aa, Mycobacterium bovis
LDDKGRLTLPAKFRDALAGGLMVTKS

SEQ ID NO: 202058 - protein, 18 aa, Mycobacterium bovis
LDDRCRWLAPVPGTDVAI

SEQ ID NO: 202059 - protein, 21 aa, Mycobacterium bovis
LDDRIRFSVFVSTDVSAKDLC

SEQ ID NO: 202060 - protein, 37 aa, Mycobacterium bovis
LDEARPTYAGGLLKIWNERNYRFWADLTEALKTGKAQ

SEQ ID NO: 202061 - protein, 18 aa, Mycobacterium bovis
LDELGLWERFAALPYSEV

SEQ ID NO: 202062 - protein, 23 aa, Mycobacterium bovis
LDERALFLGQWGLRGQRGGEGPS

SEQ ID NO: 202063 - protein, 21 aa, Mycobacterium bovis
LDFAGNADFAIAIRTALMRNG

SEQ ID NO: 202064 - protein, 24 aa, Mycobacterium bovis
LDFEPRTVWWGSANWTVRAGSHLE

SEQ ID NO: 202065 - protein, 17 aa, Mycobacterium bovis
LDFFKDPVKGFFRALDY

SEQ ID NO: 202066 - protein, 22 aa, Mycobacterium bovis
LDFMGCCAFAALADEAQRCRCR

SEQ ID NO: 202067 - protein, 28 aa, Mycobacterium bovis
LDFPELVIVCGHVGYPWTEEMVAVARKH

SEQ ID NO: 202068 - protein, 25 aa, Mycobacterium bovis
LDFRPKHKLAVLVVCAIPLAEPVRL

SEQ ID NO: 202069 - protein, 24 aa, Mycobacterium bovis
LDFRPKHRLAVLVVSAIPLAEPVR

SEQ ID NO: 202070 - protein, 21 aa, Mycobacterium bovis
LDFYRCAMLPASPDWKPGAVP

SEQ ID NO: 202071 - protein, 18 aa, Mycobacterium bovis
LDGARKVFKLVDALEDSD

SEQ ID NO: 202072 - protein, 19 aa, Mycobacterium bovis
LDGCAALIVALLGACPALR

SEQ ID NO: 202073 - protein, 24 aa, Mycobacterium bovis
LDGDARGGAALSVREVTGVPILFA

SEQ ID NO: 202074 - protein, 21 aa, Mycobacterium bovis
LDGFCSASLLVDRTSGRAVSS

SEQ ID NO: 202075 - protein, 20 aa, Mycobacterium bovis
LDGFCSASLMVDHPACRRAV

SEQ ID NO: 202076 - protein, 19 aa, Mycobacterium bovis
LDGGFGPVVLPPIPVPAVN

SEQ ID NO: 202077 - protein, 29 aa, Mycobacterium bovis
LDGLAAYRRSRGLAALSVAWGLWEQASAM

SEQ ID NO: 202078 - protein, 24 aa, Mycobacterium bovis
LDGLLELLPAGAWLDHTSDHAQAS

SEQ ID NO: 202079 - protein, 24 aa, Mycobacterium bovis
LDGQLRLSVRQVMWGADAGLLEST

SEQ ID NO: 202080 - protein, 18 aa, Mycobacterium bovis
LDGQRFLLTAGFFETHRP

SEQ ID NO: 202081 - protein, 25 aa, Mycobacterium bovis
LDGRADPGEIVWTWVAYEQDPTRGK

SEQ ID NO: 202082 - protein, 19 aa, Mycobacterium bovis
LDHACGLGTGGLFEEDVAE

SEQ ID NO: 202083 - protein, 18 aa, Mycobacterium bovis
LDHAMWFMRPFRADEWLL

SEQ ID NO: 202084 - protein, 22 aa, Mycobacterium bovis
LDHELRPVIITRGFTENPAGSV

SEQ ID NO: 202085 - protein, 18 aa, Mycobacterium bovis
LDHRGVGLSSRLAAITTL

SEQ ID NO: 202086 - protein, 23 aa, Mycobacterium bovis
LDHSLPYIFAVALQDGCWHHERS

SEQ ID NO: 202087 - protein, 19 aa, Mycobacterium bovis
LDHVREVVCEDSLGLAEEF

SEQ ID NO: 202088 - protein, 34 aa, Mycobacterium bovis
LDIAADGSFEWRLRPSAPGQLVIREVYGDWSQQR

SEQ ID NO: 202089 - protein, 17 aa, Mycobacterium bovis
LDICAPVSGSVTYPPAT

SEQ ID NO: 202090 - protein, 19 aa, Mycobacterium bovis
LDIGCGWGSTMRHAVAEYD

SEQ ID NO: 202091 - protein, 23 aa, Mycobacterium bovis
LDINVFGRRAGIAAASYAQGHDF

SEQ ID NO: 202092 - protein, 26 aa, Mycobacterium bovis
LDIWRRPDLAPGRRAPVLIQVPGGAW

SEQ ID NO: 202093 - protein, 23 aa, Mycobacterium bovis
LDKARPVLILTREVVRPHLTNVT

SEQ ID NO: 202094 - protein, 18 aa, Mycobacterium bovis
LDKLRIEALRNKDLEVDT

SEQ ID NO: 202095 - protein, 17 aa, Mycobacterium bovis
LDKVVGGAVPRQFIPSV

SEQ ID NO: 202096 - protein, 18 aa, Mycobacterium bovis
LDLAAGMDSAREWLRDRI

SEQ ID NO: 202097 - protein, 17 aa, Mycobacterium bovis
LDLAEVILQSPLDISRP

SEQ ID NO: 202098 - protein, 17 aa, Mycobacterium bovis
LDLERAMELCAPDECVE

SEQ ID NO: 202099 - protein, 22 aa, Mycobacterium bovis
LDLHAPVARYWPEFGQAGKQAI

SEQ ID NO: 202100 - protein, 25 aa, Mycobacterium bovis
LDLLPTVRGAFCLTFMDENTLYACR

SEQ ID NO: 202101 - protein, 19 aa, Mycobacterium bovis
LDLLRLGTYQLLRTRVDAH

SEQ ID NO: 202102 - protein, 26 aa, Mycobacterium bovis
LDLPVDWEPLGAIAIGYADEPSGLRD

SEQ ID NO: 202103 - protein, 17 aa, Mycobacterium bovis
LDLQEQFGLSYLFVSHD

SEQ ID NO: 202104 - protein, 20 aa, Mycobacterium bovis
LDLQGRRAAGTGARRVAVVR

SEQ ID NO: 202105 - protein, 26 aa, Mycobacterium bovis
LDLSKLARPTSTWTYMVNDNPLSDDT

SEQ ID NO: 202106 - protein, 21 aa, Mycobacterium bovis
LDLTSRFPLDPAVAAVDALIQ

SEQ ID NO: 202107 - protein, 25 aa, Mycobacterium bovis
LDLVKARFAGPVVVIELDMMFGSLE

SEQ ID NO: 202108 - protein, 18 aa, Mycobacterium bovis
LDLYSCAVYAGQLIIEHH

SEQ ID NO: 202109 - protein, 21 aa, Mycobacterium bovis
LDMFYNLGIAGRAMRRIGAVE

SEQ ID NO: 202110 - protein, 21 aa, Mycobacterium bovis
LDMVVGGAVLKHSRDFNLMRE

SEQ ID NO: 202111 - protein, 19 aa, Mycobacterium bovis
LDPDASLGAGWACGVTVVL

SEQ ID NO: 202112 - protein, 20 aa, Mycobacterium bovis
LDPDLLIGEMVFVPNPSARA

SEQ ID NO: 202113 - protein, 19 aa, Mycobacterium bovis
LDPDYRFNFGVAYDRSLLF

SEQ ID NO: 202114 - protein, 20 aa, Mycobacterium bovis
LDPGDLYDVLAINAASASTQ

SEQ ID NO: 202115 - protein, 17 aa, Mycobacterium bovis
LDPLDYVDYRWGTEEFA

SEQ ID NO: 202116 - protein, 21 aa, Mycobacterium bovis
LDPLFEVLEKHVPPPKGEPDA

SEQ ID NO: 202117 - protein, 19 aa, Mycobacterium bovis
LDPPFGIPATVWQKSLLPI

SEQ ID NO: 202118 - protein, 21 aa, Mycobacterium bovis
LDPPWSFGPAGERYEIEVRGS

SEQ ID NO: 202119 - protein, 26 aa, Mycobacterium bovis
LDPRGRGLMCAFSLPTTADRDELIRQ

SEQ ID NO: 202120 - protein, 20 aa, Mycobacterium bovis
LDPTMAYTCAYFEREDMTLE

SEQ ID NO: 202121 - protein, 18 aa, Mycobacterium bovis
LDPTWAIEEIVRRYIGKP

SEQ ID NO: 202122 - protein, 17 aa, Mycobacterium bovis
LDQALARTAVLGVQTNV

SEQ ID NO: 202123 - protein, 17 aa, Mycobacterium bovis
LDQEGRDDLALRIAVQP

SEQ ID NO: 202124 - protein, 18 aa, Mycobacterium bovis
LDQLQRPAPVYNMAVALR

SEQ ID NO: 202125 - protein, 27 aa, Mycobacterium bovis
LDQQRQWILHMAKLSAAMAKQAQYVAQ

SEQ ID NO: 202126 - protein, 27 aa, Mycobacterium bovis
LDQRCYRAQGFLFSRPVPGEAMRHMLS

SEQ ID NO: 202127 - protein, 18 aa, Mycobacterium bovis
LDQSVSLLHLQLILREGG

SEQ ID NO: 202128 - protein, 20 aa, Mycobacterium bovis
LDRAADLFCHAVGSTRPLTV

SEQ ID NO: 202129 - protein, 17 aa, Mycobacterium bovis
LDRCARLLADIAGGEVS

SEQ ID NO: 202130 - protein, 23 aa, Mycobacterium bovis
LDRFVQQRVDGVTLREEHIAGKP

SEQ ID NO: 202131 - protein, 22 aa, Mycobacterium bovis
LDRGPEMLSFVLKHTPLKMCWV

SEQ ID NO: 202132 - protein, 23 aa, Mycobacterium bovis
LDRHLRLPLRDVIWGADADLLDS

SEQ ID NO: 202133 - protein, 23 aa, Mycobacterium bovis
LDRHLRLPLRNVLWEGDEALLTS

SEQ ID NO: 202134 - protein, 19 aa, Mycobacterium bovis
LDRLAELGVSEIFGVPGDY

SEQ ID NO: 202135 - protein, 21 aa, Mycobacterium bovis
LDRLLAQKLPDGWDADLPHWE

SEQ ID NO: 202136 - protein, 21 aa, Mycobacterium bovis
LDRLYGYEVSPVLWKKVAPKL

SEQ ID NO: 202137 - protein, 19 aa, Mycobacterium bovis
LDRPFAWALIKLDGADTLL

SEQ ID NO: 202138 - protein, 25 aa, Mycobacterium bovis
LDRRGDGAPEFHLRSKRIRAHSTHL

SEQ ID NO: 202139 - protein, 17 aa, Mycobacterium bovis
LDRRLLLGMLAELPAGA

SEQ ID NO: 202140 - protein, 24 aa, Mycobacterium bovis
LDRRSRAAGWGIISNAAHPGLTKT

SEQ ID NO: 202141 - protein, 23 aa, Mycobacterium bovis
LDRVFKVDGFAGAQYKKLRDVLG

SEQ ID NO: 202142 - protein, 17 aa, Mycobacterium bovis
LDSDALAAVCPIFRDAE

SEQ ID NO: 202143 - protein, 27 aa, Mycobacterium bovis
LDSIRMMSLVGRWRRKGIAVDFATLAA

SEQ ID NO: 202144 - protein, 17 aa, Mycobacterium bovis
LDSLGPIFSELRDTGRE

SEQ ID NO: 202145 - protein, 24 aa, Mycobacterium bovis
LDSPELIRLAPRPAARTDPMLLAW

SEQ ID NO: 202146 - protein, 17 aa, Mycobacterium bovis
LDSPSLMVADMFAARTI

SEQ ID NO: 202147 - protein, 27 aa, Mycobacterium bovis
LDSRLRVLARREFAGMISVAIDSADGA

SEQ ID NO: 202148 - protein, 20 aa, Mycobacterium bovis
LDSWRNYQWHQLARAFLMYV

SEQ ID NO: 202149 - protein, 17 aa, Mycobacterium bovis
LDTAAVCIDTWVPADAL

SEQ ID NO: 202150 - protein, 29 aa, Mycobacterium bovis
LDTCLDKYARLFAWLGLWERHTDLAVIPV

SEQ ID NO: 202151 - protein, 31 aa, Mycobacterium bovis
LDTDSFYRPKRPGSYPIVLATYEIVCSKYPD

SEQ ID NO: 202152 - protein, 17 aa, Mycobacterium bovis
LDTEAIAVVQGDGAVSQ

SEQ ID NO: 202153 - protein, 17 aa, Mycobacterium bovis
LDTEDAWVAALRNSLRA

SEQ ID NO: 202154 - protein, 20 aa, Mycobacterium bovis
LDTSVAISWIGKETGREVVA

SEQ ID NO: 202155 - protein, 24 aa, Mycobacterium bovis
LDTWFSSALWPFSTLGWPDKTAEL

SEQ ID NO: 202156 - protein, 20 aa, Mycobacterium bovis
LDVADGARLVDSIEGEPGLG

SEQ ID NO: 202157 - protein, 18 aa, Mycobacterium bovis
LDVARMVLFGQVGRELVN

SEQ ID NO: 202158 - protein, 17 aa, Mycobacterium bovis
LDVDGRLICLVRAESDE

SEQ ID NO: 202159 - protein, 18 aa, Mycobacterium bovis
LDVEFSVSAGEVLAVLGP

SEQ ID NO: 202160 - protein, 31 aa, Mycobacterium bovis
LDVGCGDGLLAARLARRIPYVTAVDIDAPVL

SEQ ID NO: 202161 - protein, 19 aa, Mycobacterium bovis
LDVGCGWGSVMKRAVERYD

SEQ ID NO: 202162 - protein, 25 aa, Mycobacterium bovis
LDVKAIAAFSRWYAGEIDLHNPPAP

SEQ ID NO: 202163 - protein, 20 aa, Mycobacterium bovis
LDVLERMGLLAAAQEHKTRI

SEQ ID NO: 202164 - protein, 25 aa, Mycobacterium bovis
LDVMMPRLDGLEVCRQLRSTGDDLP

SEQ ID NO: 202165 - protein, 23 aa, Mycobacterium bovis
LDVRVAAVVTCVDCVRWLPQSLG

SEQ ID NO: 202166 - protein, 19 aa, Mycobacterium bovis
LDVVRLGRAIGVVYLPATE

SEQ ID NO: 202167 - protein, 27 aa, Mycobacterium bovis
LDVVRRARFAAAFTFQYSKRPGTPAAQ

SEQ ID NO: 202168 - protein, 30 aa, Mycobacterium bovis
LDYLQWLGIDCIWLPPFYDSPLRDGGYDIR

SEQ ID NO: 202169 - protein, 20 aa, Mycobacterium bovis
LEAAAKWREIVGPDNYFLEL

SEQ ID NO: 202170 - protein, 17 aa, Mycobacterium bovis
LEAEGHRILKLNIGNPA

SEQ ID NO: 202171 - protein, 17 aa, Mycobacterium bovis
LEAFANFGFPESHALSF

SEQ ID NO: 202172 - protein, 21 aa, Mycobacterium bovis
LEAIPRISRAQVMDALSSQAN

SEQ ID NO: 202173 - protein, 35 aa, Mycobacterium bovis
LEANLRLVVSLAKRYTGRGMAFLDLIQEGNLGLIR

SEQ ID NO: 202174 - protein, 18 aa, Mycobacterium bovis
LEAVRQFLNLDVPLFVES

SEQ ID NO: 202175 - protein, 17 aa, Mycobacterium bovis
LEDAFGFTETVDQLTAI

SEQ ID NO: 202176 - protein, 17 aa, Mycobacterium bovis
LEDEFDIAISFRDAQNI

SEQ ID NO: 202177 - protein, 18 aa, Mycobacterium bovis
LEDFDVFHPDRMASRILG

SEQ ID NO: 202178 - protein, 24 aa, Mycobacterium bovis
LEDGTTWRVEIERAHMEEDTGKLT

SEQ ID NO: 202179 - protein, 17 aa, Mycobacterium bovis
LEDLGWYVADNLPPQLI

SEQ ID NO: 202180 - protein, 29 aa, Mycobacterium bovis
LEDPVKISLMRRIKQSFDPAGILNPGVVF

SEQ ID NO: 202181 - protein, 20 aa, Mycobacterium bovis
LEDWWGRWLGRWTAEEHLHA

SEQ ID NO: 202182 - protein, 20 aa, Mycobacterium bovis
LEDYRRILAAGINIVGSGPV

SEQ ID NO: 202183 - protein, 18 aa, Mycobacterium bovis
LEEGARASFMPKPFGQHP

SEQ ID NO: 202184 - protein, 22 aa, Mycobacterium bovis
LEEGRVVLVAGFQGVSQDTKDV

SEQ ID NO: 202185 - protein, 22 aa, Mycobacterium bovis
LEELKALWFSEAAKYNGLPLAD

SEQ ID NO: 202186 - protein, 18 aa, Mycobacterium bovis
LEERAELDALKADGGSSW

SEQ ID NO: 202187 - protein, 21 aa, Mycobacterium bovis
LEERYVREWLGGMTTGQIVEY

SEQ ID NO: 202188 - protein, 20 aa, Mycobacterium bovis
LEEVLQWPAGTIARIRRGEP

SEQ ID NO: 202189 - protein, 21 aa, Mycobacterium bovis
LEFRVLRDRLFDTLAAAGGPE

SEQ ID NO: 202190 - protein, 17 aa, Mycobacterium bovis
LEFVPAADVDPMMFDRS

SEQ ID NO: 202191 - protein, 18 aa, Mycobacterium bovis
LEFYDLSHPWGHGAPAWP

SEQ ID NO: 202192 - protein, 32 aa, Mycobacterium bovis
LEGGKGRGTVAKWRLQATQSRVRDVQVNVDVA

SEQ ID NO: 202193 - protein, 21 aa, Mycobacterium bovis
LEGIGSALAAANRAAEAPTTG

SEQ ID NO: 202194 - protein, 19 aa, Mycobacterium bovis
LEGIPATGIANAFWEVLDR

SEQ ID NO: 202195 - protein, 21 aa, Mycobacterium bovis
LEGKSSLGRLGLLTHSTAGFI

SEQ ID NO: 202196 - protein, 19 aa, Mycobacterium bovis
LEGKTLPGIEVLSREQPTG

SEQ ID NO: 202197 - protein, 19 aa, Mycobacterium bovis
LEGLPGLRLIGLDRDPTAL

SEQ ID NO: 202198 - protein, 25 aa, Mycobacterium bovis
LEHPDRAVAVLAALPAWTGEPELAP

SEQ ID NO: 202199 - protein, 26 aa, Mycobacterium bovis
LEHYEKLEGVPLTFAGKINRLAIMVR

SEQ ID NO: 202200 - protein, 18 aa, Mycobacterium bovis
LEIALACHHRIAADVKGS

SEQ ID NO: 202201 - protein, 24 aa, Mycobacterium bovis
LEIDNLRAAFAFSRENGDTGHALL

SEQ ID NO: 202202 - protein, 23 aa, Mycobacterium bovis
LEIGTGWGELCIRAAARGAHIRS

SEQ ID NO: 202203 - protein, 18 aa, Mycobacterium bovis
LEILAQLLVLATGTRITY

SEQ ID NO: 202204 - protein, 17 aa, Mycobacterium bovis
LEILRRVRESDVYTPTL

SEQ ID NO: 202205 - protein, 20 aa, Mycobacterium bovis
LEIPVATALAAARAAQSADA

SEQ ID NO: 202206 - protein, 20 aa, Mycobacterium bovis
LELEGLRRWVPPHLDGYKPL

SEQ ID NO: 202207 - protein, 28 aa, Mycobacterium bovis
LELGFRSSIQREWQWRLSRGESLQNLQA

SEQ ID NO: 202208 - protein, 17 aa, Mycobacterium bovis
LELIKAHLPDVALLDYR

SEQ ID NO: 202209 - protein, 25 aa, Mycobacterium bovis
LELLNRLWPLVSLRCNFFTPTKKPV

SEQ ID NO: 202210 - protein, 23 aa, Mycobacterium bovis
LELLPFRRNLAFYGLDLGLMSVS

SEQ ID NO: 202211 - protein, 25 aa, Mycobacterium bovis
LELPDIKCVYWAGGNPFHHHQNLPR

SEQ ID NO: 202212 - protein, 21 aa, Mycobacterium bovis
LELPPAGSYDDFCRRQHTFSS

SEQ ID NO: 202213 - protein, 33 aa, Mycobacterium bovis
LELRNRLEASLGITLPVALVWAYPTISDLATAL

SEQ ID NO: 202214 - protein, 20 aa, Mycobacterium bovis
LELTLHPGVMTGYAHGELAD

SEQ ID NO: 202215 - protein, 18 aa, Mycobacterium bovis
LEMEGPTLGRPVVDKVND

SEQ ID NO: 202216 - protein, 20 aa, Mycobacterium bovis
LEMKDLLVVGDIPGFADSLL

SEQ ID NO: 202217 - protein, 19 aa, Mycobacterium bovis
LEMNTRLQVEHPVTEETTG

SEQ ID NO: 202218 - protein, 17 aa, Mycobacterium bovis
LEMTKWFDTNYHYLVPE

SEQ ID NO: 202219 - protein, 23 aa, Mycobacterium bovis
LEPEFVAQGGFSLRDVIAGGKEL

SEQ ID NO: 202220 - protein, 24 aa, Mycobacterium bovis
LEPGYGLRIGYFAQEHDTLDNDAT

SEQ ID NO: 202221 - protein, 23 aa, Mycobacterium bovis
LEPRRFASGSALGMLSATGRCHA

SEQ ID NO: 202222 - protein, 21 aa, Mycobacterium bovis
LEPTFRRSVIYIVEHNDGGTL

SEQ ID NO: 202223 - protein, 20 aa, Mycobacterium bovis
LEQELACFLGKPAAVLCSTG

SEQ ID NO: 202224 - protein, 20 aa, Mycobacterium bovis
LERAYRMGLVSAEARTKLYK

SEQ ID NO: 202225 - protein, 20 aa, Mycobacterium bovis
LERDISWEALVCGGVTALPV

SEQ ID NO: 202226 - protein, 18 aa, Mycobacterium bovis
LEREPEIRCALKHPPKSP

SEQ ID NO: 202227 - protein, 24 aa, Mycobacterium bovis
LERIGFAAQHIWDGSARRVLAHAT

SEQ ID NO: 202228 - protein, 24 aa, Mycobacterium bovis
LERLGKVWAAMAITEPEFGSDSAA

SEQ ID NO: 202229 - protein, 21 aa, Mycobacterium bovis
LERLRGAIAVARNIPADLHRQ

SEQ ID NO: 202230 - protein, 18 aa, Mycobacterium bovis
LERLRPGDFYRPAHQNVY

SEQ ID NO: 202231 - protein, 20 aa, Mycobacterium bovis
LERRERLGGTWDLFRYPGVR

SEQ ID NO: 202232 - protein, 17 aa, Mycobacterium bovis
LERRILLSRVPELPEHF

SEQ ID NO: 202233 - protein, 35 aa, Mycobacterium bovis
LERRQGLKVSIPEEVAWRMGWIDDEQLVQRARALV

SEQ ID NO: 202234 - protein, 19 aa, Mycobacterium bovis
LERTFPLALSALIQEAIAA

SEQ ID NO: 202235 - protein, 34 aa, Mycobacterium bovis
LESAGRGRARIEFKLRDWLFARQRYWGEPFPIVY

SEQ ID NO: 202236 - protein, 24 aa, Mycobacterium bovis
LESARELDVWLPVHPVTRRRWPNG

SEQ ID NO: 202237 - protein, 22 aa, Mycobacterium bovis
LESRLDNVIYRAGLARTRRMAR

SEQ ID NO: 202238 - protein, 20 aa, Mycobacterium bovis
LESTMRFLLSAKSAYVDGQV

SEQ ID NO: 202239 - protein, 24 aa, Mycobacterium bovis
LETHRFDFCFIGAGYEDQVDEFLT

SEQ ID NO: 202240 - protein, 19 aa, Mycobacterium bovis
LETLAAHWGVPQQRPHDAF

SEQ ID NO: 202241 - protein, 17 aa, Mycobacterium bovis
LETLRKLAHDCGVADHV

SEQ ID NO: 202242 - protein, 17 aa, Mycobacterium bovis
LEVDGGLTFPNLDLPIP

SEQ ID NO: 202243 - protein, 22 aa, Mycobacterium bovis
LEVEPFEAMIVFVRTKQATEEI

SEQ ID NO: 202244 - protein, 20 aa, Mycobacterium bovis
LEVLEGRGAGPLKDYVYIDV

SEQ ID NO: 202245 - protein, 17 aa, Mycobacterium bovis
LEVSCGAGGGASYIARN

SEQ ID NO: 202246 - protein, 21 aa, Mycobacterium bovis
LEVTTRLAAPLLPLITEIIWR

SEQ ID NO: 202247 - protein, 17 aa, Mycobacterium bovis
LEYAIGRTCSAAWSVNG

SEQ ID NO: 202248 - protein, 25 aa, Mycobacterium bovis
LFDEMLIELDIHFRIEDDLYYPALS

SEQ ID NO: 202249 - protein, 24 aa, Mycobacterium bovis
LFDGSDTVTLVWLGQRRIPGIDTG

SEQ ID NO: 202250 - protein, 26 aa, Mycobacterium bovis
LFDRIAGHRRFRFYLNVEIGKHLGHA

SEQ ID NO: 202251 - protein, 28 aa, Mycobacterium bovis
LFESALDPCTRCWELGPDGQWTASPQEG

SEQ ID NO: 202252 - protein, 17 aa, Mycobacterium bovis
LFFEWLTDHGFRAFAGH

SEQ ID NO: 202253 - protein, 26 aa, Mycobacterium bovis
LFFSLPWYYRSGYDVLLYTLPFHGQR

SEQ ID NO: 202254 - protein, 30 aa, Mycobacterium bovis
LFGPGGLGTFSWPGAYGTWWQADPSADLIL

SEQ ID NO: 202255 - protein, 56 aa, Mycobacterium bovis
LFGVRLVKLLYRLERPLLFALQCMPLNWVRRRHGLSSLGWNLCRIFTDGDHTLYAD

SEQ ID NO: 202256 - protein, 19 aa, Mycobacterium bovis
LFHAGEPADSIYIVDSGRF

SEQ ID NO: 202257 - protein, 25 aa, Mycobacterium bovis
LFHARAKLRRKGCDLLVVNAVGEGR

SEQ ID NO: 202258 - protein, 25 aa, Mycobacterium bovis
LFIMGRIKDLLIVDGRNHYPDDIEA

SEQ ID NO: 202259 - protein, 24 aa, Mycobacterium bovis
LFKHLHRAGLRRVFIGVETGSYEQ

SEQ ID NO: 202260 - protein, 17 aa, Mycobacterium bovis
LFLFHLLEYMDVDYELD

SEQ ID NO: 202261 - protein, 24 aa, Mycobacterium bovis
LFLIPPEHAHKLVFAVLRGVAAVA

SEQ ID NO: 202262 - protein, 17 aa, Mycobacterium bovis
LFLPSNTIAPFLGLLGG

SEQ ID NO: 202263 - protein, 17 aa, Mycobacterium bovis
LFNPGHGNTGFLNAGSF

SEQ ID NO: 202264 - protein, 22 aa, Mycobacterium bovis
LFPGGEGRLRLTEPDDMLTTGI

SEQ ID NO: 202265 - protein, 25 aa, Mycobacterium bovis
LFPKLNPRIPRIWNITSLPSEMALA

SEQ ID NO: 202266 - protein, 19 aa, Mycobacterium bovis
LFQSHMWDGSAVPIDENLA

SEQ ID NO: 202267 - protein, 18 aa, Mycobacterium bovis
LFRRYWPADLHMIGKDII

SEQ ID NO: 202268 - protein, 18 aa, Mycobacterium bovis
LFRYPGVRSDSSIFTLSF

SEQ ID NO: 202269 - protein, 19 aa, Mycobacterium bovis
LFSHVPWLASQLLGAVEAY

SEQ ID NO: 202270 - protein, 27 aa, Mycobacterium bovis
LFTGDCLFPGGVGKTWQPADFTQLLDD

SEQ ID NO: 202271 - protein, 21 aa, Mycobacterium bovis
LGAALGEYGRRVLLVDMDPQG

SEQ ID NO: 202272 - protein, 19 aa, Mycobacterium bovis
LGAALWRGVELVVASMGGV

SEQ ID NO: 202273 - protein, 19 aa, Mycobacterium bovis
LGAAVAAAWALEHPDRAVA

SEQ ID NO: 202274 - protein, 18 aa, Mycobacterium bovis
LGADLLAVVARLNRLATQ

SEQ ID NO: 202275 - protein, 37 aa, Mycobacterium bovis
LGADWPRLVAPVFDPKKAVVFDDRWASAREDLVKLWL

SEQ ID NO: 202276 - protein, 19 aa, Mycobacterium bovis
LGAELGAPVIQGSTRTSER

SEQ ID NO: 202277 - protein, 20 aa, Mycobacterium bovis
LGAGLDWKTSLQELTAARGL

SEQ ID NO: 202278 - protein, 24 aa, Mycobacterium bovis
LGAGWACGVTVVLPPPGTVGAVDC

SEQ ID NO: 202279 - protein, 24 aa, Mycobacterium bovis
LGAHCNIEHGCVVARAETLRGAEI

SEQ ID NO: 202280 - protein, 17 aa, Mycobacterium bovis
LGALIANGAAMTRVPAR

SEQ ID NO: 202281 - protein, 22 aa, Mycobacterium bovis
LGALRMLAGDVIEMATGEGKTL

SEQ ID NO: 202282 - protein, 22 aa, Mycobacterium bovis
LGALSRRYPHRVFDSGIAEQHL

SEQ ID NO: 202283 - protein, 20 aa, Mycobacterium bovis
LGAMTPMFVGFRAREIVLTL

SEQ ID NO: 202284 - protein, 20 aa, Mycobacterium bovis
LGAPCWIDLTTSDVDRAQDF

SEQ ID NO: 202285 - protein, 21 aa, Mycobacterium bovis
LGARWSDTFARDQHPDVQMDY

SEQ ID NO: 202286 - protein, 17 aa, Mycobacterium bovis
LGATCGGIRVWSLYVPN

SEQ ID NO: 202287 - protein, 24 aa, Mycobacterium bovis
LGAVLDRLAVYRARSVDIDGCTYR

SEQ ID NO: 202288 - protein, 18 aa, Mycobacterium bovis
LGAVPRVLVWDGEGAIGR

SEQ ID NO: 202289 - protein, 18 aa, Mycobacterium bovis
LGCDLDLVELAGLAHDIG

SEQ ID NO: 202290 - protein, 21 aa, Mycobacterium bovis
LGDDLPVAWKHRSERYTEKLA

SEQ ID NO: 202291 - protein, 19 aa, Mycobacterium bovis
LGDGVGRLARCVVEQAGRG

SEQ ID NO: 202292 - protein, 19 aa, Mycobacterium bovis
LGDRTELRSLAASYGTAPA

SEQ ID NO: 202293 - protein, 24 aa, Mycobacterium bovis
LGDRWTLLIVRELLFGPLRFTEIE

SEQ ID NO: 202294 - protein, 17 aa, Mycobacterium bovis
LGDYFLAGYAVRSGDTA

SEQ ID NO: 202295 - protein, 17 aa, Mycobacterium bovis
LGEAKIEADRRLHVADE

SEQ ID NO: 202296 - protein, 19 aa, Mycobacterium bovis
LGEALGFDVDTPWRKLPAK

SEQ ID NO: 202297 - protein, 32 aa, Mycobacterium bovis
LGEGPARAWERGRFAAPYLRDSLLAAGALCET

SEQ ID NO: 202298 - protein, 24 aa, Mycobacterium bovis
LGELRPGSRVNLERAAALGSRLGG

SEQ ID NO: 202299 - protein, 21 aa, Mycobacterium bovis
LGEQFMQWFLQEQIEEVALMA

SEQ ID NO: 202300 - protein, 25 aa, Mycobacterium bovis
LGERPTVVCLSRLVPRKGQDTLVTA

SEQ ID NO: 202301 - protein, 18 aa, Mycobacterium bovis
LGESRTALAAALETQDGP

SEQ ID NO: 202302 - protein, 17 aa, Mycobacterium bovis
LGEVLRRYPKVVAPELN

SEQ ID NO: 202303 - protein, 18 aa, Mycobacterium bovis
LGEVNPRLSGASPMTNLT

SEQ ID NO: 202304 - protein, 17 aa, Mycobacterium bovis
LGFVEAQGGGTILLARG

SEQ ID NO: 202305 - protein, 23 aa, Mycobacterium bovis
LGGAGGGGGWLYGDGGAGGHGGQ

SEQ ID NO: 202306 - protein, 19 aa, Mycobacterium bovis
LGGCSTALFPAGGSTGSLL

SEQ ID NO: 202307 - protein, 17 aa, Mycobacterium bovis
LGGDGFGVLEQVAVLVA

SEQ ID NO: 202308 - protein, 34 aa, Mycobacterium bovis
LGGDGGKGGFADEFTGGFAQGGRGGFGGNGNTGA

SEQ ID NO: 202309 - protein, 20 aa, Mycobacterium bovis
LGGGAIRAALRGDLHLHSNW

SEQ ID NO: 202310 - protein, 27 aa, Mycobacterium bovis
LGGGFARYSVDGAWVVPHFEKMLYDNA

SEQ ID NO: 202311 - protein, 28 aa, Mycobacterium bovis
LGGGKRLRPLFAYWGWHAVASREPDPDV

SEQ ID NO: 202312 - protein, 18 aa, Mycobacterium bovis
LGGHIWADGGIRHPRDVA

SEQ ID NO: 202313 - protein, 30 aa, Mycobacterium bovis
LGGKGGSGGLIGRAGSDGGVGAGGAGGAGG

SEQ ID NO: 202314 - protein, 24 aa, Mycobacterium bovis
LGGKLPFALAERLHISRGEASRRI

SEQ ID NO: 202315 - protein, 21 aa, Mycobacterium bovis
LGGLGGQLIGLDGSNAPVSTS

SEQ ID NO: 202316 - protein, 18 aa, Mycobacterium bovis
LGGMDYLSPERVELRYTM

SEQ ID NO: 202317 - protein, 18 aa, Mycobacterium bovis
LGGPSHRLELLGARCSLT

SEQ ID NO: 202318 - protein, 17 aa, Mycobacterium bovis
LGGRAGYYDGIGAARDV

SEQ ID NO: 202319 - protein, 26 aa, Mycobacterium bovis
LGGRWADSFGGLVFDATGITEPAGLK

SEQ ID NO: 202320 - protein, 18 aa, Mycobacterium bovis
LGGTIGWADPETGSAFGY

SEQ ID NO: 202321 - protein, 21 aa, Mycobacterium bovis
LGGTLCCALANRLRITKPDAA

SEQ ID NO: 202322 - protein, 24 aa, Mycobacterium bovis
LGGTRTAVMMGVYFNEYQSMLAAS

SEQ ID NO: 202323 - protein, 29 aa, Mycobacterium bovis
LGGTSLRRSYTLLRPGGRLVGYGISNMQH

SEQ ID NO: 202324 - protein, 17 aa, Mycobacterium bovis
LGGVLYLFVRGMCGAAT

SEQ ID NO: 202325 - protein, 28 aa, Mycobacterium bovis
LGIEFPIFAFTHCRDVVVAVSKAGGFGV

SEQ ID NO: 202326 - protein, 19 aa, Mycobacterium bovis
LGIVPLLLLDMWEHAFYLQ

SEQ ID NO: 202327 - protein, 20 aa, Mycobacterium bovis
LGKQRPGSVRALRSNEIGQL

SEQ ID NO: 202328 - protein, 18 aa, Mycobacterium bovis
LGLARAYVSGDLQAHGVH

SEQ ID NO: 202329 - protein, 17 aa, Mycobacterium bovis
LGLDFLRHIERCAVLVH

SEQ ID NO: 202330 - protein, 20 aa, Mycobacterium bovis
LGLDHCFGPVMLHRVEATVR

SEQ ID NO: 202331 - protein, 18 aa, Mycobacterium bovis
LGLDSVRFVLLMKQLGVN

SEQ ID NO: 202332 - protein, 17 aa, Mycobacterium bovis
LGLFEINEAASLVQDAA

SEQ ID NO: 202333 - protein, 25 aa, Mycobacterium bovis
LGLGAIKPRPVVVGGEVVARPTMTL

SEQ ID NO: 202334 - protein, 25 aa, Mycobacterium bovis
LGLIDPDAWAFVWVVDPPLFEPADE

SEQ ID NO: 202335 - protein, 23 aa, Mycobacterium bovis
LGLIKVVLALKHGVVPRNLHFTR

SEQ ID NO: 202336 - protein, 18 aa, Mycobacterium bovis
LGLRWPSTVAPFDVHLVI

SEQ ID NO: 202337 - protein, 19 aa, Mycobacterium bovis
LGLSGATLRRGAVAAVVAA

SEQ ID NO: 202338 - protein, 19 aa, Mycobacterium bovis
LGLVRLHIATVLGNITPEA

SEQ ID NO: 202339 - protein, 24 aa, Mycobacterium bovis
LGMGSELYAAYPVFAEALDAVVDE

SEQ ID NO: 202340 - protein, 21 aa, Mycobacterium bovis
LGNALGAVAQWVGLQDDHDAF

SEQ ID NO: 202341 - protein, 21 aa, Mycobacterium bovis
LGNWFRAAGYDTHYDGKWHIS

SEQ ID NO: 202342 - protein, 19 aa, Mycobacterium bovis
LGPAGRFASIYDRVHAWAS

SEQ ID NO: 202343 - protein, 17 aa, Mycobacterium bovis
LGPARLDEVAPRAAAVV

SEQ ID NO: 202344 - protein, 32 aa, Mycobacterium bovis
LGPDRLPGVRLWLYTNFHCNLCCDYCCVSSSP

SEQ ID NO: 202345 - protein, 17 aa, Mycobacterium bovis
LGPHEFLSFIEGRAAMF

SEQ ID NO: 202346 - protein, 19 aa, Mycobacterium bovis
LGPINITSAPGFGNSTTTP

SEQ ID NO: 202347 - protein, 23 aa, Mycobacterium bovis
LGPKFWAQDAIAVMDAVGCEQAT

SEQ ID NO: 202348 - protein, 17 aa, Mycobacterium bovis
LGPNGIGVLYGRRELLA

SEQ ID NO: 202349 - protein, 23 aa, Mycobacterium bovis
LGPSGKRPGAIAERVKKTWELGE

SEQ ID NO: 202350 - protein, 18 aa, Mycobacterium bovis
LGQFQFALELAEQVSTTN

SEQ ID NO: 202351 - protein, 18 aa, Mycobacterium bovis
LGQRALRFVTDPDSGRTM

SEQ ID NO: 202352 - protein, 21 aa, Mycobacterium bovis
LGRDDVCYVSMPLFHSNAVLV

SEQ ID NO: 202353 - protein, 22 aa, Mycobacterium bovis
LGRIKTILCGSERVHPATLKRF

SEQ ID NO: 202354 - protein, 20 aa, Mycobacterium bovis
LGRLVACDLIGMGASDKLSP

SEQ ID NO: 202355 - protein, 17 aa, Mycobacterium bovis
LGRMIGAAFEISRDIIA

SEQ ID NO: 202356 - protein, 21 aa, Mycobacterium bovis
LGRTEIRRLAKELDFRPRKSL

SEQ ID NO: 202357 - protein, 17 aa, Mycobacterium bovis
LGSDVPFALHGGTALGT

SEQ ID NO: 202358 - protein, 18 aa, Mycobacterium bovis
LGSHASFDLTVRATGDVE

SEQ ID NO: 202359 - protein, 27 aa, Mycobacterium bovis
LGSKMNRFFLRGALVARLLSQSAWKQY

SEQ ID NO: 202360 - protein, 24 aa, Mycobacterium bovis
LGSLDDFRGTLCVPGDPDYPRVRA

SEQ ID NO: 202361 - protein, 22 aa, Mycobacterium bovis
LGSLVAGSRYRGDFEERLKKVL

SEQ ID NO: 202362 - protein, 17 aa, Mycobacterium bovis
LGSMISAANSAAAAQTT

SEQ ID NO: 202363 - protein, 19 aa, Mycobacterium bovis
LGSVPSRILCAGKLRQSIQ

SEQ ID NO: 202364 - protein, 19 aa, Mycobacterium bovis
LGTASFALGNARRALVESL

SEQ ID NO: 202365 - protein, 27 aa, Mycobacterium bovis
LGTDRSWRPDVVHAHDWLVAHPAIALA

SEQ ID NO: 202366 - protein, 18 aa, Mycobacterium bovis
LGTEHLVGTTLNVLAHPC

SEQ ID NO: 202367 - protein, 19 aa, Mycobacterium bovis
LGTLPNLTWSRLKVNVAVT

SEQ ID NO: 202368 - protein, 17 aa, Mycobacterium bovis
LGTLTWRQLDERGNALA

SEQ ID NO: 202369 - protein, 18 aa, Mycobacterium bovis
LGTNGYRVLDRVEDGARV

SEQ ID NO: 202370 - protein, 28 aa, Mycobacterium bovis
LGTQAAAFHERFIQALSTAAGAYGSAEA

SEQ ID NO: 202371 - protein, 20 aa, Mycobacterium bovis
LGTQGAWTGSQWLMVEEAAN

SEQ ID NO: 202372 - protein, 20 aa, Mycobacterium bovis
LGVAYGYPGAPGQWWQQQVV

SEQ ID NO: 202373 - protein, 17 aa, Mycobacterium bovis
LGVCVGMQILFACGVEF

SEQ ID NO: 202374 - protein, 19 aa, Mycobacterium bovis
LGVEAARVRMLRSFDPRSG

SEQ ID NO: 202375 - protein, 19 aa, Mycobacterium bovis
LGVEASLRSLARVAPTQRH

SEQ ID NO: 202376 - protein, 20 aa, Mycobacterium bovis
LGVLPARVAECLAAIEAPLV

SEQ ID NO: 202377 - protein, 21 aa, Mycobacterium bovis
LGVPTFRMLRALRGFDPDVVH

SEQ ID NO: 202378 - protein, 23 aa, Mycobacterium bovis
LGVPVLGICYGFQAMAQALGGIV

SEQ ID NO: 202379 - protein, 24 aa, Mycobacterium bovis
LGVSRPAVREALKRLSAAGLVEVR

SEQ ID NO: 202380 - protein, 29 aa, Mycobacterium bovis
LGWAGGSELGFRLAFAEGYSHAMTLNNDT

SEQ ID NO: 202381 - protein, 17 aa, Mycobacterium bovis
LGWRAQHSQSHYAAAKA

SEQ ID NO: 202382 - protein, 19 aa, Mycobacterium bovis
LGWVRELGEIIGRDGDPVR

SEQ ID NO: 202383 - protein, 21 aa, Mycobacterium bovis
LGYKLPSLLLPIWDSELGAGL

SEQ ID NO: 202384 - protein, 17 aa, Mycobacterium bovis
LGYLLYRVGAVLRPEVS

SEQ ID NO: 202385 - protein, 19 aa, Mycobacterium bovis
LGYQRCRVADGMVYGEGSS

SEQ ID NO: 202386 - protein, 19 aa, Mycobacterium bovis
LHAELARRDPAAAAAILPT

SEQ ID NO: 202387 - protein, 25 aa, Mycobacterium bovis
LHAGGAGRVRARFASAGADAISVDV

SEQ ID NO: 202388 - protein, 20 aa, Mycobacterium bovis
LHAHVLLQRDVHYIVRDDAV

SEQ ID NO: 202389 - protein, 26 aa, Mycobacterium bovis
LHAIAKLAPQRLIVVLGHDHQRIAPL

SEQ ID NO: 202390 - protein, 19 aa, Mycobacterium bovis
LHAPTRLALLTGLAPHQVT

SEQ ID NO: 202391 - protein, 34 aa, Mycobacterium bovis
LHAWSDMGPLDFPRLNWAPIEWRNLEDEQEKMLA

SEQ ID NO: 202392 - protein, 23 aa, Mycobacterium bovis
LHDRFRLLTGGSRIAVRRQQTMR

SEQ ID NO: 202393 - protein, 18 aa, Mycobacterium bovis
LHEAELQLAEFIGLDEVK

SEQ ID NO: 202394 - protein, 18 aa, Mycobacterium bovis
LHEVKPLSLVVGLIDELR

SEQ ID NO: 202395 - protein, 22 aa, Mycobacterium bovis
LHGGRISGRYALIRTNGDRWLA

SEQ ID NO: 202396 - protein, 17 aa, Mycobacterium bovis
LHGGYGYMREYPVARAY

SEQ ID NO: 202397 - protein, 18 aa, Mycobacterium bovis
LHGICRWGGSDSCDRTTV

SEQ ID NO: 202398 - protein, 25 aa, Mycobacterium bovis
LHGNHPVRLFIGSGMPTGLWERVVE

SEQ ID NO: 202399 - protein, 18 aa, Mycobacterium bovis
LHGRIEVDEPYVLILPTY

SEQ ID NO: 202400 - protein, 18 aa, Mycobacterium bovis
LHGVVHCAGGSQTIGPIT

SEQ ID NO: 202401 - protein, 25 aa, Mycobacterium bovis
LHGWQWRLDDGRCLTARGHQLRSSR

SEQ ID NO: 202402 - protein, 19 aa, Mycobacterium bovis
LHHALALAGRHLRRHAGAQ

SEQ ID NO: 202403 - protein, 23 aa, Mycobacterium bovis
LHHPPMRTFLGVPVRIRDEVFGN

SEQ ID NO: 202404 - protein, 20 aa, Mycobacterium bovis
LHIPRTTWYDGVRFEEVSVG

SEQ ID NO: 202405 - protein, 26 aa, Mycobacterium bovis
LHKQRTGLPHVTWKYATSIDGRSAAA

SEQ ID NO: 202406 - protein, 17 aa, Mycobacterium bovis
LHLALKAFRPGRLPFPV

SEQ ID NO: 202407 - protein, 17 aa, Mycobacterium bovis
LHLDILVDRMRREFKVE

SEQ ID NO: 202408 - protein, 20 aa, Mycobacterium bovis
LHLDLRFVNGKSWLVFGPYA

SEQ ID NO: 202409 - protein, 23 aa, Mycobacterium bovis
LHLVDFPVTLGIRPNIPQEDLRD

SEQ ID NO: 202410 - protein, 22 aa, Mycobacterium bovis
LHPEYRTMPMVWYIPPLSPVVD

SEQ ID NO: 202411 - protein, 24 aa, Mycobacterium bovis
LHPLSAPMTLRWLTDRFAGKPLTD

SEQ ID NO: 202412 - protein, 25 aa, Mycobacterium bovis
LHPNAIAALGIREWDAVSLTGSRTT

SEQ ID NO: 202413 - protein, 19 aa, Mycobacterium bovis
LHPPGIDFGPALLADVQVA

SEQ ID NO: 202414 - protein, 21 aa, Mycobacterium bovis
LHPRALAAYRRAAGRTRHDAP

SEQ ID NO: 202415 - protein, 33 aa, Mycobacterium bovis; identical to SEQ ID NO: 81998

SEQ ID NO: 202416 - protein, 20 aa, Mycobacterium bovis
LHQLGTVWVRRHLPNVALFH

SEQ ID NO: 202417 - protein, 19 aa, Mycobacterium bovis
LHQLRRAAPEVDFRAVNDR

SEQ ID NO: 202418 - protein, 21 aa, Mycobacterium bovis
LHQTYLRLGHSVDLIEPISGL

SEQ ID NO: 202419 - protein, 17 aa, Mycobacterium bovis
LHRAVVVAVARRKDLLD

SEQ ID NO: 202420 - protein, 23 aa, Mycobacterium bovis
LHREELDAFVVRRLNLPFRDVDW

SEQ ID NO: 202421 - protein, 19 aa, Mycobacterium bovis
LHRHGFAGATVLLGVDGTA

SEQ ID NO: 202422 - protein, 24 aa, Mycobacterium bovis
LHRLGRPVFGPSFEVEVDTDLRIR

SEQ ID NO: 202423 - protein, 19 aa, Mycobacterium bovis
LHTARLALCQATRQVIANG

SEQ ID NO: 202424 - protein, 20 aa, Mycobacterium bovis
LHTEECRKLGLAFAADPSQQ

SEQ ID NO: 202425 - protein, 27 aa, Mycobacterium bovis
LHTHLPWLAHHGRWPVGEEWLYQSWAA

SEQ ID NO: 202426 - protein, 31 aa, Mycobacterium bovis
LHVRIASPPVKWPCFYGIDFPSPAELIANAV

SEQ ID NO: 202427 - protein, 25 aa, Mycobacterium bovis
LHWEEVPGCDPAVFTMATVPSRLAD

SEQ ID NO: 202428 - protein, 17 aa, Mycobacterium bovis
LIADGVVDTRAFSKNSD

SEQ ID NO: 202429 - protein, 17 aa, Mycobacterium bovis
LIAEEALTLMAGAATLV

SEQ ID NO: 202430 - protein, 20 aa, Mycobacterium bovis
LIAGVARYDGTPGTIADQDV

SEQ ID NO: 202431 - protein, 19 aa, Mycobacterium bovis
LIAQLRPPPTFAEVSFATY

SEQ ID NO: 202432 - protein, 20 aa, Mycobacterium bovis
LIARRVREARVFSEVIPHTA

SEQ ID NO: 202433 - protein, 18 aa, Mycobacterium bovis
LIDAVKFTPALTGPHARL

SEQ ID NO: 202434 - protein, 27 aa, Mycobacterium bovis
LIDGARLAELLVRYRVGVQAVQTVELL

SEQ ID NO: 202435 - protein, 21 aa, Mycobacterium bovis
LIDYSGLRVCEYLPGKAIVMQ

SEQ ID NO: 202436 - protein, 28 aa, Mycobacterium bovis
LIEESIYGWKEFELELMRDGHDNVVVVC

SEQ ID NO: 202437 - protein, 18 aa, Mycobacterium bovis
LIEPGVRTGIPLLVDNPK

SEQ ID NO: 202438 - protein, 18 aa, Mycobacterium bovis
LIERGHRVAVLAVDPSST

SEQ ID NO: 202439 - protein, 18 aa, Mycobacterium bovis
LIERIEAEYARYFTPTGR

SEQ ID NO: 202440 - protein, 18 aa, Mycobacterium bovis
LIERIQGGWLEFDAAIAA

SEQ ID NO: 202441 - protein, 20 aa, Mycobacterium bovis
LIERLQRPTLVMAPNKTLAA

SEQ ID NO: 202442 - protein, 17 aa, Mycobacterium bovis
LIGDGRDGWVGGKTPIN

SEQ ID NO: 202443 - protein, 21 aa, Mycobacterium bovis
LIGQFGIGFYSSFMVADKVQL

SEQ ID NO: 202444 - protein, 21 aa, Mycobacterium bovis
LIKNIEVAARVGGGDPAGNPT

SEQ ID NO: 202445 - protein, 22 aa, Mycobacterium bovis
LIMDSLRYWVIEMHVDGFRFDL

SEQ ID NO: 202446 - protein, 31 aa, Mycobacterium bovis
LINAPTQTLLGRPLIGDGANATTPGGAGGDG

SEQ ID NO: 202447 - protein, 18 aa, Mycobacterium bovis
LINIHHSFLPAFTGAAPY

SEQ ID NO: 202448 - protein, 25 aa, Mycobacterium bovis
LINPHPLFVPWLVGPLLTGEGIQLV

SEQ ID NO: 202449 - protein, 22 aa, Mycobacterium bovis
LIPDQRAGCSLADSITPDELRA

SEQ ID NO: 202450 - protein, 23 aa, Mycobacterium bovis
LIPRARAKISIRVAPGGDATAHL

SEQ ID NO: 202451 - protein, 32 aa, Mycobacterium bovis
LIQARGLVDVVIPRGGAGLIEAVVRDAQVPTI

SEQ ID NO: 202452 - protein, 18 aa, Mycobacterium bovis
LIRFAEAAIQVMGKAEAR

SEQ ID NO: 202453 - protein, 17 aa, Mycobacterium bovis
LIRRPGIVHTRAQLLER

SEQ ID NO: 202454 - protein, 24 aa, Mycobacterium bovis
LIRYIDRFLIYYIRTADRLQRTAP

SEQ ID NO: 202455 - protein, 24 aa, Mycobacterium bovis
LISRGGWCTVTVRYDRASVRNDEL

SEQ ID NO: 202456 - protein, 19 aa, Mycobacterium bovis
LITAPQYAAYDIWESLFTG

SEQ ID NO: 202457 - protein, 18 aa, Mycobacterium bovis
LITTPGLINVDFADVKGI

SEQ ID NO: 202458 - protein, 18 aa, Mycobacterium bovis
LIVELERLYNHAADLGAL

SEQ ID NO: 202459 - protein, 24 aa, Mycobacterium bovis
LIYPREALWRPPVLTMSAVEGRGL

SEQ ID NO: 202460 - protein, 17 aa, Mycobacterium bovis
LKAARLLPAGQVDDEED

SEQ ID NO: 202461 - protein, 19 aa, Mycobacterium bovis
LKAEFFKTLAHPARIRILE

SEQ ID NO: 202462 - protein, 18 aa, Mycobacterium bovis
LKAEKVLQAIGFAPNVEG

SEQ ID NO: 202463 - protein, 18 aa, Mycobacterium bovis
LKAFRPGRLPFPVMHVDT

SEQ ID NO: 202464 - protein, 18 aa, Mycobacterium bovis
LKALGWTSEQIVERFGFS

SEQ ID NO: 202465 - protein, 25 aa, Mycobacterium bovis
LKCAIADGCGDVPALKSCTAAGTSC

SEQ ID NO: 202466 - protein, 17 aa, Mycobacterium bovis
LKDAFVYPETMPAWFTE

SEQ ID NO: 202467 - protein, 20 aa, Mycobacterium bovis
LKDLEIRGAGNVLGIEQSGH

SEQ ID NO: 202468 - protein, 18 aa, Mycobacterium bovis
LKDRVGLRPDQVSFGKLN

SEQ ID NO: 202469 - protein, 21 aa, Mycobacterium bovis
LKENIKRQWWRSVVTGRDDVV

SEQ ID NO: 202470 - protein, 18 aa, Mycobacterium bovis
LKESGFRLLAMTPHGNAC

SEQ ID NO: 202471 - protein, 19 aa, Mycobacterium bovis
LKEVREMQALLAKYGAGHR

SEQ ID NO: 202472 - protein, 19 aa, Mycobacterium bovis
LKGKLDGYALRVPIPTGSV

SEQ ID NO: 202473 - protein, 20 aa, Mycobacterium bovis
LKGRGLGGVRLVISDQHAGL

SEQ ID NO: 202474 - protein, 22 aa, Mycobacterium bovis
LKHGLTPIVCIGEHLDVREAGN

SEQ ID NO: 202475 - protein, 20 aa, Mycobacterium bovis
LKHRAGDTFCEIVPRDLKDL

SEQ ID NO: 202476 - protein, 27 aa, Mycobacterium bovis
LKHRLARSLFLYALCNGWINENTTVVE

SEQ ID NO: 202477 - protein, 17 aa, Mycobacterium bovis
LKLAGLLEELGHRVEHV

SEQ ID NO: 202478 - protein, 20 aa, Mycobacterium bovis
LKLRVEVFVVEQACPYPELD

SEQ ID NO: 202479 - protein, 25 aa, Mycobacterium bovis
LKLTGALGACIWHYLQATGQSDFKS

SEQ ID NO: 202480 - protein, 19 aa, Mycobacterium bovis
LKNKIALMCDVDIDGVIST

SEQ ID NO: 202481 - protein, 20 aa, Mycobacterium bovis
LKPAELAGVVSAVVYETRGG

SEQ ID NO: 202482 - protein, 19 aa, Mycobacterium bovis
LKQLQPFVASSLKQALQYA

SEQ ID NO: 202483 - protein, 19 aa, Mycobacterium bovis
LKQVCNHPAQLLHDRSPVG

SEQ ID NO: 202484 - protein, 21 aa, Mycobacterium bovis
LKTATGLTLPPTVIFDHPTPT

SEQ ID NO: 202485 - protein, 25 aa, Mycobacterium bovis
LKTELRLRYGACVNVERRSASAGFT

SEQ ID NO: 202486 - protein, 19 aa, Mycobacterium bovis
LKTHCKTALVVRREGPTIR

SEQ ID NO: 202487 - protein, 23 aa, Mycobacterium bovis
LKTSLEFRERFGIEVEELDEYAE

SEQ ID NO: 202488 - protein, 22 aa, Mycobacterium bovis
LKVTHPAAIVWAAQMGTITLHP

SEQ ID NO: 202489 - protein, 18 aa, Mycobacterium bovis
LLAAAARDAFGLDVHPAV

SEQ ID NO: 202490 - protein, 18 aa, Mycobacterium bovis
LLAAEYDEFLAGSAELQV

SEQ ID NO: 202491 - protein, 18 aa, Mycobacterium bovis
LLAALQHAGVTVHLDPDE

SEQ ID NO: 202492 - protein, 24 aa, Mycobacterium bovis
LLAARCPIDGFGVGTQLVVAQDAP

SEQ ID NO: 202493 - protein, 25 aa, Mycobacterium bovis
LLADCGHLVLVPAISPLAEHRALAR

SEQ ID NO: 202494 - protein, 21 aa, Mycobacterium bovis
LLADRFGCRTIVFTGVAGGLD

SEQ ID NO: 202495 - protein, 25 aa, Mycobacterium bovis
LLADRPVVVAARLDRAALAGAELPA

SEQ ID NO: 202496 - protein, 17 aa, Mycobacterium bovis
LLAERLGVRQTIGLGTV

SEQ ID NO: 202497 - protein, 19 aa, Mycobacterium bovis
LLAGERPYREFPLDWMLGR

SEQ ID NO: 202498 - protein, 17 aa, Mycobacterium bovis
LLAGRKVNLEFVSANPT

SEQ ID NO: 202499 - protein, 20 aa, Mycobacterium bovis
LLAHCYRMTGSLHDAEDLVQ

SEQ ID NO: 202500 - protein, 25 aa, Mycobacterium bovis
LLAIPRDEVRVMRKERNGWKAEVNS

SEQ ID NO: 202501 - protein, 30 aa, Mycobacterium bovis
LLAKYAIEHWTRLPVEVELASEFRYRDPVL

SEQ ID NO: 202502 - protein, 18 aa, Mycobacterium bovis
LLALGALLHDIGKGRGTD

SEQ ID NO: 202503 - protein, 20 aa, Mycobacterium bovis
LLALLPLVGVWRGEGEGRGP

SEQ ID NO: 202504 - protein, 17 aa, Mycobacterium bovis
LLALSAFCVVIDKGTSF

SEQ ID NO: 202505 - protein, 19 aa, Mycobacterium bovis
LLAPRARLAGASRVLASTH

SEQ ID NO: 202506 - protein, 25 aa, Mycobacterium bovis
LLARELPVYIISIGRTFRTDELDAT

SEQ ID NO: 202507 - protein, 35 aa, Mycobacterium bovis
LLASCLQPLWRARGRLQEGLAWFAAALADHDAHPA

SEQ ID NO: 202508 - protein, 22 aa, Mycobacterium bovis
LLAVRRIAERPGLTVGLEPLLD

SEQ ID NO: 202509 - protein, 18 aa, Mycobacterium bovis
LLAWLRDRLSHFKCPRSI

SEQ ID NO: 202510 - protein, 21 aa, Mycobacterium bovis
LLCAGITLYSPLRHWNAGANT

SEQ ID NO: 202511 - protein, 17 aa, Mycobacterium bovis
LLDACFQSVAAHPAVQG

SEQ ID NO: 202512 - protein, 17 aa, Mycobacterium bovis
LLDAEGLFDPRLKRPIP

SEQ ID NO: 202513 - protein, 19 aa, Mycobacterium bovis
LLDDEFLEIQAGYAQNIVV

SEQ ID NO: 202514 - protein, 23 aa, Mycobacterium bovis
LLDGVCYPGQLAAHLGLTRSNVS

SEQ ID NO: 202515 - protein, 25 aa, Mycobacterium bovis
LLDIGCGWGATMRRAIAQYDVNVVG

SEQ ID NO: 202516 - protein, 21 aa, Mycobacterium bovis
LLDIGCGWGATMRRAIEKYDV

SEQ ID NO: 202517 - protein, 24 aa, Mycobacterium bovis
LLDIGCGWGGGLQRAIENYDVNVI

SEQ ID NO: 202518 - protein, 21 aa, Mycobacterium bovis
LLDIGCGWGTTMRRAVERLDV

SEQ ID NO: 202519 - protein, 17 aa, Mycobacterium bovis
LLDKPVKWMEDRSENLT

SEQ ID NO: 202520 - protein, 20 aa, Mycobacterium bovis
LLDLLWRNRRGELEMSVVMV

SEQ ID NO: 202521 - protein, 19 aa, Mycobacterium bovis
LLDNIAIEIGTFAGTDRPD

SEQ ID NO: 202522 - protein, 17 aa, Mycobacterium bovis
LLDPGLRESVRHGVTTV

SEQ ID NO: 202523 - protein, 18 aa, Mycobacterium bovis
LLDRGMVFVVAHVRGGGE

SEQ ID NO: 202524 - protein, 17 aa, Mycobacterium bovis
LLDRHRPLWELHVVEGL

SEQ ID NO: 202525 - protein, 26 aa, Mycobacterium bovis
LLDVGCGWGATMMRAVEKYDVNVVGL

SEQ ID NO: 202526 - protein, 26 aa, Mycobacterium bovis
LLDVGCGWGGALVRAVEKYDVNVIGL

SEQ ID NO: 202527 - protein, 24 aa, Mycobacterium bovis
LLDVKRWVTLTGVGGVGKTRLATQ

SEQ ID NO: 202528 - protein, 19 aa, Mycobacterium bovis
LLDYFPEDFLLVIDESHVT

SEQ ID NO: 202529 - protein, 20 aa, Mycobacterium bovis
LLDYLAGLGRSVHMVVLSAS

SEQ ID NO: 202530 - protein, 28 aa, Mycobacterium bovis
LLEALPERERTVLVLRFFDSMTQTQIAE

SEQ ID NO: 202531 - protein, 18 aa, Mycobacterium bovis
LLEAVVLSDRFVDIRPVT

SEQ ID NO: 202532 - protein, 17 aa, Mycobacterium bovis
LLENFSRKTLNDDVAVG

SEQ ID NO: 202533 - protein, 19 aa, Mycobacterium bovis
LLEPLRSVPIVGNPLANLV

SEQ ID NO: 202534 - protein, 19 aa, Mycobacterium bovis
LLERSGLVALRNVIDQQFA

SEQ ID NO: 202535 - protein, 24 aa, Mycobacterium bovis
LLEVEEVYLPLARLIHLQVAARQR

SEQ ID NO: 202536 - protein, 17 aa, Mycobacterium bovis
LLFLQNIAGFMVGRDYE

SEQ ID NO: 202537 - protein, 19 aa, Mycobacterium bovis
LLFRDAYALGGRFEEHLGG

SEQ ID NO: 202538 - protein, 26 aa, Mycobacterium bovis
LLFSALELLHAWALVHDDLIDRSATR

SEQ ID NO: 202539 - protein, 18 aa, Mycobacterium bovis
LLGAHGGLHQKWFNLYDE

SEQ ID NO: 202540 - protein, 18 aa, Mycobacterium bovis
LLGCGAVLDHFRVAMAAA

SEQ ID NO: 202541 - protein, 25 aa, Mycobacterium bovis
LLGFKKACAGFRSLGRGATEEPAEM

SEQ ID NO: 202542 - protein, 26 aa, Mycobacterium bovis
LLGGKCPQCGTYVFPPRADNCPNPAC

SEQ ID NO: 202543 - protein, 17 aa, Mycobacterium bovis
LLGKKCYSLRIASAMAH

SEQ ID NO: 202544 - protein, 20 aa, Mycobacterium bovis
LLGPLGDLFTIMTIPAQEAQ

SEQ ID NO: 202545 - protein, 17 aa, Mycobacterium bovis
LLGRPLIGDGADGTAPG

SEQ ID NO: 202546 - protein, 24 aa, Mycobacterium bovis
LLGTARSWAWLSGRDYVTPDDVKA

SEQ ID NO: 202547 - protein, 25 aa, Mycobacterium bovis
LLGVDEVWAVGGAQAVALLAYGGTD

SEQ ID NO: 202548 - protein, 20 aa, Mycobacterium bovis
LLHELPRRLGGEHSDSTNTE

SEQ ID NO: 202549 - protein, 26 aa, Mycobacterium bovis
LLHGFPESWYSWRHQIPALAGAGYRV

SEQ ID NO: 202550 - protein, 24 aa, Mycobacterium bovis
LLHLARDIGCVFSIDTDAHAPGQL

SEQ ID NO: 202551 - protein, 19 aa, Mycobacterium bovis
LLIRKAGAASADMAAELAK

SEQ ID NO: 202552 - protein, 18 aa, Mycobacterium bovis
LLKATAAAVLAERGLDAS

SEQ ID NO: 202553 - protein, 18 aa, Mycobacterium bovis
LLKIALAACSGMASDQPL

SEQ ID NO: 202554 - protein, 18 aa, Mycobacterium bovis
LLLAGLEPDLKWERFITA

SEQ ID NO: 202555 - protein, 17 aa, Mycobacterium bovis
LLLDLQEQFGLSYLFVS

SEQ ID NO: 202556 - protein, 19 aa, Mycobacterium bovis
LLLNRISLAPGEAIFLPAG

SEQ ID NO: 202557 - protein, 18 aa, Mycobacterium bovis
LLLVRAAHATELPYVWGN

SEQ ID NO: 202558 - protein, 22 aa, Mycobacterium bovis
LLMNSRSGYKYGDVTVLDHMAY

SEQ ID NO: 202559 - protein, 17 aa, Mycobacterium bovis
LLNAALEAGETVLLEGS

SEQ ID NO: 202560 - protein, 27 aa, Mycobacterium bovis
LLNDVLKGAWGYRGWVMSDWGGTPSWE

SEQ ID NO: 202561 - protein, 24 aa, Mycobacterium bovis
LLNGPRYWLMNAIEKAPQGPPVTK

SEQ ID NO: 202562 - protein, 25 aa, Mycobacterium bovis
LLNNRLWSRLRRRIEEADALLYAEI

SEQ ID NO: 202563 - protein, 19 aa, Mycobacterium bovis
LLPDELYTAVGASIGDAWA

SEQ ID NO: 202564 - protein, 19 aa, Mycobacterium bovis
LLPGRDGLVHISKLGKGKR

SEQ ID NO: 202565 - protein, 21 aa, Mycobacterium bovis
LLPHWRERRFGHVVNVSSAGV

SEQ ID NO: 202566 - protein, 22 aa, Mycobacterium bovis
LLPLYFELDGSFPNHEANPLDP

SEQ ID NO: 202567 - protein, 18 aa, Mycobacterium bovis
LLPREKRAALSAVYALGR

SEQ ID NO: 202568 - protein, 20 aa, Mycobacterium bovis
LLPVPARKVGRLILVDELAS

SEQ ID NO: 202569 - protein, 21 aa, Mycobacterium bovis
LLQLKSWRLSTAKEQNVPAYV

SEQ ID NO: 202570 - protein, 23 aa, Mycobacterium bovis
LLQPGVLSLAWGSVVRQLAAGLG

SEQ ID NO: 202571 - protein, 23 aa, Mycobacterium bovis
LLQRPEEVAARRGLPIEDVAPAG

SEQ ID NO: 202572 - protein, 27 aa, Mycobacterium bovis
LLQSSNGPLSWLWQILFGTPNFPTSIS

SEQ ID NO: 202573 - protein, 20 aa, Mycobacterium bovis
LLRALAVSDLDPFIDLLSEG

SEQ ID NO: 202574 - protein, 19 aa, Mycobacterium bovis
LLRDALRRHLAALAADQDV

SEQ ID NO: 202575 - protein, 20 aa, Mycobacterium bovis
LLRECTVLGKLATHAEQGRL

SEQ ID NO: 202576 - protein, 19 aa, Mycobacterium bovis
LLRELPHQLLRSWYILYFQ

SEQ ID NO: 202577 - protein, 18 aa, Mycobacterium bovis
LLRHAHCPVVIIHDEDSV

SEQ ID NO: 202578 - protein, 24 aa, Mycobacterium bovis
LLRIGHEVEEVIPLGPVDGPVTVG

SEQ ID NO: 202579 - protein, 20 aa, Mycobacterium bovis
LLRLLHPVIPFLTEALWLAL

SEQ ID NO: 202580 - protein, 17 aa, Mycobacterium bovis
LLRLWRPPLRPGEWRTL

SEQ ID NO: 202581 - protein, 29 aa, Mycobacterium bovis
LLRQLRLGDYDVLVGINLLREGLDLPEVS

SEQ ID NO: 202582 - protein, 17 aa, Mycobacterium bovis
LLRSMRSPIPITELQRQ

SEQ ID NO: 202583 - protein, 26 aa, Mycobacterium bovis
LLSAVPRALQGLALPTASQSASATPQ

SEQ ID NO: 202584 - protein, 24 aa, Mycobacterium bovis
LLSKHIRLIAAFDHRHIFLDPNPD

SEQ ID NO: 202585 - protein, 27 aa, Mycobacterium bovis
LLSVGYAACHWCHVMAHESFDDDEVAA

SEQ ID NO: 202586 - protein, 18 aa, Mycobacterium bovis
LLTLLLFDIGSFAGLAAL

SEQ ID NO: 202587 - protein, 21 aa, Mycobacterium bovis
LLTRADLVICGGGHGMVAKTL

SEQ ID NO: 202588 - protein, 17 aa, Mycobacterium bovis
LLTRIAFGFRSPQALIA

SEQ ID NO: 202589 - protein, 19 aa, Mycobacterium bovis
LLTSLPFAPGYGVEIGLLI

SEQ ID NO: 202590 - protein, 18 aa, Mycobacterium bovis
LLVAAAISFIEDVARTWH

SEQ ID NO: 202591 - protein, 17 aa, Mycobacterium bovis
LLVADLAYVRGMVYRQL

SEQ ID NO: 202592 - protein, 29 aa, Mycobacterium bovis
LLVAECLRTGAWEGLKPAELAGVVSAVVY

SEQ ID NO: 202593 - protein, 19 aa, Mycobacterium bovis
LLVAGWRALHTTGPKPLVQ

SEQ ID NO: 202594 - protein, 19 aa, Mycobacterium bovis
LLVASALARQGPLLVVTAT

SEQ ID NO: 202595 - protein, 19 aa, Mycobacterium bovis
LLVESGMAPLFPLVVVVHA

SEQ ID NO: 202596 - protein, 17 aa, Mycobacterium bovis
LLVRLAGVADRDAADAL

SEQ ID NO: 202597 - protein, 25 aa, Mycobacterium bovis
LLVSAEGWHSLSIAYAETADELAAL

SEQ ID NO: 202598 - protein, 20 aa, Mycobacterium bovis
LLWGDARVGNVLYRDFQPVA

SEQ ID NO: 202599 - protein, 19 aa, Mycobacterium bovis
LLWRTDFCARLVAKGLRVI

SEQ ID NO: 202600 - protein, 17 aa, Mycobacterium bovis
LLWSFAPPPRPRPVDGS

SEQ ID NO: 202601 - protein, 23 aa, Mycobacterium bovis
LLYRLCGDRNPLHSDPEFAAAAG

SEQ ID NO: 202602 - protein, 19 aa, Mycobacterium bovis
LLYVVVLHRFLRWRQRDYA

SEQ ID NO: 202603 - protein, 18 aa, Mycobacterium bovis
LMAALGMLEARHIAGDQQ

SEQ ID NO: 202604 - protein, 23 aa, Mycobacterium bovis
LMAARGVGVGQILAITFTNKAAA

SEQ ID NO: 202605 - protein, 23 aa, Mycobacterium bovis
LMAEAIVAMFNQFCYLQLSGKRS

SEQ ID NO: 202606 - protein, 19 aa, Mycobacterium bovis
LMDAVPVTLGQEFSGYARQ

SEQ ID NO: 202607 - protein, 26 aa, Mycobacterium bovis
LMERLRARLPAPDWMPPLTVAQQLGF

SEQ ID NO: 202608 - protein, 18 aa, Mycobacterium bovis
LMETRPSALVAIAALSRL

SEQ ID NO: 202609 - protein, 18 aa, Mycobacterium bovis
LMEWCAMVGCPIVGINDS

SEQ ID NO: 202610 - protein, 22 aa, Mycobacterium bovis
LMGAREFQTFLVAKQREIVAVV

SEQ ID NO: 202611 - protein, 24 aa, Mycobacterium bovis
LMGIPGPGGLQFAGRVGTGLSERE

SEQ ID NO: 202612 - protein, 17 aa, Mycobacterium bovis
LMHRTRASALMMAAGME

SEQ ID NO: 202613 - protein, 20 aa, Mycobacterium bovis
LMIKPPRPLASTSIPAGGID

SEQ ID NO: 202614 - protein, 26 aa, Mycobacterium bovis
LMLDDASKIVGCWNGLAKRSGTGIVA

SEQ ID NO: 202615 - protein, 24 aa, Mycobacterium bovis
LMMSLNMLIEFGDAFDYSAADFRG

SEQ ID NO: 202616 - protein, 23 aa, Mycobacterium bovis
LMNHGRPAAILISAERYESLMEE

SEQ ID NO: 202617 - protein, 23 aa, Mycobacterium bovis
LMPRTVYDTLIWCIYSGVHLPPP

SEQ ID NO: 202618 - protein, 18 aa, Mycobacterium bovis
LMPTSSVNLGNWSASRLV

SEQ ID NO: 202619 - protein, 18 aa, Mycobacterium bovis
LMQNICFLYHLVGGGTGV

SEQ ID NO: 202620 - protein, 23 aa, Mycobacterium bovis
LMQPRARGRITLVSSDPQIPVRI

SEQ ID NO: 202621 - protein, 19 aa, Mycobacterium bovis
LMRDIPFRVGAVVQSPAYY

SEQ ID NO: 202622 - protein, 23 aa, Mycobacterium bovis
LMRNRVDLIVGHGRFIDPHTILV

SEQ ID NO: 202623 - protein, 26 aa, Mycobacterium bovis
LMRPRIASRVLGKWARTRLSGQKTLI

SEQ ID NO: 202624 - protein, 22 aa, Mycobacterium bovis
LMRRAGGLVFARKVRAEHRPGR

SEQ ID NO: 202625 - protein, 17 aa, Mycobacterium bovis
LMRSGAKDQLRFTAPPR

SEQ ID NO: 202626 - protein, 17 aa, Mycobacterium bovis
LMRYPRRNTVCISSQAG

SEQ ID NO: 202627 - protein, 18 aa, Mycobacterium bovis
LMTIPWAVISGFLFNVLL

SEQ ID NO: 202628 - protein, 25 aa, Mycobacterium bovis
LMVGERVLAGYGFRTDQRAHAEIAA

SEQ ID NO: 202629 - protein, 17 aa, Mycobacterium bovis
LNAAVRRIDRHGAGVTV

SEQ ID NO: 202630 - protein, 18 aa, Mycobacterium bovis
LNAGLGFGGGCLPKDIRA

SEQ ID NO: 202631 - protein, 18 aa, Mycobacterium bovis
LNAIAAGGYYGHSATAFS

SEQ ID NO: 202632 - protein, 24 aa, Mycobacterium bovis
LNALERNKMRVVPGLTSKAMSVAS

SEQ ID NO: 202633 - protein, 21 aa, Mycobacterium bovis
LNALVGLARPGKFGGDVSHLN

SEQ ID NO: 202634 - protein, 32 aa, Mycobacterium bovis
LNARVLARFADLFAAVRMRLREAVDRGEAHPD

SEQ ID NO: 202635 - protein, 17 aa, Mycobacterium bovis
LNASGRSPSAWTPEYFG

SEQ ID NO: 202636 - protein, 23 aa, Mycobacterium bovis
LNDFAQLLAALGRRYDGDERLSV

SEQ ID NO: 202637 - protein, 25 aa, Mycobacterium bovis
LNDGCLRPLRIVVPEGSMLAPTHPA

SEQ ID NO: 202638 - protein, 18 aa, Mycobacterium bovis
LNDGRIGENVFLLEDNTI

SEQ ID NO: 202639 - protein, 23 aa, Mycobacterium bovis
LNEEIRVLRGWSIDDYCQHQLSS

SEQ ID NO: 202640 - protein, 19 aa, Mycobacterium bovis
LNEGLPHWAMTPSIEQAAQ

SEQ ID NO: 202641 - protein, 18 aa, Mycobacterium bovis
LNFISDLNAVAGITFVHT

SEQ ID NO: 202642 - protein, 25 aa, Mycobacterium bovis
LNGEAYRGHVFWDALFVAPVLSLRM

SEQ ID NO: 202643 - protein, 20 aa, Mycobacterium bovis
LNGGSLIGLEWAEIVRGQIA

SEQ ID NO: 202644 - protein, 18 aa, Mycobacterium bovis
LNHPEAIAVIADHILEGA

SEQ ID NO: 202645 - protein, 19 aa, Mycobacterium bovis
LNIKGPELLNKFVGETERH

SEQ ID NO: 202646 - protein, 29 aa, Mycobacterium bovis
LNIPVNIPIHLDFGTLAVNGFQIPAITLR

SEQ ID NO: 202647 - protein, 25 aa, Mycobacterium bovis
LNLGKLLTKRARVIGTTLRARPVSG

SEQ ID NO: 202648 - protein, 18 aa, Mycobacterium bovis
LNLSFAIAVRKRAKADAQ

SEQ ID NO: 202649 - protein, 29 aa, Mycobacterium bovis
LNMTLSQRWGRLFVAVCYALRTPTTRSPL

SEQ ID NO: 202650 - protein, 19 aa, Mycobacterium bovis
LNNVPRLRKPTVLVIDQIP

SEQ ID NO: 202651 - protein, 19 aa, Mycobacterium bovis
LNPGPATRLVFDLDPGEGV

SEQ ID NO: 202652 - protein, 17 aa, Mycobacterium bovis
LNPSTGVELLIPDFNGE

SEQ ID NO: 202653 - protein, 23 aa, Mycobacterium bovis
LNPVRRGAALAGDIAKADCQLVL

SEQ ID NO: 202654 - protein, 24 aa, Mycobacterium bovis
LNQGEVCTCPSRSLIQADIYDEFL

SEQ ID NO: 202655 - protein, 24 aa, Mycobacterium bovis
LNSPLSDFFIKWMSRINTWMYRRN

SEQ ID NO: 202656 - protein, 19 aa, Mycobacterium bovis
LNTAVWSGGSFIYVPPGVH

SEQ ID NO: 202657 - protein, 18 aa, Mycobacterium bovis
LNTGFGNAGFVNTGFDNS

SEQ ID NO: 202658 - protein, 18 aa, Mycobacterium bovis
LNVGCIPSKALLRNAELV

SEQ ID NO: 202659 - protein, 20 aa, Mycobacterium bovis
LNVGCIPTKMFVYAAEVAKT

SEQ ID NO: 202660 - protein, 30 aa, Mycobacterium bovis
LNYLGAVQLILKFIPGMRERHFGHIVNVSS

SEQ ID NO: 202661 - protein, 21 aa, Mycobacterium bovis
LNYYAPLRLIRGLAPGMLERG

SEQ ID NO: 202662 - protein, 22 aa, Mycobacterium bovis
LPAADLRPAYSNADAARQVADG

SEQ ID NO: 202663 - protein, 28 aa, Mycobacterium bovis
LPAARRAAHRAGHLGAMYPWQSGSDGSE

SEQ ID NO: 202664 - protein, 19 aa, Mycobacterium bovis
LPAAWAYKRFRDLDDKESY

SEQ ID NO: 202665 - protein, 20 aa, Mycobacterium bovis
LPADDPRIWPNIVASQLDWD

SEQ ID NO: 202666 - protein, 17 aa, Mycobacterium bovis
LPADFLLDADGTVAAVH

SEQ ID NO: 202667 - protein, 18 aa, Mycobacterium bovis
LPADIIITATGLNLQLFG

SEQ ID NO: 202668 - protein, 19 aa, Mycobacterium bovis
LPADLLIHNRWHRDPHGSI

SEQ ID NO: 202669 - protein, 19 aa, Mycobacterium bovis
LPADPRRGGQLVSLPPGAG

SEQ ID NO: 202670 - protein, 17 aa, Mycobacterium bovis
LPAERWREYCLSSVTTH

SEQ ID NO: 202671 - protein, 27 aa, Mycobacterium bovis
LPAGHYTLRAAIDWQQHKPNGSHVVNY

SEQ ID NO: 202672 - protein, 18 aa, Mycobacterium bovis
LPALFSQLVAGPIRRIID

SEQ ID NO: 202673 - protein, 19 aa, Mycobacterium bovis
LPALGRSGAFDILLAAYSL

SEQ ID NO: 202674 - protein, 19 aa, Mycobacterium bovis
LPALKSFVLPGGSPLSALL

SEQ ID NO: 202675 - protein, 22 aa, Mycobacterium bovis
LPANHRYLGPVLWSPDVKPPTW

SEQ ID NO: 202676 - protein, 18 aa, Mycobacterium bovis
LPAPLRRGQIRPLGLDRY

SEQ ID NO: 202677 - protein, 19 aa, Mycobacterium bovis
LPARGRFSAHTFWDDIKAV

SEQ ID NO: 202678 - protein, 19 aa, Mycobacterium bovis
LPASQVVRFIVPRYVQDDP

SEQ ID NO: 202679 - protein, 17 aa, Mycobacterium bovis
LPDAITIYREALLDACD

SEQ ID NO: 202680 - protein, 20 aa, Mycobacterium bovis
LPDDLKFTLVEPLRLLFKDE

SEQ ID NO: 202681 - protein, 19 aa, Mycobacterium bovis
LPDECWHLVIVAHHIVIDG

SEQ ID NO: 202682 - protein, 27 aa, Mycobacterium bovis
LPDGALMRRAAFGLATEIGRELTARTG

SEQ ID NO: 202683 - protein, 19 aa, Mycobacterium bovis
LPDGGAWLYAATVRAIKEL

SEQ ID NO: 202684 - protein, 21 aa, Mycobacterium bovis
LPDGRRVVGEWVYGPHNNAIN

SEQ ID NO: 202685 - protein, 24 aa, Mycobacterium bovis
LPDLCKLLDVAPGIAIVDEAYGEF

SEQ ID NO: 202686 - protein, 21 aa, Mycobacterium bovis
LPDMFTRLMLSLAATGIAPGS

SEQ ID NO: 202687 - protein, 25 aa, Mycobacterium bovis
LPDNTPWGGKPVRKLQLPRDAALVT

SEQ ID NO: 202688 - protein, 24 aa, Mycobacterium bovis
LPDPRLDKLAELFGSQRVVPAPVT

SEQ ID NO: 202689 - protein, 19 aa, Mycobacterium bovis
LPDPYRPHRSAVLTASLTS

SEQ ID NO: 202690 - protein, 18 aa, Mycobacterium bovis
LPDRITRERLDAVLAAVV

SEQ ID NO: 202691 - protein, 18 aa, Mycobacterium bovis
LPDSPDLVQLLLACLARG

SEQ ID NO: 202692 - protein, 17 aa, Mycobacterium bovis
LPDVVSRYGGWGDRQIL

SEQ ID NO: 202693 - protein, 17 aa, Mycobacterium bovis
LPEDRVVVELSPYDLSR

SEQ ID NO: 202694 - protein, 24 aa, Mycobacterium bovis
LPEETLRWLYEMMVVTRELDTEFV

SEQ ID NO: 202695 - protein, 18 aa, Mycobacterium bovis
LPEFPRLWAEMVGPGQGW

SEQ ID NO: 202696 - protein, 17 aa, Mycobacterium bovis
LPEHAIVQFVKAICSPM

SEQ ID NO: 202697 - protein, 26 aa, Mycobacterium bovis
LPEPLKCLTENLWALHTNRYDYVTTK

SEQ ID NO: 202698 - protein, 23 aa, Mycobacterium bovis
LPEPTFAPVLGRIAAGGPILAEE

SEQ ID NO: 202699 - protein, 20 aa, Mycobacterium bovis
LPFETLFEPAISYGRNGFLV

SEQ ID NO: 202700 - protein, 24 aa, Mycobacterium bovis
LPFSPRSQYLVGHLAPVKLTGAAL

SEQ ID NO: 202701 - protein, 27 aa, Mycobacterium bovis
LPFYHDMGLVIGICAPILGGYPAVLTS

SEQ ID NO: 202702 - protein, 24 aa, Mycobacterium bovis
LPFYHDMGLVLGIIAPILGGYRSE

SEQ ID NO: 202703 - protein, 25 aa, Mycobacterium bovis
LPGADLRAPCALPVLVIDGRDEKHL

SEQ ID NO: 202704 - protein, 18 aa, Mycobacterium bovis
LPGAQGRLKVAAPKPSKL

SEQ ID NO: 202705 - protein, 17 aa, Mycobacterium bovis
LPGDPLALIAPAGSGAG

SEQ ID NO: 202706 - protein, 17 aa, Mycobacterium bovis
LPGEVADKFHATFDALL

SEQ ID NO: 202707 - protein, 18 aa, Mycobacterium bovis
LPGFRPGKAPAKLLEARI

SEQ ID NO: 202708 - protein, 18 aa, Mycobacterium bovis
LPGLGGMLGGGPVAAGLG

SEQ ID NO: 202709 - protein, 17 aa, Mycobacterium bovis
LPGLLTILHDGGYRDTE

SEQ ID NO: 202710 - protein, 18 aa, Mycobacterium bovis
LPGLRALQKYAVRTGGGV

SEQ ID NO: 202711 - protein, 17 aa, Mycobacterium bovis
LPGRGWVEYEPYGTVLI

SEQ ID NO: 202712 - protein, 21 aa, Mycobacterium bovis
LPGRRYYGGCEHVDVVENLAR

SEQ ID NO: 202713 - protein, 20 aa, Mycobacterium bovis
LPGYALPLFVRVVGSLAHTT

SEQ ID NO: 202714 - protein, 40 aa, Mycobacterium bovis
LPHAQVRFVWLRGRRATSHWLTLPALKAFGAIPVADERIV

SEQ ID NO: 202715 - protein, 18 aa, Mycobacterium bovis
LPHDELAALLPEVVEVLD

SEQ ID NO: 202716 - protein, 24 aa, Mycobacterium bovis
LPHFNLSVGVTDAFLRAVERNGLH

SEQ ID NO: 202717 - protein, 21 aa, Mycobacterium bovis
LPHQLLRSWYILYFQLPWLPE

SEQ ID NO: 202718 - protein, 24 aa, Mycobacterium bovis
LPIALPRRTVVTFTPEHTGAITAR

SEQ ID NO: 202719 - protein, 20 aa, Mycobacterium bovis
LPISVVRPATKYERKAQLGG

SEQ ID NO: 202720 - protein, 17 aa, Mycobacterium bovis
LPIVPMFHANGWGLPYA

SEQ ID NO: 202721 - protein, 18 aa, Mycobacterium bovis
LPKSIIIAGAGAIGMEFG

SEQ ID NO: 202722 - protein, 17 aa, Mycobacterium bovis
LPKTRSGKIMRRLLRDV

SEQ ID NO: 202723 - protein, 17 aa, Mycobacterium bovis
LPLFEPPGDEFFGRYRD

SEQ ID NO: 202724 - protein, 17 aa, Mycobacterium bovis
LPLGLALSNGIPPVDIP

SEQ ID NO: 202725 - protein, 17 aa, Mycobacterium bovis
LPLHLALNLTVPDSSIP

SEQ ID NO: 202726 - protein, 19 aa, Mycobacterium bovis
LPLPPRRRRRIPVVIHEAN

SEQ ID NO: 202727 - protein, 17 aa, Mycobacterium bovis
LPLRPFKTMAVNVDGRL

SEQ ID NO: 202728 - protein, 19 aa, Mycobacterium bovis
LPLYCASLRTAEPRLLERL

SEQ ID NO: 202729 - protein, 25 aa, Mycobacterium bovis
LPLYHDMGLILGICAPLVARRRAVL

SEQ ID NO: 202730 - protein, 27 aa, Mycobacterium bovis
LPMGSEAMALLRLPLVLPAVQIAGRIV

SEQ ID NO: 202731 - protein, 24 aa, Mycobacterium bovis
LPNLDFPTGPAYYLMGFDIASFTP

SEQ ID NO: 202732 - protein, 21 aa, Mycobacterium bovis
LPNRLYWLSATIDPDGQNGGP

SEQ ID NO: 202733 - protein, 17 aa, Mycobacterium bovis
LPPAKRLPDGLASYVSV

SEQ ID NO: 202734 - protein, 17 aa, Mycobacterium bovis
LPPARPMPFEEVRDFFY

SEQ ID NO: 202735 - protein, 21 aa, Mycobacterium bovis
LPPEGASAIVFRDTAHAAELA

SEQ ID NO: 202736 - protein, 18 aa, Mycobacterium bovis
LPPGGRLGLYGFGGSAHI

SEQ ID NO: 202737 - protein, 19 aa, Mycobacterium bovis
LPPGPRLSGSVQAVLMLRH

SEQ ID NO: 202738 - protein, 26 aa, Mycobacterium bovis
LPPLSGGMVGFFAYDMVRRLERLPER

SEQ ID NO: 202739 - protein, 21 aa, Mycobacterium bovis
LPPSALWGREAYVTGLLGDGV

SEQ ID NO: 202740 - protein, 19 aa, Mycobacterium bovis
LPPSPKPGQKWVNVDPTKN

SEQ ID NO: 202741 - protein, 18 aa, Mycobacterium bovis
LPQAVPHSGAVVLNADDP

SEQ ID NO: 202742 - protein, 19 aa, Mycobacterium bovis
LPQTFADLGPTYVKFGQII

SEQ ID NO: 202743 - protein, 21 aa, Mycobacterium bovis
LPRAQALAVSLLLLSPAALNT

SEQ ID NO: 202744 - protein, 17 aa, Mycobacterium bovis
LPRGRRTARPSGDDREL

SEQ ID NO: 202745 - protein, 25 aa, Mycobacterium bovis
LPRLKPRVFYDLVVEVALIRPGPIQ

SEQ ID NO: 202746 - protein, 19 aa, Mycobacterium bovis
LPRSRRIPASRVVEIAPTV

SEQ ID NO: 202747 - protein, 20 aa, Mycobacterium bovis
LPRTIQIEAGVFLWCTPGDA

SEQ ID NO: 202748 - protein, 19 aa, Mycobacterium bovis
LPRTMTFKVIKRQLSAEGV

SEQ ID NO: 202749 - protein, 17 aa, Mycobacterium bovis
LPRWSMIDQALGLGSPD

SEQ ID NO: 202750 - protein, 24 aa, Mycobacterium bovis
LPSARRLLLFKADGSVSVHADDRA

SEQ ID NO: 202751 - protein, 21 aa, Mycobacterium bovis
LPSCKELIESIVLDAITHLQT

SEQ ID NO: 202752 - protein, 19 aa, Mycobacterium bovis
LPSDITFHRWCAALSTRWC

SEQ ID NO: 202753 - protein, 25 aa, Mycobacterium bovis
LPSERELIDRSGLSRVTVRAAVGML

SEQ ID NO: 202754 - protein, 17 aa, Mycobacterium bovis
LPSHPGHEIAARQMRGF

SEQ ID NO: 202755 - protein, 17 aa, Mycobacterium bovis
LPSNCFDKPPVVNPGLE

SEQ ID NO: 202756 - protein, 23 aa, Mycobacterium bovis
LPSRCAEDLFAGWWRLIEALGAV

SEQ ID NO: 202757 - protein, 26 aa, Mycobacterium bovis
LPSYPHPRLMPDFWEFPTVSMGLGPL

SEQ ID NO: 202758 - protein, 21 aa, Mycobacterium bovis
LPTAGCARHSSGLSVQTFLRG

SEQ ID NO: 202759 - protein, 19 aa, Mycobacterium bovis
LPTDRPIIYATLGSSGGKN

SEQ ID NO: 202760 - protein, 17 aa, Mycobacterium bovis
LPTERWTAVTAARSLAD

SEQ ID NO: 202761 - protein, 24 aa, Mycobacterium bovis
LPTMEKAGLIQRGRQVSVREIDEM

SEQ ID NO: 202762 - protein, 22 aa, Mycobacterium bovis
LPTQLCAFAAGVLRAEAVHEPG

SEQ ID NO: 202763 - protein, 24 aa, Mycobacterium bovis
LPTRPRATLVLRKDADHSINRLRL

SEQ ID NO: 202764 - protein, 18 aa, Mycobacterium bovis
LPTVWDFETDPQYQSKLD

SEQ ID NO: 202765 - protein, 24 aa, Mycobacterium bovis
LPTYAVICCPAFGAAAKVGTFNPA

SEQ ID NO: 202766 - protein, 19 aa, Mycobacterium bovis
LPVAEAIAYLLEILPALSY

SEQ ID NO: 202767 - protein, 22 aa, Mycobacterium bovis
LPVGGWNCRPTADFGYSACAAA

SEQ ID NO: 202768 - protein, 18 aa, Mycobacterium bovis
LPVGRLRIGDELAEIDSA

SEQ ID NO: 202769 - protein, 21 aa, Mycobacterium bovis
LPVICSHWYGLIPPIKEVRDQ

SEQ ID NO: 202770 - protein, 25 aa, Mycobacterium bovis
LPVIGTKELIAWLPTLLGLGGADLV

SEQ ID NO: 202771 - protein, 17 aa, Mycobacterium bovis
LPVKGTWAFIPPGEAAI

SEQ ID NO: 202772 - protein, 17 aa, Mycobacterium bovis
LPVSLSVQVRGELAAEE

SEQ ID NO: 202773 - protein, 18 aa, Mycobacterium bovis
LPVSLTIPGFTIPGGTLI

SEQ ID NO: 202774 - protein, 20 aa, Mycobacterium bovis
LPVTVFRCDMILADTSYTGQ

SEQ ID NO: 202775 - protein, 22 aa, Mycobacterium bovis
LPWMADLVGEFALRAPPAEQIA

SEQ ID NO: 202776 - protein, 17 aa, Mycobacterium bovis
LPYYVSLFEQMKNEARA

SEQ ID NO: 202777 - protein, 17 aa, Mycobacterium bovis
LQAELHKTIVFVTHDID

SEQ ID NO: 202778 - protein, 18 aa, Mycobacterium bovis
LQALAGRCATLAGELSAA

SEQ ID NO: 202779 - protein, 19 aa, Mycobacterium bovis
LQAPYELVAEVARAGKLPV

SEQ ID NO: 202780 - protein, 17 aa, Mycobacterium bovis
LQCGRSVHTRRAYLGDL

SEQ ID NO: 202781 - protein, 17 aa, Mycobacterium bovis
LQDLLGVVNAPAQALLG

SEQ ID NO: 202782 - protein, 17 aa, Mycobacterium bovis
LQDPKGQRWVMQTWSQV

SEQ ID NO: 202783 - protein, 19 aa, Mycobacterium bovis
LQFGSNHLGHFALTAHLLP

SEQ ID NO: 202784 - protein, 22 aa, Mycobacterium bovis
LQFRTVHGYRRAFRIAGSGPAI

SEQ ID NO: 202785 - protein, 25 aa, Mycobacterium bovis
LQGDVKRFRGFDNWEGDAATACEAS

SEQ ID NO: 202786 - protein, 18 aa, Mycobacterium bovis
LQGLRLVFERNLEVQRGR

SEQ ID NO: 202787 - protein, 17 aa, Mycobacterium bovis
LQIHPRVLRAIGDVGYE

SEQ ID NO: 202788 - protein, 25 aa, Mycobacterium bovis
LQKISELYDRVGFAAAGKFNEFDNL

SEQ ID NO: 202789 - protein, 24 aa, Mycobacterium bovis
LQLACAGGFPEVVQRPAGRARSRW

SEQ ID NO: 202790 - protein, 18 aa, Mycobacterium bovis
LQLHYARTLDMWATALEA

SEQ ID NO: 202791 - protein, 18 aa, Mycobacterium bovis
LQLLIIISAGRTIANDIS

SEQ ID NO: 202792 - protein, 23 aa, Mycobacterium bovis
LQLRRAGLVTSRRDGKRVIYALS

SEQ ID NO: 202793 - protein, 25 aa, Mycobacterium bovis
LQLSKRGGGVALLLTNIREHGAPIK

SEQ ID NO: 202794 - protein, 19 aa, Mycobacterium bovis
LQLSTLAPMRPRVGVHTGD

SEQ ID NO: 202795 - protein, 23 aa, Mycobacterium bovis
LQPEIPYYSATSFDPREEPYCDA

SEQ ID NO: 202796 - protein, 17 aa, Mycobacterium bovis
LQPFDGYTDPVASEKKL

SEQ ID NO: 202797 - protein, 25 aa, Mycobacterium bovis
LQPIEWRYANDPAWIMRDKGDRLAY

SEQ ID NO: 202798 - protein, 21 aa, Mycobacterium bovis
LQPLFDVINAPTLALLNRPLI

SEQ ID NO: 202799 - protein, 18 aa, Mycobacterium bovis
LQPLKPTRGCSAPTDRFR

SEQ ID NO: 202800 - protein, 19 aa, Mycobacterium bovis
LQPYASFFYNTEGLPYFSI

SEQ ID NO: 202801 - protein, 34 aa, Mycobacterium bovis
LQQVCAEWTRRGWLAVRYNLPYRRRRPTGPPSGS

SEQ ID NO: 202802 - protein, 18 aa, Mycobacterium bovis
LQRDLAHHRGMWHRTPLP

SEQ ID NO: 202803 - protein, 17 aa, Mycobacterium bovis
LQRDVHYIVRDDAVHLI

SEQ ID NO: 202804 - protein, 19 aa, Mycobacterium bovis
LQRRGFLEVETPVLQTLAG

SEQ ID NO: 202805 - protein, 24 aa, Mycobacterium bovis
LQSARAQILAGFCDVALVIGADTT

SEQ ID NO: 202806 - protein, 18 aa, Mycobacterium bovis
LQSAVGFSALGSEHAAIA

SEQ ID NO: 202807 - protein, 23 aa, Mycobacterium bovis
LQSRLHRWRLNMVTGAVHEEQLS

SEQ ID NO: 202808 - protein, 25 aa, Mycobacterium bovis
LQSVDGIGAMWARHVRDGLSQLAES

SEQ ID NO: 202809 - protein, 18 aa, Mycobacterium bovis
LQTEEWLGPASTLMVEAV

SEQ ID NO: 202810 - protein, 17 aa, Mycobacterium bovis
LQTRAEIVVVRGDVASP

SEQ ID NO: 202811 - protein, 27 aa, Mycobacterium bovis
LQVGDFVKIDFGALVAGYHSDMTRTFV

SEQ ID NO: 202812 - protein, 17 aa, Mycobacterium bovis
LQVRPPVVTVMGHVDHG

SEQ ID NO: 202813 - protein, 19 aa, Mycobacterium bovis
LQVTIWTKRLRAVDFTLGY

SEQ ID NO: 202814 - protein, 27 aa, Mycobacterium bovis
LQWGCFRFGIVQGCDHFTFFASVDHVH

SEQ ID NO: 202815 - protein, 25 aa, Mycobacterium bovis
LQYWRGRGLPGKRRLMTWRGGYHGD

SEQ ID NO: 202816 - protein, 20 aa, Mycobacterium bovis
LRAAATRLALRHPMLRVQFL

SEQ ID NO: 202817 - protein, 18 aa, Mycobacterium bovis
LRAADVLVLADAKRGDIG

SEQ ID NO: 202818 - protein, 18 aa, Mycobacterium bovis
LRAAGAVIIGKLAMTEGA

SEQ ID NO: 202819 - protein, 19 aa, Mycobacterium bovis
LRAALPRGGADVEAVLPTV

SEQ ID NO: 202820 - protein, 30 aa, Mycobacterium bovis
LRAALRAVPAERLWVNPDCGLKTRNVDEVT

SEQ ID NO: 202821 - protein, 19 aa, Mycobacterium bovis
LRAAVSKYWIIDEIKPARL

SEQ ID NO: 202822 - protein, 21 aa, Mycobacterium bovis
LRADWPAALQAAGLDSTAPTA

SEQ ID NO: 202823 - protein, 17 aa, Mycobacterium bovis
LRAEGLLAVTGDGAHAA

SEQ ID NO: 202824 - protein, 17 aa, Mycobacterium bovis
LRAGAIARFAPVMDEVV

SEQ ID NO: 202825 - protein, 18 aa, Mycobacterium bovis
LRAGDYVNMGLARHAGLP

SEQ ID NO: 202826 - protein, 18 aa, Mycobacterium bovis
LRAGGRRRLILIHAPSGF

SEQ ID NO: 202827 - protein, 20 aa, Mycobacterium bovis
LRAGIPTLILWVTSDQPIWA

SEQ ID NO: 202828 - protein, 20 aa, Mycobacterium bovis
LRAGLGVAMGNAHPDALAVA

SEQ ID NO: 202829 - protein, 24 aa, Mycobacterium bovis
LRAGVARSGFYFYFDSKYSVLAQI

SEQ ID NO: 202830 - protein, 25 aa, Mycobacterium bovis
LRAKALWLRSRRRGVLAGYSASAFH

SEQ ID NO: 202831 - protein, 17 aa, Mycobacterium bovis
LRAKHGLIPEDEALRAI

SEQ ID NO: 202832 - protein, 21 aa, Mycobacterium bovis
LRALKPWEGPRHFVLIDDVQD

SEQ ID NO: 202833 - protein, 25 aa, Mycobacterium bovis
LRAMLLERLPRYLVPHHIVVLDELP

SEQ ID NO: 202834 - protein, 19 aa, Mycobacterium bovis
LRANLPAVDAVLCSTATRA

SEQ ID NO: 202835 - protein, 19 aa, Mycobacterium bovis
LRAPIQQMIDFMAARTAFF

SEQ ID NO: 202836 - protein, 26 aa, Mycobacterium bovis
LRAQGRHCVAVKWGLWQAPKAGEPAR

SEQ ID NO: 202837 - protein, 21 aa, Mycobacterium bovis
LRARPADYMLALSVAGGSLPV

SEQ ID NO: 202838 - protein, 18 aa, Mycobacterium bovis
LRARRDRLAAGLTEIGFA

SEQ ID NO: 202839 - protein, 30 aa, Mycobacterium bovis
LRASKPLVRLRVPFTLSRNEIDDVERGSKD

SEQ ID NO: 202840 - protein, 21 aa, Mycobacterium bovis
LRASNRIAIERGTHFKGFERS

SEQ ID NO: 202841 - protein, 17 aa, Mycobacterium bovis
LRAVVCAPACAVDDADR

SEQ ID NO: 202842 - protein, 19 aa, Mycobacterium bovis
LRDAGCDIVTITQYLRPSA

SEQ ID NO: 202843 - protein, 18 aa, Mycobacterium bovis
LRDASGIAQVVFRDPQDT

SEQ ID NO: 202844 - protein, 20 aa, Mycobacterium bovis
LRDAVNAVARRHRILRTTYP

SEQ ID NO: 202845 - protein, 24 aa, Mycobacterium bovis
LRDAYCRHIGVEYAHILDPEQKEW

SEQ ID NO: 202846 - protein, 26 aa, Mycobacterium bovis
LRDEGITAMHFVPSLLGLFLSLPGVS

SEQ ID NO: 202847 - protein, 17 aa, Mycobacterium bovis
LRDHAGWPLYPIRPDRS

SEQ ID NO: 202848 - protein, 24 aa, Mycobacterium bovis
LRDICRRYEVLLIFDEIATGFGRT

SEQ ID NO: 202849 - protein, 25 aa, Mycobacterium bovis
LRDLASRIYTDFTYRSGSTTISTGV

SEQ ID NO: 202850 - protein, 19 aa, Mycobacterium bovis
LRDPCRDLVAAIADERIAA

SEQ ID NO: 202851 - protein, 17 aa, Mycobacterium bovis
LRDQRCRTPYCDAPIRH

SEQ ID NO: 202852 - protein, 19 aa, Mycobacterium bovis
LRDRFRCVAPDYLGFGLSE

SEQ ID NO: 202853 - protein, 37 aa, Mycobacterium bovis
LRDTGRCRVPLILRLDPKIGLPDIRAVLTAVVNHHDA

SEQ ID NO: 202854 - protein, 30 aa, Mycobacterium bovis
LRDWRQWWDWVPGACWRHPFGRDSDIADRA

SEQ ID NO: 202855 - protein, 32 aa, Mycobacterium bovis
LREADRWPDKPGRYFTVRAGSLVAWNAEQSGH

SEQ ID NO: 202856 - protein, 18 aa, Mycobacterium bovis
LREALGLQPGSTVEISRY

SEQ ID NO: 202857 - protein, 31 aa, Mycobacterium bovis
LREANDLCALPVAVFRCGMILADTSYAGQLN

SEQ ID NO: 202858 - protein, 26 aa, Mycobacterium bovis
LREANGDRYLPIWIGQSEAAAIALEQ

SEQ ID NO: 202859 - protein, 21 aa, Mycobacterium bovis
LREAVDFELPAPGSYATGIAF

SEQ ID NO: 202860 - protein, 19 aa, Mycobacterium bovis
LREAVPLMPVEQLLVETDA

SEQ ID NO: 202861 - protein, 20 aa, Mycobacterium bovis
LREKFAPLRILTGIEVDILE

SEQ ID NO: 202862 - protein, 20 aa, Mycobacterium bovis
LRELIQVLGHAGVRSLVSQP

SEQ ID NO: 202863 - protein, 23 aa, Mycobacterium bovis
LRELSQRLSAPRVVWVMVPAGNI

SEQ ID NO: 202864 - protein, 20 aa, Mycobacterium bovis
LREREVMGVLAAGMTADHVL

SEQ ID NO: 202865 - protein, 25 aa, Mycobacterium bovis
LRERLGFGELRWALSGAAPIPKETL

SEQ ID NO: 202866 - protein, 18 aa, Mycobacterium bovis
LRESVVAALARRYGITRL

SEQ ID NO: 202867 - protein, 24 aa, Mycobacterium bovis
LRETFRAIGVDLMFDHIKQSLHEF

SEQ ID NO: 202868 - protein, 25 aa, Mycobacterium bovis
LRFAATEVIPRLAGTATEIEQVLRA

SEQ ID NO: 202869 - protein, 24 aa, Mycobacterium bovis
LRFLKEDPWERLATLRAAMPNICL

SEQ ID NO: 202870 - protein, 19 aa, Mycobacterium bovis
LRFPESLMVGLAVTRLGRS

SEQ ID NO: 202871 - protein, 18 aa, Mycobacterium bovis
LRGAWLCTKHAAPRMIER

SEQ ID NO: 202872 - protein, 17 aa, Mycobacterium bovis
LRGFEVLEQLAFDERRL

SEQ ID NO: 202873 - protein, 19 aa, Mycobacterium bovis
LRGGMRNNIGLELKVAESE

SEQ ID NO: 202874 - protein, 19 aa, Mycobacterium bovis
LRGLLTELHRAGAALDYSA

SEQ ID NO: 202875 - protein, 18 aa, Mycobacterium bovis
LRGLMSHMVYADKPDDSI

SEQ ID NO: 202876 - protein, 20 aa, Mycobacterium bovis
LRGLPRLNSAGVRAMGTDLL

SEQ ID NO: 202877 - protein, 28 aa, Mycobacterium bovis
LRGLRMVGRGVLRPGLAVLVGDETVGVT

SEQ ID NO: 202878 - protein, 21 aa, Mycobacterium bovis
LRGRNTLKWNYFGPDVVPLWL

SEQ ID NO: 202879 - protein, 19 aa, Mycobacterium bovis
LRGSRVVLRVPRRGDKRAL

SEQ ID NO: 202880 - protein, 21 aa, Mycobacterium bovis
LRHGLRFLTACQRRYGSVFTL

SEQ ID NO: 202881 - protein, 17 aa, Mycobacterium bovis
LRHVADLVMTGWPVLMA

SEQ ID NO: 202882 - protein, 19 aa, Mycobacterium bovis
LRHYPRSYVEGAARVGIGD

SEQ ID NO: 202883 - protein, 18 aa, Mycobacterium bovis
LRIGVPALADPGTGELVG

SEQ ID NO: 202884 - protein, 20 aa, Mycobacterium bovis
LRIHCDGATDFARIPGSGID

SEQ ID NO: 202885 - protein, 25 aa, Mycobacterium bovis
LRILSDINAFMGYFYVHNTYPELMA

SEQ ID NO: 202886 - protein, 27 aa, Mycobacterium bovis
LRKFLWAPRLGCYGIQRIHPLRNVMIL

SEQ ID NO: 202887 - protein, 20 aa, Mycobacterium bovis
LRKHRGYDFFCLNDGSFPEV

SEQ ID NO: 202888 - protein, 28 aa, Mycobacterium bovis
LRKLLAQEWLRFGWFFLVTRRDPKGLWE

SEQ ID NO: 202889 - protein, 23 aa, Mycobacterium bovis
LRKLRYILNFARLADFEPGAAGP

SEQ ID NO: 202890 - protein, 22 aa, Mycobacterium bovis
LRKRQHIAFKLWRIGRGTAAHP

SEQ ID NO: 202891 - protein, 23 aa, Mycobacterium bovis
LRKSEPYCGYQHYEFDVITDDSC

SEQ ID NO: 202892 - protein, 21 aa, Mycobacterium bovis
LRKTFASGRTRSVEWRKQQLR

SEQ ID NO: 202893 - protein, 20 aa, Mycobacterium bovis
LRKYLGAYLAVLGHTDVVSF

SEQ ID NO: 202894 - protein, 19 aa, Mycobacterium bovis
LRLEGLEVIPSVLPPAPAG

SEQ ID NO: 202895 - protein, 20 aa, Mycobacterium bovis
LRLFDDLRLEHGRLDQPIPV

SEQ ID NO: 202896 - protein, 20 aa, Mycobacterium bovis
LRLGTSVLCNSYRHPSVLAK

SEQ ID NO: 202897 - protein, 20 aa, Mycobacterium bovis
LRLHPNMVRQGGRRSAADPF

SEQ ID NO: 202898 - protein, 17 aa, Mycobacterium bovis
LRLIQRITDRLPAKAPL

SEQ ID NO: 202899 - protein, 20 aa, Mycobacterium bovis
LRLMMKYDPHFFTFLEIPEV

SEQ ID NO: 202900 - protein, 18 aa, Mycobacterium bovis
LRLPDVRALLDAQLAGRP

SEQ ID NO: 202901 - protein, 23 aa, Mycobacterium bovis
LRLRMADLQARVDLLRYALHGIA

SEQ ID NO: 202902 - protein, 17 aa, Mycobacterium bovis
LRLTGRRVMLVPTMGAL

SEQ ID NO: 202903 - protein, 21 aa, Mycobacterium bovis
LRLVAAGVNPIALGVGIGKAA

SEQ ID NO: 202904 - protein, 21 aa, Mycobacterium bovis
LRLWRERFMQRRDGLAHLGFD

SEQ ID NO: 202905 - protein, 21 aa, Mycobacterium bovis
LRMGHVLSQAILRSARRHEAA

SEQ ID NO: 202906 - protein, 18 aa, Mycobacterium bovis
LRMPPYPLILTLRTLVGS

SEQ ID NO: 202907 - protein, 18 aa, Mycobacterium bovis
LRNEVGAAVAVWVDGDLV

SEQ ID NO: 202908 - protein, 26 aa, Mycobacterium bovis
LRNKTRLAALRVKDFGKREVMMVHTL

SEQ ID NO: 202909 - protein, 17 aa, Mycobacterium bovis
LRNLAAIKDVAARPTRT

SEQ ID NO: 202910 - protein, 26 aa, Mycobacterium bovis
LRNLRRPCFSRAEAPIGVYNGEQAII

SEQ ID NO: 202911 - protein, 23 aa, Mycobacterium bovis
LRNTFPPLRMRIADASGIPYVGR

SEQ ID NO: 202912 - protein, 19 aa, Mycobacterium bovis
LRPAGARPGRRCGADRRRR

SEQ ID NO: 202913 - protein, 17 aa, Mycobacterium bovis
LRPAGHGLATPRRRPHR

SEQ ID NO: 202914 - protein, 20 aa, Mycobacterium bovis
LRPDIAWDKGKALDWIGERL

SEQ ID NO: 202915 - protein, 21 aa, Mycobacterium bovis
LRPDVDWDKGKTLLWVLDHLP

SEQ ID NO: 202916 - protein, 21 aa, Mycobacterium bovis
LRPGDFYRPAHQNVYDAILDL

SEQ ID NO: 202917 - protein, 17 aa, Mycobacterium bovis
LRPGPTMISDRKLAWPA

SEQ ID NO: 202918 - protein, 19 aa, Mycobacterium bovis
LRPIESIRVGDFVTGHDGR

SEQ ID NO: 202919 - protein, 18 aa, Mycobacterium bovis
LRPLAPVAHLDFDEPEPA

SEQ ID NO: 202920 - protein, 17 aa, Mycobacterium bovis
LRPLHPYGVSKAATDML

SEQ ID NO: 202921 - protein, 19 aa, Mycobacterium bovis
LRPLKALAARMACPYLNPG

SEQ ID NO: 202922 - protein, 17 aa, Mycobacterium bovis
LRPPPPQRYPLSEAQAA

SEQ ID NO: 202923 - protein, 19 aa, Mycobacterium bovis
LRPPPTFAEVSFATYRPDP

SEQ ID NO: 202924 - protein, 17 aa, Mycobacterium bovis
LRPRKLREAGALWERLT

SEQ ID NO: 202925 - protein, 17 aa, Mycobacterium bovis
LRPSRGTHLVFDAKSFA

SEQ ID NO: 202926 - protein, 30 aa, Mycobacterium bovis
LRPVKPPPSEGWRRLLYLLSGRLINAGEGP

SEQ ID NO: 202927 - protein, 19 aa, Mycobacterium bovis
LRQDGMLALARLQRKMRLV

SEQ ID NO: 202928 - protein, 17 aa, Mycobacterium bovis
LRQISFRLAADDDQFMT

SEQ ID NO: 202929 - protein, 18 aa, Mycobacterium bovis
LRQLAIGSEGVFGVITRV

SEQ ID NO: 202930 - protein, 20 aa, Mycobacterium bovis
LRQLEAIAVQATRISRITPE

SEQ ID NO: 202931 - protein, 22 aa, Mycobacterium bovis
LRQTAARLADWVDAQGPELAPA

SEQ ID NO: 202932 - protein, 20 aa, Mycobacterium bovis
LRQTWLDLHESWLIDKADEI

SEQ ID NO: 202933 - protein, 17 aa, Mycobacterium bovis
LRRAFAADMAFLRNCGI

SEQ ID NO: 202934 - protein, 21 aa, Mycobacterium bovis
LRRAVRLLAQLTRQVAVVQYP

SEQ ID NO: 202935 - protein, 20 aa, Mycobacterium bovis
LRRELLRDGQAFYVHNRVSS

SEQ ID NO: 202936 - protein, 19 aa, Mycobacterium bovis
LRRGGFDAAEPAAWIAEGL

SEQ ID NO: 202937 - protein, 26 aa, Mycobacterium bovis
LRRIEIELDQCWDLLRQRRALRQTGG

SEQ ID NO: 202938 - protein, 19 aa, Mycobacterium bovis
LRRLFPTGFDEQRRAAEIA

SEQ ID NO: 202939 - protein, 24 aa, Mycobacterium bovis
LRRLRELIDRYPLRGIKGPMGTGQ

SEQ ID NO: 202940 - protein, 19 aa, Mycobacterium bovis
LRRQLKPLGRQAEAAQRAA

SEQ ID NO: 202941 - protein, 19 aa, Mycobacterium bovis
LRRRCLYHWIDYPEPDRAA

SEQ ID NO: 202942 - protein, 25 aa, Mycobacterium bovis
LRRRGDRWYWHWDPQFIGGIAAFPP

SEQ ID NO: 202943 - protein, 25 aa, Mycobacterium bovis
LRRRLRLRGSRPLAVVITRIGAGSL

SEQ ID NO: 202944 - protein, 19 aa, Mycobacterium bovis
LRRRMKLGVLAALDQRIGL

SEQ ID NO: 202945 - protein, 22 aa, Mycobacterium bovis
LRRRSAQALRNWVSREQRAVAQ

SEQ ID NO: 202946 - protein, 27 aa, Mycobacterium bovis
LRRRWSPDGKPIVGFVGRLAPEKHVDR

SEQ ID NO: 202947 - protein, 23 aa, Mycobacterium bovis
LRRVIRSAKLLGIDAAIVGDLMA

SEQ ID NO: 202948 - protein, 21 aa, Mycobacterium bovis
LRRWHIDGLLCIGDAAHAMSP

SEQ ID NO: 202949 - protein, 22 aa, Mycobacterium bovis
LRRWLDRPQELLLTELGRASRI

SEQ ID NO: 202950 - protein, 25 aa, Mycobacterium bovis
LRSDFPVLWPVGTRWADNDMFGHLN

SEQ ID NO: 202951 - protein, 22 aa, Mycobacterium bovis
LRSTEAQWARTLAKQTELQAEL

SEQ ID NO: 202952 - protein, 17 aa, Mycobacterium bovis
LRSVPIVGNPLANLVQP

SEQ ID NO: 202953 - protein, 17 aa, Mycobacterium bovis
LRSYRGDMINGFAPDAA

SEQ ID NO: 202954 - protein, 19 aa, Mycobacterium bovis
LRTAVLDFIDRLRCAERAI

SEQ ID NO: 202955 - protein, 20 aa, Mycobacterium bovis
LRTAVRRAKVLAGLDEDTEV

SEQ ID NO: 202956 - protein, 19 aa, Mycobacterium bovis
LRTEMGYPLHGHELSLDIS

SEQ ID NO: 202957 - protein, 24 aa, Mycobacterium bovis
LRTGEAPEQFAWSLVVTASDLSRR

SEQ ID NO: 202958 - protein, 24 aa, Mycobacterium bovis
LRTPESWLLIDFEGEPGQPLDERR

SEQ ID NO: 202959 - protein, 25 aa, Mycobacterium bovis
LRTRKAGAVGLVMAEPLTYFFSDPA

SEQ ID NO: 202960 - protein, 17 aa, Mycobacterium bovis
LRTVKREVASAISRSHR

SEQ ID NO: 202961 - protein, 24 aa, Mycobacterium bovis
LRTVPLELARTWVGLAGTMTTLSA

SEQ ID NO: 202962 - protein, 17 aa, Mycobacterium bovis
LRTWLFRIADDEHVLVA

SEQ ID NO: 202963 - protein, 20 aa, Mycobacterium bovis
LRTYRGVLDAGRVVEFMMLD

SEQ ID NO: 202964 - protein, 19 aa, Mycobacterium bovis
LRVADLFDSQGIWLVSSMT

SEQ ID NO: 202965 - protein, 17 aa, Mycobacterium bovis
LRVAMFPAVEPDDVSAL

SEQ ID NO: 202966 - protein, 28 aa, Mycobacterium bovis
LRVAPSASWMLEYYPIRELRQLPDGSCE

SEQ ID NO: 202967 - protein, 17 aa, Mycobacterium bovis
LRVGTPRGPNLFENMGF

SEQ ID NO: 202968 - protein, 26 aa, Mycobacterium bovis
LRVHARTGLPCPVCGDTVREVSFADK

SEQ ID NO: 202969 - protein, 18 aa, Mycobacterium bovis
LRVLRNIERVIRDEMNAI

SEQ ID NO: 202970 - protein, 19 aa, Mycobacterium bovis
LRVPDSHLIYVARPDDPAD

SEQ ID NO: 202971 - protein, 17 aa, Mycobacterium bovis
LRVPLRETFAGNAKGHG

SEQ ID NO: 202972 - protein, 18 aa, Mycobacterium bovis
LRVQFWVCGVFEVDDGRI

SEQ ID NO: 202973 - protein, 20 aa, Mycobacterium bovis
LRVQMRGEIAQLQRRLGTTT

SEQ ID NO: 202974 - protein, 23 aa, Mycobacterium bovis
LRVVQHWVNHGVKFFRVDNPHTK

SEQ ID NO: 202975 - protein, 19 aa, Mycobacterium bovis
LRWCHEAGIELATVYLLST

SEQ ID NO: 202976 - protein, 18 aa, Mycobacterium bovis
LRWPCPVPGAMPISEVGD

SEQ ID NO: 202977 - protein, 17 aa, Mycobacterium bovis
LRWPGDPSLDAGIDVRS

SEQ ID NO: 202978 - protein, 17 aa, Mycobacterium bovis
LRWYGLDGVEHTGGPLV

SEQ ID NO: 202979 - protein, 19 aa, Mycobacterium bovis
LRYLSAQAQQIEWSKVHLF

SEQ ID NO: 202980 - protein, 19 aa, Mycobacterium bovis
LRYPESHELYILDRRGDGA

SEQ ID NO: 202981 - protein, 17 aa, Mycobacterium bovis
LSAAGADVIMAIRNRAK

SEQ ID NO: 202982 - protein, 21 aa, Mycobacterium bovis
LSAALAEWRGPVLDDLREFSF

SEQ ID NO: 202983 - protein, 39 aa, Mycobacterium bovis
LSAARALGRYGVCANVICPRARTAMTADVFGAAPDVEAG

SEQ ID NO: 202984 - protein, 17 aa, Mycobacterium bovis
LSAAVAAAAPWLRDGDV

SEQ ID NO: 202985 - protein, 23 aa, Mycobacterium bovis
LSADDVARAWSLLGLTVAGPDVP

SEQ ID NO: 202986 - protein, 21 aa, Mycobacterium bovis
LSADRGFARFRRLRWRHPLDG

SEQ ID NO: 202987 - protein, 27 aa, Mycobacterium bovis
LSADRIVLCAGAIQSAHLLMLSGVGEE

SEQ ID NO: 202988 - protein, 17 aa, Mycobacterium bovis
LSAELRASALSYSSVLS

SEQ ID NO: 202989 - protein, 23 aa, Mycobacterium bovis
LSAGCAGFGYALGAAADMIRGGG

SEQ ID NO: 202990 - protein, 25 aa, Mycobacterium bovis
LSALGPKLPELWGGSADLAGSNNTT

SEQ ID NO: 202991 - protein, 17 aa, Mycobacterium bovis
LSALPYPGTGRDLGALV

SEQ ID NO: 202992 - protein, 20 aa, Mycobacterium bovis
LSAPAIKLLIRKAGAASADM

SEQ ID NO: 202993 - protein, 18 aa, Mycobacterium bovis
LSAQAAAFHSQFVQALSG

SEQ ID NO: 202994 - protein, 25 aa, Mycobacterium bovis
LSAQAALFHEQFVRALTAGAGSYAA

SEQ ID NO: 202995 - protein, 20 aa, Mycobacterium bovis
LSAQCPVAIVRPHRVPIGRD

SEQ ID NO: 202996 - protein, 28 aa, Mycobacterium bovis
LSARAAAFHERFVQALATGGGAYAAAEA

SEQ ID NO: 202997 - protein, 18 aa, Mycobacterium bovis
LSATFPDHVLVELPNAKH

SEQ ID NO: 202998 - protein, 20 aa, Mycobacterium bovis
LSAVVHAWVLARANRSNAME

SEQ ID NO: 202999 - protein, 18 aa, Mycobacterium bovis
LSDAASWITGQVINVDGG

SEQ ID NO: 203000 - protein, 22 aa, Mycobacterium bovis
LSDAELYLFFHLLFSAGAETTR

SEQ ID NO: 203001 - protein, 22 aa, Mycobacterium bovis
LSDAGPTGWRIRVRLDVGADRR

SEQ ID NO: 203002 - protein, 20 aa, Mycobacterium bovis
LSDLALNWLCERQLPDGSWG

SEQ ID NO: 203003 - protein, 23 aa, Mycobacterium bovis
LSDLLSRPGVFVFGSNDYFGPRL

SEQ ID NO: 203004 - protein, 20 aa, Mycobacterium bovis
LSEAAFRRFVAALDEPDEAA

SEQ ID NO: 203005 - protein, 22 aa, Mycobacterium bovis
LSEAARQGFTIALVPPSDDPVP

SEQ ID NO: 203006 - protein, 22 aa, Mycobacterium bovis
LSEDDWDGWAALTASIGDRVQI

SEQ ID NO: 203007 - protein, 23 aa, Mycobacterium bovis
LSESIPIRIPVDIPASVIDGISM

SEQ ID NO: 203008 - protein, 20 aa, Mycobacterium bovis
LSFSLPRNGIVGVIGPNGVG

SEQ ID NO: 203009 - protein, 28 aa, Mycobacterium bovis
LSFSRFELLRLLAFSRIGALPITKASDR

SEQ ID NO: 203010 - protein, 20 aa, Mycobacterium bovis
LSFSRPATWASKAAGPLGAV

SEQ ID NO: 203011 - protein, 26 aa, Mycobacterium bovis
LSGADRVGFAWVPLLAFVRLATKVGL

SEQ ID NO: 203012 - protein, 25 aa, Mycobacterium bovis
LSGAKLDVIVPMSFLCDGYGLNVTL

SEQ ID NO: 203013 - protein, 21 aa, Mycobacterium bovis
LSGATPAFAFPLEITIDRIPV

SEQ ID NO: 203014 - protein, 21 aa, Mycobacterium bovis
LSGLDLRPATSRAQCLRMVAD

SEQ ID NO: 203015 - protein, 17 aa, Mycobacterium bovis
LSGLLRGVGDEPELTDF

SEQ ID NO: 203016 - protein, 23 aa, Mycobacterium bovis
LSGYSRVLLKLGGEMFGGGQVGL

SEQ ID NO: 203017 - protein, 19 aa, Mycobacterium bovis
LSHDACCYFDALPEELVPV

SEQ ID NO: 203018 - protein, 25 aa, Mycobacterium bovis
LSHGRVSVGVGFGWNTDELVDHGVP

SEQ ID NO: 203019 - protein, 17 aa, Mycobacterium bovis
LSIAFAIGERHELGPVP

SEQ ID NO: 203020 - protein, 23 aa, Mycobacterium bovis
LSISRTSFDWGVQVPEHPDHVMY

SEQ ID NO: 203021 - protein, 22 aa, Mycobacterium bovis
LSKAQILDRVWSYDFGGRSNIV

SEQ ID NO: 203022 - protein, 21 aa, Mycobacterium bovis
LSKLTPWKAPPPIAHSTVLVA

SEQ ID NO: 203023 - protein, 18 aa, Mycobacterium bovis
LSKQPGIHAVHVSNGDKP

SEQ ID NO: 203024 - protein, 24 aa, Mycobacterium bovis
LSLDEACLLMFARRDLTAAEASAA

SEQ ID NO: 203025 - protein, 20 aa, Mycobacterium bovis
LSLPVRRWPLKPFTQRAYQL

SEQ ID NO: 203026 - protein, 28 aa, Mycobacterium bovis
LSLRDLLKFEFLFSGRAQFEKDLANEVL

SEQ ID NO: 203027 - protein, 21 aa, Mycobacterium bovis
LSLYFVPKFLFDVETGEPGER

SEQ ID NO: 203028 - protein, 23 aa, Mycobacterium bovis
LSMAAAVQPYLVWLTCTAESSAL

SEQ ID NO: 203029 - protein, 19 aa, Mycobacterium bovis
LSPALTFGGANLNFFPMGA

SEQ ID NO: 203030 - protein, 22 aa, Mycobacterium bovis
LSPANIAFALGYPMDIGSYVAF

SEQ ID NO: 203031 - protein, 26 aa, Mycobacterium bovis
LSPAPTCCRTCGAWQTGFPRRSKSCW

SEQ ID NO: 203032 - protein, 19 aa, Mycobacterium bovis
LSPEIMGLGPIEASKKALE

SEQ ID NO: 203033 - protein, 32 aa, Mycobacterium bovis
LSPERVELRYTMPLGEIIFDFFDALKSRTRGY

SEQ ID NO: 203034 - protein, 26 aa, Mycobacterium bovis
LSPLAPLRGGYIADITPLGGGATGGI

SEQ ID NO: 203035 - protein, 18 aa, Mycobacterium bovis
LSPRGDWRAPSDMSARIW

SEQ ID NO: 203036 - protein, 21 aa, Mycobacterium bovis
LSPVRAAIVVPAFTEPAIALS

SEQ ID NO: 203037 - protein, 19 aa, Mycobacterium bovis
LSRELPKSIIIAGAGAIGM

SEQ ID NO: 203038 - protein, 25 aa, Mycobacterium bovis
LSREVIRVARMLNRLTATRLTAAAT

SEQ ID NO: 203039 - protein, 17 aa, Mycobacterium bovis
LSRFSALTRDWFTSTFA

SEQ ID NO: 203040 - protein, 22 aa, Mycobacterium bovis
LSRKLGRVCPAPSPKDAARGAH

SEQ ID NO: 203041 - protein, 25 aa, Mycobacterium bovis
LSRLAAQGWVCLSIDYRVAPHHRWP

SEQ ID NO: 203042 - protein, 28 aa, Mycobacterium bovis
LSRQDWTPSYCRHRRNLQLIGLNDAEKR

SEQ ID NO: 203043 - protein, 18 aa, Mycobacterium bovis
LSRQSAWQVLQDAAERAG

SEQ ID NO: 203044 - protein, 17 aa, Mycobacterium bovis
LSSAERRAIQSFLESGV

SEQ ID NO: 203045 - protein, 17 aa, Mycobacterium bovis
LSSAPVWCSDIRAGAGL

SEQ ID NO: 203046 - protein, 17 aa, Mycobacterium bovis
LSSDPRTGLPLVSVGTV

SEQ ID NO: 203047 - protein, 17 aa, Mycobacterium bovis
LSSEGWLGPASAAMAEA

SEQ ID NO: 203048 - protein, 17 aa, Mycobacterium bovis
LSSGDRVLLCLPDSPDL

SEQ ID NO: 203049 - protein, 25 aa, Mycobacterium bovis
LSSLRAVAVGGDWVRPDLARRLQVQ

SEQ ID NO: 203050 - protein, 23 aa, Mycobacterium bovis
LSSREIASFFILLVVAGNETTRN

SEQ ID NO: 203051 - protein, 21 aa, Mycobacterium bovis
LSSSQMRSWFNYRFDGPNAVN

SEQ ID NO: 203052 - protein, 24 aa, Mycobacterium bovis
LSTEHWMGPASLSMAAAVQPYLVW

SEQ ID NO: 203053 - protein, 18 aa, Mycobacterium bovis
LSTGIALAFPRGPFVPAA

SEQ ID NO: 203054 - protein, 18 aa, Mycobacterium bovis
LSTRLEVEIKRDGYEWSQ

SEQ ID NO: 203055 - protein, 20 aa, Mycobacterium bovis
LSTTDVGAWVTHPGGPKIIN

SEQ ID NO: 203056 - protein, 19 aa, Mycobacterium bovis
LSVPHSWTTAAPEIQLAVQ

SEQ ID NO: 203057 - protein, 19 aa, Mycobacterium bovis
LSVPPDWAARARWANPAAW

SEQ ID NO: 203058 - protein, 17 aa, Mycobacterium bovis
LSVPPSWAGQANLVSST

SEQ ID NO: 203059 - protein, 18 aa, Mycobacterium bovis
LSVQLSGWMLMEAAHSAA

SEQ ID NO: 203060 - protein, 17 aa, Mycobacterium bovis
LSYALAIDRREPLLWKG

SEQ ID NO: 203061 - protein, 18 aa, Mycobacterium bovis
LTAARAVLDMAASVGATS

SEQ ID NO: 203062 - protein, 28 aa, Mycobacterium bovis
LTAARISSIPVEYVLAFVEGSNMGQMMG

SEQ ID NO: 203063 - protein, 24 aa, Mycobacterium bovis
LTAEARSGVDVVRLVAGDPLTVDA

SEQ ID NO: 203064 - protein, 26 aa, Mycobacterium bovis
LTAIKRVLPGLGYRLTSRGVRVATSP

SEQ ID NO: 203065 - protein, 24 aa, Mycobacterium bovis
LTALDRLRFAAGNFYVNDKPTGAV

SEQ ID NO: 203066 - protein, 17 aa, Mycobacterium bovis
LTALGLPTEMDYMGYAD

SEQ ID NO: 203067 - protein, 24 aa, Mycobacterium bovis
LTAMVAKVGVFRPITRLSAERDYI

SEQ ID NO: 203068 - protein, 20 aa, Mycobacterium bovis
LTAMWYAVIDGEIWLETKAK

SEQ ID NO: 203069 - protein, 25 aa, Mycobacterium bovis
LTARLRAAGIPILGKTNMDEFAMGS

SEQ ID NO: 203070 - protein, 28 aa, Mycobacterium bovis
LTATLLTARCPVLFAPAMHTEMWLHPAT

SEQ ID NO: 203071 - protein, 29 aa, Mycobacterium bovis
LTAWSRAQAAWLWSRRRGVIAGQSAAAMH

SEQ ID NO: 203072 - protein, 19 aa, Mycobacterium bovis
LTAYCALRVLAQVQPGESV

SEQ ID NO: 203073 - protein, 19 aa, Mycobacterium bovis
LTAYPAQIHDWYGSEDGLD

SEQ ID NO: 203074 - protein, 19 aa, Mycobacterium bovis
LTDAIALLIAEGHPVHVVV

SEQ ID NO: 203075 - protein, 24 aa, Mycobacterium bovis
LTDERIAYADGWFAEAHDDSSSIT

SEQ ID NO: 203076 - protein, 20 aa, Mycobacterium bovis
LTDHSPRLTIANGLSPDRLR

SEQ ID NO: 203077 - protein, 18 aa, Mycobacterium bovis
LTDIPVRVYWPPVVRDNL

SEQ ID NO: 203078 - protein, 20 aa, Mycobacterium bovis
LTDLLDGWVAYFAEHPRERA

SEQ ID NO: 203079 - protein, 26 aa, Mycobacterium bovis
LTDMIRFGSLYLRDGVSLAGQQVVPA

SEQ ID NO: 203080 - protein, 24 aa, Mycobacterium bovis
LTDRRTRQSFALSARAVINAAGVW

SEQ ID NO: 203081 - protein, 17 aa, Mycobacterium bovis
LTEAIPVQIIWGTKDVV

SEQ ID NO: 203082 - protein, 17 aa, Mycobacterium bovis
LTEALSVEWQRHGVRVA

SEQ ID NO: 203083 - protein, 19 aa, Mycobacterium bovis
LTEARIGVAPAIISLTLLP

SEQ ID NO: 203084 - protein, 17 aa, Mycobacterium bovis
LTEEGHVVVCGRVKDVI

SEQ ID NO: 203085 - protein, 19 aa, Mycobacterium bovis
LTEKKCAITAYPDRGFTNA

SEQ ID NO: 203086 - protein, 18 aa, Mycobacterium bovis
LTELAGRLGEMCSLAGIA

SEQ ID NO: 203087 - protein, 21 aa, Mycobacterium bovis
LTEPMAVGWHAVRRGEVGKGD

SEQ ID NO: 203088 - protein, 21 aa, Mycobacterium bovis
LTERKQVLVVIGRSDEAGAKS

SEQ ID NO: 203089 - protein, 24 aa, Mycobacterium bovis
LTESLRIVTPVGISESRRLPGSGA

SEQ ID NO: 203090 - protein, 21 aa, Mycobacterium bovis
LTESPACLITDAFGMTPALAR

SEQ ID NO: 203091 - protein, 17 aa, Mycobacterium bovis
LTETELDSFAGQLDAIL

SEQ ID NO: 203092 - protein, 26 aa, Mycobacterium bovis
LTETELMAWAIPRAANRFWMLNEPER

SEQ ID NO: 203093 - protein, 17 aa, Mycobacterium bovis
LTFGIVYTYARPNWWAN

SEQ ID NO: 203094 - protein, 23 aa, Mycobacterium bovis
LTFLDREGWDSLTINALATQLGT

SEQ ID NO: 203095 - protein, 19 aa, Mycobacterium bovis
LTGAIAEYLADVTIHVSLT

SEQ ID NO: 203096 - protein, 19 aa, Mycobacterium bovis
LTGCAKLFRQGYTDVDQFT

SEQ ID NO: 203097 - protein, 19 aa, Mycobacterium bovis
LTGCAKLFRVGYIDVNQFT

SEQ ID NO: 203098 - protein, 19 aa, Mycobacterium bovis
LTGCMALGITGPILRSTGL

SEQ ID NO: 203099 - protein, 23 aa, Mycobacterium bovis
LTGCRRAVPALSILTDQLAHELE

SEQ ID NO: 203100 - protein, 26 aa, Mycobacterium bovis
LTGGETIDLLARMRGGIDNARRAELI

SEQ ID NO: 203101 - protein, 18 aa, Mycobacterium bovis
LTGLQIGAGDGFSAIGAV

SEQ ID NO: 203102 - protein, 26 aa, Mycobacterium bovis
LTGLRQRWALVGGFAVSARSEPRFTR

SEQ ID NO: 203103 - protein, 24 aa, Mycobacterium bovis
LTGPRWRLGARDLAALWRRALTLS

SEQ ID NO: 203104 - protein, 19 aa, Mycobacterium bovis
LTGQGGWPMTCFLTPNGRP

SEQ ID NO: 203105 - protein, 25 aa, Mycobacterium bovis
LTGQPAAVVPWDFDGDGLPMSVQLV

SEQ ID NO: 203106 - protein, 17 aa, Mycobacterium bovis
LTGRRVMLVPTMGALHE

SEQ ID NO: 203107 - protein, 18 aa, Mycobacterium bovis
LTGRSWRAGLRQRAAVRV

SEQ ID NO: 203108 - protein, 22 aa, Mycobacterium bovis
LTGSGLLGFGGLNSGTGNIGLF

SEQ ID NO: 203109 - protein, 24 aa, Mycobacterium bovis
LTGYRIAVTSARRAEELCALLRRQ

SEQ ID NO: 203110 - protein, 17 aa, Mycobacterium bovis
LTHDDFRNAWFVDASGR

SEQ ID NO: 203111 - protein, 17 aa, Mycobacterium bovis
LTIANGLSPDRLRKQLD

SEQ ID NO: 203112 - protein, 28 aa, Mycobacterium bovis
LTIPEIPAHLDVNIPIDIPITGSFTDLV

SEQ ID NO: 203113 - protein, 22 aa, Mycobacterium bovis
LTIPMFFGAELVKVTPMDFLRD

SEQ ID NO: 203114 - protein, 17 aa, Mycobacterium bovis
LTKAGELGFSCYVHPEI

SEQ ID NO: 203115 - protein, 22 aa, Mycobacterium bovis
LTLDFPRQVDVLGLAAKAGNPN

SEQ ID NO: 203116 - protein, 26 aa, Mycobacterium bovis
LTLNALQFVGGMLWSTALAEAGAAEA

SEQ ID NO: 203117 - protein, 17 aa, Mycobacterium bovis
LTLNEIHAFIKDPLGRP

SEQ ID NO: 203118 - protein, 17 aa, Mycobacterium bovis
LTLPPTVIFDHPTPTAV

SEQ ID NO: 203119 - protein, 25 aa, Mycobacterium bovis
LTLRGALVRDPRAWSGYLTEAIDTF

SEQ ID NO: 203120 - protein, 29 aa, Mycobacterium bovis
LTLRHFPQSFGFSTLGGWLATRSGGHFAT

SEQ ID NO: 203121 - protein, 17 aa, Mycobacterium bovis
LTLRVYAYSSCCKASYP

SEQ ID NO: 203122 - protein, 17 aa, Mycobacterium bovis
LTPGYLTMGGFIPAQDE

SEQ ID NO: 203123 - protein, 19 aa, Mycobacterium bovis
LTPHSKWSFHSTYQDNLYM

SEQ ID NO: 203124 - protein, 28 aa, Mycobacterium bovis
LTPLEFDLLVALARKPRQVFTRDVLLEQ

SEQ ID NO: 203125 - protein, 21 aa, Mycobacterium bovis
LTPLRHWRSALATALAAPANS

SEQ ID NO: 203126 - protein, 32 aa, Mycobacterium bovis
LTPNITGSAAFRIVVGSVRIPPVSVIVEQIIN

SEQ ID NO: 203127 - protein, 23 aa, Mycobacterium bovis
LTQPVRWDLCTATLREHTVTAIV

SEQ ID NO: 203128 - protein, 19 aa, Mycobacterium bovis
LTQQMVWDRVCSALTPGNV

SEQ ID NO: 203129 - protein, 24 aa, Mycobacterium bovis
LTRIGLGIPYAWSRMRMMRSGKHI

SEQ ID NO: 203130 - protein, 20 aa, Mycobacterium bovis
LTRNLPRLIRPVATVLGPLL

SEQ ID NO: 203131 - protein, 33 aa, Mycobacterium bovis
LTRRYYESFSRCFGCGRIYWPGSHHARLVRLVE

SEQ ID NO: 203132 - protein, 18 aa, Mycobacterium bovis
LTSARLAADVADVPTVVI

SEQ ID NO: 203133 - protein, 26 aa, Mycobacterium bovis
LTSGLQPVDCRFCHVTVTVKRLGPGH

SEQ ID NO: 203134 - protein, 17 aa, Mycobacterium bovis
LTSKPWVKTTIAPGSQV

SEQ ID NO: 203135 - protein, 26 aa, Mycobacterium bovis
LTSRPCPTCRGVGVVIPDPCQQCMGD

SEQ ID NO: 203136 - protein, 33 aa, Mycobacterium bovis
LTTCERCSGRLRKLFNAVGVVFKGTGFYRTDSR

SEQ ID NO: 203137 - protein, 18 aa, Mycobacterium bovis
LTTRVIDLIMPIGKGQRA

SEQ ID NO: 203138 - protein, 24 aa, Mycobacterium bovis
LTTSGFRPATFAAIVDGIVESVEH

SEQ ID NO: 203139 - protein, 20 aa, Mycobacterium bovis
LTVAPWMGPSSITMAAAVAP

SEQ ID NO: 203140 - protein, 17 aa, Mycobacterium bovis
LTVRDNVAFGLKIRKRP

SEQ ID NO: 203141 - protein, 17 aa, Mycobacterium bovis
LTVRLADALARTGDCTA

SEQ ID NO: 203142 - protein, 20 aa, Mycobacterium bovis
LTVTCSRDLVLSAPVKLAEG

SEQ ID NO: 203143 - protein, 19 aa, Mycobacterium bovis
LTVYFALAVRGRLQAGETV

SEQ ID NO: 203144 - protein, 17 aa, Mycobacterium bovis
LTWSRLKVNVAVTQEQA

SEQ ID NO: 203145 - protein, 26 aa, Mycobacterium bovis
LVAANRSDLVSLVFSNFFGQNAPAIA

SEQ ID NO: 203146 - protein, 18 aa, Mycobacterium bovis
LVADGVEQFGRLDIVVAN

SEQ ID NO: 203147 - protein, 18 aa, Mycobacterium bovis
LVAFAERSRFFEVFSSSN

SEQ ID NO: 203148 - protein, 19 aa, Mycobacterium bovis
LVAFPEIRSISYFTQVVEE

SEQ ID NO: 203149 - protein, 17 aa, Mycobacterium bovis
LVAHPTESFGLRITDPS

SEQ ID NO: 203150 - protein, 23 aa, Mycobacterium bovis
LVAIWRRGSELFAEVVAPGEAGV

SEQ ID NO: 203151 - protein, 18 aa, Mycobacterium bovis
LVALPARLANTVAGAALG

SEQ ID NO: 203152 - protein, 37 aa, Mycobacterium bovis
LVALPNGRYGWRISLPAMVCYWSELARDIVLPPVGTA

SEQ ID NO: 203153 - protein, 19 aa, Mycobacterium bovis
LVCRSCGSTIEVGDHEVEA

SEQ ID NO: 203154 - protein, 17 aa, Mycobacterium bovis
LVDACRLSRARVVVTPH

SEQ ID NO: 203155 - protein, 22 aa, Mycobacterium bovis
LVDARYGALGVRGYDHRLVEFV

SEQ ID NO: 203156 - protein, 17 aa, Mycobacterium bovis
LVDCLAFELKMDPAELR

SEQ ID NO: 203157 - protein, 17 aa, Mycobacterium bovis
LVDCRRLQDSFAAVDFF

SEQ ID NO: 203158 - protein, 19 aa, Mycobacterium bovis
LVDDFGINTDNMFGFWDWV

SEQ ID NO: 203159 - protein, 28 aa, Mycobacterium bovis
LVDLILFDWPTHMLQLATWLAENPQLLV

SEQ ID NO: 203160 - protein, 18 aa, Mycobacterium bovis
LVDPRIVDGTSWITGADQ

SEQ ID NO: 203161 - protein, 17 aa, Mycobacterium bovis
LVDVALFAIAQVVQPTE

SEQ ID NO: 203162 - protein, 20 aa, Mycobacterium bovis
LVEHFILEDWWGRWLGRWTA

SEQ ID NO: 203163 - protein, 23 aa, Mycobacterium bovis
LVEKLVPDFLWISTEHTARVSLN

SEQ ID NO: 203164 - protein, 24 aa, Mycobacterium bovis
LVELLEIRAALGPLIGRLAAARST

SEQ ID NO: 203165 - protein, 22 aa, Mycobacterium bovis
LVEMRRVRDLQPYIGKEIEAKI

SEQ ID NO: 203166 - protein, 18 aa, Mycobacterium bovis
LVEPLGFDLSEPKLRRAG

SEQ ID NO: 203167 - protein, 17 aa, Mycobacterium bovis
LVERGWAAALEPVADQV

SEQ ID NO: 203168 - protein, 18 aa, Mycobacterium bovis
LVFDTVITRTVRFPETSV

SEQ ID NO: 203169 - protein, 20 aa, Mycobacterium bovis
LVFPVKRLADLGFRVLATEG

SEQ ID NO: 203170 - protein, 19 aa, Mycobacterium bovis
LVGARLNWLLGNGESPQWS

SEQ ID NO: 203171 - protein, 23 aa, Mycobacterium bovis
LVGASRKRFLGALLAGPDGVMRP

SEQ ID NO: 203172 - protein, 19 aa, Mycobacterium bovis
LVGDAARFLLEGMPVQVAF

SEQ ID NO: 203173 - protein, 24 aa, Mycobacterium bovis
LVGFGGTLRAMFRGDGRTIGGEAL

SEQ ID NO: 203174 - protein, 18 aa, Mycobacterium bovis
LVGRARRHAAAALRSGIT

SEQ ID NO: 203175 - protein, 20 aa, Mycobacterium bovis
LVGTCGVGKASVRVFDDYAH

SEQ ID NO: 203176 - protein, 19 aa, Mycobacterium bovis
LVGVFTFPGHSYAPGKPGE

SEQ ID NO: 203177 - protein, 17 aa, Mycobacterium bovis
LVGVRVGPTISQFPVTV

SEQ ID NO: 203178 - protein, 17 aa, Mycobacterium bovis
LVHCGRLSVEKHADRSI

SEQ ID NO: 203179 - protein, 31 aa, Mycobacterium bovis
LVHFTKFILAEIFPGGWLPSIPTVHEYAEKV

SEQ ID NO: 203180 - protein, 22 aa, Mycobacterium bovis
LVHGLPLYHVHGLVLGLLGSLR

SEQ ID NO: 203181 - protein, 26 aa, Mycobacterium bovis
LVHLLECGLLRGWLIPPADIKAARDV

SEQ ID NO: 203182 - protein, 17 aa, Mycobacterium bovis
LVHPAPRGVLGGLAATV

SEQ ID NO: 203183 - protein, 33 aa, Mycobacterium bovis
LVILLHGFGSFWWSWRHQLCGLTGARVVAVDLR

SEQ ID NO: 203184 - protein, 24 aa, Mycobacterium bovis
LVKKYSDFIAWPIRMDVERRTPAS

SEQ ID NO: 203185 - protein, 20 aa, Mycobacterium bovis
LVKLRPYFDHPLFVEMFADA

SEQ ID NO: 203186 - protein, 17 aa, Mycobacterium bovis
LVKLTCRGRDLPTAVSR

SEQ ID NO: 203187 - protein, 20 aa, Mycobacterium bovis
LVKPPSALMRPRIASRVLGK

SEQ ID NO: 203188 - protein, 23 aa, Mycobacterium bovis
LVKTYRLAKGVVLRRAIGEVRAV

SEQ ID NO: 203189 - protein, 21 aa, Mycobacterium bovis
LVKVRSGYEAALAAALGPAAD

SEQ ID NO: 203190 - protein, 18 aa, Mycobacterium bovis
LVLDECHHLLATWGALVS

SEQ ID NO: 203191 - protein, 17 aa, Mycobacterium bovis
LVLGPGMRIQAPPNLVS

SEQ ID NO: 203192 - protein, 19 aa, Mycobacterium bovis
LVLRTPVRELAGYRSDDPT

SEQ ID NO: 203193 - protein, 31 aa, Mycobacterium bovis
LVLVAARGVERWLSQRLSLVLGCGPGRADGV

SEQ ID NO: 203194 - protein, 25 aa, Mycobacterium bovis
LVMARGIEIGHIFQLGSKYTDAFTA

SEQ ID NO: 203195 - protein, 24 aa, Mycobacterium bovis
LVMQRWVYHSTRLAVPTHTYSDST

SEQ ID NO: 203196 - protein, 19 aa, Mycobacterium bovis
LVNAVGYPLAADVALFTAA

SEQ ID NO: 203197 - protein, 18 aa, Mycobacterium bovis
LVNLKVTLLDGAYHEVDS

SEQ ID NO: 203198 - protein, 20 aa, Mycobacterium bovis
LVNLPNWLSLTFRIDGGAWF

SEQ ID NO: 203199 - protein, 24 aa, Mycobacterium bovis
LVNSDPYGAGWLLDIQVDSSDVAA

SEQ ID NO: 203200 - protein, 21 aa, Mycobacterium bovis
LVPQHLMRRLFFTAATVDAAT

SEQ ID NO: 203201 - protein, 24 aa, Mycobacterium bovis
LVPVLRPRGLFAHDVDLAGEATPT

SEQ ID NO: 203202 - protein, 23 aa, Mycobacterium bovis
LVPVYPTCHYLMGGIPTTVTGQV

SEQ ID NO: 203203 - protein, 17 aa, Mycobacterium bovis
LVQAAALMEGHEADSQT

SEQ ID NO: 203204 - protein, 25 aa, Mycobacterium bovis
LVQGGGFAGPLFDGFDNLYVGQPGA

SEQ ID NO: 203205 - protein, 17 aa, Mycobacterium bovis
LVQGMRVGLAAEVKRTH

SEQ ID NO: 203206 - protein, 18 aa, Mycobacterium bovis
LVQIIRWLRPGAVIAIAK

SEQ ID NO: 203207 - protein, 17 aa, Mycobacterium bovis
LVQRGTLRVGDSVVAGD

SEQ ID NO: 203208 - protein, 26 aa, Mycobacterium bovis
LVRAVGIDFFTRWAAGNIKATDVDDP

SEQ ID NO: 203209 - protein, 25 aa, Mycobacterium bovis
LVRNMPRPLVAVAAILAPLMQDAEL

SEQ ID NO: 203210 - protein, 24 aa, Mycobacterium bovis
LVRPEVMVGTGFLGAHAEEVYRVE

SEQ ID NO: 203211 - protein, 20 aa, Mycobacterium bovis
LVRRCRMVMAGESLPQAEPT

SEQ ID NO: 203212 - protein, 18 aa, Mycobacterium bovis
LVSADWPEPSGISVDLVA

SEQ ID NO: 203213 - protein, 20 aa, Mycobacterium bovis
LVSGRASFELTQKALMAGIP

SEQ ID NO: 203214 - protein, 26 aa, Mycobacterium bovis
LVSHYDVYPAFGFRFDLKKSGVSVTF

SEQ ID NO: 203215 - protein, 17 aa, Mycobacterium bovis
LVSRAHRDKVAGYVPDD

SEQ ID NO: 203216 - protein, 25 aa, Mycobacterium bovis
LVSRISAFLRPDWTRTVRARRFAAA

SEQ ID NO: 203217 - protein, 18 aa, Mycobacterium bovis
LVTDWQLKGEKPNTHDDA

SEQ ID NO: 203218 - protein, 25 aa, Mycobacterium bovis
LVTPAFASGLMRDGMGTMTLNLGLA

SEQ ID NO: 203219 - protein, 17 aa, Mycobacterium bovis
LVTRVPQGWSFAQAAAV

SEQ ID NO: 203220 - protein, 17 aa, Mycobacterium bovis
LVVIAGLQDGLWPNTVP

SEQ ID NO: 203221 - protein, 23 aa, Mycobacterium bovis
LVVPGRPAVMVLPGPPRELQPIW

SEQ ID NO: 203222 - protein, 21 aa, Mycobacterium bovis
LVVSAGFMRILGPQFLSRFYG

SEQ ID NO: 203223 - protein, 25 aa, Mycobacterium bovis
LVYRADSLVNWCPGLGTVLANEEVT

SEQ ID NO: 203224 - protein, 18 aa, Mycobacterium bovis
LWARAGTLATALSAEPAI

SEQ ID NO: 203225 - protein, 20 aa, Mycobacterium bovis
LWCRHPWPEVHGLAESVAAW

SEQ ID NO: 203226 - protein, 19 aa, Mycobacterium bovis
LWDKLTGWVTGLFSRGWSN

SEQ ID NO: 203227 - protein, 24 aa, Mycobacterium bovis
LWGWPQLAGDIWVGAATVAEAVRR

SEQ ID NO: 203228 - protein, 27 aa, Mycobacterium bovis
LWKQWDRCALHWFPGSHLLHVSQLDYL

SEQ ID NO: 203229 - protein, 18 aa, Mycobacterium bovis
LWLDLTYAGSRPVVLTGA

SEQ ID NO: 203230 - protein, 19 aa, Mycobacterium bovis
LWLNESFATFASVLCQSEA

SEQ ID NO: 203231 - protein, 18 aa, Mycobacterium bovis
LWMLMSPTMIARGVKGTN

SEQ ID NO: 203232 - protein, 17 aa, Mycobacterium bovis
LWNPRGYGNNAWARVAL

SEQ ID NO: 203233 - protein, 24 aa, Mycobacterium bovis
LWPPHVPAMLVAGCDPRPNAEPLP

SEQ ID NO: 203234 - protein, 26 aa, Mycobacterium bovis
LWRPPLRPGEWRTLGLFAADDNGELE

SEQ ID NO: 203235 - protein, 27 aa, Mycobacterium bovis
LWTRRGAHESLCFAGANLIPLRGGPID

SEQ ID NO: 203236 - protein, 25 aa, Mycobacterium bovis
LWYCGPWTLWVMAGRGVASGAGVWR

SEQ ID NO: 203237 - protein, 18 aa, Mycobacterium bovis
LYDEVLRVVQHWVNHGVK

SEQ ID NO: 203238 - protein, 20 aa, Mycobacterium bovis
LYDIPGRSAVPIEPDTIRAL

SEQ ID NO: 203239 - protein, 23 aa, Mycobacterium bovis
LYDSYIRAFRWATDRIGDNGVVG

SEQ ID NO: 203240 - protein, 31 aa, Mycobacterium bovis
LYEAKTTFGRIGVKVWIYKGDIVGGKRELAA

SEQ ID NO: 203241 - protein, 19 aa, Mycobacterium bovis
LYELIWQRTVASQMADARG

SEQ ID NO: 203242 - protein, 17 aa, Mycobacterium bovis
LYHREWWDRYVDVNQRF

SEQ ID NO: 203243 - protein, 17 aa, Mycobacterium bovis
LYIEGRLLGKPASIDEA

SEQ ID NO: 203244 - protein, 26 aa, Mycobacterium bovis
LYIQLYLGGFGLELSDIESLRTWGSK

SEQ ID NO: 203245 - protein, 17 aa, Mycobacterium bovis
LYLLPGYHGTGAAAALM

SEQ ID NO: 203246 - protein, 25 aa, Mycobacterium bovis
LYPRKGVSELTRFTPEAVVEKYGLT

SEQ ID NO: 203247 - protein, 18 aa, Mycobacterium bovis
LYPVLDRYDYVLIDCQPS

SEQ ID NO: 203248 - protein, 18 aa, Mycobacterium bovis
LYQRGFQAGQKFLANWNY

SEQ ID NO: 203249 - protein, 18 aa, Mycobacterium bovis
LYQYTVRLLTAIASNPER

SEQ ID NO: 203250 - protein, 18 aa, Mycobacterium bovis
LYRASRAGVRIEVVVRGI

SEQ ID NO: 203251 - protein, 17 aa, Mycobacterium bovis
LYRAYLLKESLRHVFSV

SEQ ID NO: 203252 - protein, 23 aa, Mycobacterium bovis
LYRLYELRLRQGLAASKSDLPRH

SEQ ID NO: 203253 - protein, 19 aa, Mycobacterium bovis
LYSRLARHRIALKLVDRCA

SEQ ID NO: 203254 - protein, 19 aa, Mycobacterium bovis
LYTAVGASIGDAWAADVVV

SEQ ID NO: 203255 - protein, 25 aa, Mycobacterium bovis
LYTHRPSWPAGIAVGKTVVSSSIID

SEQ ID NO: 203256 - protein, 17 aa, Mycobacterium bovis
LYTPCRGQEAAQVGAAA

SEQ ID NO: 203257 - protein, 18 aa, Mycobacterium bovis
LYWIGRYVERADDTARIL

SEQ ID NO: 203258 - protein, 25 aa, Mycobacterium bovis
LYYEAYPAMVHRTLMDIIEECERQA

SEQ ID NO: 203259 - protein, 20 aa, Mycobacterium bovis
MAAAASPYVAWMSVTAGQAQ

SEQ ID NO: 203260 - protein, 20 aa, Mycobacterium bovis
MAAAATPYVGWLAATAALAK

SEQ ID NO: 203261 - protein, 20 aa, Mycobacterium bovis
MAAALGADVCEIYTDVDGIF

SEQ ID NO: 203262 - protein, 20 aa, Mycobacterium bovis
MAASMGEFLLAAGTKGKRYA

SEQ ID NO: 203263 - protein, 18 aa, Mycobacterium bovis
MAAVQLARQWGVEVFVTA

SEQ ID NO: 203264 - protein, 18 aa, Mycobacterium bovis
MADEGRNDIRIEAALAKL

SEQ ID NO: 203265 - protein, 22 aa, Mycobacterium bovis
MAEEVMAPLGPILVAAAGIGPG

SEQ ID NO: 203266 - protein, 24 aa, Mycobacterium bovis
MAFGGKGRAAIAIGNPDTAKHTAV

SEQ ID NO: 203267 - protein, 23 aa, Mycobacterium bovis
MAFLQRPARWMQLLAKHRAQISS

SEQ ID NO: 203268 - protein, 17 aa, Mycobacterium bovis
MAGEPYAVAFGGQGSAW

SEQ ID NO: 203269 - protein, 17 aa, Mycobacterium bovis
MAGKVMKVRGKIAAGAP

SEQ ID NO: 203270 - protein, 17 aa, Mycobacterium bovis
MAGNFSFGDYFKRGAIE

SEQ ID NO: 203271 - protein, 21 aa, Mycobacterium bovis
MAGPRVKRTLTANGLRQLIAF

SEQ ID NO: 203272 - protein, 22 aa, Mycobacterium bovis
MANSLPGQWTAHVTLARRVGGH

SEQ ID NO: 203273 - protein, 24 aa, Mycobacterium bovis
MAPLTLAGVPGFLSAVPPPFNIVI

SEQ ID NO: 203274 - protein, 25 aa, Mycobacterium bovis
MAPRQWRGLRRWLGEPEDFQDPKYD

SEQ ID NO: 203275 - protein, 23 aa, Mycobacterium bovis
MARRMGPGLVHLHLCDGSGLPAD

SEQ ID NO: 203276 - protein, 21 aa, Mycobacterium bovis
MASAAAPYVAWMSATAVHAEL

SEQ ID NO: 203277 - protein, 18 aa, Mycobacterium bovis
MASESWLGPSSAGMAAAA

SEQ ID NO: 203278 - protein, 23 aa, Mycobacterium bovis
MASGELRATMALTEPGGGSDLQN

SEQ ID NO: 203279 - protein, 18 aa, Mycobacterium bovis
MATRPACVEVLFDELARS

SEQ ID NO: 203280 - protein, 18 aa, Mycobacterium bovis
MAVARAREMTALLRAIVE

SEQ ID NO: 203281 - protein, 21 aa, Mycobacterium bovis
MAVERIELFVDVLLKGGRTAD

SEQ ID NO: 203282 - protein, 25 aa, Mycobacterium bovis
MAVLREFPSYIAFRERTKAKQPVDA

SEQ ID NO: 203283 - protein, 22 aa, Mycobacterium bovis
MAVSRAGDWFGSPVNVASRVTG

SEQ ID NO: 203284 - protein, 18 aa, Mycobacterium bovis
MCAGLFAGVGRKFSDEEL

SEQ ID NO: 203285 - protein, 18 aa, Mycobacterium bovis
MDAAWALYEAYIKLLTGE

SEQ ID NO: 203286 - protein, 21 aa, Mycobacterium bovis
MDARLDVYRMLGIKEGEAHVI

SEQ ID NO: 203287 - protein, 23 aa, Mycobacterium bovis
MDEGLRFAIREGGRTVGAGRVTK

SEQ ID NO: 203288 - protein, 25 aa, Mycobacterium bovis
MDFVVPSRGLIGWRTDFLTETRGSG

SEQ ID NO: 203289 - protein, 21 aa, Mycobacterium bovis
MDHDLRFYKDFTGTGNSLNAR

SEQ ID NO: 203290 - protein, 25 aa, Mycobacterium bovis
MDPELIPKLMSAGVIEVAPLAYMRG

SEQ ID NO: 203291 - protein, 26 aa, Mycobacterium bovis
MDPQHRILLEVAWEALEHAGIPPDSL

SEQ ID NO: 203292 - protein, 26 aa, Mycobacterium bovis
MDPQHRMLLELSWEALERAGIDPTGL

SEQ ID NO: 203293 - protein, 25 aa, Mycobacterium bovis
MDPQQRLLIEVAWEALEDAGVPQHT

SEQ ID NO: 203294 - protein, 26 aa, Mycobacterium bovis
MDPQQRMLLELSWEALERAGIDPTGL

SEQ ID NO: 203295 - protein, 20 aa, Mycobacterium bovis
MDQPYPVAMAKLGQAIATEQ

SEQ ID NO: 203296 - protein, 19 aa, Mycobacterium bovis
MDRMLRPGGVVDLLTQPGG

SEQ ID NO: 203297 - protein, 25 aa, Mycobacterium bovis
MDSRLWRLLLAPGRGIGRLITGVMG

SEQ ID NO: 203298 - protein, 24 aa, Mycobacterium bovis
MDVNPCAELSMLLLDTAAMADLHM

SEQ ID NO: 203299 - protein, 17 aa, Mycobacterium bovis
MDVRFLPNPHWVDELRP

SEQ ID NO: 203300 - protein, 17 aa, Mycobacterium bovis
MELFKTALRLARHRELV

SEQ ID NO: 203301 - protein, 21 aa, Mycobacterium bovis
MEPYLGVAVHGFPNYFFITGP

SEQ ID NO: 203302 - protein, 19 aa, Mycobacterium bovis
MEQAMGIAKGYLANQENVM

SEQ ID NO: 203303 - protein, 23 aa, Mycobacterium bovis
MEREFPEEFARTAASPFRSDTDI

SEQ ID NO: 203304 - protein, 18 aa, Mycobacterium bovis
MFGNRGIYHKGWTAVTKH

SEQ ID NO: 203305 - protein, 17 aa, Mycobacterium bovis
MFGPESDLAIAIQRITR

SEQ ID NO: 203306 - protein, 23 aa, Mycobacterium bovis
MFQMKFYAVALFRSRGVPPTRLR

SEQ ID NO: 203307 - protein, 18 aa, Mycobacterium bovis
MFVGGRRGSSVTVSDKTL

SEQ ID NO: 203308 - protein, 20 aa, Mycobacterium bovis
MGAEGLRAASLTAITSANYI

SEQ ID NO: 203309 - protein, 25 aa, Mycobacterium bovis
MGAKIALPGTEVWAIDGDGCFQMTN

SEQ ID NO: 203310 - protein, 24 aa, Mycobacterium bovis
MGALRTAAALARLNQRNGFDCPGC

SEQ ID NO: 203311 - protein, 18 aa, Mycobacterium bovis
MGARKSPRLWIVTRGAAQ

SEQ ID NO: 203312 - protein, 17 aa, Mycobacterium bovis
MGDGRIRARREISVKIP

SEQ ID NO: 203313 - protein, 20 aa, Mycobacterium bovis
MGFCTPQEYVLFLRQTPIFE

SEQ ID NO: 203314 - protein, 21 aa, Mycobacterium bovis
MGFVDARGFDSLPIEERRRDA

SEQ ID NO: 203315 - protein, 35 aa, Mycobacterium bovis; identical to SEQ ID NO: 82626

SEQ ID NO: 203316 - protein, 18 aa, Mycobacterium bovis
MGIDKLRVIHTGMDPVVA

SEQ ID NO: 203317 - protein, 21 aa, Mycobacterium bovis
MGLVEIRPELRAVTVDGDLVG

SEQ ID NO: 203318 - protein, 18 aa, Mycobacterium bovis
MGLVPAMTVKCAVALVKS

SEQ ID NO: 203319 - protein, 24 aa, Mycobacterium bovis
MGPEGRAAIGLGDGVVRISVGLED

SEQ ID NO: 203320 - protein, 24 aa, Mycobacterium bovis
MGPLMRRSGMIFIRRNIGNDPLYK

SEQ ID NO: 203321 - protein, 22 aa, Mycobacterium bovis
MGSDHIRPAMAINKEINLRFVL

SEQ ID NO: 203322 - protein, 25 aa, Mycobacterium bovis
MGSLARLPLILSDGHLRELALTGKN

SEQ ID NO: 203323 - protein, 18 aa, Mycobacterium bovis
MGVLPAERLGSVSDGDRV

SEQ ID NO: 203324 - protein, 31 aa, Mycobacterium bovis
MHDWCISRQLWWGHRIPIWYGPDGEQVCVGP

SEQ ID NO: 203325 - protein, 23 aa, Mycobacterium bovis
MHGPAEVAFTCELFSRVEDVLGL

SEQ ID NO: 203326 - protein, 23 aa, Mycobacterium bovis
MHGTDAWEPYAAVADSEITRVVL

SEQ ID NO: 203327 - protein, 23 aa, Mycobacterium bovis
MHPFCARRELIASIPGIGVGASA

SEQ ID NO: 203328 - protein, 24 aa, Mycobacterium bovis
MHPFCARRELIASIPGIGVGASAT

SEQ ID NO: 203329 - protein, 24 aa, Mycobacterium bovis
MIGKPGAGVCPVRGHSNVQGDRTM

SEQ ID NO: 203330 - protein, 32 aa, Mycobacterium bovis
MIHVVGFRDGKAFYRNRFIRTDGFLAENEAGG

SEQ ID NO: 203331 - protein, 17 aa, Mycobacterium bovis
MIRGLRRTHGWPAAMGI

SEQ ID NO: 203332 - protein, 27 aa, Mycobacterium bovis
MIVDEPFMLPAHIDFAALKVKFDGGTL

SEQ ID NO: 203333 - protein, 34 aa, Mycobacterium bovis
MKAEGTFEYQALLFIPSHAPFDLFDRDAHVGIQL

SEQ ID NO: 203334 - protein, 20 aa, Mycobacterium bovis
MKDMVGMMIVVARHLRQAAI

SEQ ID NO: 203335 - protein, 24 aa, Mycobacterium bovis
MKEGDDVFVALSWTKHPPPQTYDE

SEQ ID NO: 203336 - protein, 22 aa, Mycobacterium bovis
MKEGRYEVRAELPGVDPDKDVD

SEQ ID NO: 203337 - protein, 22 aa, Mycobacterium bovis
MKKLDPRGVIVVIEAEHLCMAM

SEQ ID NO: 203338 - protein, 18 aa, Mycobacterium bovis
MKWNMGWMHDTLDYVSRD

SEQ ID NO: 203339 - protein, 20 aa, Mycobacterium bovis
MLAAASAWDGLATELASAAV

SEQ ID NO: 203340 - protein, 20 aa, Mycobacterium bovis
MLAAASAWHGLSAELRASAL

SEQ ID NO: 203341 - protein, 20 aa, Mycobacterium bovis
MLAELFRRRVLVPPEGACPG

SEQ ID NO: 203342 - protein, 17 aa, Mycobacterium bovis
MLAFLQKRPPRWVQPAT

SEQ ID NO: 203343 - protein, 18 aa, Mycobacterium bovis
MLAQLAAAGLGGYVLCGL

SEQ ID NO: 203344 - protein, 20 aa, Mycobacterium bovis
MLAQRVGAWVPLGEVPEVWA

SEQ ID NO: 203345 - protein, 17 aa, Mycobacterium bovis
MLARADSVGVFQVESRA

SEQ ID NO: 203346 - protein, 17 aa, Mycobacterium bovis
MLARRLSGWQDRYPDVV

SEQ ID NO: 203347 - protein, 18 aa, Mycobacterium bovis
MLASARFRAGLDRIPGAT

SEQ ID NO: 203348 - protein, 17 aa, Mycobacterium bovis
MLCYRRRGHNEGDDPSM

SEQ ID NO: 203349 - protein, 22 aa, Mycobacterium bovis
MLDLFLLILVELFRRHLSSTEQ

SEQ ID NO: 203350 - protein, 20 aa, Mycobacterium bovis
MLDLGFLPDIERILRQIPAD

SEQ ID NO: 203351 - protein, 21 aa, Mycobacterium bovis
MLDYDCPRSALKKATAITPGL

SEQ ID NO: 203352 - protein, 18 aa, Mycobacterium bovis
MLEAAVIAGLTSEGVDAL

SEQ ID NO: 203353 - protein, 29 aa, Mycobacterium bovis
MLEMAACGAKVLMLRCVEYARRHNIPVHV

SEQ ID NO: 203354 - protein, 26 aa, Mycobacterium bovis
MLGELERIGGRYGLQTMCEGGGTANV

SEQ ID NO: 203355 - protein, 20 aa, Mycobacterium bovis
MLIAGGRRAVLCGNIGSAVL

SEQ ID NO: 203356 - protein, 18 aa, Mycobacterium bovis
MLIVPGSMRVRAQAEAEG

SEQ ID NO: 203357 - protein, 18 aa, Mycobacterium bovis
MLLDEGRLQDGEPYLAGT

SEQ ID NO: 203358 - protein, 20 aa, Mycobacterium bovis
MLLEVAWEALEHAGIPPDSL

SEQ ID NO: 203359 - protein, 17 aa, Mycobacterium bovis
MLLHQAFAQVEQFTGLP

SEQ ID NO: 203360 - protein, 20 aa, Mycobacterium bovis
MLLLWIRGVRFMYSVDPYLP

SEQ ID NO: 203361 - protein, 17 aa, Mycobacterium bovis
MLPPGTSTLVWRDAAQL

SEQ ID NO: 203362 - protein, 21 aa, Mycobacterium bovis
MLRAARFVSQLGFAVAPRVRA

SEQ ID NO: 203363 - protein, 18 aa, Mycobacterium bovis
MLRANAKLAASTGVPQES

SEQ ID NO: 203364 - protein, 26 aa, Mycobacterium bovis
MLRMLRPDLTIGFFLHIPFPPVELFM

SEQ ID NO: 203365 - protein, 19 aa, Mycobacterium bovis
MLRSIYLQSLVHKRTAQPV

SEQ ID NO: 203366 - protein, 19 aa, Mycobacterium bovis
MLSRLGRRGAALDLIEEFE

SEQ ID NO: 203367 - protein, 24 aa, Mycobacterium bovis
MLTCAIRPSGIWGNGDQTMFRKLF

SEQ ID NO: 203368 - protein, 19 aa, Mycobacterium bovis
MMAAFADQAALAWQLATSQ

SEQ ID NO: 203369 - protein, 20 aa, Mycobacterium bovis
MMAAGAAWNGLAAELGTTAA

SEQ ID NO: 203370 - protein, 21 aa, Mycobacterium bovis
MMDKLRTAGPWESEQTHDSLR

SEQ ID NO: 203371 - protein, 18 aa, Mycobacterium bovis
MMINLFWLGLKGAPVDRL

SEQ ID NO: 203372 - protein, 29 aa, Mycobacterium bovis
MMLDRLFPRSVFHSLKLAEHNLAELMHNP

SEQ ID NO: 203373 - protein, 21 aa, Mycobacterium bovis
MMMPFLEHFVMRSRYVDNPGL

SEQ ID NO: 203374 - protein, 21 aa, Mycobacterium bovis
MMRLECPAGLDLRTPNPEAYE

SEQ ID NO: 203375 - protein, 26 aa, Mycobacterium bovis
MMTDGRWDPGKDFAMVTARETGPTQK

SEQ ID NO: 203376 - protein, 23 aa, Mycobacterium bovis
MNAFGIALLCHVLLVETDDGLVL

SEQ ID NO: 203377 - protein, 18 aa, Mycobacterium bovis
MNDVKSWVAFGASPRASL

SEQ ID NO: 203378 - protein, 28 aa, Mycobacterium bovis
MNNGVFYRGVGQGSLQFAITSPDLTLPS

SEQ ID NO: 203379 - protein, 27 aa, Mycobacterium bovis
MNNGVFYRGVGQGSLQFSITTPDLTLP

SEQ ID NO: 203380 - protein, 25 aa, Mycobacterium bovis
MPAYAKMVMNFGRFAMPQVGEPFYA

SEQ ID NO: 203381 - protein, 18 aa, Mycobacterium bovis
MPDLRCLILTSYTSDEAM

SEQ ID NO: 203382 - protein, 18 aa, Mycobacterium bovis
MPDPVPVILLSRLAVDRK

SEQ ID NO: 203383 - protein, 24 aa, Mycobacterium bovis
MPDRVKCLHVLIAHSLAKGPGLNP

SEQ ID NO: 203384 - protein, 20 aa, Mycobacterium bovis
MPEDLIKFGLIPEFIGRLPV

SEQ ID NO: 203385 - protein, 25 aa, Mycobacterium bovis
MPEKLHELQRLWLIEATRYNVLPLD

SEQ ID NO: 203386 - protein, 18 aa, Mycobacterium bovis
MPENLVAVVQDGWRNIRR

SEQ ID NO: 203387 - protein, 21 aa, Mycobacterium bovis
MPEPFAFSMVLPLAVPGHDRG

SEQ ID NO: 203388 - protein, 26 aa, Mycobacterium bovis
MPGAGGNGGNANWFGSGGAGGQGGTG

SEQ ID NO: 203389 - protein, 21 aa, Mycobacterium bovis
MPGMDGFGVLRRLRADGIDAP

SEQ ID NO: 203390 - protein, 21 aa, Mycobacterium bovis
MPGVLSARWSGRYGDDAANTA

SEQ ID NO: 203391 - protein, 21 aa, Mycobacterium bovis
MPGVPNHWHVYFAVDDADATA

SEQ ID NO: 203392 - protein, 24 aa, Mycobacterium bovis
MPIHMRLPKLKGFRNRFRTEYEIV

SEQ ID NO: 203393 - protein, 23 aa, Mycobacterium bovis
MPLLERAKFLAIFASNLDEFYMV

SEQ ID NO: 203394 - protein, 21 aa, Mycobacterium bovis
MPMVPPGAMGARGEGSGQEKP

SEQ ID NO: 203395 - protein, 21 aa, Mycobacterium bovis
MPPCTGTGMGIDRLLMSLTGL

SEQ ID NO: 203396 - protein, 20 aa, Mycobacterium bovis
MPPLDHRAPGPVLALLCDPR

SEQ ID NO: 203397 - protein, 29 aa, Mycobacterium bovis
MPRHPIRLARFGPRAALPATAMARRFHTE

SEQ ID NO: 203398 - protein, 25 aa, Mycobacterium bovis
MPTLDSFLHYRMIDVSSIKELCRRW

SEQ ID NO: 203399 - protein, 19 aa, Mycobacterium bovis
MQELVRYGVQPDWFELGDR

SEQ ID NO: 203400 - protein, 18 aa, Mycobacterium bovis
MQLDRAERGFAYATDAPL

SEQ ID NO: 203401 - protein, 25 aa, Mycobacterium bovis
MQLTLTELWRSYGVQPDLVIGHSMG

SEQ ID NO: 203402 - protein, 22 aa, Mycobacterium bovis
MQVCQKSQCPFSTADSENLQIP

SEQ ID NO: 203403 - protein, 17 aa, Mycobacterium bovis
MRAGRRAAQDLCAKTRV

SEQ ID NO: 203404 - protein, 17 aa, Mycobacterium bovis
MRAIVGFAAETGDANGD

SEQ ID NO: 203405 - protein, 19 aa, Mycobacterium bovis
MRALDWFEVQSIRGHLVDG

SEQ ID NO: 203406 - protein, 19 aa, Mycobacterium bovis
MRALIVVAGLRMSRTPPDI

SEQ ID NO: 203407 - protein, 17 aa, Mycobacterium bovis
MRALTGRSWRAGLRQRA

SEQ ID NO: 203408 - protein, 17 aa, Mycobacterium bovis
MRDLLAYMENVVSDALG

SEQ ID NO: 203409 - protein, 24 aa, Mycobacterium bovis
MRDRGRLPGLSKRLGVLTRTNSES

SEQ ID NO: 203410 - protein, 18 aa, Mycobacterium bovis
MREGLAWLESILEREGDN

SEQ ID NO: 203411 - protein, 17 aa, Mycobacterium bovis
MREQAARIGRATLTRYA

SEQ ID NO: 203412 - protein, 17 aa, Mycobacterium bovis
MRGGNPLAYLDSGATSQ

SEQ ID NO: 203413 - protein, 24 aa, Mycobacterium bovis
MRGPSSIWYRIRINLQHVPADQRP

SEQ ID NO: 203414 - protein, 20 aa, Mycobacterium bovis
MRLAAIGAHVQRFAGPGDRV

SEQ ID NO: 203415 - protein, 23 aa, Mycobacterium bovis
MRLAGNAHFTFRGCEGDALLMLL

SEQ ID NO: 203416 - protein, 18 aa, Mycobacterium bovis
MRLGELAVEAGLDEDLLQ

SEQ ID NO: 203417 - protein, 20 aa, Mycobacterium bovis
MRLLGVTCLEELSPRHVTQL

SEQ ID NO: 203418 - protein, 17 aa, Mycobacterium bovis
MRNPVRFQQAIASAGSG

SEQ ID NO: 203419 - protein, 20 aa, Mycobacterium bovis
MRQDETFLRELVDAYVNGDG

SEQ ID NO: 203420 - protein, 18 aa, Mycobacterium bovis
MRRAREEAEQLVAQATAE

SEQ ID NO: 203421 - protein, 24 aa, Mycobacterium bovis
MRRHHLPVPPAFCITTEVGVRYLA

SEQ ID NO: 203422 - protein, 24 aa, Mycobacterium bovis
MRRRIDIACGLVVQPQVAFLDEPT

SEQ ID NO: 203423 - protein, 19 aa, Mycobacterium bovis
MRRRRGLPPIAPHSGLGYA

SEQ ID NO: 203424 - protein, 20 aa, Mycobacterium bovis
MRVRLAMGVVTSIDPEILLL

SEQ ID NO: 203425 - protein, 21 aa, Mycobacterium bovis
MRVVVCRRLGPAKGQRRWHPL

SEQ ID NO: 203426 - protein, 21 aa, Mycobacterium bovis
MRWKGKRPSVRGVVMNPVDHP

SEQ ID NO: 203427 - protein, 17 aa, Mycobacterium bovis
MRYDLSAGFPLLTTKKV

SEQ ID NO: 203428 - protein, 20 aa, Mycobacterium bovis
MRYTCERLVRGLDTIAATGN

SEQ ID NO: 203429 - protein, 19 aa, Mycobacterium bovis
MSDEEWDAVIAVHLRGHFL

SEQ ID NO: 203430 - protein, 22 aa, Mycobacterium bovis
MSDGWLGLLACGDHHLDTLAGA

SEQ ID NO: 203431 - protein, 21 aa, Mycobacterium bovis
MSDLRFLKFLRESIFPGGELP

SEQ ID NO: 203432 - protein, 24 aa, Mycobacterium bovis
MSEAQLADEIFVIADLARQKARAS

SEQ ID NO: 203433 - protein, 24 aa, Mycobacterium bovis
MSEFPTDRGWDLAGLFDPDPDVRH

SEQ ID NO: 203434 - protein, 19 aa, Mycobacterium bovis
MSGALRSGTFIRLDETAAE

SEQ ID NO: 203435 - protein, 20 aa, Mycobacterium bovis
MSGGMPAAAFGGRAEVMQRL

SEQ ID NO: 203436 - protein, 29 aa, Mycobacterium bovis
MSGTRITLHAALQLARRGSGVGVAALCGA

SEQ ID NO: 203437 - protein, 27 aa, Mycobacterium bovis
MSIDERARAGLFLAMQYPVEVPGVSMS

SEQ ID NO: 203438 - protein, 25 aa, Mycobacterium bovis
MSKAFAFAGGRLGYLIATPAVIDAM

SEQ ID NO: 203439 - protein, 20 aa, Mycobacterium bovis
MSLLDRWYAAIGHELHTLGG

SEQ ID NO: 203440 - protein, 35 aa, Mycobacterium bovis
MSPAERWHLLASAWLDLPGRPALIGTRGPDAKPYG

SEQ ID NO: 203441 - protein, 22 aa, Mycobacterium bovis
MSPGERLLGLDLANGGHLTHGM

SEQ ID NO: 203442 - protein, 25 aa, Mycobacterium bovis
MSPTAFVRRPLRWIQALSEGSRTGR

SEQ ID NO: 203443 - protein, 20 aa, Mycobacterium bovis
MSRGAIFHHFRDKDALFFAL

SEQ ID NO: 203444 - protein, 17 aa, Mycobacterium bovis
MSRPCMDAARCLSEEQI

SEQ ID NO: 203445 - protein, 19 aa, Mycobacterium bovis
MSRSEFFTKAAQRYLHELD

SEQ ID NO: 203446 - protein, 21 aa, Mycobacterium bovis
MSSLRSGECDLALAGGVTVMG

SEQ ID NO: 203447 - protein, 19 aa, Mycobacterium bovis
MSVAYRLTGTVADAEDIVQ

SEQ ID NO: 203448 - protein, 18 aa, Mycobacterium bovis
MSVPPSWAAATPAIRTVA

SEQ ID NO: 203449 - protein, 24 aa, Mycobacterium bovis
MTAHLRPGQLVLIHGGASGIGSHA

SEQ ID NO: 203450 - protein, 27 aa, Mycobacterium bovis
MTAIVKGLRTGTDFEYELQMAQMNKHI

SEQ ID NO: 203451 - protein, 21 aa, Mycobacterium bovis
MTEFHSGFVCLVGRPNTGKST

SEQ ID NO: 203452 - protein, 18 aa, Mycobacterium bovis
MTEFKVFWQPPPAPEIPK

SEQ ID NO: 203453 - protein, 18 aa, Mycobacterium bovis
MTELPLLVIDVQRGGPST

SEQ ID NO: 203454 - protein, 18 aa, Mycobacterium bovis
MTETSPLATMAWPPPGTP

SEQ ID NO: 203455 - protein, 18 aa, Mycobacterium bovis
MTGFGGWNSGTGNIGLFN

SEQ ID NO: 203456 - protein, 17 aa, Mycobacterium bovis
MTLEMGKTLAAAKAEAL

SEQ ID NO: 203457 - protein, 21 aa, Mycobacterium bovis
MTQGSLVRFLVRSGQSAAAAR

SEQ ID NO: 203458 - protein, 18 aa, Mycobacterium bovis
MTTFGFILGEVFRRVTGR

SEQ ID NO: 203459 - protein, 35 aa, Mycobacterium bovis
MTVTLCKRLAAVTGLRLPETVGWDYGSISGLAQYL

SEQ ID NO: 203460 - protein, 19 aa, Mycobacterium bovis
MVAAASAWNGLAAELSSAA

SEQ ID NO: 203461 - protein, 27 aa, Mycobacterium bovis
MVAACLKWEGGYVWACKNYDGDVQSDT

SEQ ID NO: 203462 - protein, 19 aa, Mycobacterium bovis
MVAAVLPFVGWLSTTATLA

SEQ ID NO: 203463 - protein, 20 aa, Mycobacterium bovis
MVATEAWPPNAAMATRRLHP

SEQ ID NO: 203464 - protein, 19 aa, Mycobacterium bovis
MVDAAASYIGWLSTSAAHA

SEQ ID NO: 203465 - protein, 23 aa, Mycobacterium bovis
MVDVRFPVQYVIRPHTLEHQDHR

SEQ ID NO: 203466 - protein, 20 aa, Mycobacterium bovis
MVIKDGRFGPYVTDGETNAS

SEQ ID NO: 203467 - protein, 23 aa, Mycobacterium bovis
MVRNMRVARQLGFLRVADSDLID

SEQ ID NO: 203468 - protein, 20 aa, Mycobacterium bovis
MVRWNKIRWRCREDYCKLGP

SEQ ID NO: 203469 - protein, 17 aa, Mycobacterium bovis
MWAASGVDYPTLLATMI

SEQ ID NO: 203470 - protein, 17 aa, Mycobacterium bovis
MWLDAVGISEDLHRYLD

SEQ ID NO: 203471 - protein, 25 aa, Mycobacterium bovis
MWQTTECWRQWINIGNFPDHPWRAY

SEQ ID NO: 203472 - protein, 24 aa, Mycobacterium bovis
MYAAGRIPGSFFRREGRPSTDAIL

SEQ ID NO: 203473 - protein, 20 aa, Mycobacterium bovis
MYDRGNCFIFADGAAAVVVG

SEQ ID NO: 203474 - protein, 24 aa, Mycobacterium bovis
MYEQMWAADVAAMVGYHGGASAAA

SEQ ID NO: 203475 - protein, 18 aa, Mycobacterium bovis
MYSVMWSEHCSYKSSKVH

SEQ ID NO: 203476 - protein, 20 aa, Mycobacterium bovis
MYTLGFRFRPWTGRQAIADG

SEQ ID NO: 203477 - protein, 20 aa, Mycobacterium bovis
NAAALPFRYTVNGYRGCSHA

SEQ ID NO: 203478 - protein, 23 aa, Mycobacterium bovis
NAAGLPSLMVLTGVNSAWDAVYA

SEQ ID NO: 203479 - protein, 22 aa, Mycobacterium bovis
NAAGPYASWLTAAGAQAELAAR

SEQ ID NO: 203480 - protein, 18 aa, Mycobacterium bovis
NADAFSWSQTFESLVPVD

SEQ ID NO: 203481 - protein, 23 aa, Mycobacterium bovis
NADIAMAFERYRIVTGDGSLEEE

SEQ ID NO: 203482 - protein, 28 aa, Mycobacterium bovis
NADLARPWLAEAVGLARAVGDKWRLAEV

SEQ ID NO: 203483 - protein, 19 aa, Mycobacterium bovis
NAGKLIVVVLPDFGERYLS

SEQ ID NO: 203484 - protein, 18 aa, Mycobacterium bovis
NAGSGSWGLANVGVGNIG

SEQ ID NO: 203485 - protein, 19 aa, Mycobacterium bovis
NAGTIFWNGPMGVFEFPAY

SEQ ID NO: 203486 - protein, 19 aa, Mycobacterium bovis
NAGVHACAVIMSSEPLTEA

SEQ ID NO: 203487 - protein, 24 aa, Mycobacterium bovis
NAHLRLHVHLEISPAYRDVFTIRV

SEQ ID NO: 203488 - protein, 26 aa, Mycobacterium bovis
NAITLFPGGLTFPATSLLNLDVTAGA

SEQ ID NO: 203489 - protein, 18 aa, Mycobacterium bovis
NALISVCRACPRLVSWRE

SEQ ID NO: 203490 - protein, 22 aa, Mycobacterium bovis
NALPRRGISALVRRPKRRPLDE

SEQ ID NO: 203491 - protein, 25 aa, Mycobacterium bovis
NAPAQALFGRPLIGNGANGTAASPN

SEQ ID NO: 203492 - protein, 18 aa, Mycobacterium bovis
NAPLVSFDETFKLVKVNP

SEQ ID NO: 203493 - protein, 17 aa, Mycobacterium bovis
NAPMLGVAYGYPGAPGQ

SEQ ID NO: 203494 - protein, 19 aa, Mycobacterium bovis
NAPVAVPWVLAARSPQALT

SEQ ID NO: 203495 - protein, 21 aa, Mycobacterium bovis
NARGGRLSRQSAWQVLQDAAE

SEQ ID NO: 203496 - protein, 17 aa, Mycobacterium bovis
NARTRFVLVGRPGPPPA

SEQ ID NO: 203497 - protein, 18 aa, Mycobacterium bovis
NASALDLATPGFLSGIGN

SEQ ID NO: 203498 - protein, 23 aa, Mycobacterium bovis
NATLHGLAGWVDVKPAVVSTAIA

SEQ ID NO: 203499 - protein, 23 aa, Mycobacterium bovis
NATLRYLMFSVFSVSPGALGDQR

SEQ ID NO: 203500 - protein, 19 aa, Mycobacterium bovis
NATPRERLLALFDRPNRGD

SEQ ID NO: 203501 - protein, 19 aa, Mycobacterium bovis
NAVGSPITTAIAFAESTTA

SEQ ID NO: 203502 - protein, 23 aa, Mycobacterium bovis
NAVPTAAAYRWRGAARALRRLAN

SEQ ID NO: 203503 - protein, 19 aa, Mycobacterium bovis
NCEIVPWCRFARKNYFYPD

SEQ ID NO: 203504 - protein, 23 aa, Mycobacterium bovis
NDCPAELWSALDPQALATEHKAA

SEQ ID NO: 203505 - protein, 17 aa, Mycobacterium bovis
NDGCCSHGAFLSDDDDR

SEQ ID NO: 203506 - protein, 28 aa, Mycobacterium bovis
NDGKLKYCYNLGGIKHFYAESADPLPAG

SEQ ID NO: 203507 - protein, 19 aa, Mycobacterium bovis
NDGMLRVRATLVLDGDTLR

SEQ ID NO: 203508 - protein, 17 aa, Mycobacterium bovis
NDGRAAFQTVFHVHLHV

SEQ ID NO: 203509 - protein, 22 aa, Mycobacterium bovis
NDGRFAMYTKMHHALIDGVSAM

SEQ ID NO: 203510 - protein, 19 aa, Mycobacterium bovis
NDHWSGFRPDRIKALAGAA

SEQ ID NO: 203511 - protein, 22 aa, Mycobacterium bovis
NDPGTVCGPLISARQRDRVQGY

SEQ ID NO: 203512 - protein, 19 aa, Mycobacterium bovis
NDQFLLYAFDGEPTDLERA

SEQ ID NO: 203513 - protein, 25 aa, Mycobacterium bovis
NDQVAALFRMWLRDAVRRVATGVLD

SEQ ID NO: 203514 - protein, 28 aa, Mycobacterium bovis
NDQVALFLRHLWSAGGSVRWDPTNGQGR

SEQ ID NO: 203515 - protein, 21 aa, Mycobacterium bovis
NDRDRLVVIIAGYRADLDKFL

SEQ ID NO: 203516 - protein, 21 aa, Mycobacterium bovis
NDRGACLAGVVIDDGLRPKVV

SEQ ID NO: 203517 - protein, 24 aa, Mycobacterium bovis
NDRLKDMYICGGFNVYPAEVEQVL

SEQ ID NO: 203518 - protein, 25 aa, Mycobacterium bovis
NDVLDRYLPVLADLRMRYLDDGDWD

SEQ ID NO: 203519 - protein, 27 aa, Mycobacterium bovis
NDWPSPPTHFVITLGVRGARYVGADGV

SEQ ID NO: 203520 - protein, 23 aa, Mycobacterium bovis
NDYDLSSLFLLASTAALFSPSIK

SEQ ID NO: 203521 - protein, 24 aa, Mycobacterium bovis
NEAAFKLSRLTGRTKLVAAHDAFH

SEQ ID NO: 203522 - protein, 22 aa, Mycobacterium bovis
NEAFASVVLKFQKDLNIPDEKL

SEQ ID NO: 203523 - protein, 20 aa, Mycobacterium bovis
NEAFASVVLSWARVHEPDMD

SEQ ID NO: 203524 - protein, 20 aa, Mycobacterium bovis
NECWVRHLGTESGVGLLERF

SEQ ID NO: 203525 - protein, 22 aa, Mycobacterium bovis
NEDEVDAFLDLVENELTRLIEE

SEQ ID NO: 203526 - protein, 26 aa, Mycobacterium bovis
NEGDVFCSVVRRVALPDSFFAVDGQI

SEQ ID NO: 203527 - protein, 22 aa, Mycobacterium bovis
NEGLRSRFTRNIDFPSYTSHEL

SEQ ID NO: 203528 - protein, 17 aa, Mycobacterium bovis
NEGQWALGHREPLNANE

SEQ ID NO: 203529 - protein, 24 aa, Mycobacterium bovis
NEHYRLAVDPERGGALSSLVQDGR

SEQ ID NO: 203530 - protein, 19 aa, Mycobacterium bovis
NEIQIVVTILSLDPGDLYD

SEQ ID NO: 203531 - protein, 29 aa, Mycobacterium bovis
NELDPAGARLCVRPMSEFQSNEAYRELHA

SEQ ID NO: 203532 - protein, 20 aa, Mycobacterium bovis
NELRFSQGRHGWRCAVTLDV

SEQ ID NO: 203533 - protein, 26 aa, Mycobacterium bovis
NELVEWSHPLGHRWRWEFESLSPTLT

SEQ ID NO: 203534 - protein, 21 aa, Mycobacterium bovis
NEPKHPAARPKHVALQQLTGA

SEQ ID NO: 203535 - protein, 23 aa, Mycobacterium bovis
NERRTNWLNNFYFGGDHGVPDSV

SEQ ID NO: 203536 - protein, 23 aa, Mycobacterium bovis
NERYKLVWKNRLGFARLAIQHGY

SEQ ID NO: 203537 - protein, 21 aa, Mycobacterium bovis
NEVKPGSGMRGVIAKKGNIPV

SEQ ID NO: 203538 - protein, 20 aa, Mycobacterium bovis
NEVRAALLHLRDVMVECEQR

SEQ ID NO: 203539 - protein, 23 aa, Mycobacterium bovis
NEVTEIIPLDGFLDGLALYDELD

SEQ ID NO: 203540 - protein, 21 aa, Mycobacterium bovis
NEVYRLPKHLDEKVARIHVEA

SEQ ID NO: 203541 - protein, 17 aa, Mycobacterium bovis
NFHPWGIAQQFSAILGS

SEQ ID NO: 203542 - protein, 24 aa, Mycobacterium bovis
NFLNPRPGTPFADLEVMPVGDALK

SEQ ID NO: 203543 - protein, 22 aa, Mycobacterium bovis
NFRDVLVALGIYPGAAELGAEG

SEQ ID NO: 203544 - protein, 21 aa, Mycobacterium bovis
NFRDVVAALGMYPGQAPPLGA

SEQ ID NO: 203545 - protein, 19 aa, Mycobacterium bovis
NFTDGWLRTGDLGSLSAAG

SEQ ID NO: 203546 - protein, 25 aa, Mycobacterium bovis
NFTPKIRFWHVESAPRVRSLAKSLA

SEQ ID NO: 203547 - protein, 25 aa, Mycobacterium bovis
NGAAALPTVEVVAAAADEVSTQIAA

SEQ ID NO: 203548 - protein, 22 aa, Mycobacterium bovis
NGESMAAVARELHYADVSALYT

SEQ ID NO: 203549 - protein, 28 aa, Mycobacterium bovis
NGFLNGEARLPLALPTSATGGIPVTVEV

SEQ ID NO: 203550 - protein, 18 aa, Mycobacterium bovis
NGFSPAAIKALWDTILPF

SEQ ID NO: 203551 - protein, 29 aa, Mycobacterium bovis
NGGAGGQAALLFGRGGTGGAGGYGGDGGG

SEQ ID NO: 203552 - protein, 29 aa, Mycobacterium bovis
NGGAGGTAGWFFGFGGNGGAGGIGVAGIN

SEQ ID NO: 203553 - protein, 23 aa, Mycobacterium bovis
NGGAGGTGGWLFGNGGAGGNSGG

SEQ ID NO: 203554 - protein, 20 aa, Mycobacterium bovis
NGGDGGWLYGNGGNGGSGGT

SEQ ID NO: 203555 - protein, 39 aa, Mycobacterium bovis
NGGDPGLGARLFQVGSRGGDGGVGGWLYGDGGGGGDGGN

SEQ ID NO: 203556 - protein, 20 aa, Mycobacterium bovis
NGGNGALLIGAGGVGGAGGI

SEQ ID NO: 203557 - protein, 19 aa, Mycobacterium bovis
NGGSARLIGNGGAGGSGGS

SEQ ID NO: 203558 - protein, 26 aa, Mycobacterium bovis
NGGSGGRGGLLFGNGGNGSVGGMGGQ

SEQ ID NO: 203559 - protein, 20 aa, Mycobacterium bovis
NGHTAEYFTRMMAGLGEALG

SEQ ID NO: 203560 - protein, 17 aa, Mycobacterium bovis
NGIGTGISASDRATTMR

SEQ ID NO: 203561 - protein, 18 aa, Mycobacterium bovis
NGLAACYVSGYLATDPPP

SEQ ID NO: 203562 - protein, 29 aa, Mycobacterium bovis
NGLDFMGCCAVAVLAHKAERCRRRGVDVR

SEQ ID NO: 203563 - protein, 18 aa, Mycobacterium bovis
NGPLIEFCAPIGHRDADA

SEQ ID NO: 203564 - protein, 18 aa, Mycobacterium bovis
NGQPCRPPHCVASVSPAR

SEQ ID NO: 203565 - protein, 21 aa, Mycobacterium bovis
NGQPVKGRLTVPPSVPVKSAD

SEQ ID NO: 203566 - protein, 20 aa, Mycobacterium bovis
NGRIRKGQQVAWIRQVDGQQ

SEQ ID NO: 203567 - protein, 22 aa, Mycobacterium bovis
NGSFPDFPLPLGDPSKPSDADI

SEQ ID NO: 203568 - protein, 25 aa, Mycobacterium bovis
NGSLCKELSADIARRPMAKPVDFGS

SEQ ID NO: 203569 - protein, 20 aa, Mycobacterium bovis
NGSPSWSAAPNFAFELAVRK

SEQ ID NO: 203570 - protein, 24 aa, Mycobacterium bovis
NGTEVLRLGGRIADIVGLAGISHN

SEQ ID NO: 203571 - protein, 20 aa, Mycobacterium bovis
NGVGPAQFPAMLTALRQAMA

SEQ ID NO: 203572 - protein, 24 aa, Mycobacterium bovis
NHDRELAKLFGPVDRDEWFMTPQT

SEQ ID NO: 203573 - protein, 20 aa, Mycobacterium bovis
NHLKRSYGWNRTELTGITGA

SEQ ID NO: 203574 - protein, 23 aa, Mycobacterium bovis
NHRPEVRGGVLARECAAPLEAFF

SEQ ID NO: 203575 - protein, 19 aa, Mycobacterium bovis
NHTGGWRVDPLRGLSRPDF

SEQ ID NO: 203576 - protein, 34 aa, Mycobacterium bovis
NHYDCRSTRALRDWLLMRAWEAGVTPIGAQPVPD

SEQ ID NO: 203577 - protein, 22 aa, Mycobacterium bovis
NICYTGCRFCAFAQRKGDADAY

SEQ ID NO: 203578 - protein, 23 aa, Mycobacterium bovis
NIGHLEAAAGIAGFIKATLAVQR

SEQ ID NO: 203579 - protein, 20 aa, Mycobacterium bovis
NIGNPAPFGFEAPDVIMRDI

SEQ ID NO: 203580 - protein, 18 aa, Mycobacterium bovis
NILCLDVRRGIEQTRAHE

SEQ ID NO: 203581 - protein, 32 aa, Mycobacterium bovis
NILSDLNAFMGIRWVHNAYPFTAAEVANAVPL

SEQ ID NO: 203582 - protein, 18 aa, Mycobacterium bovis
NIPERGGALIALNHTSYV

SEQ ID NO: 203583 - protein, 18 aa, Mycobacterium bovis
NIPIEIAGTPGFGNSTTT

SEQ ID NO: 203584 - protein, 24 aa, Mycobacterium bovis
NIPIIDIPAAPGFGNSTQMPSSGF

SEQ ID NO: 203585 - protein, 25 aa, Mycobacterium bovis
NITQLPLGFMVEFDRAGVLVEAEHL

SEQ ID NO: 203586 - protein, 19 aa, Mycobacterium bovis
NIVDPLALTAGDLVVHDQH

SEQ ID NO: 203587 - protein, 31 aa, Mycobacterium bovis
NIYRTGEHIGWRFWMGIAFELTSDPQELREL

SEQ ID NO: 203588 - protein, 26 aa, Mycobacterium bovis
NKALADFAHRGWIRLEGKSVLISDSE

SEQ ID NO: 203589 - protein, 17 aa, Mycobacterium bovis
NKIGALSVPPSWVKTTA

SEQ ID NO: 203590 - protein, 19 aa, Mycobacterium bovis
NKNGMPWASAQLEDLTGGI

SEQ ID NO: 203591 - protein, 21 aa, Mycobacterium bovis
NKPTTAAFCDAEFERMRVEAL

SEQ ID NO: 203592 - protein, 25 aa, Mycobacterium bovis
NKVPGARCALAWSVQTAALAREHNN

SEQ ID NO: 203593 - protein, 26 aa, Mycobacterium bovis
NKVRFPAPVPVGSRVRATSSLVGVED

SEQ ID NO: 203594 - protein, 24 aa, Mycobacterium bovis
NKVSELPAGHGLNVNTLSYGDLAA

SEQ ID NO: 203595 - protein, 24 aa, Mycobacterium bovis
NKYRLIFEKLRLEPGDRLLDVGCG

SEQ ID NO: 203596 - protein, 18 aa, Mycobacterium bovis
NLADGIVVLEFVDHELGA

SEQ ID NO: 203597 - protein, 23 aa, Mycobacterium bovis
NLARAKMGLPVPVTSRHTLLLGP

SEQ ID NO: 203598 - protein, 21 aa, Mycobacterium bovis
NLDEARLLVDIEVVDAESQRA

SEQ ID NO: 203599 - protein, 25 aa, Mycobacterium bovis
NLDPAVVLAGWPAVERAARAVVDDG

SEQ ID NO: 203600 - protein, 20 aa, Mycobacterium bovis
NLFVPQPSVADWAQLEYYAD

SEQ ID NO: 203601 - protein, 25 aa, Mycobacterium bovis
NLGAGDPMSGLRQAVAARHGFAQDV

SEQ ID NO: 203602 - protein, 20 aa, Mycobacterium bovis
NLGRCGRVVVVGGTPEAAAS

SEQ ID NO: 203603 - protein, 17 aa, Mycobacterium bovis
NLGRLVLGTPAPLPCTP

SEQ ID NO: 203604 - protein, 35 aa, Mycobacterium bovis
NLHRLPLAIMRLRMLRRRSVRFFGTYDVLLTPTVA

SEQ ID NO: 203605 - protein, 19 aa, Mycobacterium bovis
NLIRARWARELAKGRQVGH

SEQ ID NO: 203606 - protein, 25 aa, Mycobacterium bovis
NLLAPGHWPMMVFRIGHARAPSVRT

SEQ ID NO: 203607 - protein, 18 aa, Mycobacterium bovis
NLLGSVALVGGARLWTRD

SEQ ID NO: 203608 - protein, 18 aa, Mycobacterium bovis
NLLTTKPFLYVFNADEAV

SEQ ID NO: 203609 - protein, 19 aa, Mycobacterium bovis
NLRRLLSLFEQLREQSQII

SEQ ID NO: 203610 - protein, 20 aa, Mycobacterium bovis
NLSIRDGWWDEWYDGENGWE

SEQ ID NO: 203611 - protein, 27 aa, Mycobacterium bovis
NLVIDMPLPISLGVNIPIDIPITASAG

SEQ ID NO: 203612 - protein, 22 aa, Mycobacterium bovis
NLVKMALHYEGWDVEVAHDGQE

SEQ ID NO: 203613 - protein, 29 aa, Mycobacterium bovis
NLVSPDLVRRLCWEWEDISQSSPDPIAAV

SEQ ID NO: 203614 - protein, 25 aa, Mycobacterium bovis
NMDDARWDAVLAVNLLAPLRLTEGL

SEQ ID NO: 203615 - protein, 29 aa, Mycobacterium bovis
NMKELRPAGTSIRILFAFDPARQAILLLG

SEQ ID NO: 203616 - protein, 17 aa, Mycobacterium bovis
NMRARMNSALGITEQGF

SEQ ID NO: 203617 - protein, 17 aa, Mycobacterium bovis
NNGLSLFEREAHHQPLN

SEQ ID NO: 203618 - protein, 17 aa, Mycobacterium bovis
NNIGFGLTGDNQIGFGA

SEQ ID NO: 203619 - protein, 18 aa, Mycobacterium bovis
NNKIAFDRIDERLVVVGL

SEQ ID NO: 203620 - protein, 23 aa, Mycobacterium bovis
NNNWFAAYAYWYFKLYGHEKVKL

SEQ ID NO: 203621 - protein, 24 aa, Mycobacterium bovis
NNRGRAGYRLLYSVRQYALEKLSE

SEQ ID NO: 203622 - protein, 22 aa, Mycobacterium bovis
NNTEARAALAFMDTELRIDYRD

SEQ ID NO: 203623 - protein, 22 aa, Mycobacterium bovis
NNVETRPGVGYPRTYEDQERWR

SEQ ID NO: 203624 - protein, 19 aa, Mycobacterium bovis
NNVVKFRWNGGGVELIGNT

SEQ ID NO: 203625 - protein, 23 aa, Mycobacterium bovis
NNWESVFGGPAWTRVREPDGNPG

SEQ ID NO: 203626 - protein, 21 aa, Mycobacterium bovis
NNWFAAYAYWYFKLYGHEKVK

SEQ ID NO: 203627 - protein, 19 aa, Mycobacterium bovis
NPATWSGAGVVASHMTATE

SEQ ID NO: 203628 - protein, 25 aa, Mycobacterium bovis
NPDAGMVLREVGLEVLGSARRVVVS

SEQ ID NO: 203629 - protein, 17 aa, Mycobacterium bovis
NPECHLMVVLVDERPEE

SEQ ID NO: 203630 - protein, 24 aa, Mycobacterium bovis
NPHYDIPKLLSMYKAGKLNLDDMV

SEQ ID NO: 203631 - protein, 19 aa, Mycobacterium bovis
NPKLGASWEGFVLEQLAAL

SEQ ID NO: 203632 - protein, 18 aa, Mycobacterium bovis
NPMRQLRITVGLIADLKV

SEQ ID NO: 203633 - protein, 21 aa, Mycobacterium bovis
NPNHYLAVAIEYLYTHRPSWP

SEQ ID NO: 203634 - protein, 22 aa, Mycobacterium bovis
NPPRTVSVSTLMDGRIDHVELS

SEQ ID NO: 203635 - protein, 23 aa, Mycobacterium bovis
NPQRPWEHPDFWDIWKASLQGVL

SEQ ID NO: 203636 - protein, 23 aa, Mycobacterium bovis
NPSVHRFDLFVPVFRNHLVELSA

SEQ ID NO: 203637 - protein, 22 aa, Mycobacterium bovis
NPVSALLFFLASSRIFNRRKGV

SEQ ID NO: 203638 - protein, 35 aa, Mycobacterium bovis
NPVSALVSFEVFIRPPLRMAMGLPDPYRPHRSAVL

SEQ ID NO: 203639 - protein, 19 aa, Mycobacterium bovis
NPYLTFAVLLAAGLRGVEK

SEQ ID NO: 203640 - protein, 25 aa, Mycobacterium bovis
NQFDRPREALALALDQERTVTDQVG

SEQ ID NO: 203641 - protein, 22 aa, Mycobacterium bovis
NQFPYQSKTGWVYDSGDYETTM

SEQ ID NO: 203642 - protein, 27 aa, Mycobacterium bovis
NQHGFCAECHLDAPMVNRALAGAPDGV

SEQ ID NO: 203643 - protein, 17 aa, Mycobacterium bovis
NQIGFGGLNSGSGNIGF

SEQ ID NO: 203644 - protein, 25 aa, Mycobacterium bovis
NQIKLAVLVATNFFGINTIPIAINE

SEQ ID NO: 203645 - protein, 17 aa, Mycobacterium bovis
NQIRWLFEKLLGESPRR

SEQ ID NO: 203646 - protein, 18 aa, Mycobacterium bovis
NQLYVRWAGQDEWAAVPL

SEQ ID NO: 203647 - protein, 17 aa, Mycobacterium bovis
NQWPGDVVEYFGDPNTG

SEQ ID NO: 203648 - protein, 18 aa, Mycobacterium bovis
NRAAYKFIDYDTDPAGFT

SEQ ID NO: 203649 - protein, 22 aa, Mycobacterium bovis
NRAVELACTVGRTLKSGTTVNL

SEQ ID NO: 203650 - protein, 25 aa, Mycobacterium bovis
NRDGESYNRSWNCGVEGPTDDPDIL

SEQ ID NO: 203651 - protein, 20 aa, Mycobacterium bovis
NRDGIPIAVRNELNLSVLQR

SEQ ID NO: 203652 - protein, 25 aa, Mycobacterium bovis
NRGFLRCVAALARAAAAIGETDEYG

SEQ ID NO: 203653 - protein, 25 aa, Mycobacterium bovis
NRIVRRLLAAAGFPVEALVRTDIGA

SEQ ID NO: 203654 - protein, 23 aa, Mycobacterium bovis
NRLAELWSIMDFLNPGLLGSSER

SEQ ID NO: 203655 - protein, 18 aa, Mycobacterium bovis
NRLAHRLAGCGAGPGECV

SEQ ID NO: 203656 - protein, 17 aa, Mycobacterium bovis
NRLHAQKALLVWLLERS

SEQ ID NO: 203657 - protein, 25 aa, Mycobacterium bovis
NRLMPRFVREFPFNLMLWDLDRRMR

SEQ ID NO: 203658 - protein, 22 aa, Mycobacterium bovis
NRLPPVHMFGGINLSFGLMGPL

SEQ ID NO: 203659 - protein, 28 aa, Mycobacterium bovis
NRMRWPHGRMRYYIAMLAELSRLRPLPF

SEQ ID NO: 203660 - protein, 21 aa, Mycobacterium bovis
NRNQGAFGFSEPCTDCRGSGS

SEQ ID NO: 203661 - protein, 21 aa, Mycobacterium bovis
NRPEVLMIIGAGQARGYRRTA

SEQ ID NO: 203662 - protein, 22 aa, Mycobacterium bovis
NRPGYLRFDFNWQGPLTDDQRT

SEQ ID NO: 203663 - protein, 22 aa, Mycobacterium bovis
NRPLLQPLRAVPVIGDPLADLI

SEQ ID NO: 203664 - protein, 23 aa, Mycobacterium bovis
NRPQRFQVTASRFGRSVDVAAAR

SEQ ID NO: 203665 - protein, 25 aa, Mycobacterium bovis
NRRRRRGRRGRGRGRGEQGGSDGDP

SEQ ID NO: 203666 - protein, 20 aa, Mycobacterium bovis
NRSACVRIPITGSNPKAKRL

SEQ ID NO: 203667 - protein, 18 aa, Mycobacterium bovis
NRSRLMSLVAANILGQNS

SEQ ID NO: 203668 - protein, 17 aa, Mycobacterium bovis
NRTGVFWIQDRLTIGQL

SEQ ID NO: 203669 - protein, 23 aa, Mycobacterium bovis
NRTTPPIKWPTVIRHPKTGQEIL

SEQ ID NO: 203670 - protein, 25 aa, Mycobacterium bovis
NRVKTWLQFPQWFYLNIPVNTMVAP

SEQ ID NO: 203671 - protein, 26 aa, Mycobacterium bovis
NSAGRYRPFYLRNLLDAVQGRNLNDA

SEQ ID NO: 203672 - protein, 22 aa, Mycobacterium bovis
NSDGFGALARRIAGRSLGLVMA

SEQ ID NO: 203673 - protein, 20 aa, Mycobacterium bovis
NSFGAFVPKGITLRVYGDAN

SEQ ID NO: 203674 - protein, 31 aa, Mycobacterium bovis
NSFSKYYAMTGWRLGWLLVPTVLRRAVDCLT

SEQ ID NO: 203675 - protein, 37 aa, Mycobacterium bovis
NSGNYSNGFFWRGDYQGLGGFAYQSAVSEIPWSYDIG

SEQ ID NO: 203676 - protein, 34 aa, Mycobacterium bovis
NSGNYSNGFFWRGDYQGLIGFSGTLTIPAAGLDL

SEQ ID NO: 203677 - protein, 24 aa, Mycobacterium bovis
NSGRMYCGPGSGPMLAAAAAWDGV

SEQ ID NO: 203678 - protein, 18 aa, Mycobacterium bovis
NSGTGNWGIANTGDTNTG

SEQ ID NO: 203679 - protein, 19 aa, Mycobacterium bovis
NSGTGNWGIGNPGTDNTGI

SEQ ID NO: 203680 - protein, 18 aa, Mycobacterium bovis
NSGTGNWGIGNSGDYNTG

SEQ ID NO: 203681 - protein, 18 aa, Mycobacterium bovis
NSGTGNWGIGNSGNSYNT

SEQ ID NO: 203682 - protein, 19 aa, Mycobacterium bovis
NSGTGNWGIGNSGSGNTGI

SEQ ID NO: 203683 - protein, 24 aa, Mycobacterium bovis
NSIGGFRNAMTFVLTGLDIDAKAD

SEQ ID NO: 203684 - protein, 18 aa, Mycobacterium bovis
NSKECYSSGLADLAQGLA

SEQ ID NO: 203685 - protein, 19 aa, Mycobacterium bovis
NSLGGWVAFELERRGRARS

SEQ ID NO: 203686 - protein, 30 aa, Mycobacterium bovis
NSLSDLLVFGRRAGLGAADYVRALSSRPAV

SEQ ID NO: 203687 - protein, 25 aa, Mycobacterium bovis
NSLVTWGAGVPAAMGTSTAGQVSIS

SEQ ID NO: 203688 - protein, 17 aa, Mycobacterium bovis
NSNFCYFDDAGFNYKQL

SEQ ID NO: 203689 - protein, 23 aa, Mycobacterium bovis
NSRFMFDYIPPVFKGQYAETEEE

SEQ ID NO: 203690 - protein, 32 aa, Mycobacterium bovis
NSRLTDPEVLEWRYPVLLREFAVRQGSGGAGR

SEQ ID NO: 203691 - protein, 20 aa, Mycobacterium bovis
NSTPLPAARIGPGTNNAPSA

SEQ ID NO: 203692 - protein, 25 aa, Mycobacterium bovis
NSTRTRFSFELGIAQLGGHAVVVDS

SEQ ID NO: 203693 - protein, 24 aa, Mycobacterium bovis
NSVTSGLVGESWLGPSSAAMAAAV

SEQ ID NO: 203694 - protein, 22 aa, Mycobacterium bovis
NSWLRETLREFLLRNRSYVATA

SEQ ID NO: 203695 - protein, 31 aa, Mycobacterium bovis; identical to SEQ ID NO: 82892

SEQ ID NO: 203696 - protein, 24 aa, Mycobacterium bovis
NTATRRLCEWAGCKFLGEHDTTNR

SEQ ID NO: 203697 - protein, 24 aa, Mycobacterium bovis
NTECPPGTIGEIWVHGDNVAGGYW

SEQ ID NO: 203698 - protein, 27 aa, Mycobacterium bovis
NTGHAAELFGWLGPHPDTMVSSAATIV

SEQ ID NO: 203699 - protein, 18 aa, Mycobacterium bovis
NTGTLPFAVTSLVSGLAN

SEQ ID NO: 203700 - protein, 24 aa, Mycobacterium bovis
NTHGVSWLPLYHDMGLSMIGFPAV

SEQ ID NO: 203701 - protein, 23 aa, Mycobacterium bovis
NTLSRFCNRFAPYNFREDMIRPS

SEQ ID NO: 203702 - protein, 19 aa, Mycobacterium bovis
NTPRGRFGVIASVSHAFCS

SEQ ID NO: 203703 - protein, 25 aa, Mycobacterium bovis
NTPRNFARRGIRCHVLPASTTFEQI

SEQ ID NO: 203704 - protein, 26 aa, Mycobacterium bovis
NTPTQLLLGRPLIGNGANGAPGTGQA

SEQ ID NO: 203705 - protein, 28 aa, Mycobacterium bovis
NTQVCPVCLGLPGSLPVLNRAAVESAIR

SEQ ID NO: 203706 - protein, 24 aa, Mycobacterium bovis
NTRVPEFLERLGVGAPEAEQDIIN

SEQ ID NO: 203707 - protein, 18 aa, Mycobacterium bovis
NTTIPTKRSETFTTADDN

SEQ ID NO: 203708 - protein, 18 aa, Mycobacterium bovis
NTVPRGGVLGTQRLLDEL

SEQ ID NO: 203709 - protein, 18 aa, Mycobacterium bovis
NTVQFAAAVQAAMEDGYR

SEQ ID NO: 203710 - protein, 24 aa, Mycobacterium bovis
NTVRYRLKRITDFTGRDPTQPRDA

SEQ ID NO: 203711 - protein, 17 aa, Mycobacterium bovis
NVADGDAALALLRAELR

SEQ ID NO: 203712 - protein, 18 aa, Mycobacterium bovis
NVANGFLNGEARLPLALP

SEQ ID NO: 203713 - protein, 25 aa, Mycobacterium bovis
NVAVSRAQYAAVIVRSELLTQYLPA

SEQ ID NO: 203714 - protein, 17 aa, Mycobacterium bovis
NVDADFEPLYIISPEKR

SEQ ID NO: 203715 - protein, 29 aa, Mycobacterium bovis
NVGSGGSGFWNIAGNLGNSGFLNVGPLTS

SEQ ID NO: 203716 - protein, 17 aa, Mycobacterium bovis
NVIAWASSGHVGFKGSR

SEQ ID NO: 203717 - protein, 21 aa, Mycobacterium bovis
NVIDPLDWVEMFGADALRFTL

SEQ ID NO: 203718 - protein, 19 aa, Mycobacterium bovis
NVKPGRVLFELSYPNEGVA

SEQ ID NO: 203719 - protein, 23 aa, Mycobacterium bovis
NVLSRAIVRLCLSYVSMPPEADH

SEQ ID NO: 203720 - protein, 24 aa, Mycobacterium bovis
NVMPQWAGSSWYELRYTDPHNSER

SEQ ID NO: 203721 - protein, 26 aa, Mycobacterium bovis
NVNDCGRYGLADCAGRVLVGEPTDPA

SEQ ID NO: 203722 - protein, 24 aa, Mycobacterium bovis
NVQAGLRTDYLFRIANQRGGIVLG

SEQ ID NO: 203723 - protein, 25 aa, Mycobacterium bovis
NVSKLLWANWHRNLGELAMDVIGKP

SEQ ID NO: 203724 - protein, 23 aa, Mycobacterium bovis
NVSRLFAQRCIAGLTANVEHLRR

SEQ ID NO: 203725 - protein, 22 aa, Mycobacterium bovis
NVSSVLAWLPLGMSYGVSKAAM

SEQ ID NO: 203726 - protein, 18 aa, Mycobacterium bovis
NVVGRLPGRYAVAALGIG

SEQ ID NO: 203727 - protein, 20 aa, Mycobacterium bovis
NVYVPDELAERARARGLNVS

SEQ ID NO: 203728 - protein, 26 aa, Mycobacterium bovis
NWETFHIAQLLPWIEANFRTYAEYDG

SEQ ID NO: 203729 - protein, 18 aa, Mycobacterium bovis
NWLLGNGESPQWSADAKF

SEQ ID NO: 203730 - protein, 17 aa, Mycobacterium bovis
NWLSLTFRIDGGAWFNV

SEQ ID NO: 203731 - protein, 18 aa, Mycobacterium bovis
NWMRAREALIKTDIFGSA

SEQ ID NO: 203732 - protein, 19 aa, Mycobacterium bovis
NWSIRRLSSLVGHGRARAM

SEQ ID NO: 203733 - protein, 17 aa, Mycobacterium bovis
NWVRSWYDFAVEGIGRS

SEQ ID NO: 203734 - protein, 23 aa, Mycobacterium bovis
NYAPRPLLDLPWDIQESPAGMAV

SEQ ID NO: 203735 - protein, 27 aa, Mycobacterium bovis
NYDMSMARLLYWGCDVWLNNPLRPLEA

SEQ ID NO: 203736 - protein, 20 aa, Mycobacterium bovis
NYGDCFSYGLAKISGQPLLF

SEQ ID NO: 203737 - protein, 23 aa, Mycobacterium bovis
NYRAWRHFIAMRASEHADVEIRR

SEQ ID NO: 203738 - protein, 18 aa, Mycobacterium bovis
NYSVGFANSGNYHIGIAN

SEQ ID NO: 203739 - protein, 18 aa, Mycobacterium bovis
PAACGGPFARLTLNSPHN

SEQ ID NO: 203740 - protein, 18 aa, Mycobacterium bovis
PAAEGFLAAADRVGVDPQ

SEQ ID NO: 203741 - protein, 17 aa, Mycobacterium bovis
PAAKAWIKEELKANPDG

SEQ ID NO: 203742 - protein, 18 aa, Mycobacterium bovis
PAALLRCLVEGADEVHVD

SEQ ID NO: 203743 - protein, 19 aa, Mycobacterium bovis
PAALLRWGVSQFDAEVRPV

SEQ ID NO: 203744 - protein, 25 aa, Mycobacterium bovis
PAALREARRGMALAAELCLPLVLVI

SEQ ID NO: 203745 - protein, 22 aa, Mycobacterium bovis
PAAQAIRFAKEFARNATESGGR

SEQ ID NO: 203746 - protein, 24 aa, Mycobacterium bovis
PAARTDPMLLAWTVPVVDLDPTAA

SEQ ID NO: 203747 - protein, 18 aa, Mycobacterium bovis
PAATRPAAQQTPAVPAAA

SEQ ID NO: 203748 - protein, 29 aa, Mycobacterium bovis
PAAVSPWWLQRRLLLCGIRATCPAVDVTN

SEQ ID NO: 203749 - protein, 21 aa, Mycobacterium bovis
PAAWIAEGLFGYLPPDAQNRL

SEQ ID NO: 203750 - protein, 19 aa, Mycobacterium bovis
PACVQCSATSKALDKQGIA

SEQ ID NO: 203751 - protein, 17 aa, Mycobacterium bovis
PADAGMVGPMFDVGFPF

SEQ ID NO: 203752 - protein, 24 aa, Mycobacterium bovis
PADEAIGPGDRWIVEQLRSTGPAN

SEQ ID NO: 203753 - protein, 21 aa, Mycobacterium bovis
PADPDIVGWEVDEFVSLARSG

SEQ ID NO: 203754 - protein, 25 aa, Mycobacterium bovis
PADRHPHCAWTVIIDESYPEAEGIP

SEQ ID NO: 203755 - protein, 25 aa, Mycobacterium bovis
PADTRWHPVSSLPPMAFDHGPMVTH

SEQ ID NO: 203756 - protein, 17 aa, Mycobacterium bovis
PADVALCTADRLAEADA

SEQ ID NO: 203757 - protein, 28 aa, Mycobacterium bovis
PAEARRVGRRFARLAPIVATHRKLTSAR

SEQ ID NO: 203758 - protein, 24 aa, Mycobacterium bovis
PAEIREFLEGYVIGQDTAKRTLAV

SEQ ID NO: 203759 - protein, 19 aa, Mycobacterium bovis
PAELLEAGFDNVEEIGRGG

SEQ ID NO: 203760 - protein, 21 aa, Mycobacterium bovis
PAELRLRNLLRPNQFPYQSKT

SEQ ID NO: 203761 - protein, 27 aa, Mycobacterium bovis
PAERLRALRRACAAGVLATLVSGAGDC

SEQ ID NO: 203762 - protein, 20 aa, Mycobacterium bovis
PAETGLKWPNDVLARGGKLA

SEQ ID NO: 203763 - protein, 25 aa, Mycobacterium bovis
PAFALGDYEWILAFEAPELDRIVDL

SEQ ID NO: 203764 - protein, 25 aa, Mycobacterium bovis
PAFALPLRLPAGLAAGPAAVVTALT

SEQ ID NO: 203765 - protein, 19 aa, Mycobacterium bovis
PAFYFACPSTVLGPYDDAP

SEQ ID NO: 203766 - protein, 26 aa, Mycobacterium bovis
PAGGAGGAAGLWGHGGAGGAGGSASG

SEQ ID NO: 203767 - protein, 26 aa, Mycobacterium bovis
PAGKQAASAFAMWFPIEGGSKYGGYG

SEQ ID NO: 203768 - protein, 18 aa, Mycobacterium bovis
PAGPIPGFIVKRASEHVL

SEQ ID NO: 203769 - protein, 17 aa, Mycobacterium bovis
PAGRPFIAAGLAIAAVG

SEQ ID NO: 203770 - protein, 25 aa, Mycobacterium bovis
PAGSGAMGSTGFAGGAGGDGGNGGG

SEQ ID NO: 203771 - protein, 18 aa, Mycobacterium bovis
PAGSLWRLEFLLQSTQDP

SEQ ID NO: 203772 - protein, 25 aa, Mycobacterium bovis
PAHIVDVKRAIAWVRENIADYGGDP

SEQ ID NO: 203773 - protein, 22 aa, Mycobacterium bovis
PAHLWWIRSQLRSMLVEDVRAR

SEQ ID NO: 203774 - protein, 21 aa, Mycobacterium bovis
PAIKGMWTVPVFGNPSGVTYS

SEQ ID NO: 203775 - protein, 24 aa, Mycobacterium bovis
PAILRLPLTSAFFAAMARMRPKWV

SEQ ID NO: 203776 - protein, 40 aa, Mycobacterium bovis
PAITLRALGVTHFSVGPIIVPRIAGTLPVIDINIGDPGGS

SEQ ID NO: 203777 - protein, 19 aa, Mycobacterium bovis
PAKRKPGYANFAIADPPLK

SEQ ID NO: 203778 - protein, 19 aa, Mycobacterium bovis
PALAHGPLTLKGFDAPVMA

SEQ ID NO: 203779 - protein, 17 aa, Mycobacterium bovis
PALDRLDLIVGDGEFVV

SEQ ID NO: 203780 - protein, 25 aa, Mycobacterium bovis
PALPTVWPGNAYPLGATYDGAGTNF

SEQ ID NO: 203781 - protein, 18 aa, Mycobacterium bovis
PALQLSRALLGNQGLGGT

SEQ ID NO: 203782 - protein, 23 aa, Mycobacterium bovis
PALQRRWWAARGRGAFASVDGAR

SEQ ID NO: 203783 - protein, 20 aa, Mycobacterium bovis
PAMHTEMWLHPATVDNVATL

SEQ ID NO: 203784 - protein, 27 aa, Mycobacterium bovis
PAMNFFPARLTAIGLTLPFGEVTLAPE

SEQ ID NO: 203785 - protein, 25 aa, Mycobacterium bovis
PAMRRAFPSWMAWSPFAPAMRQAVV

SEQ ID NO: 203786 - protein, 26 aa, Mycobacterium bovis
PAMSKFEVLTAMAFAAFADAPVDVAV

SEQ ID NO: 203787 - protein, 19 aa, Mycobacterium bovis
PAMVFRLIAEEALTLMAGA

SEQ ID NO: 203788 - protein, 25 aa, Mycobacterium bovis
PANPPPRVAFMLGDAVPVAAVTTAG

SEQ ID NO: 203789 - protein, 17 aa, Mycobacterium bovis
PANTWLTDVGKYPLRGL

SEQ ID NO: 203790 - protein, 20 aa, Mycobacterium bovis
PAPARRVGGHPAKRTFQALR

SEQ ID NO: 203791 - protein, 21 aa, Mycobacterium bovis
PAPCEPACVLGINQDPVTIKQ

SEQ ID NO: 203792 - protein, 21 aa, Mycobacterium bovis
PAPFLQQYLANQFGYGQLTLT

SEQ ID NO: 203793 - protein, 20 aa, Mycobacterium bovis
PAPIFGCLREVREWAQNTKD

SEQ ID NO: 203794 - protein, 20 aa, Mycobacterium bovis
PAPPPRELDMLLTAGERISN

SEQ ID NO: 203795 - protein, 20 aa, Mycobacterium bovis
PAPPVGKYVDAWGGMIQSRG

SEQ ID NO: 203796 - protein, 20 aa, Mycobacterium bovis
PAPQRLRVLALALAGERTVV

SEQ ID NO: 203797 - protein, 18 aa, Mycobacterium bovis
PAPVYNMAVALRLRGYLD

SEQ ID NO: 203798 - protein, 18 aa, Mycobacterium bovis
PAQADWLDPMIALSFAAA

SEQ ID NO: 203799 - protein, 21 aa, Mycobacterium bovis
PAQAIAQVCELTWQLRGQATG

SEQ ID NO: 203800 - protein, 18 aa, Mycobacterium bovis
PAQRVCAVDGAIHVMTTV

SEQ ID NO: 203801 - protein, 18 aa, Mycobacterium bovis
PARARAEVLAAMRAAHPY

SEQ ID NO: 203802 - protein, 21 aa, Mycobacterium bovis
PARARTPLPVPTPRGERPDDG

SEQ ID NO: 203803 - protein, 17 aa, Mycobacterium bovis
PARECWQTNRFRPGDDD

SEQ ID NO: 203804 - protein, 22 aa, Mycobacterium bovis
PAREPRPVLAPTPASSEPTVAA

SEQ ID NO: 203805 - protein, 17 aa, Mycobacterium bovis
PARFIDIVERFMDTTEP

SEQ ID NO: 203806 - protein, 25 aa, Mycobacterium bovis
PARLKVGIISAGRVGTALGVALQRA

SEQ ID NO: 203807 - protein, 23 aa, Mycobacterium bovis
PARLSARRFWVRYAAEATGALTL

SEQ ID NO: 203808 - protein, 19 aa, Mycobacterium bovis
PARRDPCLYPRTGQALPRT

SEQ ID NO: 203809 - protein, 19 aa, Mycobacterium bovis
PARVANLVERLRAAEKELE

SEQ ID NO: 203810 - protein, 18 aa, Mycobacterium bovis
PASARLLVASALARQGPL

SEQ ID NO: 203811 - protein, 20 aa, Mycobacterium bovis
PASGAAHLLAQWTGAHNDGP

SEQ ID NO: 203812 - protein, 29 aa, Mycobacterium bovis
PASGRPLAMPRLDMVTGLYYLTTEVPGDT

SEQ ID NO: 203813 - protein, 18 aa, Mycobacterium bovis
PASLRRDFGLVVHWANLS

SEQ ID NO: 203814 - protein, 21 aa, Mycobacterium bovis
PASTIKVLLALVALDELDLNS

SEQ ID NO: 203815 - protein, 44 aa, Mycobacterium bovis
PATLKRFAERFGRFNFAAAALRPAYGMAEATVYIATRNVNEPPE

SEQ ID NO: 203816 - protein, 27 aa, Mycobacterium bovis
PATLKRFVDRFSRFNLREFAIRPAYGL

SEQ ID NO: 203817 - protein, 30 aa, Mycobacterium bovis
PATLTDLVFAWRACRAVKSNAIVIAADGAT

SEQ ID NO: 203818 - protein, 20 aa, Mycobacterium bovis
PATRAVVIYLEYLGTTIGDL

SEQ ID NO: 203819 - protein, 18 aa, Mycobacterium bovis
PATRSRVPTLARVAAAGV

SEQ ID NO: 203820 - protein, 20 aa, Mycobacterium bovis
PATRSYRYIDYWGTAVTAFD

SEQ ID NO: 203821 - protein, 19 aa, Mycobacterium bovis
PATSMEIAEAAGLEERYVR

SEQ ID NO: 203822 - protein, 26 aa, Mycobacterium bovis
PATTREMIKTGGFDAVCFTSSSTVRN

SEQ ID NO: 203823 - protein, 18 aa, Mycobacterium bovis
PAVIARYPAPPGAPTVLL

SEQ ID NO: 203824 - protein, 26 aa, Mycobacterium bovis
PAVLGIKVARRLLANVAHVAVFDTAF

SEQ ID NO: 203825 - protein, 18 aa, Mycobacterium bovis
PAVPNGQPVKGRLTVPPS

SEQ ID NO: 203826 - protein, 20 aa, Mycobacterium bovis
PAVRDCAVFGLADDRLGQRV

SEQ ID NO: 203827 - protein, 23 aa, Mycobacterium bovis
PAWLEPGQWWALVRVGCAGQLVY

SEQ ID NO: 203828 - protein, 24 aa, Mycobacterium bovis
PAYVRRAPLLDGIDEFDAGFFGFP

SEQ ID NO: 203829 - protein, 23 aa, Mycobacterium bovis
PCSPPRRPRVCSRRRSPRAHRRH

SEQ ID NO: 203830 - protein, 23 aa, Mycobacterium bovis
PCTMCAGALVLARVARLVFGAWE

SEQ ID NO: 203831 - protein, 24 aa, Mycobacterium bovis
PCVIKAADGRVVWDNDAYSFLDGA

SEQ ID NO: 203832 - protein, 20 aa, Mycobacterium bovis
PCWLVGLLFPSADGCAGHSD

SEQ ID NO: 203833 - protein, 22 aa, Mycobacterium bovis
PDAHLYCAIAIFGDKVTALQLV

SEQ ID NO: 203834 - protein, 18 aa, Mycobacterium bovis
PDAIAALWSDDLLTRVAI

SEQ ID NO: 203835 - protein, 27 aa, Mycobacterium bovis
PDALVGPCWPAVFAAIGSAVTDTGEPV

SEQ ID NO: 203836 - protein, 20 aa, Mycobacterium bovis
PDAMAGLIRTMFGNRERYQI

SEQ ID NO: 203837 - protein, 25 aa, Mycobacterium bovis
PDAPVLPTLCRAAAALLGSTAADVR

SEQ ID NO: 203838 - protein, 21 aa, Mycobacterium bovis
PDARGIYYGRLTEMTTTDFQV

SEQ ID NO: 203839 - protein, 17 aa, Mycobacterium bovis
PDARWLLAVSDRNGIVS

SEQ ID NO: 203840 - protein, 32 aa, Mycobacterium bovis
PDASWRRDLRCPGLLPPGCHQPVLVVGLVGQQ

SEQ ID NO: 203841 - protein, 19 aa, Mycobacterium bovis
PDATLRLVVDPRKDEVVVE

SEQ ID NO: 203842 - protein, 18 aa, Mycobacterium bovis
PDDFEVPPMPAPVEPQGP

SEQ ID NO: 203843 - protein, 23 aa, Mycobacterium bovis
PDDIRPGDLVAVAATGAYCYSLS

SEQ ID NO: 203844 - protein, 20 aa, Mycobacterium bovis
PDDMSEEFCRWEERIRLDQD

SEQ ID NO: 203845 - protein, 18 aa, Mycobacterium bovis
PDDQHWAFRITQGQPVCG

SEQ ID NO: 203846 - protein, 18 aa, Mycobacterium bovis
PDDTWLASWSRAEAAVPH

SEQ ID NO: 203847 - protein, 26 aa, Mycobacterium bovis
PDEFARRLPFMAAKRAFSEPVALNWA

SEQ ID NO: 203848 - protein, 21 aa, Mycobacterium bovis
PDEIEAAIGLAERDQDIKVIV

SEQ ID NO: 203849 - protein, 20 aa, Mycobacterium bovis
PDELALPFAWQGVSLHATGA

SEQ ID NO: 203850 - protein, 21 aa, Mycobacterium bovis
PDELKAAVKRAARQRGVSEAQ

SEQ ID NO: 203851 - protein, 24 aa, Mycobacterium bovis
PDERGMRTVMCILNGQLRPVLVRD

SEQ ID NO: 203852 - protein, 26 aa, Mycobacterium bovis
PDEYVKGLAELGCFGLKIPSEYGGLN

SEQ ID NO: 203853 - protein, 21 aa, Mycobacterium bovis
PDGEPGLLLSRVNRLQPFDGY

SEQ ID NO: 203854 - protein, 21 aa, Mycobacterium bovis
PDGKVSPYHAVIVNTGESFMI

SEQ ID NO: 203855 - protein, 26 aa, Mycobacterium bovis
PDGPHFECWTVLGAWAEQTSHIEIGA

SEQ ID NO: 203856 - protein, 24 aa, Mycobacterium bovis
PDGPRAVVDVGLIGGRTRQNLAHR

SEQ ID NO: 203857 - protein, 21 aa, Mycobacterium bovis
PDGQFPALPLFELGYDVAHVG

SEQ ID NO: 203858 - protein, 22 aa, Mycobacterium bovis
PDGRIPIWLPPAKRLPDGLASY

SEQ ID NO: 203859 - protein, 28 aa, Mycobacterium bovis
PDGSWGAEFPFCYEDRLLSTLAAMISLT

SEQ ID NO: 203860 - protein, 20 aa, Mycobacterium bovis
PDGSWLRTGDLGFLSEDEMF

SEQ ID NO: 203861 - protein, 25 aa, Mycobacterium bovis
PDGTGWRWRTWHLYPSASGGTVVHT

SEQ ID NO: 203862 - protein, 17 aa, Mycobacterium bovis
PDGTPTFSRYVEIGVDF

SEQ ID NO: 203863 - protein, 23 aa, Mycobacterium bovis
PDGTRWVGLSAMRAADEQSATGS

SEQ ID NO: 203864 - protein, 27 aa, Mycobacterium bovis
PDGVAGWLLLCCGAMLDGAREALSIAE

SEQ ID NO: 203865 - protein, 19 aa, Mycobacterium bovis
PDHPAFHWYAERIGEQRAV

SEQ ID NO: 203866 - protein, 18 aa, Mycobacterium bovis
PDHPKFHGPKGIGYAELP

SEQ ID NO: 203867 - protein, 38 aa, Mycobacterium bovis
PDHRKKGYGTAALRKSRSEMAWAFPAVPMVARAPAAQP

SEQ ID NO: 203868 - protein, 19 aa, Mycobacterium bovis
PDIADVLYGIHRWLHGHAD

SEQ ID NO: 203869 - protein, 19 aa, Mycobacterium bovis
PDIDPVLKMLLDTFPVTFT

SEQ ID NO: 203870 - protein, 23 aa, Mycobacterium bovis
PDIFKEYFGTVIPAGDNKFSALN

SEQ ID NO: 203871 - protein, 18 aa, Mycobacterium bovis
PDIGPLFYEPTVLTNVAP

SEQ ID NO: 203872 - protein, 17 aa, Mycobacterium bovis
PDIKLLQPVPAGDPSKG

SEQ ID NO: 203873 - protein, 17 aa, Mycobacterium bovis
PDIPIPAIHIGINGVVT

SEQ ID NO: 203874 - protein, 17 aa, Mycobacterium bovis
PDLCGFAGESLGFTSGG

SEQ ID NO: 203875 - protein, 24 aa, Mycobacterium bovis
PDLEVLTHGLTLWDLDRVFKVDGF

SEQ ID NO: 203876 - protein, 18 aa, Mycobacterium bovis
PDLGGRLRAGRSRNDQVA

SEQ ID NO: 203877 - protein, 17 aa, Mycobacterium bovis
PDLITWWCERDGVHPDK

SEQ ID NO: 203878 - protein, 17 aa, Mycobacterium bovis
PDLPPSHHYLAAYRWLD

SEQ ID NO: 203879 - protein, 21 aa, Mycobacterium bovis
PDLRLPGSVAEILASPAGPKV

SEQ ID NO: 203880 - protein, 25 aa, Mycobacterium bovis
PDLTSGRALAGFGLTEPGAGSDAGS

SEQ ID NO: 203881 - protein, 20 aa, Mycobacterium bovis
PDMADRVAALAAHAPPERLL

SEQ ID NO: 203882 - protein, 21 aa, Mycobacterium bovis
PDNTCDLGRFVAEKTAGVHAA

SEQ ID NO: 203883 - protein, 23 aa, Mycobacterium bovis
PDPDIAQLVKWGYAATQLLEGLV

SEQ ID NO: 203884 - protein, 18 aa, Mycobacterium bovis
PDPFCEIESTLLWHLATA

SEQ ID NO: 203885 - protein, 18 aa, Mycobacterium bovis
PDPGIEALAHTKIASTIS

SEQ ID NO: 203886 - protein, 22 aa, Mycobacterium bovis
PDPRAADIVETWAHVLDQLERD

SEQ ID NO: 203887 - protein, 20 aa, Mycobacterium bovis
PDPRASLCDIARALRPGGRL

SEQ ID NO: 203888 - protein, 17 aa, Mycobacterium bovis
PDQFDWLATRLEIARKL

SEQ ID NO: 203889 - protein, 24 aa, Mycobacterium bovis
PDQLRRAQKVFARTGGLHAAALFG

SEQ ID NO: 203890 - protein, 25 aa, Mycobacterium bovis
PDQMLAYNCSPSFNWKKHLDDATIA

SEQ ID NO: 203891 - protein, 24 aa, Mycobacterium bovis
PDQRLGEVGRAFVVARPGTGLDEA

SEQ ID NO: 203892 - protein, 20 aa, Mycobacterium bovis
PDRLRSGADVADFGCGSGRA

SEQ ID NO: 203893 - protein, 23 aa, Mycobacterium bovis
PDRPLWECWIIEGLNGNRWAILI

SEQ ID NO: 203894 - protein, 23 aa, Mycobacterium bovis
PDRQRLENVVIRFAGDSGDGMQL

SEQ ID NO: 203895 - protein, 18 aa, Mycobacterium bovis
PDRRDWRLVREVLVAETD

SEQ ID NO: 203896 - protein, 20 aa, Mycobacterium bovis
PDSYLAYGFAVHNCTAPIYK

SEQ ID NO: 203897 - protein, 22 aa, Mycobacterium bovis
PDTAELLRWLDAQTKRNLVITF

SEQ ID NO: 203898 - protein, 21 aa, Mycobacterium bovis
PDTDSELFRRYWPADLHMIGK

SEQ ID NO: 203899 - protein, 18 aa, Mycobacterium bovis
PDTFAGLVALRLPTDEEL

SEQ ID NO: 203900 - protein, 25 aa, Mycobacterium bovis
PDTFRKLRGGFDLILNTVSANLDLG

SEQ ID NO: 203901 - protein, 19 aa, Mycobacterium bovis
PDTKLIVMIGEIGGDAEER

SEQ ID NO: 203902 - protein, 17 aa, Mycobacterium bovis
PDTMTWVTALLPVARGV

SEQ ID NO: 203903 - protein, 17 aa, Mycobacterium bovis
PDTWLPMPPEWAALTAE

SEQ ID NO: 203904 - protein, 21 aa, Mycobacterium bovis
PDVADALGLAVGSPVLVVDRT

SEQ ID NO: 203905 - protein, 18 aa, Mycobacterium bovis
PDVARIGSSIGAPDTAAA

SEQ ID NO: 203906 - protein, 20 aa, Mycobacterium bovis
PDVMLGIVEVLRLITDRGDP

SEQ ID NO: 203907 - protein, 26 aa, Mycobacterium bovis
PDWDARVALHRARRPPTWLTVETADV

SEQ ID NO: 203908 - protein, 24 aa, Mycobacterium bovis
PDYLVTFASLWASVNVEDWKCWAR

SEQ ID NO: 203909 - protein, 27 aa, Mycobacterium bovis
PEADGFQWSFAGPRRLRGIRGDVRLFR

SEQ ID NO: 203910 - protein, 22 aa, Mycobacterium bovis
PEAFTKLAARFLGPVLGGVQPV

SEQ ID NO: 203911 - protein, 17 aa, Mycobacterium bovis
PEAGEAILTGWRMLLDE

SEQ ID NO: 203912 - protein, 20 aa, Mycobacterium bovis
PEAGVVCGVGKPAGKTAFVF

SEQ ID NO: 203913 - protein, 27 aa, Mycobacterium bovis
PEAITRPRWLWKFAKTLRPPDLRVPNQ

SEQ ID NO: 203914 - protein, 20 aa, Mycobacterium bovis
PEALADMVAIGQRIARAARA

SEQ ID NO: 203915 - protein, 17 aa, Mycobacterium bovis
PEALGGLGGAASSQLLP

SEQ ID NO: 203916 - protein, 20 aa, Mycobacterium bovis
PEALGPLEFPFVYRRHQLSL

SEQ ID NO: 203917 - protein, 20 aa, Mycobacterium bovis
PEARVLDTLVHIWVTSIYGE

SEQ ID NO: 203918 - protein, 20 aa, Mycobacterium bovis
PEATRVAVLRSFKDHWDREH

SEQ ID NO: 203919 - protein, 20 aa, Mycobacterium bovis
PECSGRVGIVGFCMGGQFAL

SEQ ID NO: 203920 - protein, 19 aa, Mycobacterium bovis
PEDAWQFAGRVRELTGGTG

SEQ ID NO: 203921 - protein, 18 aa, Mycobacterium bovis
PEDLGWHTICAVMTTEFL

SEQ ID NO: 203922 - protein, 29 aa, Mycobacterium bovis
PEDTGLCSARMYFAYGLGNSVWFPLATGG

SEQ ID NO: 203923 - protein, 19 aa, Mycobacterium bovis
PEDVMGMLAAQGIVTEVGG

SEQ ID NO: 203924 - protein, 25 aa, Mycobacterium bovis
PEDYELMGVPFAKRGKRIDECIEIV

SEQ ID NO: 203925 - protein, 20 aa, Mycobacterium bovis
PEDYRTFWTQFGRVLKEGLL

SEQ ID NO: 203926 - protein, 18 aa, Mycobacterium bovis
PEEAIGLPETFVRDVYGK

SEQ ID NO: 203927 - protein, 19 aa, Mycobacterium bovis
PEETRYWYYALLGFGLNRY

SEQ ID NO: 203928 - protein, 25 aa, Mycobacterium bovis
PEFATYAPGLWRYWAEHLDPDRARR

SEQ ID NO: 203929 - protein, 26 aa, Mycobacterium bovis
PEFDFPRLRTLLCTEAIAAADLMSAI

SEQ ID NO: 203930 - protein, 24 aa, Mycobacterium bovis
PEFINRLDDVLIFEGLNPEELVRI

SEQ ID NO: 203931 - protein, 21 aa, Mycobacterium bovis
PEGADPFVLLFSESAGRVLVA

SEQ ID NO: 203932 - protein, 26 aa, Mycobacterium bovis
PEGKSIASFARRLQVAGVRVAAHTSH

SEQ ID NO: 203933 - protein, 19 aa, Mycobacterium bovis
PEGLRPDDAMIMFTGGTTG

SEQ ID NO: 203934 - protein, 20 aa, Mycobacterium bovis
PEGMPPIWNTYIAVDDVDAV

SEQ ID NO: 203935 - protein, 26 aa, Mycobacterium bovis
PEGSAFPWCRQSAVVQWYVNTPSDGQ

SEQ ID NO: 203936 - protein, 25 aa, Mycobacterium bovis
PEHFAEELVRIIGVLRGMQLKKVPS

SEQ ID NO: 203937 - protein, 17 aa, Mycobacterium bovis
PEHPDHVMYVWVDALTN

SEQ ID NO: 203938 - protein, 29 aa, Mycobacterium bovis
PEHPVAAFPQWFGRSWRRVAMLRYGENPH

SEQ ID NO: 203939 - protein, 21 aa, Mycobacterium bovis
PEIEVGKGFAGVMETFDNTRP

SEQ ID NO: 203940 - protein, 25 aa, Mycobacterium bovis
PEINSLRMYLGAGSAPMLQAAAAWD

SEQ ID NO: 203941 - protein, 21 aa, Mycobacterium bovis
PEISEQLLRVLARRLRRTNNN

SEQ ID NO: 203942 - protein, 19 aa, Mycobacterium bovis
PEIWARLVRALGVVDEADL

SEQ ID NO: 203943 - protein, 22 aa, Mycobacterium bovis
PEKLELCRDLGAQITINYRDED

SEQ ID NO: 203944 - protein, 22 aa, Mycobacterium bovis
PELAGRWELPGGKVAAGETERA

SEQ ID NO: 203945 - protein, 17 aa, Mycobacterium bovis
PELGYRLLQRLGADVAD

SEQ ID NO: 203946 - protein, 25 aa, Mycobacterium bovis
PELLPGDGAQAFACSRKHGWEGVIA

SEQ ID NO: 203947 - protein, 20 aa, Mycobacterium bovis
PELMSELLWSRIGAQCDATI

SEQ ID NO: 203948 - protein, 20 aa, Mycobacterium bovis
PELYDPEILTARYSVGAVDA

SEQ ID NO: 203949 - protein, 19 aa, Mycobacterium bovis
PEPSAAWAEARRRVRQRRE

SEQ ID NO: 203950 - protein, 18 aa, Mycobacterium bovis
PEQLGMNDVKSWVAFGAS

SEQ ID NO: 203951 - protein, 23 aa, Mycobacterium bovis
PERCARVAGLAVRHARLRQVAPA

SEQ ID NO: 203952 - protein, 23 aa, Mycobacterium bovis
PERLPGNHPLAAHFNVYQWLTVL

SEQ ID NO: 203953 - protein, 19 aa, Mycobacterium bovis
PERLVRAAVDLVDHPGARA

SEQ ID NO: 203954 - protein, 21 aa, Mycobacterium bovis
PERRRGMAVIISDFLGPINWM

SEQ ID NO: 203955 - protein, 27 aa, Mycobacterium bovis
PERSASWVVPLLWRRWSPGYHAEEDLR

SEQ ID NO: 203956 - protein, 24 aa, Mycobacterium bovis
PERTSALNATWRSATCRVLAAATG

SEQ ID NO: 203957 - protein, 21 aa, Mycobacterium bovis
PESFLGGAYHPVFAAGPAADH

SEQ ID NO: 203958 - protein, 19 aa, Mycobacterium bovis
PESHAMFVALAYAKLNGVR

SEQ ID NO: 203959 - protein, 22 aa, Mycobacterium bovis
PESLRLSRTGVFVGVSSTDYVR

SEQ ID NO: 203960 - protein, 17 aa, Mycobacterium bovis
PESYVQAQFDSVLHSAL

SEQ ID NO: 203961 - protein, 17 aa, Mycobacterium bovis
PETAQGIFVNFANVVTT

SEQ ID NO: 203962 - protein, 26 aa, Mycobacterium bovis
PETGLRPPRPGNFVMSFLDASIAPLS

SEQ ID NO: 203963 - protein, 22 aa, Mycobacterium bovis
PETPARPVLVVDFGAQYAQLIA

SEQ ID NO: 203964 - protein, 21 aa, Mycobacterium bovis
PEVAAEFGAGLVCAHTGGALP

SEQ ID NO: 203965 - protein, 21 aa, Mycobacterium bovis
PEVIARIAAGVAEGNAKLSRV

SEQ ID NO: 203966 - protein, 19 aa, Mycobacterium bovis
PEVIASPTPAAAGRVQAWV

SEQ ID NO: 203967 - protein, 17 aa, Mycobacterium bovis
PEVLLAWQMNSEPLPRA

SEQ ID NO: 203968 - protein, 31 aa, Mycobacterium bovis
PEVLWLAQRARQAWDGVRIVIGNAMATLNYE

SEQ ID NO: 203969 - protein, 17 aa, Mycobacterium bovis
PEVSAALSPLGLTLPEF

SEQ ID NO: 203970 - protein, 23 aa, Mycobacterium bovis
PEVVEATLALPVRDLVADGEAIA

SEQ ID NO: 203971 - protein, 20 aa, Mycobacterium bovis
PEVVIPMLVPDGAHSYPDAA

SEQ ID NO: 203972 - protein, 17 aa, Mycobacterium bovis
PEVYGGAGVHVTELVAY

SEQ ID NO: 203973 - protein, 27 aa, Mycobacterium bovis
PEWPQMLLRALMFRLAVYALHPRSTAE

SEQ ID NO: 203974 - protein, 21 aa, Mycobacterium bovis
PFADLSFPAGVTVDRDDSVYV

SEQ ID NO: 203975 - protein, 18 aa, Mycobacterium bovis
PFAEPGWFHTDDLGALES

SEQ ID NO: 203976 - protein, 26 aa, Mycobacterium bovis
PFAGHPTVGASWWLRERGTPINTLQV

SEQ ID NO: 203977 - protein, 19 aa, Mycobacterium bovis
PFAPELPKGYPVSSAPYGS

SEQ ID NO: 203978 - protein, 25 aa, Mycobacterium bovis
PFEKAVVVPLDPTSTFALITQPDRL

SEQ ID NO: 203979 - protein, 20 aa, Mycobacterium bovis
PFEPDVRLSPYLALHGICRW

SEQ ID NO: 203980 - protein, 22 aa, Mycobacterium bovis
PFGGAYRLIDFVLSNLVNARYL

SEQ ID NO: 203981 - protein, 33 aa, Mycobacterium bovis
PFGTPTFTGRSWPLADVRLLAPILASKVVCVGK

SEQ ID NO: 203982 - protein, 31 aa, Mycobacterium bovis
PFLHKELYREYSLRPPKGVLLYGPPGCGKTL

SEQ ID NO: 203983 - protein, 21 aa, Mycobacterium bovis
PFMEFTPGYVLRSLDELPKQG

SEQ ID NO: 203984 - protein, 21 aa, Mycobacterium bovis
PFPLAPMQHAMWVGRHDHQQL

SEQ ID NO: 203985 - protein, 27 aa, Mycobacterium bovis
PFPMTAWAVGLLMRLPQRGVVTVATNV

SEQ ID NO: 203986 - protein, 19 aa, Mycobacterium bovis
PFQPEELMPEYSIGTMTFA

SEQ ID NO: 203987 - protein, 17 aa, Mycobacterium bovis
PFRGWSAADLEHVTPEQ

SEQ ID NO: 203988 - protein, 18 aa, Mycobacterium bovis
PFRISLIERDAWLRCMHT

SEQ ID NO: 203989 - protein, 34 aa, Mycobacterium bovis
PFSPVCRPDCPGLCPQCGVPLASEPGHRHEQIDP

SEQ ID NO: 203990 - protein, 24 aa, Mycobacterium bovis
PFSVTRPDGLPVWIYQFKISPHPT

SEQ ID NO: 203991 - protein, 19 aa, Mycobacterium bovis
PFVKAAYRIGQVQDIGRGV

SEQ ID NO: 203992 - protein, 17 aa, Mycobacterium bovis
PFWPRNPWTTAYRQERL

SEQ ID NO: 203993 - protein, 19 aa, Mycobacterium bovis
PGAAPAVRAEWAAPGNQAL

SEQ ID NO: 203994 - protein, 18 aa, Mycobacterium bovis
PGAAQGWHLHHLLTAGQI

SEQ ID NO: 203995 - protein, 25 aa, Mycobacterium bovis
PGAEASWVVGITWWSAVVGGFQMSF

SEQ ID NO: 203996 - protein, 24 aa, Mycobacterium bovis
PGAECERLHLPPMCDRDTTHCVSV

SEQ ID NO: 203997 - protein, 25 aa, Mycobacterium bovis
PGAGPMLAAAVAWDGLAAELQSMAA

SEQ ID NO: 203998 - protein, 17 aa, Mycobacterium bovis
PGAPGQAGGAGGSAGLL

SEQ ID NO: 203999 - protein, 18 aa, Mycobacterium bovis
PGAVIGHSMGESAAAVVA

SEQ ID NO: 204000 - protein, 21 aa, Mycobacterium bovis
PGAYVAGWIKRGPTGFIGTNK

SEQ ID NO: 204001 - protein, 22 aa, Mycobacterium bovis
PGCGHWPGAVIRLEAPVIPHMG

SEQ ID NO: 204002 - protein, 28 aa, Mycobacterium bovis
PGCPFAPRCPLVIDECLTAEPELLDVAT

SEQ ID NO: 204003 - protein, 18 aa, Mycobacterium bovis
PGDAYWLLRHAIACPDPV

SEQ ID NO: 204004 - protein, 23 aa, Mycobacterium bovis
PGDGWRVAMATLTFERGVSTLGQ

SEQ ID NO: 204005 - protein, 17 aa, Mycobacterium bovis
PGDHKPVEDFLSRDHAG

SEQ ID NO: 204006 - protein, 27 aa, Mycobacterium bovis
PGDIDRFGRRFGCVVMDGFGSTEGGVA

SEQ ID NO: 204007 - protein, 21 aa, Mycobacterium bovis
PGDQPGKWSLMAQGVYAPAIP

SEQ ID NO: 204008 - protein, 20 aa, Mycobacterium bovis
PGDSLTLRYAGARGAVIQST

SEQ ID NO: 204009 - protein, 21 aa, Mycobacterium bovis
PGELRRPVVHADDLVAVSAKQ

SEQ ID NO: 204010 - protein, 22 aa, Mycobacterium bovis
PGERIRVVRRVHLRYEGTDTAI

SEQ ID NO: 204011 - protein, 21 aa, Mycobacterium bovis
PGEVPARMEALGALGGLDRAA

SEQ ID NO: 204012 - protein, 24 aa, Mycobacterium bovis
PGGARSGLRAAVDILEDIDDIHIA

SEQ ID NO: 204013 - protein, 25 aa, Mycobacterium bovis
PGGCAGLRYNLFFDDRTLDGDQTAE

SEQ ID NO: 204014 - protein, 19 aa, Mycobacterium bovis
PGGDIKPEHLILIGQIAQD

SEQ ID NO: 204015 - protein, 17 aa, Mycobacterium bovis
PGGGVTIVIPGHENVTL

SEQ ID NO: 204016 - protein, 25 aa, Mycobacterium bovis
PGGLTFPANSLLNLDVFVGTPGATI

SEQ ID NO: 204017 - protein, 17 aa, Mycobacterium bovis
PGGLTVFDVRVEAMAPF

SEQ ID NO: 204018 - protein, 21 aa, Mycobacterium bovis
PGGPLKIGPITGLFNTPIGLT

SEQ ID NO: 204019 - protein, 19 aa, Mycobacterium bovis
PGGRCLCTYFLLNDESLAH

SEQ ID NO: 204020 - protein, 23 aa, Mycobacterium bovis
PGGSGGNGGVWYGNGGAGGAAGQ

SEQ ID NO: 204021 - protein, 19 aa, Mycobacterium bovis
PGGSTAIRIPATASVGPFD

SEQ ID NO: 204022 - protein, 19 aa, Mycobacterium bovis
PGGVVSRGDLLRVLPGDGS

SEQ ID NO: 204023 - protein, 23 aa, Mycobacterium bovis
PGGYLKAAVDFALDRDDYGPDLR

SEQ ID NO: 204024 - protein, 23 aa, Mycobacterium bovis
PGHICPISMTYAVVPALRYNSEL

SEQ ID NO: 204025 - protein, 20 aa, Mycobacterium bovis
PGIPESFKVLLKELQSLCLN

SEQ ID NO: 204026 - protein, 23 aa, Mycobacterium bovis
PGIPFGAAVGSGFARLNFATTRA

SEQ ID NO: 204027 - protein, 31 aa, Mycobacterium bovis
PGKGNAMGPAFWSEMPEVFHALDADREVRAI

SEQ ID NO: 204028 - protein, 19 aa, Mycobacterium bovis
PGKLPAIRQQIWTLIRAAK

SEQ ID NO: 204029 - protein, 22 aa, Mycobacterium bovis
PGKPSWNLEPWRPVVDDSEMLA

SEQ ID NO: 204030 - protein, 19 aa, Mycobacterium bovis
PGLARAVVNLHRRYRITTA

SEQ ID NO: 204031 - protein, 17 aa, Mycobacterium bovis
PGLATPVTPAANGGNGL

SEQ ID NO: 204032 - protein, 20 aa, Mycobacterium bovis
PGLEEVRIAVGYRWDPDTRE

SEQ ID NO: 204033 - protein, 19 aa, Mycobacterium bovis
PGLELSTGIALAFPRGPFV

SEQ ID NO: 204034 - protein, 23 aa, Mycobacterium bovis
PGLHRPRTLLGKRLNDLVRETYA

SEQ ID NO: 204035 - protein, 19 aa, Mycobacterium bovis
PGLIDELGTLTWRQLDERG

SEQ ID NO: 204036 - protein, 24 aa, Mycobacterium bovis
PGLLTLDGTNTWVLRGPLSDELVV

SEQ ID NO: 204037 - protein, 22 aa, Mycobacterium bovis
PGLMHVRFGPYHVRDVKFVAAF

SEQ ID NO: 204038 - protein, 19 aa, Mycobacterium bovis
PGLQEKPLSIALREIHADL

SEQ ID NO: 204039 - protein, 21 aa, Mycobacterium bovis
PGLREAGFWRFVADPYDPSES

SEQ ID NO: 204040 - protein, 22 aa, Mycobacterium bovis
PGLRWPDLALQGGRLNWSAVRA

SEQ ID NO: 204041 - protein, 20 aa, Mycobacterium bovis
PGLTEALHNIGFGNIGGNNY

SEQ ID NO: 204042 - protein, 24 aa, Mycobacterium bovis
PGMDPNWRRILLVCRATETMGTGG

SEQ ID NO: 204043 - protein, 18 aa, Mycobacterium bovis
PGMGHAIELRVYRFGGSL

SEQ ID NO: 204044 - protein, 19 aa, Mycobacterium bovis
PGMNGIDVCRVLRADSGVP

SEQ ID NO: 204045 - protein, 18 aa, Mycobacterium bovis
PGMRAKLFDAARLAASAI

SEQ ID NO: 204046 - protein, 27 aa, Mycobacterium bovis
PGNSLFITVNCWGRLVTGVGAALGKGA

SEQ ID NO: 204047 - protein, 23 aa, Mycobacterium bovis
PGPDIDGGIDLTDDEFQAFLQAA

SEQ ID NO: 204048 - protein, 18 aa, Mycobacterium bovis
PGPESMLAAAAAWDGVAA

SEQ ID NO: 204049 - protein, 23 aa, Mycobacterium bovis
PGPMLAAATAWDGLAVELHATAA

SEQ ID NO: 204050 - protein, 19 aa, Mycobacterium bovis
PGPRAQFLTALAGVMRPGD

SEQ ID NO: 204051 - protein, 26 aa, Mycobacterium bovis
PGPSIACSRWGMLSPEGRCKTFDASA

SEQ ID NO: 204052 - protein, 20 aa, Mycobacterium bovis
PGPSSARGAEEFVEVSWDEL

SEQ ID NO: 204053 - protein, 22 aa, Mycobacterium bovis
PGPTALLAPDWVPWEQRVRPGD

SEQ ID NO: 204054 - protein, 19 aa, Mycobacterium bovis
PGPTRLRVADLLRATDQAA

SEQ ID NO: 204055 - protein, 24 aa, Mycobacterium bovis
PGPWRLDPLPLVISAADWEVLEAG

SEQ ID NO: 204056 - protein, 26 aa, Mycobacterium bovis
PGQGSQWLGMGIELLDTAPAFAQQID

SEQ ID NO: 204057 - protein, 23 aa, Mycobacterium bovis
PGQPGGAGGLLFGNGGNGAAGAV

SEQ ID NO: 204058 - protein, 18 aa, Mycobacterium bovis
PGQPGGRGGAAGLIGNGG

SEQ ID NO: 204059 - protein, 22 aa, Mycobacterium bovis
PGQRIPSRWLDSGVIVQADTLA

SEQ ID NO: 204060 - protein, 17 aa, Mycobacterium bovis
PGQVLGLTFTRKAAGQL

SEQ ID NO: 204061 - protein, 23 aa, Mycobacterium bovis
PGRAIPFGAFRHLISLPASGADI

SEQ ID NO: 204062 - protein, 24 aa, Mycobacterium bovis
PGRDDWAVHIALWRRSSNGQPEIT

SEQ ID NO: 204063 - protein, 27 aa, Mycobacterium bovis
PGRGPCYRCLHPAPPPPGLVPSCAEGG

SEQ ID NO: 204064 - protein, 23 aa, Mycobacterium bovis
PGRVKTRLAAAIGDKVAADIAAA

SEQ ID NO: 204065 - protein, 19 aa, Mycobacterium bovis
PGRVWPLLQRNKSALADIG

SEQ ID NO: 204066 - protein, 42 aa, Mycobacterium bovis
PGSAMARSTKRVCRDCGFFLPLAGSLGAMFGVCGNELSADGH

SEQ ID NO: 204067 - protein, 24 aa, Mycobacterium bovis
PGSDFELVQGFLLAEGVVAHREDV

SEQ ID NO: 204068 - protein, 19 aa, Mycobacterium bovis
PGSGIDYGLLRYLRADTAE

SEQ ID NO: 204069 - protein, 18 aa, Mycobacterium bovis
PGSVACCLVGVTAVADGI

SEQ ID NO: 204070 - protein, 27 aa, Mycobacterium bovis
PGTGDDGGAGGWLFGNGGNGGAGAAGT

SEQ ID NO: 204071 - protein, 18 aa, Mycobacterium bovis
PGTGMPAAPMVPPTGSPG

SEQ ID NO: 204072 - protein, 17 aa, Mycobacterium bovis
PGTLTSLGFSYDVLHAF

SEQ ID NO: 204073 - protein, 18 aa, Mycobacterium bovis
PGTRRMYSNYGFTVLAES

SEQ ID NO: 204074 - protein, 22 aa, Mycobacterium bovis
PGVDLRAGIACQLRDLGVESID

SEQ ID NO: 204075 - protein, 24 aa, Mycobacterium bovis
PGVEFKDLTPLFADRRGLAAVTEA

SEQ ID NO: 204076 - protein, 25 aa, Mycobacterium bovis
PGVPMVFPLWLERLQVKYINRALKP

SEQ ID NO: 204077 - protein, 27 aa, Mycobacterium bovis
PGVSCVKPAGALYAFPRLDPEVYDIDD

SEQ ID NO: 204078 - protein, 18 aa, Mycobacterium bovis
PGVSLGVRPDPVRPVRSA

SEQ ID NO: 204079 - protein, 18 aa, Mycobacterium bovis
PGWLWPHPPEALAPRYVD

SEQ ID NO: 204080 - protein, 20 aa, Mycobacterium bovis
PGWRAGSSPLGYAQLYLPTR

SEQ ID NO: 204081 - protein, 23 aa, Mycobacterium bovis
PGYGEMFSALGFDGLVRSARSRA

SEQ ID NO: 204082 - protein, 19 aa, Mycobacterium bovis
PGYTGLHFMAAYELEECWQ

SEQ ID NO: 204083 - protein, 27 aa, Mycobacterium bovis
PHAGYRAVHVWLRLPAGRVEIQIRTIL

SEQ ID NO: 204084 - protein, 22 aa, Mycobacterium bovis
PHAWLGDAFHAWVQQFYGAELL

SEQ ID NO: 204085 - protein, 27 aa, Mycobacterium bovis
PHDIVLFPAWVWRSPLKPSPLDPPHVP

SEQ ID NO: 204086 - protein, 17 aa, Mycobacterium bovis
PHDWIVWHFTHADNLPG

SEQ ID NO: 204087 - protein, 25 aa, Mycobacterium bovis
PHECCRLRKVVPLGKTLRGYSAWVT

SEQ ID NO: 204088 - protein, 24 aa, Mycobacterium bovis
PHGQVLVFWDCYRPHDVQVRMFDV

SEQ ID NO: 204089 - protein, 18 aa, Mycobacterium bovis
PHHRWPRHILDVKTAIAW

SEQ ID NO: 204090 - protein, 18 aa, Mycobacterium bovis
PHLCSRAFITEQYDRYVR

SEQ ID NO: 204091 - protein, 18 aa, Mycobacterium bovis
PHLIRQLARMGAKTIVAM

SEQ ID NO: 204092 - protein, 19 aa, Mycobacterium bovis
PHMERRFSADGTSWDPTEL

SEQ ID NO: 204093 - protein, 18 aa, Mycobacterium bovis
PHPELLRGWDLATTADGL

SEQ ID NO: 204094 - protein, 21 aa, Mycobacterium bovis
PHPIQGIGAGFVPPVLDQDLV

SEQ ID NO: 204095 - protein, 26 aa, Mycobacterium bovis
PHQISRAGNMLSVFFGETPVTDFASA

SEQ ID NO: 204096 - protein, 18 aa, Mycobacterium bovis
PHRLPGIRMIASTYLGVV

SEQ ID NO: 204097 - protein, 17 aa, Mycobacterium bovis
PHRVCRYLEDLAGDYHR

SEQ ID NO: 204098 - protein, 25 aa, Mycobacterium bovis
PHTKPPNFWAWLIAQVKTVDPDVLF

SEQ ID NO: 204099 - protein, 18 aa, Mycobacterium bovis
PHTRPPIGELLRGYEETV

SEQ ID NO: 204100 - protein, 18 aa, Mycobacterium bovis
PIAIVGMACRYPGGVNSP

SEQ ID NO: 204101 - protein, 19 aa, Mycobacterium bovis
PIARDLASKLIRVVTIAPG

SEQ ID NO: 204102 - protein, 19 aa, Mycobacterium bovis
PIARSVMDAALLLDATTTV

SEQ ID NO: 204103 - protein, 20 aa, Mycobacterium bovis
PIAVTDFWTFPRSCNPTGGL

SEQ ID NO: 204104 - protein, 22 aa, Mycobacterium bovis
PICAFSHCRDVVAAVSNAGGFG

SEQ ID NO: 204105 - protein, 18 aa, Mycobacterium bovis
PIDCTLRGLTQYSRTNNA

SEQ ID NO: 204106 - protein, 25 aa, Mycobacterium bovis
PIDEISVLVPDDFVGAVLGDLSSRR

SEQ ID NO: 204107 - protein, 19 aa, Mycobacterium bovis
PIDIGLPVSLTIPGFTIPG

SEQ ID NO: 204108 - protein, 24 aa, Mycobacterium bovis
PIDLRADWPTALQAAGFDSAAPTA

SEQ ID NO: 204109 - protein, 25 aa, Mycobacterium bovis
PIDPWGGSYYVEWLTHRLARRARAH

SEQ ID NO: 204110 - protein, 23 aa, Mycobacterium bovis
PIEAKVAAVNAVIEQSNAMADHV

SEQ ID NO: 204111 - protein, 26 aa, Mycobacterium bovis
PIEPRLSLQWWVRVESLAKAAGDAVR

SEQ ID NO: 204112 - protein, 19 aa, Mycobacterium bovis
PIERLEELVPVYSELLSLL

SEQ ID NO: 204113 - protein, 22 aa, Mycobacterium bovis
PIERTCEFLEWFGENVPISPIW

SEQ ID NO: 204114 - protein, 22 aa, Mycobacterium bovis
PIEVNAGPVLKVHPNLRYATDG

SEQ ID NO: 204115 - protein, 26 aa, Mycobacterium bovis
PIGMAPEEWRAFAARASLHAARAKAK

SEQ ID NO: 204116 - protein, 27 aa, Mycobacterium bovis
PIGPESWGFTGWRWFSGTAPRYIRDTG

SEQ ID NO: 204117 - protein, 23 aa, Mycobacterium bovis
PILHRRRREFKARAAEKPAPSDR

SEQ ID NO: 204118 - protein, 24 aa, Mycobacterium bovis
PILLGAGWEGGWRCGEVVLSMVAD

SEQ ID NO: 204119 - protein, 29 aa, Mycobacterium bovis
PIPDERFRYGFAIAPELVRTVLRDNEPDW

SEQ ID NO: 204120 - protein, 25 aa, Mycobacterium bovis
PIPRPPSIRDSLCFLDHMRNCQEAM

SEQ ID NO: 204121 - protein, 18 aa, Mycobacterium bovis
PIPVGFAAVGGIGPIAIP

SEQ ID NO: 204122 - protein, 18 aa, Mycobacterium bovis
PIPYVYPVDLRFVLAPPV

SEQ ID NO: 204123 - protein, 17 aa, Mycobacterium bovis
PIQQARGGESLWDENGG

SEQ ID NO: 204124 - protein, 20 aa, Mycobacterium bovis
PIQSIYGWRGASATNLPRFT

SEQ ID NO: 204125 - protein, 24 aa, Mycobacterium bovis
PIRIDRFELLAARRRDQLIDIDVE

SEQ ID NO: 204126 - protein, 24 aa, Mycobacterium bovis
PIRMGVDVPDRIAGVAYPQGTTAR

SEQ ID NO: 204127 - protein, 19 aa, Mycobacterium bovis
PITAVSLAWLPAGDYERAL

SEQ ID NO: 204128 - protein, 18 aa, Mycobacterium bovis
PITVPVLLLLTERFDLSA

SEQ ID NO: 204129 - protein, 17 aa, Mycobacterium bovis
PIWEGEDGVIAWLLAGP

SEQ ID NO: 204130 - protein, 19 aa, Mycobacterium bovis
PKELVARVRARLRRNDDEP

SEQ ID NO: 204131 - protein, 22 aa, Mycobacterium bovis
PKGIWAPECAYAPGMEVDYATA

SEQ ID NO: 204132 - protein, 21 aa, Mycobacterium bovis
PKGTLGLTVAEPIKVARNDDG

SEQ ID NO: 204133 - protein, 19 aa, Mycobacterium bovis
PKITLACEVCKHRNYITKK

SEQ ID NO: 204134 - protein, 22 aa, Mycobacterium bovis
PKKQVRCVYVAIGQKGTTIAAV

SEQ ID NO: 204135 - protein, 18 aa, Mycobacterium bovis
PKLAGRVVDARWDGPQAG

SEQ ID NO: 204136 - protein, 17 aa, Mycobacterium bovis
PKLAPAPMLERQANQRS

SEQ ID NO: 204137 - protein, 19 aa, Mycobacterium bovis
PKLRRAGLDYHDLASVTVH

SEQ ID NO: 204138 - protein, 21 aa, Mycobacterium bovis
PKNPRLRARPRIKGLRLRATD

SEQ ID NO: 204139 - protein, 21 aa, Mycobacterium bovis
PKPDAPVRYRFHFPRQQRGRF

SEQ ID NO: 204140 - protein, 18 aa, Mycobacterium bovis
PKPGQKWVNVDPTKNKSG

SEQ ID NO: 204141 - protein, 20 aa, Mycobacterium bovis
PKPLRLDDVSAHPASIGFPP

SEQ ID NO: 204142 - protein, 20 aa, Mycobacterium bovis
PKPPFAQRVPDWLWAAPRKL

SEQ ID NO: 204143 - protein, 20 aa, Mycobacterium bovis
PKPPPRRITLTLPAIQRSRE

SEQ ID NO: 204144 - protein, 18 aa, Mycobacterium bovis
PKRARMLMDAAIFKDTLI

SEQ ID NO: 204145 - protein, 18 aa, Mycobacterium bovis
PKRRPVPLRLRDWREVYE

SEQ ID NO: 204146 - protein, 19 aa, Mycobacterium bovis
PKSALGAGLGLRSAISSGL

SEQ ID NO: 204147 - protein, 19 aa, Mycobacterium bovis
PKSWDPAAMESAIYQKWLD

SEQ ID NO: 204148 - protein, 24 aa, Mycobacterium bovis
PKTLIQHLIRWVISAGEFGEKVGE

SEQ ID NO: 204149 - protein, 19 aa, Mycobacterium bovis
PKTPEWAAALSGLAAGDLR

SEQ ID NO: 204150 - protein, 18 aa, Mycobacterium bovis
PKTSHLIVRMYNALLEAV

SEQ ID NO: 204151 - protein, 20 aa, Mycobacterium bovis
PKVEACLRAVIGGVPSAHII

SEQ ID NO: 204152 - protein, 20 aa, Mycobacterium bovis
PKYAEAGIRAIDLTPAAVGP

SEQ ID NO: 204153 - protein, 17 aa, Mycobacterium bovis
PLACGLPALPQGNNPVS

SEQ ID NO: 204154 - protein, 19 aa, Mycobacterium bovis
PLACPGLLGAMTVGATAVF

SEQ ID NO: 204155 - protein, 24 aa, Mycobacterium bovis
PLADLRGGAVWDAAAVRRFAETWE

SEQ ID NO: 204156 - protein, 18 aa, Mycobacterium bovis
PLARCSRSPGLNESSHMS

SEQ ID NO: 204157 - protein, 23 aa, Mycobacterium bovis
PLAVDHFRYFAAAIRAQEGALSQ

SEQ ID NO: 204158 - protein, 22 aa, Mycobacterium bovis
PLDCVIGAPVLFGRANVVFTRL

SEQ ID NO: 204159 - protein, 17 aa, Mycobacterium bovis
PLDGFRVLDFTQNVAGP

SEQ ID NO: 204160 - protein, 18 aa, Mycobacterium bovis
PLDRSHTAAIIWYDDPDD

SEQ ID NO: 204161 - protein, 19 aa, Mycobacterium bovis
PLDRVCMIDGLRIIVLDTS

SEQ ID NO: 204162 - protein, 25 aa, Mycobacterium bovis
PLDTTWHRPGWTIGELEAAKAGRTI

SEQ ID NO: 204163 - protein, 35 aa, Mycobacterium bovis
PLEGVLDVINAPALALLGRPLIGNGANGAPGTGAN

SEQ ID NO: 204164 - protein, 23 aa, Mycobacterium bovis
PLFQRRHLLLSGWIKMQEGQLPS

SEQ ID NO: 204165 - protein, 18 aa, Mycobacterium bovis
PLGAFGIGGEFNMADLGQ

SEQ ID NO: 204166 - protein, 18 aa, Mycobacterium bovis
PLGFDIRTSAGPLNIPII

SEQ ID NO: 204167 - protein, 24 aa, Mycobacterium bovis
PLGKTLRGYSAWVTGLRRVDAPTR

SEQ ID NO: 204168 - protein, 18 aa, Mycobacterium bovis
PLGLRVLRNIERVIRDEM

SEQ ID NO: 204169 - protein, 24 aa, Mycobacterium bovis
PLGLTLPEFVCLRMLSQSPGLSSA

SEQ ID NO: 204170 - protein, 27 aa, Mycobacterium bovis
PLGMSYGVSKAAMWSATESMRIELAPR

SEQ ID NO: 204171 - protein, 18 aa, Mycobacterium bovis
PLGPYGFSGWVGPEPHGA

SEQ ID NO: 204172 - protein, 24 aa, Mycobacterium bovis
PLGRANLYSVCFDLATTDRKLTPA

SEQ ID NO: 204173 - protein, 18 aa, Mycobacterium bovis
PLGSWLAALPDERLTQLL

SEQ ID NO: 204174 - protein, 28 aa, Mycobacterium bovis
PLLAEADVPWVLMHWRAVSADTPHVPVR

SEQ ID NO: 204175 - protein, 18 aa, Mycobacterium bovis
PLLDGEITSCYSMTEPQG

SEQ ID NO: 204176 - protein, 18 aa, Mycobacterium bovis
PLLVACDLQRPAAVNQLQ

SEQ ID NO: 204177 - protein, 18 aa, Mycobacterium bovis
PLLVPLRAIPLLGNPLAD

SEQ ID NO: 204178 - protein, 24 aa, Mycobacterium bovis
PLMSNEIFGPILPVVTVKSLDDAI

SEQ ID NO: 204179 - protein, 24 aa, Mycobacterium bovis
PLPFLRRFDIPPGIEHQEDAFMSL

SEQ ID NO: 204180 - protein, 25 aa, Mycobacterium bovis
PLPLPLKTSCAWAQARRDGQDPYPP

SEQ ID NO: 204181 - protein, 24 aa, Mycobacterium bovis
PLPPTVGITLHLPFDGILVPPHPV

SEQ ID NO: 204182 - protein, 17 aa, Mycobacterium bovis
PLPTAITPHHLWLRAVA

SEQ ID NO: 204183 - protein, 22 aa, Mycobacterium bovis
PLPTEKNVYCVIRSPHKYKDSR

SEQ ID NO: 204184 - protein, 17 aa, Mycobacterium bovis
PLQRLVRALLGFDAKLS

SEQ ID NO: 204185 - protein, 17 aa, Mycobacterium bovis
PLRFKREGAGHFNRGTQ

SEQ ID NO: 204186 - protein, 19 aa, Mycobacterium bovis
PLRGLISICAAGGQGVAAI

SEQ ID NO: 204187 - protein, 23 aa, Mycobacterium bovis
PLRLLFKDEVRAVGRELGLPEEI

SEQ ID NO: 204188 - protein, 25 aa, Mycobacterium bovis
PLRPDRYLRIVAAMRREGMGFTAGF

SEQ ID NO: 204189 - protein, 20 aa, Mycobacterium bovis
PLRRELAGTFSARRGTYRLL

SEQ ID NO: 204190 - protein, 19 aa, Mycobacterium bovis
PLSALLHVARTVVRRAERS

SEQ ID NO: 204191 - protein, 20 aa, Mycobacterium bovis
PLSLGRLDRGWVVASETAAL

SEQ ID NO: 204192 - protein, 20 aa, Mycobacterium bovis
PLSRLPMIPGTSLKGKVRTL

SEQ ID NO: 204193 - protein, 18 aa, Mycobacterium bovis
PLTARMVFEHPVLCELAA

SEQ ID NO: 204194 - protein, 23 aa, Mycobacterium bovis
PLVIPGRPVARVDTQRARDLLVQ

SEQ ID NO: 204195 - protein, 28 aa, Mycobacterium bovis
PLVRSTITAIDWLYWRMTKGVEDAQRRE

SEQ ID NO: 204196 - protein, 18 aa, Mycobacterium bovis
PLWAPDYPVGAQVRRADP

SEQ ID NO: 204197 - protein, 18 aa, Mycobacterium bovis
PMAVCANGAVIYDPGTDR

SEQ ID NO: 204198 - protein, 21 aa, Mycobacterium bovis
PMDRVICGDVGYGKTEIAVRA

SEQ ID NO: 204199 - protein, 24 aa, Mycobacterium bovis
PMFAFGHGLSYTSFEYRDLVVTGG

SEQ ID NO: 204200 - protein, 17 aa, Mycobacterium bovis
PMGGDALAYATYTSGTT

SEQ ID NO: 204201 - protein, 17 aa, Mycobacterium bovis
PMGLPELTSTKWIAWGA

SEQ ID NO: 204202 - protein, 22 aa, Mycobacterium bovis
PMGRIAAQLADLVVVTDDNPRD

SEQ ID NO: 204203 - protein, 22 aa, Mycobacterium bovis
PMLDAAAAWDGLADELGSAAAS

SEQ ID NO: 204204 - protein, 17 aa, Mycobacterium bovis
PMMARNILESFKLLTNV

SEQ ID NO: 204205 - protein, 23 aa, Mycobacterium bovis
PMSFLRRPARWMQLLATSGRCFS

SEQ ID NO: 204206 - protein, 17 aa, Mycobacterium bovis
PMWAHPEPLPPVSGLTI

SEQ ID NO: 204207 - protein, 18 aa, Mycobacterium bovis
PNCGTCRYCCTGRQNLCD

SEQ ID NO: 204208 - protein, 25 aa, Mycobacterium bovis
PNFAIGAVLSMHFAKQAARFFDSAE

SEQ ID NO: 204209 - protein, 25 aa, Mycobacterium bovis
PNGGVLERYVGLYLTFLDMSFNGAT

SEQ ID NO: 204210 - protein, 23 aa, Mycobacterium bovis
PNIKTDAMFPARAFDALDALVAS

SEQ ID NO: 204211 - protein, 21 aa, Mycobacterium bovis
PNLFENMGFTYIGPVDGHNIP

SEQ ID NO: 204212 - protein, 31 aa, Mycobacterium bovis
PNLVMGSNVQVVWEKFCRYFDVEPRYLPMER

SEQ ID NO: 204213 - protein, 21 aa, Mycobacterium bovis
PNNEEWARFVAACDLVRGAHA

SEQ ID NO: 204214 - protein, 18 aa, Mycobacterium bovis
PNRSLDCVDDELAGSAHF

SEQ ID NO: 204215 - protein, 26 aa, Mycobacterium bovis
PNSFTIPGFQIRVLLGPAAVLVNEMI

SEQ ID NO: 204216 - protein, 23 aa, Mycobacterium bovis
PNSPACWMDELLYARAATIYAGS

SEQ ID NO: 204217 - protein, 20 aa, Mycobacterium bovis
PNYDAVASIAWLGYDAPDGL

SEQ ID NO: 204218 - protein, 25 aa, Mycobacterium bovis
PNYLPWDERLCAVPNGDLFKTLASG

SEQ ID NO: 204219 - protein, 25 aa, Mycobacterium bovis
PPAEVPVRCAAGSDAAWLRAELNNE

SEQ ID NO: 204220 - protein, 17 aa, Mycobacterium bovis
PPATVVFARRGKQIARG

SEQ ID NO: 204221 - protein, 21 aa, Mycobacterium bovis
PPATYFSGGKLQWILENVDGV

SEQ ID NO: 204222 - protein, 24 aa, Mycobacterium bovis
PPAVARFLAHWVHQAGPKILEPSC

SEQ ID NO: 204223 - protein, 17 aa, Mycobacterium bovis
PPCDDWSPPPIRMGVDV

SEQ ID NO: 204224 - protein, 23 aa, Mycobacterium bovis
PPDLRIPFDPREVIARIVDGSEF

SEQ ID NO: 204225 - protein, 18 aa, Mycobacterium bovis
PPDNWRLVVSDLADSELP

SEQ ID NO: 204226 - protein, 21 aa, Mycobacterium bovis
PPDVRISLSPLDFVTEGRSLI

SEQ ID NO: 204227 - protein, 25 aa, Mycobacterium bovis
PPEFADRVADAWIKAQAYRLQTFGT

SEQ ID NO: 204228 - protein, 26 aa, Mycobacterium bovis
PPEGACPGPFGAPIPGFARSYQPSSP

SEQ ID NO: 204229 - protein, 18 aa, Mycobacterium bovis
PPEGRFGSVASVQRYVDD

SEQ ID NO: 204230 - protein, 18 aa, Mycobacterium bovis
PPEINSARMFAGAGSGPL

SEQ ID NO: 204231 - protein, 18 aa, Mycobacterium bovis
PPELYRITYDGSIADEPH

SEQ ID NO: 204232 - protein, 17 aa, Mycobacterium bovis
PPERGSRVRLCPTPGHL

SEQ ID NO: 204233 - protein, 22 aa, Mycobacterium bovis
PPFDLDGRWIGEASFVLPADLP

SEQ ID NO: 204234 - protein, 17 aa, Mycobacterium bovis
PPFPANLTTLFFGPTGI

SEQ ID NO: 204235 - protein, 25 aa, Mycobacterium bovis
PPFPLYMAGARLDSLVPLGPPVMDV

SEQ ID NO: 204236 - protein, 26 aa, Mycobacterium bovis
PPFRSLTPIPVHWVAAAVLDGVARRR

SEQ ID NO: 204237 - protein, 20 aa, Mycobacterium bovis
PPGAPGMPGMPGMPGAPGAP

SEQ ID NO: 204238 - protein, 19 aa, Mycobacterium bovis
PPGCGKTFVVRALASTGQL

SEQ ID NO: 204239 - protein, 26 aa, Mycobacterium bovis
PPGGWPEPLRTAALAGRGAARPTAQL

SEQ ID NO: 204240 - protein, 25 aa, Mycobacterium bovis
PPGHVGVAWRGTWHGGLQFTTKCCA

SEQ ID NO: 204241 - protein, 17 aa, Mycobacterium bovis
PPGIPVDIGPGATVAHL

SEQ ID NO: 204242 - protein, 21 aa, Mycobacterium bovis
PPGSWTKYGHWLREPVGPIHW

SEQ ID NO: 204243 - protein, 23 aa, Mycobacterium bovis
PPGTGAPEVHRWWTSLTSEERQR

SEQ ID NO: 204244 - protein, 32 aa, Mycobacterium bovis
PPHAGHVYLCEFARRWVDELTIVVGSTAAEPI

SEQ ID NO: 204245 - protein, 33 aa, Mycobacterium bovis
PPHGYPIVLTHGFVCAIRAWAYQIADLAGDYRV

SEQ ID NO: 204246 - protein, 18 aa, Mycobacterium bovis
PPIAPSLPTPVPHNEKPQ

SEQ ID NO: 204247 - protein, 20 aa, Mycobacterium bovis
PPILLCHGNPTWSFLYRDII

SEQ ID NO: 204248 - protein, 27 aa, Mycobacterium bovis
PPILRLAYRLLSPMLRVLPFVHSTRVS

SEQ ID NO: 204249 - protein, 18 aa, Mycobacterium bovis
PPIYFGFGSMPIGSLADR

SEQ ID NO: 204250 - protein, 19 aa, Mycobacterium bovis
PPKGPNWAAMPTVRTPAGG

SEQ ID NO: 204251 - protein, 20 aa, Mycobacterium bovis
PPKPSMRIISDIFAYTSAKM

SEQ ID NO: 204252 - protein, 25 aa, Mycobacterium bovis
PPLPSTRQRLGWALRDLPSRLGKIA

SEQ ID NO: 204253 - protein, 28 aa, Mycobacterium bovis
PPLTMKPDVCWQLPIRRSQEWVTRPDGT

SEQ ID NO: 204254 - protein, 18 aa, Mycobacterium bovis
PPLYVGGGPANFPRIARL

SEQ ID NO: 204255 - protein, 21 aa, Mycobacterium bovis
PPMIRYPIPPMIHGATQSATW

SEQ ID NO: 204256 - protein, 24 aa, Mycobacterium bovis
PPNPKATIALLRRVEDVLDVEVPL

SEQ ID NO: 204257 - protein, 17 aa, Mycobacterium bovis
PPPADIGRLLLRCHDRP

SEQ ID NO: 204258 - protein, 25 aa, Mycobacterium bovis
PPPGMHHLGCSRGVLLISSQRDAGH

SEQ ID NO: 204259 - protein, 18 aa, Mycobacterium bovis
PPPGYDITALLQAHPHAV

SEQ ID NO: 204260 - protein, 18 aa, Mycobacterium bovis
PPPLRWLERRTRGDQLHP

SEQ ID NO: 204261 - protein, 20 aa, Mycobacterium bovis
PPPNVDIRWSTADLRPRVDL

SEQ ID NO: 204262 - protein, 17 aa, Mycobacterium bovis
PPPQLVAVWAEERGFAG

SEQ ID NO: 204263 - protein, 22 aa, Mycobacterium bovis
PPQLRAVTNWVGPVGTGARLAN

SEQ ID NO: 204264 - protein, 19 aa, Mycobacterium bovis
PPQQETVGFVGFQIPGLER

SEQ ID NO: 204265 - protein, 23 aa, Mycobacterium bovis
PPRARAHAAAMFVSNAREAEPFV

SEQ ID NO: 204266 - protein, 18 aa, Mycobacterium bovis
PPRMLVLLHLDESVQRPS

SEQ ID NO: 204267 - protein, 19 aa, Mycobacterium bovis
PPSIREIGDAVGLTSTSSV

SEQ ID NO: 204268 - protein, 22 aa, Mycobacterium bovis
PPSQANFVWLPLGSRTQDFVEQ

SEQ ID NO: 204269 - protein, 19 aa, Mycobacterium bovis
PPTARGWEVVAGDEIWNWT

SEQ ID NO: 204270 - protein, 19 aa, Mycobacterium bovis
PPTDVPITPCELTAAKNAA

SEQ ID NO: 204271 - protein, 19 aa, Mycobacterium bovis
PPTPSRVGISSVLKIGRDL

SEQ ID NO: 204272 - protein, 17 aa, Mycobacterium bovis
PPTPWHHQRFWVTDRSA

SEQ ID NO: 204273 - protein, 21 aa, Mycobacterium bovis
PPTQWTRWRQPVIGMPSTPRF

SEQ ID NO: 204274 - protein, 28 aa, Mycobacterium bovis
PPVITAPEGWAFEYSRFQEAQKREIVEH

SEQ ID NO: 204275 - protein, 23 aa, Mycobacterium bovis
PQAFDGLRLAGRRVRRPELTLAT

SEQ ID NO: 204276 - protein, 19 aa, Mycobacterium bovis
PQAGRLLSAVWLREPDGPG

SEQ ID NO: 204277 - protein, 22 aa, Mycobacterium bovis
PQAWPRWATVITKVTWTSPEPF

SEQ ID NO: 204278 - protein, 26 aa, Mycobacterium bovis
PQEARPRWRRMANGLLHSKTRDAEAI

SEQ ID NO: 204279 - protein, 20 aa, Mycobacterium bovis
PQGIDYVCGFYAAIKAGTVA

SEQ ID NO: 204280 - protein, 24 aa, Mycobacterium bovis
PQGKRLGKTTGWVHRASLKAKGVH

SEQ ID NO: 204281 - protein, 18 aa, Mycobacterium bovis
PQHRGLREPFGAQVYHVN

SEQ ID NO: 204282 - protein, 17 aa, Mycobacterium bovis
PQIIPFQLVDNASGHVL

SEQ ID NO: 204283 - protein, 17 aa, Mycobacterium bovis
PQLDRIGGDQGKYLAIM

SEQ ID NO: 204284 - protein, 24 aa, Mycobacterium bovis
PQLFKQLLMVAGMERYYQIARCYR

SEQ ID NO: 204285 - protein, 24 aa, Mycobacterium bovis
PQLGKGGGRLPITLWIVDTNASTP

SEQ ID NO: 204286 - protein, 25 aa, Mycobacterium bovis
PQLLSESGWYSALFGMQHETSYPKR

SEQ ID NO: 204287 - protein, 22 aa, Mycobacterium bovis
PQLPSTALMDVLLRRPPRTRSG

SEQ ID NO: 204288 - protein, 19 aa, Mycobacterium bovis
PQLRVRGVDGLRVADASVM

SEQ ID NO: 204289 - protein, 21 aa, Mycobacterium bovis
PQNWWEWRDLIGPLAADGNRV

SEQ ID NO: 204290 - protein, 18 aa, Mycobacterium bovis
PQPGTGFVEARTVAVDVL

SEQ ID NO: 204291 - protein, 17 aa, Mycobacterium bovis
PQPIAWPGSSDRNFYDR

SEQ ID NO: 204292 - protein, 17 aa, Mycobacterium bovis
PQQRVGLRVAWRTLENS

SEQ ID NO: 204293 - protein, 24 aa, Mycobacterium bovis
PQSSDFLHGRWLVLRRGKRSIAGV

SEQ ID NO: 204294 - protein, 19 aa, Mycobacterium bovis
PQTQIAVRNEWGWAEAHLD

SEQ ID NO: 204295 - protein, 21 aa, Mycobacterium bovis
PQVHTLLDFHFRPHLTAASGK

SEQ ID NO: 204296 - protein, 18 aa, Mycobacterium bovis
PQVSVWDLAALDIVVREA

SEQ ID NO: 204297 - protein, 18 aa, Mycobacterium bovis
PQVVKEVAPVPVLAAGGI

SEQ ID NO: 204298 - protein, 19 aa, Mycobacterium bovis
PQVWDVLEEVIAEHPVLLN

SEQ ID NO: 204299 - protein, 18 aa, Mycobacterium bovis
PQYDIVRLLRLYDAGQLM

SEQ ID NO: 204300 - protein, 24 aa, Mycobacterium bovis
PQYGEPLSRHWDFTDNPADRSRIN

SEQ ID NO: 204301 - protein, 19 aa, Mycobacterium bovis
PQYKHSVVMGVNKAKVPGK

SEQ ID NO: 204302 - protein, 18 aa, Mycobacterium bovis
PRADRSARENLLAVFTAN

SEQ ID NO: 204303 - protein, 18 aa, Mycobacterium bovis
PRALPAIAGLSVELGIAT

SEQ ID NO: 204304 - protein, 23 aa, Mycobacterium bovis
PRAPENATAWGLLLTALTGPDVT

SEQ ID NO: 204305 - protein, 33 aa, Mycobacterium bovis
PRATADWCRQRYGWCPRPDWVRVVPDVLKGMEV

SEQ ID NO: 204306 - protein, 25 aa, Mycobacterium bovis
PRCGQCAACATDGRTPCEPGSAANK

SEQ ID NO: 204307 - protein, 20 aa, Mycobacterium bovis
PRDGRFGSGPSKVRLEQLQT

SEQ ID NO: 204308 - protein, 22 aa, Mycobacterium bovis
PRDKRMEVALTYIFGIGRTRSN

SEQ ID NO: 204309 - protein, 18 aa, Mycobacterium bovis
PRDPAGRRQAIVEAAERV

SEQ ID NO: 204310 - protein, 22 aa, Mycobacterium bovis
PREAGDALAPVLDETWRGETGE

SEQ ID NO: 204311 - protein, 19 aa, Mycobacterium bovis
PREAPACDARYWADNLRHT

SEQ ID NO: 204312 - protein, 21 aa, Mycobacterium bovis
PREEPYCDAYYWVDNLRHTVR

SEQ ID NO: 204313 - protein, 18 aa, Mycobacterium bovis
PREPRYLGRWRVDQWFST

SEQ ID NO: 204314 - protein, 19 aa, Mycobacterium bovis
PREQPVCDGAYWVDNLRNT

SEQ ID NO: 204315 - protein, 19 aa, Mycobacterium bovis
PRERSRWRFTFKRLAAEAQ

SEQ ID NO: 204316 - protein, 19 aa, Mycobacterium bovis
PREWSDWVTRTAMPPLRIP

SEQ ID NO: 204317 - protein, 18 aa, Mycobacterium bovis
PRFDSLRTLVPVSTRSNS

SEQ ID NO: 204318 - protein, 19 aa, Mycobacterium bovis
PRFLPTTGPITMRSTALMN

SEQ ID NO: 204319 - protein, 19 aa, Mycobacterium bovis
PRFNHPNVHAIHRDIRTVI

SEQ ID NO: 204320 - protein, 25 aa, Mycobacterium bovis
PRFYPEIPSRFAVVARRGNDIRWFE

SEQ ID NO: 204321 - protein, 19 aa, Mycobacterium bovis
PRGASFSWYSYSPTRVRYP

SEQ ID NO: 204322 - protein, 18 aa, Mycobacterium bovis
PRGLSAVPLEPGQQTVGF

SEQ ID NO: 204323 - protein, 23 aa, Mycobacterium bovis
PRGRRKTRIGYVVSDKMQKTIVV

SEQ ID NO: 204324 - protein, 20 aa, Mycobacterium bovis
PRGTPWADLYALRAARGQPG

SEQ ID NO: 204325 - protein, 20 aa, Mycobacterium bovis
PRHPGYRLHPVVLDAALQSV

SEQ ID NO: 204326 - protein, 22 aa, Mycobacterium bovis
PRHPHLVKLVARRANVEGIGEV

SEQ ID NO: 204327 - protein, 19 aa, Mycobacterium bovis
PRIDCRGGVQARRTAPDTV

SEQ ID NO: 204328 - protein, 19 aa, Mycobacterium bovis
PRIDVTVRISGFFRDAFPH

SEQ ID NO: 204329 - protein, 26 aa, Mycobacterium bovis
PRIFKRIRPAFTYRRSLGVLTAARDA

SEQ ID NO: 204330 - protein, 24 aa, Mycobacterium bovis
PRIGAPRWDTVIVGLDCQTTILDE

SEQ ID NO: 204331 - protein, 21 aa, Mycobacterium bovis
PRIGRRAANAVTVFFDGATLH

SEQ ID NO: 204332 - protein, 20 aa, Mycobacterium bovis
PRIPDVCDALGVPWLTLMGY

SEQ ID NO: 204333 - protein, 28 aa, Mycobacterium bovis
PRIPEDLAFAESRIRPSTIAAEDVLHDM

SEQ ID NO: 204334 - protein, 21 aa, Mycobacterium bovis
PRKVSPLAVQMIMPNGAAAVI

SEQ ID NO: 204335 - protein, 21 aa, Mycobacterium bovis
PRKWARNLIREMSADRLYERL

SEQ ID NO: 204336 - protein, 19 aa, Mycobacterium bovis
PRLDYAHAHLKGRRGRSPA

SEQ ID NO: 204337 - protein, 20 aa, Mycobacterium bovis
PRLGLPLAQELSAYLRSLDP

SEQ ID NO: 204338 - protein, 27 aa, Mycobacterium bovis
PRLLMVGDAFSPRYGDRVVRLLESKIF

SEQ ID NO: 204339 - protein, 20 aa, Mycobacterium bovis
PRLRAVLVPHALRLREAALL

SEQ ID NO: 204340 - protein, 26 aa, Mycobacterium bovis
PRLRDHCQRVQMAVNQFIAPLSTVLG

SEQ ID NO: 204341 - protein, 26 aa, Mycobacterium bovis
PRLTALMCTADILALSAMDYLRAHGI

SEQ ID NO: 204342 - protein, 19 aa, Mycobacterium bovis
PRLVAGCRAAWLTLRDRRT

SEQ ID NO: 204343 - protein, 23 aa, Mycobacterium bovis
PRMKANVGIRRRLAPLLDNDRNQ

SEQ ID NO: 204344 - protein, 19 aa, Mycobacterium bovis
PRNEWLFNDAWGVDVAVST

SEQ ID NO: 204345 - protein, 17 aa, Mycobacterium bovis
PRPAPTVATEHLHELMV

SEQ ID NO: 204346 - protein, 26 aa, Mycobacterium bovis
PRPAWLDRCAAMNRHAIAAVREQLAA

SEQ ID NO: 204347 - protein, 29 aa, Mycobacterium bovis
PRPFVRLEGPAVFRWAAFKMGDVGRRAMD

SEQ ID NO: 204348 - protein, 22 aa, Mycobacterium bovis
PRPGAFAYRPDPRLGSANAALS

SEQ ID NO: 204349 - protein, 23 aa, Mycobacterium bovis
PRPPMVTSGLRIGTPALATRGFG

SEQ ID NO: 204350 - protein, 18 aa, Mycobacterium bovis
PRPWQLGTEMLRVTKPGG

SEQ ID NO: 204351 - protein, 20 aa, Mycobacterium bovis
PRQGKTVLFLGRYDEPRKGM

SEQ ID NO: 204352 - protein, 18 aa, Mycobacterium bovis
PRQKVVVEIDGRRVEVSL

SEQ ID NO: 204353 - protein, 19 aa, Mycobacterium bovis
PRRARWVVRMLTSLLMFPG

SEQ ID NO: 204354 - protein, 18 aa, Mycobacterium bovis
PRRAVLVRPPRGLTATGL

SEQ ID NO: 204355 - protein, 22 aa, Mycobacterium bovis
PRRHPGRRSPLWQQRQRAARLL

SEQ ID NO: 204356 - protein, 19 aa, Mycobacterium bovis
PRRIFAHGFLHNRGEKMSK

SEQ ID NO: 204357 - protein, 19 aa, Mycobacterium bovis
PRRPLQIMGRRVLDLYPVS

SEQ ID NO: 204358 - protein, 17 aa, Mycobacterium bovis
PRRRCARVRQHWATPTQ

SEQ ID NO: 204359 - protein, 22 aa, Mycobacterium bovis
PRRRRCRAKRWGGAAPVTRAGD

SEQ ID NO: 204360 - protein, 20 aa, Mycobacterium bovis
PRSALAAPVLPVFARMWRGY

SEQ ID NO: 204361 - protein, 19 aa, Mycobacterium bovis
PRSALKKATAITPGLESPT

SEQ ID NO: 204362 - protein, 22 aa, Mycobacterium bovis
PRSGLPVIEVLDTELVRGRTAG

SEQ ID NO: 204363 - protein, 27 aa, Mycobacterium bovis
PRSLEIVSCPSCGRAQVDVYTLANEVT

SEQ ID NO: 204364 - protein, 29 aa, Mycobacterium bovis
PRSLFPEFSELFAAFPSFAGLRPTFDTRL

SEQ ID NO: 204365 - protein, 21 aa, Mycobacterium bovis
PRSLHWLRPITPTFRPSWPDH

SEQ ID NO: 204366 - protein, 20 aa, Mycobacterium bovis
PRTALWLLLAKGGGDTEVSA

SEQ ID NO: 204367 - protein, 18 aa, Mycobacterium bovis
PRTMLRFAGGREITLGDL

SEQ ID NO: 204368 - protein, 19 aa, Mycobacterium bovis
PRTVALTVYGDLETSTLRE

SEQ ID NO: 204369 - protein, 19 aa, Mycobacterium bovis
PRVASPRYRCTTPQCGRAV

SEQ ID NO: 204370 - protein, 20 aa, Mycobacterium bovis
PRVAWWALCTDFDVPRSMGR

SEQ ID NO: 204371 - protein, 18 aa, Mycobacterium bovis
PRVHLFFGARYACELYDL

SEQ ID NO: 204372 - protein, 27 aa, Mycobacterium bovis
PRVLQIRALVLGGALDWLKDNKASTNH

SEQ ID NO: 204373 - protein, 18 aa, Mycobacterium bovis
PRVTLPYTDESWKTICEV

SEQ ID NO: 204374 - protein, 21 aa, Mycobacterium bovis
PRVTRKLGDLITFVIHIPLSI

SEQ ID NO: 204375 - protein, 23 aa, Mycobacterium bovis
PRVWEKLKAGIEFTVARETDEMK

SEQ ID NO: 204376 - protein, 17 aa, Mycobacterium bovis
PRYGEGVYALRNMDEGF

SEQ ID NO: 204377 - protein, 17 aa, Mycobacterium bovis
PRYGFRPTVMARPPFAG

SEQ ID NO: 204378 - protein, 17 aa, Mycobacterium bovis
PRYLIGRKILTPPARPV

SEQ ID NO: 204379 - protein, 25 aa, Mycobacterium bovis
PSAAAIDRACRWGRDSVEPAIAVTS

SEQ ID NO: 204380 - protein, 21 aa, Mycobacterium bovis
PSACFFNLGPVLAQSLYIEGN

SEQ ID NO: 204381 - protein, 25 aa, Mycobacterium bovis
PSAEVWRHIPSWEFHRANVDPGRAR

SEQ ID NO: 204382 - protein, 18 aa, Mycobacterium bovis
PSAGTPVGPWLRTGDSGF

SEQ ID NO: 204383 - protein, 18 aa, Mycobacterium bovis
PSAVWTTWLPVAETPHTR

SEQ ID NO: 204384 - protein, 22 aa, Mycobacterium bovis
PSDAGFHVGERVSAFGVLGGYA

SEQ ID NO: 204385 - protein, 24 aa, Mycobacterium bovis
PSDVLRCYLDLVLDGLLARLASGE

SEQ ID NO: 204386 - protein, 22 aa, Mycobacterium bovis
PSEILPFTVLLSSLGVTHLTPE

SEQ ID NO: 204387 - protein, 33 aa, Mycobacterium bovis
PSFAEFWRTGRLELPTRTGLTWLADFRADPAAH

SEQ ID NO: 204388 - protein, 19 aa, Mycobacterium bovis
PSFDHAASLGFTLTDQTPA

SEQ ID NO: 204389 - protein, 25 aa, Mycobacterium bovis
PSFLPKRPLVEVLRDLASRIYTDFT

SEQ ID NO: 204390 - protein, 23 aa, Mycobacterium bovis
PSGEGLHVGHPLGYIATDVYARY

SEQ ID NO: 204391 - protein, 17 aa, Mycobacterium bovis
PSGFVKLVADAKHGELL

SEQ ID NO: 204392 - protein, 23 aa, Mycobacterium bovis
PSGRLAISYSRKVFIPVTRLCRD

SEQ ID NO: 204393 - protein, 17 aa, Mycobacterium bovis
PSGTSWAQLGLASLAGG

SEQ ID NO: 204394 - protein, 20 aa, Mycobacterium bovis
PSHEGACVRATWLKVVPDQL

SEQ ID NO: 204395 - protein, 17 aa, Mycobacterium bovis
PSHGFRGVLVELSKELR

SEQ ID NO: 204396 - protein, 25 aa, Mycobacterium bovis
PSIAETIDWGRTVLALGLDTIDDAV

SEQ ID NO: 204397 - protein, 17 aa, Mycobacterium bovis
PSILLTGIIVNKLGQRF

SEQ ID NO: 204398 - protein, 20 aa, Mycobacterium bovis
PSINPGLNFYFGQPQVTLLS

SEQ ID NO: 204399 - protein, 17 aa, Mycobacterium bovis
PSIPLGFAAIGHIGPIS

SEQ ID NO: 204400 - protein, 24 aa, Mycobacterium bovis
PSIRTILRALAIHRRPSANSKLGA

SEQ ID NO: 204401 - protein, 18 aa, Mycobacterium bovis
PSKLEVFNAALAAADGGP

SEQ ID NO: 204402 - protein, 17 aa, Mycobacterium bovis
PSLDDVFLAMTTDPTES

SEQ ID NO: 204403 - protein, 23 aa, Mycobacterium bovis
PSLHAGHLVPLLTLRRFQRAGHR

SEQ ID NO: 204404 - protein, 19 aa, Mycobacterium bovis
PSLHPTVLVGMRNRLRASD

SEQ ID NO: 204405 - protein, 24 aa, Mycobacterium bovis
PSLQPETRLAAPLLAKGLPACPGV

SEQ ID NO: 204406 - protein, 25 aa, Mycobacterium bovis
PSLRQRVIAAWLWSGRKGVIAGASA

SEQ ID NO: 204407 - protein, 21 aa, Mycobacterium bovis
PSLTEFSVWVVFMMESGSRRA

SEQ ID NO: 204408 - protein, 31 aa, Mycobacterium bovis
PSLVARLAALASRVAVRPVLAVGSYLPHAPW

SEQ ID NO: 204409 - protein, 21 aa, Mycobacterium bovis
PSLVIRIAPPVGRQLDWMVCR

SEQ ID NO: 204410 - protein, 25 aa, Mycobacterium bovis
PSLWMPDLFMLRQIHFAPRLTVNAA

SEQ ID NO: 204411 - protein, 18 aa, Mycobacterium bovis
PSMADAWLGRIACGDRDL

SEQ ID NO: 204412 - protein, 18 aa, Mycobacterium bovis
PSNLRKQLKGAPMPAPRA

SEQ ID NO: 204413 - protein, 19 aa, Mycobacterium bovis
PSPFHVCATVAGRLLGAGY

SEQ ID NO: 204414 - protein, 18 aa, Mycobacterium bovis
PSPLRAGDVLPVGEHTDD

SEQ ID NO: 204415 - protein, 19 aa, Mycobacterium bovis
PSPTLPLLLPLKQIGVPDW

SEQ ID NO: 204416 - protein, 17 aa, Mycobacterium bovis
PSQIPVVRKAYRPSHEK

SEQ ID NO: 204417 - protein, 18 aa, Mycobacterium bovis
PSRGLGQRLLYPIHERRW

SEQ ID NO: 204418 - protein, 21 aa, Mycobacterium bovis
PSSAELRAWAKSVGLPVSDRG

SEQ ID NO: 204419 - protein, 19 aa, Mycobacterium bovis
PSSGPNLGRFGSFGRGVTP

SEQ ID NO: 204420 - protein, 17 aa, Mycobacterium bovis
PSSGYVYTTGWRLATTD

SEQ ID NO: 204421 - protein, 20 aa, Mycobacterium bovis
PSSLREAFGHFPTGVVAIAA

SEQ ID NO: 204422 - protein, 19 aa, Mycobacterium bovis
PSSSKGRYLKKITVSTTTG

SEQ ID NO: 204423 - protein, 20 aa, Mycobacterium bovis
PSTDAILTCRLIDRPLRPSF

SEQ ID NO: 204424 - protein, 19 aa, Mycobacterium bovis
PSTGTNLWGAFGLLAEMVK

SEQ ID NO: 204425 - protein, 20 aa, Mycobacterium bovis
PSTQIPLLGVYGHPKYFLDM

SEQ ID NO: 204426 - protein, 25 aa, Mycobacterium bovis
PSTVADMMIYLGWSMAGRGAQEGRT

SEQ ID NO: 204427 - protein, 18 aa, Mycobacterium bovis
PSVPHVLIEPGVRTGIPL

SEQ ID NO: 204428 - protein, 26 aa, Mycobacterium bovis
PSVRELAVFWTARSIGCSWCVDFGAM

SEQ ID NO: 204429 - protein, 21 aa, Mycobacterium bovis
PSVRLAALARLFAVASNPTHR

SEQ ID NO: 204430 - protein, 24 aa, Mycobacterium bovis
PSYPQDRLDFILADCDAKLVLRTP

SEQ ID NO: 204431 - protein, 20 aa, Mycobacterium bovis
PTAAPRWVVDPDFNLDFHVR

SEQ ID NO: 204432 - protein, 30 aa, Mycobacterium bovis
PTAATDVRAAWDWLAHVCGLAAEHMVIAAD

SEQ ID NO: 204433 - protein, 19 aa, Mycobacterium bovis
PTACILCECNCGIVVQVDD

SEQ ID NO: 204434 - protein, 27 aa, Mycobacterium bovis
PTANPCGVCESCVSLAPNAPGSIDVVE

SEQ ID NO: 204435 - protein, 20 aa, Mycobacterium bovis
PTAPFWFVGSLGELQAVAVH

SEQ ID NO: 204436 - protein, 18 aa, Mycobacterium bovis
PTAQDWADLVGTIHYEVV

SEQ ID NO: 204437 - protein, 17 aa, Mycobacterium bovis
PTAQFSVVLPRRDGVEY

SEQ ID NO: 204438 - protein, 24 aa, Mycobacterium bovis
PTARRRFATLCYMTDGLDDYFMPL

SEQ ID NO: 204439 - protein, 27 aa, Mycobacterium bovis
PTAVSRARRAIAEFRIRGVSTNIPFLQ

SEQ ID NO: 204440 - protein, 18 aa, Mycobacterium bovis
PTDICEPVAVVGIGCRFP

SEQ ID NO: 204441 - protein, 18 aa, Mycobacterium bovis
PTDPNALVFPGRKGGFLP

SEQ ID NO: 204442 - protein, 18 aa, Mycobacterium bovis
PTDPRPFRAGPHETSALL

SEQ ID NO: 204443 - protein, 26 aa, Mycobacterium bovis
PTDRPRCAYLPFGGGRRICIGQSFAL

SEQ ID NO: 204444 - protein, 18 aa, Mycobacterium bovis
PTECEFFSLRGLALLTDT

SEQ ID NO: 204445 - protein, 21 aa, Mycobacterium bovis
PTEPNALVFPSYRGGHLPIEE

SEQ ID NO: 204446 - protein, 20 aa, Mycobacterium bovis
PTFAGRAIAASLGLANVGGG

SEQ ID NO: 204447 - protein, 21 aa, Mycobacterium bovis
PTFSARLTAVAGRRVATGRDF

SEQ ID NO: 204448 - protein, 20 aa, Mycobacterium bovis
PTGCGKTYLAQTLAKMLNVP

SEQ ID NO: 204449 - protein, 24 aa, Mycobacterium bovis
PTGDAELLLIGWGSSYGPIGEACR

SEQ ID NO: 204450 - protein, 20 aa, Mycobacterium bovis
PTGLAGLGILISEAVRGEGG

SEQ ID NO: 204451 - protein, 24 aa, Mycobacterium bovis
PTGPLPKVRVAAALPPPADYLTRI

SEQ ID NO: 204452 - protein, 18 aa, Mycobacterium bovis
PTHCGATLIAGLDMDSDI

SEQ ID NO: 204453 - protein, 21 aa, Mycobacterium bovis
PTIRRDGSYDAGERWPDAQIV

SEQ ID NO: 204454 - protein, 17 aa, Mycobacterium bovis
PTLEALRAHVARTLDVT

SEQ ID NO: 204455 - protein, 17 aa, Mycobacterium bovis
PTLILHRVGSTYIPVGH

SEQ ID NO: 204456 - protein, 17 aa, Mycobacterium bovis
PTLKGEFAHTLNLTDVH

SEQ ID NO: 204457 - protein, 25 aa, Mycobacterium bovis
PTMALLGRPLIGHGADGAPGTGQAG

SEQ ID NO: 204458 - protein, 19 aa, Mycobacterium bovis
PTMTTPFIVEMLKRERDIQ

SEQ ID NO: 204459 - protein, 25 aa, Mycobacterium bovis
PTMVRDFQRIIGMEARVQIQGQAGR

SEQ ID NO: 204460 - protein, 24 aa, Mycobacterium bovis
PTPDMRLDMPLVDFFSHGGALKSS

SEQ ID NO: 204461 - protein, 17 aa, Mycobacterium bovis
PTPGHAVGLSFSVAPDV

SEQ ID NO: 204462 - protein, 17 aa, Mycobacterium bovis
PTPGRSRAAHMGRRYGR

SEQ ID NO: 204463 - protein, 20 aa, Mycobacterium bovis
PTPLRPQERRTIVADHQQSG

SEQ ID NO: 204464 - protein, 24 aa, Mycobacterium bovis
PTPQARLALITAIRAAGLDCHVMV

SEQ ID NO: 204465 - protein, 23 aa, Mycobacterium bovis
PTQKEIFIPGGQMFRDLTRLSAA

SEQ ID NO: 204466 - protein, 23 aa, Mycobacterium bovis
PTQKRPSIVNGRRIQSKRQVFEV

SEQ ID NO: 204467 - protein, 29 aa, Mycobacterium bovis
PTQLFRSTGIPVCLWFFAKDKAAGKQGSI

SEQ ID NO: 204468 - protein, 25 aa, Mycobacterium bovis
PTRAEPDCLLDSLLLEDPGLLADDL

SEQ ID NO: 204469 - protein, 17 aa, Mycobacterium bovis
PTRAMIFDSVYDIYRGV

SEQ ID NO: 204470 - protein, 18 aa, Mycobacterium bovis
PTRGCSAPTDRFRAAVRA

SEQ ID NO: 204471 - protein, 18 aa, Mycobacterium bovis
PTSGLLAAAGDEVSAAIA

SEQ ID NO: 204472 - protein, 18 aa, Mycobacterium bovis
PTSVLLINHGLHIEILID

SEQ ID NO: 204473 - protein, 17 aa, Mycobacterium bovis
PTTAFRLGEKVDDPLAM

SEQ ID NO: 204474 - protein, 23 aa, Mycobacterium bovis
PTTGRPRRAGVSSFGVSGTNAHV

SEQ ID NO: 204475 - protein, 22 aa, Mycobacterium bovis
PTTLHFPGFTIPTGPIHIGLPL

SEQ ID NO: 204476 - protein, 30 aa, Mycobacterium bovis
PTTLLVEGRVALTIPADWSTQRVVSGPGSA

SEQ ID NO: 204477 - protein, 17 aa, Mycobacterium bovis
PTVLVGMRNRLRASDPT

SEQ ID NO: 204478 - protein, 18 aa, Mycobacterium bovis
PTVVVSVPRVFEKVYNTA

SEQ ID NO: 204479 - protein, 22 aa, Mycobacterium bovis
PTYAFQHQKFWLAPAPSVSDPT

SEQ ID NO: 204480 - protein, 20 aa, Mycobacterium bovis
PTYRMRAIRMLECAMPNRLV

SEQ ID NO: 204481 - protein, 24 aa, Mycobacterium bovis
PVAELRSGGLGVREFKRLAKATGI

SEQ ID NO: 204482 - protein, 20 aa, Mycobacterium bovis
PVAEYWPAFGANGKATLTVR

SEQ ID NO: 204483 - protein, 24 aa, Mycobacterium bovis
PVAPGLYSWLPLGLRVLRNIERVI

SEQ ID NO: 204484 - protein, 21 aa, Mycobacterium bovis
PVAPRRAGGAVAEVYAEARRE

SEQ ID NO: 204485 - protein, 25 aa, Mycobacterium bovis
PVAVDSLWFDALRSVAVDHRDGPVV

SEQ ID NO: 204486 - protein, 19 aa, Mycobacterium bovis
PVEALIGVFDKIGVKTGID

SEQ ID NO: 204487 - protein, 25 aa, Mycobacterium bovis
PVFPGETLSTVIWRTEPGRAVFRTE

SEQ ID NO: 204488 - protein, 24 aa, Mycobacterium bovis
PVFPTYRLDHQFEVIRLVGELTDV

SEQ ID NO: 204489 - protein, 17 aa, Mycobacterium bovis
PVGEVRSRFYARAPELH

SEQ ID NO: 204490 - protein, 18 aa, Mycobacterium bovis
PVGMFRMVDEHGGDDKVL

SEQ ID NO: 204491 - protein, 24 aa, Mycobacterium bovis
PVGNAGNITAYWKGYTEYHQLGLI

SEQ ID NO: 204492 - protein, 25 aa, Mycobacterium bovis
PVGQPGGDGGILWGNGGNGGDSTSP

SEQ ID NO: 204493 - protein, 18 aa, Mycobacterium bovis
PVGVPAIVVPPVAAPNVL

SEQ ID NO: 204494 - protein, 24 aa, Mycobacterium bovis
PVHAATLLPFIGRLLAARYAELNT

SEQ ID NO: 204495 - protein, 19 aa, Mycobacterium bovis
PVHAVRLAGLVAHQEVLFG

SEQ ID NO: 204496 - protein, 17 aa, Mycobacterium bovis
PVHLITCLAEPDPSWWD

SEQ ID NO: 204497 - protein, 19 aa, Mycobacterium bovis
PVHRERVIPGHEVVGEVIE

SEQ ID NO: 204498 - protein, 17 aa, Mycobacterium bovis
PVIDMWAPFVPSAEVID

SEQ ID NO: 204499 - protein, 26 aa, Mycobacterium bovis
PVIDVKLPALAPMVAAFGKMRAVETA

SEQ ID NO: 204500 - protein, 21 aa, Mycobacterium bovis
PVIGAPWLVAFAERSRFFEVF

SEQ ID NO: 204501 - protein, 29 aa, Mycobacterium bovis
PVIGTVMRQGYQLGEQVLRHALVGVVDTV

SEQ ID NO: 204502 - protein, 22 aa, Mycobacterium bovis
PVKQRLRIAVVTRSVLREASPE

SEQ ID NO: 204503 - protein, 23 aa, Mycobacterium bovis
PVKTRKCVFCAKKDQAIDYKDTA

SEQ ID NO: 204504 - protein, 25 aa, Mycobacterium bovis
PVLAICAAIQVLGHWYETSSGDRVD

SEQ ID NO: 204505 - protein, 20 aa, Mycobacterium bovis
PVLARELLPERALMGDASAI

SEQ ID NO: 204506 - protein, 22 aa, Mycobacterium bovis
PVLEVALRLGVGYVGAMGSRKT

SEQ ID NO: 204507 - protein, 20 aa, Mycobacterium bovis
PVLRACGFDTPYPPARLEKL

SEQ ID NO: 204508 - protein, 22 aa, Mycobacterium bovis
PVLVKASAGGGGRGMRVVHELS

SEQ ID NO: 204509 - protein, 24 aa, Mycobacterium bovis
PVMADAAAALAEFDIPAEVRVVSA

SEQ ID NO: 204510 - protein, 22 aa, Mycobacterium bovis
PVMLDMLRWHGAEEVEHKAVAF

SEQ ID NO: 204511 - protein, 20 aa, Mycobacterium bovis
PVMRAALGGAVRFFAGQLVK

SEQ ID NO: 204512 - protein, 17 aa, Mycobacterium bovis
PVMRALIVVAGLRMSRT

SEQ ID NO: 204513 - protein, 19 aa, Mycobacterium bovis
PVNGTAFAVTPTLRESYAE

SEQ ID NO: 204514 - protein, 23 aa, Mycobacterium bovis
PVNWPRVLTVWRANLIGSSGKGG

SEQ ID NO: 204515 - protein, 20 aa, Mycobacterium bovis
PVPAVVKLHRWLTESLDHLH

SEQ ID NO: 204516 - protein, 17 aa, Mycobacterium bovis
PVPEFPDRPALELDGWA

SEQ ID NO: 204517 - protein, 21 aa, Mycobacterium bovis
PVPERLGGDGVGLFEVGALLT

SEQ ID NO: 204518 - protein, 17 aa, Mycobacterium bovis
PVPREVLVPCLPSNAEE

SEQ ID NO: 204519 - protein, 25 aa, Mycobacterium bovis
PVPVAYHTFGGWKRSGFGDLNQHGP

SEQ ID NO: 204520 - protein, 21 aa, Mycobacterium bovis
PVQAWGWLSLAAGLAVLDSVA

SEQ ID NO: 204521 - protein, 19 aa, Mycobacterium bovis
PVRAHLIDAARPFIFDTGL

SEQ ID NO: 204522 - protein, 17 aa, Mycobacterium bovis
PVRIIGYANAYDFFNMW

SEQ ID NO: 204523 - protein, 25 aa, Mycobacterium bovis
PVRLAELFIEAGLPAGVFQVVHGDK

SEQ ID NO: 204524 - protein, 24 aa, Mycobacterium bovis
PVRNDFRAVISLDMRRFDRLHRID

SEQ ID NO: 204525 - protein, 17 aa, Mycobacterium bovis
PVSAIAPNTRLDFEQLP

SEQ ID NO: 204526 - protein, 19 aa, Mycobacterium bovis
PVSAIAWGAWGEVGRATFL

SEQ ID NO: 204527 - protein, 32 aa, Mycobacterium bovis
PVSALVVFEVMVRPLIRLSLGKRHPMRRIVSA

SEQ ID NO: 204528 - protein, 19 aa, Mycobacterium bovis
PVSARWKFLAENTKGKPAV

SEQ ID NO: 204529 - protein, 19 aa, Mycobacterium bovis
PVSMLIPRVVGFRLTGEIQ

SEQ ID NO: 204530 - protein, 19 aa, Mycobacterium bovis
PVTVHAIGGVGPLHVAPVP

SEQ ID NO: 204531 - protein, 21 aa, Mycobacterium bovis
PVVDPRARIVILVDDGIATGA

SEQ ID NO: 204532 - protein, 27 aa, Mycobacterium bovis
PVVDVWKGWADRAGWVPWSADSAPMVF

SEQ ID NO: 204533 - protein, 24 aa, Mycobacterium bovis
PVVSFRLAGDRGYTEFDVSHELRT

SEQ ID NO: 204534 - protein, 19 aa, Mycobacterium bovis
PVYNPWDQRLCAVPDADMF

SEQ ID NO: 204535 - protein, 18 aa, Mycobacterium bovis
PWAHGAISTAQWCGVRLA

SEQ ID NO: 204536 - protein, 31 aa, Mycobacterium bovis
PWATKDVVGAYRFLQRVWRLVVDEHTGETRV

SEQ ID NO: 204537 - protein, 20 aa, Mycobacterium bovis
PWERDWSYGWSLMRIGALLR

SEQ ID NO: 204538 - protein, 19 aa, Mycobacterium bovis
PWGAFDMSLGKAMYAGFTL

SEQ ID NO: 204539 - protein, 18 aa, Mycobacterium bovis
PWHIGLYGNAGGLGPTQG

SEQ ID NO: 204540 - protein, 18 aa, Mycobacterium bovis
PWLPERSASWVVPLLWRR

SEQ ID NO: 204541 - protein, 17 aa, Mycobacterium bovis
PWPEDYELMGVPFAKRG

SEQ ID NO: 204542 - protein, 24 aa, Mycobacterium bovis
PWTMPEPLLPIAIAAHAKTDEDKL

SEQ ID NO: 204543 - protein, 18 aa, Mycobacterium bovis
PYESCNLGSINLARMLAD

SEQ ID NO: 204544 - protein, 18 aa, Mycobacterium bovis
PYEVELCVAEVAHYGETK

SEQ ID NO: 204545 - protein, 21 aa, Mycobacterium bovis
PYFDDLFLMAAERRFLSVERI

SEQ ID NO: 204546 - protein, 17 aa, Mycobacterium bovis
PYFSLAMLPGGRRRALL

SEQ ID NO: 204547 - protein, 19 aa, Mycobacterium bovis
PYGDVFLIIDGWPGFVGEF

SEQ ID NO: 204548 - protein, 26 aa, Mycobacterium bovis
PYGRRFPFSLVFARIYAARGYHVVLQ

SEQ ID NO: 204549 - protein, 18 aa, Mycobacterium bovis
PYGTVLIIGAWNYPFYLT

SEQ ID NO: 204550 - protein, 29 aa, Mycobacterium bovis
PYHAYTIDWLPEGWFIEVSEVAPGCGQPG

SEQ ID NO: 204551 - protein, 17 aa, Mycobacterium bovis
PYHGGTHLPDITVITPV

SEQ ID NO: 204552 - protein, 19 aa, Mycobacterium bovis
PYLDTVLFLLGVTRGEIEA

SEQ ID NO: 204553 - protein, 17 aa, Mycobacterium bovis
PYLGWLSAAAAQAQQAA

SEQ ID NO: 204554 - protein, 21 aa, Mycobacterium bovis
PYLIRLPVGAGLVFATSDVWP

SEQ ID NO: 204555 - protein, 17 aa, Mycobacterium bovis
PYMPTDLPAWYDVAMTH

SEQ ID NO: 204556 - protein, 19 aa, Mycobacterium bovis
PYSLLMGSIRVADEVSVAF

SEQ ID NO: 204557 - protein, 18 aa, Mycobacterium bovis
PYTGAPMKQVHQGRGITM

SEQ ID NO: 204558 - protein, 20 aa, Mycobacterium bovis
QAAAIHEMFVNTLQMSSGSY

SEQ ID NO: 204559 - protein, 21 aa, Mycobacterium bovis
QAAAIHEMFVNTLVASSGSYA

SEQ ID NO: 204560 - protein, 22 aa, Mycobacterium bovis
QAAETFAILNLAGAGDHIVSSP

SEQ ID NO: 204561 - protein, 17 aa, Mycobacterium bovis
QAALAWQLATSQRRMRE

SEQ ID NO: 204562 - protein, 17 aa, Mycobacterium bovis
QAALRIEQLEQMVLEQF

SEQ ID NO: 204563 - protein, 20 aa, Mycobacterium bovis
QAAQFGWQGASAMALNAKMD

SEQ ID NO: 204564 - protein, 18 aa, Mycobacterium bovis
QAAREGRDMLALTSSQWD

SEQ ID NO: 204565 - protein, 21 aa, Mycobacterium bovis
QAATFHIQFVQALTAGAGSYA

SEQ ID NO: 204566 - protein, 23 aa, Mycobacterium bovis
QAAWPERMFSLLAGFVEAGESFE

SEQ ID NO: 204567 - protein, 27 aa, Mycobacterium bovis
QACFRCPQCTERLRASDDLLLVGGMRV

SEQ ID NO: 204568 - protein, 18 aa, Mycobacterium bovis
QADALMLLYLLSSDELIG

SEQ ID NO: 204569 - protein, 28 aa, Mycobacterium bovis
QADEFTCSSCFLVQHRSRLASEKNGVMI

SEQ ID NO: 204570 - protein, 24 aa, Mycobacterium bovis
QADPRPGVWHSSGMNRIRLSTTVD

SEQ ID NO: 204571 - protein, 21 aa, Mycobacterium bovis
QAEGLGQLFVRLLTANFEEAV

SEQ ID NO: 204572 - protein, 19 aa, Mycobacterium bovis
QAEPWRPQAVLNHAGELAR

SEQ ID NO: 204573 - protein, 24 aa, Mycobacterium bovis
QAEYLRWAVGAFRLATSGVSDATQ

SEQ ID NO: 204574 - protein, 19 aa, Mycobacterium bovis
QAFHAQFVQALTSGGGAYA

SEQ ID NO: 204575 - protein, 17 aa, Mycobacterium bovis
QAGAVGLVVTTDWTFSH

SEQ ID NO: 204576 - protein, 23 aa, Mycobacterium bovis
QAGIDVAVCKPVQTGTARGDDDL

SEQ ID NO: 204577 - protein, 24 aa, Mycobacterium bovis
QAGMGFGGGVGLGLGGQAGGVIGG

SEQ ID NO: 204578 - protein, 31 aa, Mycobacterium bovis
QAIGFKIARMEARAHVARTAYYDAAAKMLAG

SEQ ID NO: 204579 - protein, 17 aa, Mycobacterium bovis
QAILRSARRHEAADQRR

SEQ ID NO: 204580 - protein, 17 aa, Mycobacterium bovis
QAKLANLLFTYELQRRL

SEQ ID NO: 204581 - protein, 28 aa, Mycobacterium bovis
QALDFFFRKIVRDHGKALQFVLAQVTHT

SEQ ID NO: 204582 - protein, 21 aa, Mycobacterium bovis
QALDRWISWAQRCRIPVFVEL

SEQ ID NO: 204583 - protein, 21 aa, Mycobacterium bovis
QALDRWISWARRCRIPVFVEL

SEQ ID NO: 204584 - protein, 18 aa, Mycobacterium bovis
QALGAPPQRRQWWIDRVK

SEQ ID NO: 204585 - protein, 17 aa, Mycobacterium bovis
QALGPGVITEHRVTHPE

SEQ ID NO: 204586 - protein, 17 aa, Mycobacterium bovis
QALLAKRHTEVMPVTRF

SEQ ID NO: 204587 - protein, 22 aa, Mycobacterium bovis
QALLGRPLIGNGADGAPGTGQA

SEQ ID NO: 204588 - protein, 21 aa, Mycobacterium bovis
QALLGRPLVGNGANGAPGTGA

SEQ ID NO: 204589 - protein, 27 aa, Mycobacterium bovis
QALLSGLPVRRLWGIGPVAEEKLHRLG

SEQ ID NO: 204590 - protein, 27 aa, Mycobacterium bovis
QALNARAATFHAEFVSLLNGGAAAYTG

SEQ ID NO: 204591 - protein, 24 aa, Mycobacterium bovis
QALNDCPLRWLAERHGGTNTRELP

SEQ ID NO: 204592 - protein, 18 aa, Mycobacterium bovis
QALPPGSGGPVFGALDGG

SEQ ID NO: 204593 - protein, 23 aa, Mycobacterium bovis
QALSELRLAGVDGPYSVLLSADV

SEQ ID NO: 204594 - protein, 21 aa, Mycobacterium bovis
QALTGRPLIGNGANGTPGTGA

SEQ ID NO: 204595 - protein, 27 aa, Mycobacterium bovis
QALTIPSFIPEDFTFLDAIFAGYATVG

SEQ ID NO: 204596 - protein, 19 aa, Mycobacterium bovis
QALVREGLRNVAAGANPLG

SEQ ID NO: 204597 - protein, 19 aa, Mycobacterium bovis
QALYPKLLPIARNWWAKLG

SEQ ID NO: 204598 - protein, 18 aa, Mycobacterium bovis
QAMRELPKALASTPKIIS

SEQ ID NO: 204599 - protein, 25 aa, Mycobacterium bovis
QAMRLRDLLKFDFYFADSTAFRANI

SEQ ID NO: 204600 - protein, 34 aa, Mycobacterium bovis
QAMSAQAAAFHARFVQALAGAMGAYAAAEAANAS

SEQ ID NO: 204601 - protein, 21 aa, Mycobacterium bovis
QAQAFHAQFTQALTSGGGAYA

SEQ ID NO: 204602 - protein, 19 aa, Mycobacterium bovis
QARGKGGLVRVSWAEASEM

SEQ ID NO: 204603 - protein, 27 aa, Mycobacterium bovis
QARPPARLVGWTARFLGMVRPGDEVDF

SEQ ID NO: 204604 - protein, 21 aa, Mycobacterium bovis
QARSGEFSWRQSAEALRSVLE

SEQ ID NO: 204605 - protein, 21 aa, Mycobacterium bovis
QARVGSYLRYGAYPYAIAVRE

SEQ ID NO: 204606 - protein, 23 aa, Mycobacterium bovis
QATAGAPAHDWLTLTGGAIGYGI

SEQ ID NO: 204607 - protein, 33 aa, Mycobacterium bovis
QATGARWLCETFPTCLERGAGIPAVERLAYFAE

SEQ ID NO: 204608 - protein, 25 aa, Mycobacterium bovis
QATRCMDCGIPFCHNGCPLGNLIPE

SEQ ID NO: 204609 - protein, 23 aa, Mycobacterium bovis
QAVAARHGFAQDVANVGFAGDAG

SEQ ID NO: 204610 - protein, 20 aa, Mycobacterium bovis
QAWRAPKDVVARAYEFGALA

SEQ ID NO: 204611 - protein, 24 aa, Mycobacterium bovis
QAWTNRSGTEYVWFNNVETRPGVG

SEQ ID NO: 204612 - protein, 24 aa, Mycobacterium bovis
QCDLRVVAPDAFFQFPTSKYGLAL

SEQ ID NO: 204613 - protein, 17 aa, Mycobacterium bovis
QCLFGPVLVDPPAGPAA

SEQ ID NO: 204614 - protein, 17 aa, Mycobacterium bovis
QCLNAGLGFGGGCLPKD

SEQ ID NO: 204615 - protein, 20 aa, Mycobacterium bovis
QCPAYSPGDMRLISLIANGQ

SEQ ID NO: 204616 - protein, 30 aa, Mycobacterium bovis
QDAYPIYPCRDGYVRFCVMAPRQWRGLRRW

SEQ ID NO: 204617 - protein, 30 aa, Mycobacterium bovis
QDEVSTAIAALFGSHGQHYQAISAQVAAYQ

SEQ ID NO: 204618 - protein, 38 aa, Mycobacterium bovis
QDFSLFQVLRYGFRPSKIAFLAWHAWNDAERGNWPPGF

SEQ ID NO: 204619 - protein, 18 aa, Mycobacterium bovis
QDFYGTVFGWAFESAGPD

SEQ ID NO: 204620 - protein, 20 aa, Mycobacterium bovis
QDGNALVGMVVSGGTVEYDA

SEQ ID NO: 204621 - protein, 26 aa, Mycobacterium bovis
QDLAAECWMHIGIDLFWFALPPEQLD

SEQ ID NO: 204622 - protein, 17 aa, Mycobacterium bovis
QDLCAKTRVFILAESLG

SEQ ID NO: 204623 - protein, 25 aa, Mycobacterium bovis
QDLRAAEDALWRWMTAAALVRPRGA

SEQ ID NO: 204624 - protein, 33 aa, Mycobacterium bovis
QDQIPVPPGWGGYRIAPEIVEFWQGRENRMHNR

SEQ ID NO: 204625 - protein, 31 aa, Mycobacterium bovis
QDSALSPRGYRAMAGIPRLQFAHADLLVRAF

SEQ ID NO: 204626 - protein, 18 aa, Mycobacterium bovis
QDYGDVAYGWAMEDTSGI

SEQ ID NO: 204627 - protein, 18 aa, Mycobacterium bovis
QDYRRYGGVEFYSAIAAG

SEQ ID NO: 204628 - protein, 18 aa, Mycobacterium bovis
QEASYPAVQYIPLADVVQ

SEQ ID NO: 204629 - protein, 21 aa, Mycobacterium bovis
QEAWLRWDSQDTVIADPRAWL

SEQ ID NO: 204630 - protein, 24 aa, Mycobacterium bovis
QEDSRLLTRELLYTAVARAKRKVR

SEQ ID NO: 204631 - protein, 21 aa, Mycobacterium bovis
QEELWLLRGGDPGQPGLLPPA

SEQ ID NO: 204632 - protein, 17 aa, Mycobacterium bovis
QEGRDDLALRIAVQPGG

SEQ ID NO: 204633 - protein, 24 aa, Mycobacterium bovis
QEIDLRFADALSMADNVMTFRYVI

SEQ ID NO: 204634 - protein, 20 aa, Mycobacterium bovis
QEILFPALLPRAPYETTNRW

SEQ ID NO: 204635 - protein, 20 aa, Mycobacterium bovis
QEIMTELEIAPTRRLRGLGD

SEQ ID NO: 204636 - protein, 23 aa, Mycobacterium bovis
QEITRGRCAAIAVPSNGVEKLVA

SEQ ID NO: 204637 - protein, 24 aa, Mycobacterium bovis
QEITRGRCAAISVPGDRSTEKLVA

SEQ ID NO: 204638 - protein, 24 aa, Mycobacterium bovis
QEKAQELGLTWLAEIGAHGVVAGP

SEQ ID NO: 204639 - protein, 25 aa, Mycobacterium bovis
QEKTGEAWVDFQLYGGHTRGEFENA

SEQ ID NO: 204640 - protein, 27 aa, Mycobacterium bovis
QELADLLPGCAGLRVVESVYGHDGFLV

SEQ ID NO: 204641 - protein, 20 aa, Mycobacterium bovis
QELAEYRWRSGQAREKYEQI

SEQ ID NO: 204642 - protein, 19 aa, Mycobacterium bovis
QELARRCVLAGKDVIVAGH

SEQ ID NO: 204643 - protein, 20 aa, Mycobacterium bovis
QELREAIAAFSAVKPSLAWA

SEQ ID NO: 204644 - protein, 20 aa, Mycobacterium bovis
QELRGSGIAVSVIHPALTQT

SEQ ID NO: 204645 - protein, 17 aa, Mycobacterium bovis
QEPDDVASWGRVDLGAA

SEQ ID NO: 204646 - protein, 25 aa, Mycobacterium bovis
QEPGREWSALCIGRSKTRNHIARRL

SEQ ID NO: 204647 - protein, 24 aa, Mycobacterium bovis
QEQDGIKFLCPVPGYDRHFAITET

SEQ ID NO: 204648 - protein, 24 aa, Mycobacterium bovis
QEVCALLAGGGYAEYVAVPADQVL

SEQ ID NO: 204649 - protein, 17 aa, Mycobacterium bovis
QEWIEGVPMAEIIRHGT

SEQ ID NO: 204650 - protein, 26 aa, Mycobacterium bovis
QFADSGLRTSVQFVGPLSVVDSALAD

SEQ ID NO: 204651 - protein, 17 aa, Mycobacterium bovis
QFAGERVLGQGFDRDVL

SEQ ID NO: 204652 - protein, 23 aa, Mycobacterium bovis
QFARFAEGLGFAGVLAGPLVRSS

SEQ ID NO: 204653 - protein, 19 aa, Mycobacterium bovis
QFPAYQLTALIGGDLSKVD

SEQ ID NO: 204654 - protein, 19 aa, Mycobacterium bovis
QFTLPGRSLMFVRNVGHLM

SEQ ID NO: 204655 - protein, 28 aa, Mycobacterium bovis
QFVHAVALAEVWRSCGVLPDLTVGHSLG

SEQ ID NO: 204656 - protein, 21 aa, Mycobacterium bovis
QFVSSPGYEHAWLNPDNTEVS

SEQ ID NO: 204657 - protein, 20 aa, Mycobacterium bovis
QFWRSGGRTRTRFGHVEDIP

SEQ ID NO: 204658 - protein, 21 aa, Mycobacterium bovis
QFWSQIHGFVMLELAGFYGDR

SEQ ID NO: 204659 - protein, 26 aa, Mycobacterium bovis
QFYHPLDMFGEWNRAYGPAGFLQYQF

SEQ ID NO: 204660 - protein, 24 aa, Mycobacterium bovis
QGAWPRFGLELPELLPDKLAGIKR

SEQ ID NO: 204661 - protein, 23 aa, Mycobacterium bovis
QGDGGRCMVVFQPHLYSRTKAFA

SEQ ID NO: 204662 - protein, 19 aa, Mycobacterium bovis
QGDTGITYQAWQAQWNQAM

SEQ ID NO: 204663 - protein, 25 aa, Mycobacterium bovis
QGHASPGIYARAFLEGRLTAEQLDG

SEQ ID NO: 204664 - protein, 27 aa, Mycobacterium bovis
QGHWLLARLGKRVLRPGGVELTRTLLA

SEQ ID NO: 204665 - protein, 18 aa, Mycobacterium bovis
QGLAQGYALRLADRLVDN

SEQ ID NO: 204666 - protein, 31 aa, Mycobacterium bovis
QGLRLADKLTPWRAVDGWRTAAVSAFGMSGT

SEQ ID NO: 204667 - protein, 26 aa, Mycobacterium bovis
QGLRVITTRSRLMARLSGQGAMALLE

SEQ ID NO: 204668 - protein, 17 aa, Mycobacterium bovis
QGLRVTAVRSRLMAPLS

SEQ ID NO: 204669 - protein, 19 aa, Mycobacterium bovis
QGLTAMWRRESELFADVAV

SEQ ID NO: 204670 - protein, 17 aa, Mycobacterium bovis
QGPFPMETVYLWEDGPN

SEQ ID NO: 204671 - protein, 22 aa, Mycobacterium bovis
QGRLDLGLGAGWFRRESQAYGI

SEQ ID NO: 204672 - protein, 24 aa, Mycobacterium bovis
QGSARCRDVLALKLNAQLIDELPL

SEQ ID NO: 204673 - protein, 24 aa, Mycobacterium bovis
QGTWRLWLPGCSWPPNVPQRRGQR

SEQ ID NO: 204674 - protein, 17 aa, Mycobacterium bovis
QGTYLAWLDCRELGFDD

SEQ ID NO: 204675 - protein, 19 aa, Mycobacterium bovis
QGVPFVLPNAWDVPSALAY

SEQ ID NO: 204676 - protein, 22 aa, Mycobacterium bovis
QGVPISGILFGGRRKTTVPLVT

SEQ ID NO: 204677 - protein, 23 aa, Mycobacterium bovis
QGVPKTGAFWHIDYMFMPEPFAF

SEQ ID NO: 204678 - protein, 23 aa, Mycobacterium bovis
QGVWVHPEWRGIGLGTAGTATLA

SEQ ID NO: 204679 - protein, 20 aa, Mycobacterium bovis
QHCWRHWKPAHVGRRNMDLL

SEQ ID NO: 204680 - protein, 17 aa, Mycobacterium bovis
QHGGRLLVRLAGVADRD

SEQ ID NO: 204681 - protein, 21 aa, Mycobacterium bovis
QHGVPAKGWLVGEVHNGIAQM

SEQ ID NO: 204682 - protein, 23 aa, Mycobacterium bovis
QHLAKLRMARLVRTRRDGTTIFY

SEQ ID NO: 204683 - protein, 22 aa, Mycobacterium bovis
QHLARACARVGARLIHVSTDYV

SEQ ID NO: 204684 - protein, 21 aa, Mycobacterium bovis
QHLRMLLKQQRAVSVPERNQP

SEQ ID NO: 204685 - protein, 19 aa, Mycobacterium bovis
QHPELWPNTVEEILRLDSP

SEQ ID NO: 204686 - protein, 21 aa, Mycobacterium bovis
QHPIEGVSMAYSFDDAQAPDR

SEQ ID NO: 204687 - protein, 29 aa, Mycobacterium bovis
QHVKPGKGPAFVRTKLKNVLSGKVVDKTF

SEQ ID NO: 204688 - protein, 18 aa, Mycobacterium bovis
QIADLAVRATFLAGRQVY

SEQ ID NO: 204689 - protein, 36 aa, Mycobacterium bovis
QIATTRFLLDVNISGGLPAFTLFAGGLTIPTNAIPL

SEQ ID NO: 204690 - protein, 18 aa, Mycobacterium bovis
QIDLKVASWYASTHPASK

SEQ ID NO: 204691 - protein, 17 aa, Mycobacterium bovis
QIFEGDILFLEWTANSA

SEQ ID NO: 204692 - protein, 21 aa, Mycobacterium bovis
QIMTVFVAKGLQFPIVYLPFA

SEQ ID NO: 204693 - protein, 26 aa, Mycobacterium bovis
QINYLRCIGCGLCIEACPTRALTMTY

SEQ ID NO: 204694 - protein, 19 aa, Mycobacterium bovis
QKAAEAWSGGYFAKSVVPV

SEQ ID NO: 204695 - protein, 24 aa, Mycobacterium bovis
QKAGRFGALIPRLVRQGINGEGLT

SEQ ID NO: 204696 - protein, 18 aa, Mycobacterium bovis
QKAKVLAICNTNGSQIPR

SEQ ID NO: 204697 - protein, 25 aa, Mycobacterium bovis
QKDIDFAFGVGQLFANVPYAQLILE

SEQ ID NO: 204698 - protein, 23 aa, Mycobacterium bovis
QKEKLAELTTRWQNEKNAIEIVR

SEQ ID NO: 204699 - protein, 21 aa, Mycobacterium bovis
QKLKVLVSIFGRETPVELTFG

SEQ ID NO: 204700 - protein, 18 aa, Mycobacterium bovis
QKLPDGWDADLPHWEPGS

SEQ ID NO: 204701 - protein, 21 aa, Mycobacterium bovis
QKPPVGAALWKLMERARQVGL

SEQ ID NO: 204702 - protein, 17 aa, Mycobacterium bovis
QKRLMTLIHLWLVHRFK

SEQ ID NO: 204703 - protein, 24 aa, Mycobacterium bovis
QKVIRCFREGGGVPYSEYPRFHKL

SEQ ID NO: 204704 - protein, 25 aa, Mycobacterium bovis
QKVQEVKLGLARPVWIDDRDFDITY

SEQ ID NO: 204705 - protein, 17 aa, Mycobacterium bovis
QLAARAYTASGLSHNLA

SEQ ID NO: 204706 - protein, 27 aa, Mycobacterium bovis
QLADYGFAWRDIARVVGVSVPAITKWR

SEQ ID NO: 204707 - protein, 28 aa, Mycobacterium bovis
QLAEIVGAYFPRGWQIACHVHGDGGVDT

SEQ ID NO: 204708 - protein, 23 aa, Mycobacterium bovis
QLAEVHPHWIVLRTVIDVINPIE

SEQ ID NO: 204709 - protein, 26 aa, Mycobacterium bovis
QLAGLKLLAFRGRFVEIGKRDIYGDT

SEQ ID NO: 204710 - protein, 25 aa, Mycobacterium bovis
QLALTELWRSYGVIPDAVIGHSMGE

SEQ ID NO: 204711 - protein, 24 aa, Mycobacterium bovis
QLAPLPRRRLRETLDRYENVKEFF

SEQ ID NO: 204712 - protein, 22 aa, Mycobacterium bovis
QLASSLQPIWFGRAHLREGLSW

SEQ ID NO: 204713 - protein, 18 aa, Mycobacterium bovis
QLEARIDSLAARNSKLME

SEQ ID NO: 204714 - protein, 24 aa, Mycobacterium bovis
QLEELYRRMWVLRLLDMALEQLRI

SEQ ID NO: 204715 - protein, 25 aa, Mycobacterium bovis
QLFSMPIHQVMVMPGSVMTIPGMRL

SEQ ID NO: 204716 - protein, 19 aa, Mycobacterium bovis
QLGGLPFSGPIGGVRVALI

SEQ ID NO: 204717 - protein, 27 aa, Mycobacterium bovis
QLGPHMAGGGWAWADFVAEADPSNPDM

SEQ ID NO: 204718 - protein, 17 aa, Mycobacterium bovis
QLGRGYEYLDLDPETGH

SEQ ID NO: 204719 - protein, 19 aa, Mycobacterium bovis
QLGSMWYISLDYINHQTSL

SEQ ID NO: 204720 - protein, 24 aa, Mycobacterium bovis
QLIRARRGVILACGGFEHNEQMRI

SEQ ID NO: 204721 - protein, 23 aa, Mycobacterium bovis
QLIWREYRPGWTRYGDGSVAQVK

SEQ ID NO: 204722 - protein, 19 aa, Mycobacterium bovis
QLLERCWDAAYEARSNIVD

SEQ ID NO: 204723 - protein, 19 aa, Mycobacterium bovis
QLLYWTQVLMISRGLSLDD

SEQ ID NO: 204724 - protein, 25 aa, Mycobacterium bovis
QLMKAALPFGLWVPVLPGTRQVTVG

SEQ ID NO: 204725 - protein, 22 aa, Mycobacterium bovis
QLPDDRLEELLALAHEVRMRWC

SEQ ID NO: 204726 - protein, 21 aa, Mycobacterium bovis
QLPGHKVYPWVAEVRHSTPGV

SEQ ID NO: 204727 - protein, 18 aa, Mycobacterium bovis
QLPLPAGLQQFLNTLPNL

SEQ ID NO: 204728 - protein, 17 aa, Mycobacterium bovis
QLPVGMLDGLVAADWPP

SEQ ID NO: 204729 - protein, 24 aa, Mycobacterium bovis
QLRHEFGDAVAIIGRPAYTPAGLA

SEQ ID NO: 204730 - protein, 19 aa, Mycobacterium bovis
QLRLERVVLVGVWTEGSAA

SEQ ID NO: 204731 - protein, 21 aa, Mycobacterium bovis
QLRLQHALVLLAERHDVTSVA

SEQ ID NO: 204732 - protein, 18 aa, Mycobacterium bovis
QLSEFGFSAVAEHPRLGP

SEQ ID NO: 204733 - protein, 27 aa, Mycobacterium bovis
QLSGGMCQRALIAIGLAGRPRLLIADE

SEQ ID NO: 204734 - protein, 23 aa, Mycobacterium bovis
QLSRARALLLGRDYVIPEDVKEL

SEQ ID NO: 204735 - protein, 18 aa, Mycobacterium bovis
QLTLPFGAPHTMLNVAVG

SEQ ID NO: 204736 - protein, 18 aa, Mycobacterium bovis
QLTMRVFTGLTMLDTIQG

SEQ ID NO: 204737 - protein, 31 aa, Mycobacterium bovis
QLVREWLTQWSRPGLIPVALVVVNVFVENVL

SEQ ID NO: 204738 - protein, 17 aa, Mycobacterium bovis
QLVSFIGPIVIDTTIPG

SEQ ID NO: 204739 - protein, 17 aa, Mycobacterium bovis
QLVVPVLNARFALNAAN

SEQ ID NO: 204740 - protein, 23 aa, Mycobacterium bovis
QMAEPKWVLAMGVCASSGGMFNN

SEQ ID NO: 204741 - protein, 18 aa, Mycobacterium bovis
QMLVWGFTGQVISAVLDV

SEQ ID NO: 204742 - protein, 24 aa, Mycobacterium bovis
QMRIPKPRFVLMPTPIWDQLFKPL

SEQ ID NO: 204743 - protein, 18 aa, Mycobacterium bovis
QMVIDVHNVMTFGGNMIT

SEQ ID NO: 204744 - protein, 18 aa, Mycobacterium bovis
QNAPAIAAAEAMYEQMWA

SEQ ID NO: 204745 - protein, 17 aa, Mycobacterium bovis
QNARLAARLTGWRIDIR

SEQ ID NO: 204746 - protein, 23 aa, Mycobacterium bovis
QNDPRSTYKFGPEDYGAAMQILE

SEQ ID NO: 204747 - protein, 25 aa, Mycobacterium bovis
QNFGELISGGFNFGNTVSGLVNAST

SEQ ID NO: 204748 - protein, 18 aa, Mycobacterium bovis
QNFGNLLSGWANLGNTVS

SEQ ID NO: 204749 - protein, 17 aa, Mycobacterium bovis
QNGFILPSFPPFSTPDV

SEQ ID NO: 204750 - protein, 23 aa, Mycobacterium bovis
QNLPRLRRALSRVDTIVVHEQYW

SEQ ID NO: 204751 - protein, 24 aa, Mycobacterium bovis
QNLSDAGVSWKVYRNKTLGPISSV

SEQ ID NO: 204752 - protein, 23 aa, Mycobacterium bovis
QNVALRLVALVDRLYDAGIPVVA

SEQ ID NO: 204753 - protein, 19 aa, Mycobacterium bovis
QNVDPALFGRVMSVSQLIG

SEQ ID NO: 204754 - protein, 17 aa, Mycobacterium bovis
QNYYSFRNWNITESWMG

SEQ ID NO: 204755 - protein, 19 aa, Mycobacterium bovis
QPAAVGRVVVLSGPSAVGK

SEQ ID NO: 204756 - protein, 17 aa, Mycobacterium bovis
QPALPNINLGVGNIGNL

SEQ ID NO: 204757 - protein, 22 aa, Mycobacterium bovis
QPDLRVLVELGYDRTAHQDVPS

SEQ ID NO: 204758 - protein, 25 aa, Mycobacterium bovis
QPDRLRRWMAVAARIELRTGGAYRW

SEQ ID NO: 204759 - protein, 26 aa, Mycobacterium bovis
QPESPKPLGMPLQYMVSGMAVKATHK

SEQ ID NO: 204760 - protein, 24 aa, Mycobacterium bovis
QPGEIYFEGGYPFEYLNDPAKTAA

SEQ ID NO: 204761 - protein, 26 aa, Mycobacterium bovis
QPGVPGRTVCKWGGFLDNPADFDCEF

SEQ ID NO: 204762 - protein, 25 aa, Mycobacterium bovis
QPKPLTFSALTGWEAPDPAWWTAQG

SEQ ID NO: 204763 - protein, 22 aa, Mycobacterium bovis
QPLATRLVRSWLGLPSQAAYTL

SEQ ID NO: 204764 - protein, 23 aa, Mycobacterium bovis
QPLDWFCLFSSGAALLGSPGQGA

SEQ ID NO: 204765 - protein, 17 aa, Mycobacterium bovis
QPLGVILAVMPWNFPLW

SEQ ID NO: 204766 - protein, 25 aa, Mycobacterium bovis
QPLLAPRLREFALREGLADAQLRLA

SEQ ID NO: 204767 - protein, 17 aa, Mycobacterium bovis
QPPALRAICPWEGFTDA

SEQ ID NO: 204768 - protein, 19 aa, Mycobacterium bovis
QPQLRMSGYNLAAIAAGLP

SEQ ID NO: 204769 - protein, 17 aa, Mycobacterium bovis
QPRRVLNGLSDVRAFFH

SEQ ID NO: 204770 - protein, 24 aa, Mycobacterium bovis
QPSPGGPFDWRLPDLVGASLDSLL

SEQ ID NO: 204771 - protein, 21 aa, Mycobacterium bovis
QPTHFPSVFGPSGDQPLDAGT

SEQ ID NO: 204772 - protein, 19 aa, Mycobacterium bovis
QPTIPGWRAETLGDDIAWM

SEQ ID NO: 204773 - protein, 22 aa, Mycobacterium bovis
QPWEPVPACARPRPVTAGEVVA

SEQ ID NO: 204774 - protein, 20 aa, Mycobacterium bovis
QPWFTGRFGTIGLPYLGFTQ

SEQ ID NO: 204775 - protein, 22 aa, Mycobacterium bovis
QPYWGRPVPGWGSKRPRLLILG

SEQ ID NO: 204776 - protein, 18 aa, Mycobacterium bovis
QQFSRVRVFAFIDSTDEV

SEQ ID NO: 204777 - protein, 18 aa, Mycobacterium bovis
QQKRIALDTIADVEASGL

SEQ ID NO: 204778 - protein, 20 aa, Mycobacterium bovis
QQLTLPFAAPHSMFNVKVGG

SEQ ID NO: 204779 - protein, 17 aa, Mycobacterium bovis
QQPGFRGERLVNSMFTL

SEQ ID NO: 204780 - protein, 27 aa, Mycobacterium bovis
QQPRPADCLRPLQIHALISEVLKTLPL

SEQ ID NO: 204781 - protein, 26 aa, Mycobacterium bovis
QQRCPPRQFERARVVVFAGDHGVARS

SEQ ID NO: 204782 - protein, 18 aa, Mycobacterium bovis
QQRLRRILDTVARQEPGL

SEQ ID NO: 204783 - protein, 39 aa, Mycobacterium bovis
QQRPNRLAVCLDLDWRPQFRVDLIPSYKAHRVAEPEPNG

SEQ ID NO: 204784 - protein, 22 aa, Mycobacterium bovis
QQRVRLLPCLDAVAVDSAAGNF

SEQ ID NO: 204785 - protein, 24 aa, Mycobacterium bovis
QQSWPTVADWVRWISGDGTKPENI

SEQ ID NO: 204786 - protein, 20 aa, Mycobacterium bovis
QQVAPWWRRRPHRSLTSLGQ

SEQ ID NO: 204787 - protein, 31 aa, Mycobacterium bovis
QQVSCAGLVIGSWPDPPGLVAASNRSALARI

SEQ ID NO: 204788 - protein, 25 aa, Mycobacterium bovis
QRAEGRYALMPGIIGALAASGTPLS

SEQ ID NO: 204789 - protein, 21 aa, Mycobacterium bovis
QRAGLRTACLDAKRYAGGMAS

SEQ ID NO: 204790 - protein, 19 aa, Mycobacterium bovis
QRALVRMLREAGAVELHVR

SEQ ID NO: 204791 - protein, 19 aa, Mycobacterium bovis
QRAPDEMRRVGRWVEGVPM

SEQ ID NO: 204792 - protein, 25 aa, Mycobacterium bovis
QRAQWLRPLLDGKIRSAFSMTEPAV

SEQ ID NO: 204793 - protein, 18 aa, Mycobacterium bovis
QRAVLLLRDVLQWKSAEV

SEQ ID NO: 204794 - protein, 19 aa, Mycobacterium bovis
QRAVRELVDQVALPSSILG

SEQ ID NO: 204795 - protein, 22 aa, Mycobacterium bovis
QRAWLNLVQPLTIVEGFALLSV

SEQ ID NO: 204796 - protein, 20 aa, Mycobacterium bovis
QRDRFLFKINVGYPSPEEER

SEQ ID NO: 204797 - protein, 30 aa, Mycobacterium bovis
QRDWDFARAFGLPIVEVIAGGNISESAYTG

SEQ ID NO: 204798 - protein, 17 aa, Mycobacterium bovis
QREAFAWHIDLAKRTGK

SEQ ID NO: 204799 - protein, 19 aa, Mycobacterium bovis
QREILILRVVVGLSAEETA

SEQ ID NO: 204800 - protein, 25 aa, Mycobacterium bovis
QRFADWLVRVVEAFADRPDQPLREV

SEQ ID NO: 204801 - protein, 21 aa, Mycobacterium bovis
QRFLAEQGYGYIIRDADDLLG

SEQ ID NO: 204802 - protein, 17 aa, Mycobacterium bovis
QRFLRALICRRWAGIAA

SEQ ID NO: 204803 - protein, 24 aa, Mycobacterium bovis
QRGVIPRDHIKAVLDAADVLIWMT

SEQ ID NO: 204804 - protein, 19 aa, Mycobacterium bovis
QRIAAFGAYVVAYDPYVSP

SEQ ID NO: 204805 - protein, 22 aa, Mycobacterium bovis
QRIAQMLAELVELFKTEALHRL

SEQ ID NO: 204806 - protein, 19 aa, Mycobacterium bovis
QRITATMLVPSMLYALLDH

SEQ ID NO: 204807 - protein, 19 aa, Mycobacterium bovis
QRLAAAGLTCLGWPEEHGG

SEQ ID NO: 204808 - protein, 19 aa, Mycobacterium bovis
QRLAAFVVLKPGVSATPET

SEQ ID NO: 204809 - protein, 19 aa, Mycobacterium bovis
QRLLPRPLDHTIIQVAVAI

SEQ ID NO: 204810 - protein, 18 aa, Mycobacterium bovis
QRLLPRPLDHTSVHVAVA

SEQ ID NO: 204811 - protein, 20 aa, Mycobacterium bovis
QRLLTAWLELGMATYDTNQR

SEQ ID NO: 204812 - protein, 17 aa, Mycobacterium bovis
QRLLVKVPAGWSHTAAA

SEQ ID NO: 204813 - protein, 22 aa, Mycobacterium bovis
QRLMLEVSWEALEHAGIDPLSL

SEQ ID NO: 204814 - protein, 21 aa, Mycobacterium bovis
QRLRALAALPELIAAKPDGPR

SEQ ID NO: 204815 - protein, 21 aa, Mycobacterium bovis
QRLRSIAHLGVRTRDYAFIVN

SEQ ID NO: 204816 - protein, 21 aa, Mycobacterium bovis
QRLSGPLQRLRAMAGGDVPVT

SEQ ID NO: 204817 - protein, 18 aa, Mycobacterium bovis
QRNGFDCPGCAWPEEPGG

SEQ ID NO: 204818 - protein, 25 aa, Mycobacterium bovis
QRPAPQFEVMYLLAVCDAAAADQLR

SEQ ID NO: 204819 - protein, 24 aa, Mycobacterium bovis
QRPGDPTLRRLLPDFYRPDDLDDD

SEQ ID NO: 204820 - protein, 20 aa, Mycobacterium bovis
QRPGQRLAYNGRLLELPDIK

SEQ ID NO: 204821 - protein, 19 aa, Mycobacterium bovis
QRPVIMAGTNVWWGHAEAA

SEQ ID NO: 204822 - protein, 19 aa, Mycobacterium bovis
QRQALLFLRADRLQYFVSC

SEQ ID NO: 204823 - protein, 19 aa, Mycobacterium bovis
QRQEFASRIGVTAQDLTAY

SEQ ID NO: 204824 - protein, 19 aa, Mycobacterium bovis
QRQGFRWPSATVKTIMRAN

SEQ ID NO: 204825 - protein, 22 aa, Mycobacterium bovis
QRQLEMRLNRQLADIEKLQVNV

SEQ ID NO: 204826 - protein, 25 aa, Mycobacterium bovis
QRQQRCLDGARILAGRLTQPDVAER

SEQ ID NO: 204827 - protein, 25 aa, Mycobacterium bovis
QRQQTLRASIDWSHALLTETEQILF

SEQ ID NO: 204828 - protein, 25 aa, Mycobacterium bovis
QRQQTLRASMDWSYALLTDTERILF

SEQ ID NO: 204829 - protein, 22 aa, Mycobacterium bovis
QRRAELRTAKALLGVRDELKLS

SEQ ID NO: 204830 - protein, 17 aa, Mycobacterium bovis
QRRELLRNMGIEHVYDS

SEQ ID NO: 204831 - protein, 23 aa, Mycobacterium bovis
QRRFEWLLSVLRLADRLIPHRAW

SEQ ID NO: 204832 - protein, 18 aa, Mycobacterium bovis
QRRQWWIDRVKACYSLLV

SEQ ID NO: 204833 - protein, 17 aa, Mycobacterium bovis
QRSAAVIARNIEALGLS

SEQ ID NO: 204834 - protein, 21 aa, Mycobacterium bovis
QRSREVWLLVSGPGKADAVAA

SEQ ID NO: 204835 - protein, 20 aa, Mycobacterium bovis
QRSSNFMLWQAAYAEYIFQD

SEQ ID NO: 204836 - protein, 28 aa, Mycobacterium bovis
QRSSRYPGGLALRFARVVRYRADKDPAE

SEQ ID NO: 204837 - protein, 18 aa, Mycobacterium bovis
QRTAAGWQPLKTGITTHI

SEQ ID NO: 204838 - protein, 17 aa, Mycobacterium bovis
QRTAPWVESLGLDHVRE

SEQ ID NO: 204839 - protein, 19 aa, Mycobacterium bovis
QRTFGGWLLADLVTVDGSV

SEQ ID NO: 204840 - protein, 23 aa, Mycobacterium bovis
QRTMYDRVHWSLTHMSQAGLLDR

SEQ ID NO: 204841 - protein, 28 aa, Mycobacterium bovis
QRVKANLFYRGLRFHRFPAVGDTLYTRT

SEQ ID NO: 204842 - protein, 17 aa, Mycobacterium bovis
QRVPDNLAELGRLTQLP

SEQ ID NO: 204843 - protein, 24 aa, Mycobacterium bovis
QRVVCGGISIPGRWDTTPEPEITE

SEQ ID NO: 204844 - protein, 20 aa, Mycobacterium bovis
QRWIAAGLFDPAVREKAGMH

SEQ ID NO: 204845 - protein, 23 aa, Mycobacterium bovis
QRWLADHVIAGVVLLAGAAFVEL

SEQ ID NO: 204846 - protein, 32 aa, Mycobacterium bovis
QRYEGGSTLFGRWELCALMQTVAELAEAMRDG

SEQ ID NO: 204847 - protein, 32 aa, Mycobacterium bovis
QRYLDILRPLGFRPALGFSRVDTTISWSSVEE

SEQ ID NO: 204848 - protein, 18 aa, Mycobacterium bovis
QRYPRAARRLIRHLNAKQ

SEQ ID NO: 204849 - protein, 17 aa, Mycobacterium bovis
QRYRDRYIFAGLQPGQR

SEQ ID NO: 204850 - protein, 18 aa, Mycobacterium bovis
QSAFPQLLSAVPRALQGL

SEQ ID NO: 204851 - protein, 32 aa, Mycobacterium bovis
QSAPGRWTLIRWGPAGSLVLRITLCRVSELPA

SEQ ID NO: 204852 - protein, 25 aa, Mycobacterium bovis
QSARAGDPFQHWIGRRFDAVATDKP

SEQ ID NO: 204853 - protein, 26 aa, Mycobacterium bovis
QSAVSEIPWSYDIGSNIEIPIEGDIN

SEQ ID NO: 204854 - protein, 17 aa, Mycobacterium bovis
QSFEFATIGGFAATRSS

SEQ ID NO: 204855 - protein, 21 aa, Mycobacterium bovis
QSGANYHLAWAIAAISTRRSR

SEQ ID NO: 204856 - protein, 23 aa, Mycobacterium bovis
QSGFTFPLLSDFWPHGAVSQAYG

SEQ ID NO: 204857 - protein, 22 aa, Mycobacterium bovis
QSIGVPEPLKLAGTAEQKRRFL

SEQ ID NO: 204858 - protein, 24 aa, Mycobacterium bovis
QSLLVRSLVAWFWDQPLRAPLIRH

SEQ ID NO: 204859 - protein, 24 aa, Mycobacterium bovis
QSLPANDPNTAWLRGQVADLQAHV

SEQ ID NO: 204860 - protein, 23 aa, Mycobacterium bovis
QSLRTRFGTLTAVDRPVAVGDVV

SEQ ID NO: 204861 - protein, 21 aa, Mycobacterium bovis
QSLTGRPLIGDGANGIDGTGQ

SEQ ID NO: 204862 - protein, 22 aa, Mycobacterium bovis
QSPRHCGCEIVVLTTRQHGHPV

SEQ ID NO: 204863 - protein, 28 aa, Mycobacterium bovis
QSPTFQPVRRFGWRIMPQNLSDAGVSWK

SEQ ID NO: 204864 - protein, 23 aa, Mycobacterium bovis
QSQAPIDLACRLRERIGDLDQIA

SEQ ID NO: 204865 - protein, 17 aa, Mycobacterium bovis
QSRPEDRRAFIEEAAGV

SEQ ID NO: 204866 - protein, 21 aa, Mycobacterium bovis
QSRRRGIGTAMARAALAKTAG

SEQ ID NO: 204867 - protein, 25 aa, Mycobacterium bovis
QSWDIFKCVRQVLDVLDRVDDPLPA

SEQ ID NO: 204868 - protein, 25 aa, Mycobacterium bovis
QSYGSRCVRPPILYGDVSRPRAMTV

SEQ ID NO: 204869 - protein, 23 aa, Mycobacterium bovis
QTAGRGRHGRGWAATARAQIILS

SEQ ID NO: 204870 - protein, 23 aa, Mycobacterium bovis
QTALPRECLLLFGQEGPGITDDA

SEQ ID NO: 204871 - protein, 17 aa, Mycobacterium bovis
QTDQRWAELVYDGLWYS

SEQ ID NO: 204872 - protein, 24 aa, Mycobacterium bovis
QTEGAGFDWVSWVTALGSAPDAMT

SEQ ID NO: 204873 - protein, 25 aa, Mycobacterium bovis
QTENYRGAMGLNWYLTDPTLQFIMA

SEQ ID NO: 204874 - protein, 31 aa, Mycobacterium bovis
QTGEWKDGEALFLRCNIWREAAENVAESLTR

SEQ ID NO: 204875 - protein, 29 aa, Mycobacterium bovis
QTGKAALYRRWAGKRELVLAAVQYALPPV

SEQ ID NO: 204876 - protein, 19 aa, Mycobacterium bovis
QTISAWLAGDVRLDPDQLV

SEQ ID NO: 204877 - protein, 25 aa, Mycobacterium bovis
QTLAATHRAMWALGDYALMAEEVMA

SEQ ID NO: 204878 - protein, 27 aa, Mycobacterium bovis
QTLAHEFDFRFLVGVLSVLGDKDVDGI

SEQ ID NO: 204879 - protein, 24 aa, Mycobacterium bovis
QTLLGRPLIGNGADGGPGQNGGPG

SEQ ID NO: 204880 - protein, 22 aa, Mycobacterium bovis
QTLLGRPLIGNGADGVAGTGSN

SEQ ID NO: 204881 - protein, 23 aa, Mycobacterium bovis
QTLTGRPLIGNGANGVAGTGQNG

SEQ ID NO: 204882 - protein, 24 aa, Mycobacterium bovis
QTNRLPAYRNIAAPVLVIGFADDV

SEQ ID NO: 204883 - protein, 24 aa, Mycobacterium bovis
QTNVEFLRFLLADERVRVGDLDTA

SEQ ID NO: 204884 - protein, 30 aa, Mycobacterium bovis
QTPAARVLAIWPDWVRRWPTPSATATASTA

SEQ ID NO: 204885 - protein, 24 aa, Mycobacterium bovis
QTPPAGRCRPTLSARANRGRRLAE

SEQ ID NO: 204886 - protein, 25 aa, Mycobacterium bovis
QTPTLLFPFAAPRVVGDLSEAGSRA

SEQ ID NO: 204887 - protein, 23 aa, Mycobacterium bovis
QTRRWNPKMKRFIFTDRNGIYII

SEQ ID NO: 204888 - protein, 24 aa, Mycobacterium bovis
QTSGWSLTAQDVFNNVARTCIEAM

SEQ ID NO: 204889 - protein, 31 aa, Mycobacterium bovis
QTVFGGTVGEMFGRKVARLMEWCAMVGCPIV

SEQ ID NO: 204890 - protein, 20 aa, Mycobacterium bovis
QVAAGIRSTGRWRGRPKNQD

SEQ ID NO: 204891 - protein, 26 aa, Mycobacterium bovis
QVAAYQERFVLALSQAGSTYAVAEAA

SEQ ID NO: 204892 - protein, 25 aa, Mycobacterium bovis
QVAAYQERFVLALSQASSTYAVAEA

SEQ ID NO: 204893 - protein, 22 aa, Mycobacterium bovis
QVAEGYLRIAVANMANAVKKIS

SEQ ID NO: 204894 - protein, 17 aa, Mycobacterium bovis
QVAMPILPQQALLYRLC

SEQ ID NO: 204895 - protein, 18 aa, Mycobacterium bovis
QVDWTWQLVRDAVLDRVW

SEQ ID NO: 204896 - protein, 18 aa, Mycobacterium bovis
QVGMPRAVVITKLDHARA

SEQ ID NO: 204897 - protein, 20 aa, Mycobacterium bovis
QVGNFPGLWTEWNGKYRDTV

SEQ ID NO: 204898 - protein, 24 aa, Mycobacterium bovis
QVGSHGVGGVGGDGGLGGAGGNGG

SEQ ID NO: 204899 - protein, 24 aa, Mycobacterium bovis
QVIEHLWDQARFVRECARVLRGSG

SEQ ID NO: 204900 - protein, 25 aa, Mycobacterium bovis
QVIGNRPKIGWRRLEAQAVLSRLLN

SEQ ID NO: 204901 - protein, 21 aa, Mycobacterium bovis
QVLWRRGEVYTARVHGSRAVG

SEQ ID NO: 204902 - protein, 22 aa, Mycobacterium bovis
QVMAALVLRAGDTFDPDAFEAF

SEQ ID NO: 204903 - protein, 26 aa, Mycobacterium bovis
QVNRKVLPGYILVRMDLTDDSWAAVR

SEQ ID NO: 204904 - protein, 31 aa, Mycobacterium bovis
QVNRPLRGCYRIAVLSLKGGVGKTTITATLG

SEQ ID NO: 204905 - protein, 20 aa, Mycobacterium bovis
QVNVRQALTLADQATAAGDA

SEQ ID NO: 204906 - protein, 20 aa, Mycobacterium bovis
QVPAAVRFLSCEPLLGPLDG

SEQ ID NO: 204907 - protein, 29 aa, Mycobacterium bovis
QVPAHTQLAWVLGCFTGFGQASRMTQFKD

SEQ ID NO: 204908 - protein, 17 aa, Mycobacterium bovis
QVPDEFLREAVDFELPA

SEQ ID NO: 204909 - protein, 18 aa, Mycobacterium bovis
QVPRRAAVSSYGFSGTNV

SEQ ID NO: 204910 - protein, 22 aa, Mycobacterium bovis
QVSRLKSSVAMELVRKQRGLTV

SEQ ID NO: 204911 - protein, 19 aa, Mycobacterium bovis
QVTEVLKLLTGVGTPLVGR

SEQ ID NO: 204912 - protein, 24 aa, Mycobacterium bovis
QVTLEPGSAIAWIVRLTGGFEETE

SEQ ID NO: 204913 - protein, 23 aa, Mycobacterium bovis
QVTTRVFRNLGLANVGEGNVGNG

SEQ ID NO: 204914 - protein, 17 aa, Mycobacterium bovis
QVVEGWYGQRFPKPLAR

SEQ ID NO: 204915 - protein, 21 aa, Mycobacterium bovis
QVVLQRRLPVVVVDQPKDLSG

SEQ ID NO: 204916 - protein, 20 aa, Mycobacterium bovis
QVVVCGKPSFYTGRGTFSLR

SEQ ID NO: 204917 - protein, 28 aa, Mycobacterium bovis
QWADAIDHLLRLCAGPRGRVMSRAAARH

SEQ ID NO: 204918 - protein, 19 aa, Mycobacterium bovis
QWALAGLTPLRHWRSALAT

SEQ ID NO: 204919 - protein, 21 aa, Mycobacterium bovis
QWERRYNRVAAYGQAKLANLL

SEQ ID NO: 204920 - protein, 21 aa, Mycobacterium bovis
QWERRYRRVAAYGQAKLANLL

SEQ ID NO: 204921 - protein, 24 aa, Mycobacterium bovis
QWGELYLPRFLFGVFLSEQMIAAI

SEQ ID NO: 204922 - protein, 25 aa, Mycobacterium bovis
QWKPVGGFPVTFGWIHASRRGHARL

SEQ ID NO: 204923 - protein, 29 aa, Mycobacterium bovis
QWLEGCAVQRIMFRDGLVLNFDDYNELVI

SEQ ID NO: 204924 - protein, 21 aa, Mycobacterium bovis
QWRHPELKAAGAAMATTALAS

SEQ ID NO: 204925 - protein, 24 aa, Mycobacterium bovis
QYAQLRKAKGITVEHAREIMNDAT

SEQ ID NO: 204926 - protein, 17 aa, Mycobacterium bovis
QYFGSKVLRTVIPRSVK

SEQ ID NO: 204927 - protein, 20 aa, Mycobacterium bovis
QYLRVRFVYQSGREDAVKTF

SEQ ID NO: 204928 - protein, 25 aa, Mycobacterium bovis
QYREGMARAWGPVRVAIAAEQAHGA

SEQ ID NO: 204929 - protein, 26 aa, Mycobacterium bovis
QYTPEQWWPFIGNLSLDQSIAQGVTL

SEQ ID NO: 204930 - protein, 25 aa, Mycobacterium bovis
RAAAARTGHPWWTLSQLSDESAIEL

SEQ ID NO: 204931 - protein, 20 aa, Mycobacterium bovis
RAAAFAGIKPFLALYMGGMG

SEQ ID NO: 204932 - protein, 18 aa, Mycobacterium bovis
RAAATRDWDCWVQHYTPD

SEQ ID NO: 204933 - protein, 19 aa, Mycobacterium bovis
RAACTKLGTEHLVGTTLNV

SEQ ID NO: 204934 - protein, 25 aa, Mycobacterium bovis
RAADFANAVLRRGISVNFMVDIRLD

SEQ ID NO: 204935 - protein, 17 aa, Mycobacterium bovis
RAADPVFMLTGPIPATR

SEQ ID NO: 204936 - protein, 20 aa, Mycobacterium bovis
RAADRLELAEGLRALAAGRE

SEQ ID NO: 204937 - protein, 25 aa, Mycobacterium bovis
RAAEHPRPDYVLLHISDTHLIGGDR

SEQ ID NO: 204938 - protein, 41 aa, Mycobacterium bovis
RAAELMGIQIPRFCDHPLLEPVGACRQCLVEVEGQRKPLAS

SEQ ID NO: 204939 - protein, 17 aa, Mycobacterium bovis
RAAEVVEAELLRLDNRL

SEQ ID NO: 204940 - protein, 28 aa, Mycobacterium bovis
RAAFAAATRGGWRAGGVRDGRIGTLVPG

SEQ ID NO: 204941 - protein, 22 aa, Mycobacterium bovis
RAAGLRVGDTVAVLGPKTGEQV

SEQ ID NO: 204942 - protein, 17 aa, Mycobacterium bovis
RAAGTGARRVAVVRLPR

SEQ ID NO: 204943 - protein, 23 aa, Mycobacterium bovis
RAAHRPLEWDLRNGVIVRKARAH

SEQ ID NO: 204944 - protein, 21 aa, Mycobacterium bovis
RAAKCRTRNLPLIGAPANPGP

SEQ ID NO: 204945 - protein, 21 aa, Mycobacterium bovis
RAAMPNICLQMLLRGRNTVGY

SEQ ID NO: 204946 - protein, 19 aa, Mycobacterium bovis
RAAQRRWARLAPAQRAAGL

SEQ ID NO: 204947 - protein, 18 aa, Mycobacterium bovis
RAAQTDWAKRPVIERAAV

SEQ ID NO: 204948 - protein, 23 aa, Mycobacterium bovis
RAARAGSAPAHFARQAGSSLRTA

SEQ ID NO: 204949 - protein, 19 aa, Mycobacterium bovis
RAASPYVGWLNTAAGQAAQ

SEQ ID NO: 204950 - protein, 21 aa, Mycobacterium bovis
RAAVVGAGLMGRRIAGVLASA

SEQ ID NO: 204951 - protein, 21 aa, Mycobacterium bovis
RACQAGHRVLFATASQWVDRL

SEQ ID NO: 204952 - protein, 18 aa, Mycobacterium bovis
RACTPVWSGVGLHRPAEF

SEQ ID NO: 204953 - protein, 18 aa, Mycobacterium bovis
RADEIAFGYSDDGIDAVV

SEQ ID NO: 204954 - protein, 22 aa, Mycobacterium bovis
RADLAAARRVCRRLTTSAPALA

SEQ ID NO: 204955 - protein, 27 aa, Mycobacterium bovis
RADLVLPMWQRLEPVWGPARDVRDNQP

SEQ ID NO: 204956 - protein, 24 aa, Mycobacterium bovis
RADMIAVAPSTLWSLTVDPDRPGS

SEQ ID NO: 204957 - protein, 21 aa, Mycobacterium bovis
RADVLPLPGGLTVHLPQPPNY

SEQ ID NO: 204958 - protein, 19 aa, Mycobacterium bovis
RADYPGLRVRVAMSVGPWQ

SEQ ID NO: 204959 - protein, 22 aa, Mycobacterium bovis
RADYSARGWAMNSLFDGIGPLL

SEQ ID NO: 204960 - protein, 25 aa, Mycobacterium bovis
RAEEGNLWFEWSRSLDDPAEYVLVE

SEQ ID NO: 204961 - protein, 23 aa, Mycobacterium bovis
RAELARLVAPLAVAAAVDDPIHP

SEQ ID NO: 204962 - protein, 23 aa, Mycobacterium bovis
RAEMEMKVLLWAVQRLIGGLSTI

SEQ ID NO: 204963 - protein, 24 aa, Mycobacterium bovis
RAEMTRPRFGSWLRNSTRGALAMD

SEQ ID NO: 204964 - protein, 26 aa, Mycobacterium bovis
RAEPRLAELGGRFWFGLDDGRADVSG

SEQ ID NO: 204965 - protein, 23 aa, Mycobacterium bovis
RAEPTTRWWPLTVNVGGDSGPSG

SEQ ID NO: 204966 - protein, 26 aa, Mycobacterium bovis
RAEPVGRLSVPPSWAVAAPAFAEKPE

SEQ ID NO: 204967 - protein, 24 aa, Mycobacterium bovis
RAEPWGVWGGEIFDQGSIVSHKRP

SEQ ID NO: 204968 - protein, 24 aa, Mycobacterium bovis
RAERYLGIIERVRAAIPHAAITTD

SEQ ID NO: 204969 - protein, 17 aa, Mycobacterium bovis
RAETLGDDIAWMRFGKD

SEQ ID NO: 204970 - protein, 19 aa, Mycobacterium bovis
RAFAADMAFLRNCGIHPVV

SEQ ID NO: 204971 - protein, 17 aa, Mycobacterium bovis
RAFIEISAHPALLFAIG

SEQ ID NO: 204972 - protein, 17 aa, Mycobacterium bovis
RAGALAAAIDGTRRPLA

SEQ ID NO: 204973 - protein, 18 aa, Mycobacterium bovis
RAGARILLAPDGPDLRVQ

SEQ ID NO: 204974 - protein, 20 aa, Mycobacterium bovis
RAGGRYSVYLWALLAMAAAR

SEQ ID NO: 204975 - protein, 18 aa, Mycobacterium bovis
RAGGTRRRARWRGRDRGC

SEQ ID NO: 204976 - protein, 28 aa, Mycobacterium bovis
RAGGVLRRSIKFPTFMAGIDAVRRVAER

SEQ ID NO: 204977 - protein, 21 aa, Mycobacterium bovis
RAGKHLVCTVFDLMLAHYGVA

SEQ ID NO: 204978 - protein, 19 aa, Mycobacterium bovis
RAGLGSSVPQFWAGELQTV

SEQ ID NO: 204979 - protein, 18 aa, Mycobacterium bovis
RAGNFAVVVGINRTGRAA

SEQ ID NO: 204980 - protein, 19 aa, Mycobacterium bovis
RAGVKPSLALFAADYLLNQ

SEQ ID NO: 204981 - protein, 19 aa, Mycobacterium bovis
RAGVSRPTVYRRWPDTRSI

SEQ ID NO: 204982 - protein, 19 aa, Mycobacterium bovis
RAHAVAVPPMFSDLASAPT

SEQ ID NO: 204983 - protein, 25 aa, Mycobacterium bovis
RAIIANRVSFAFGLRGPSVTIDSGQ

SEQ ID NO: 204984 - protein, 17 aa, Mycobacterium bovis
RAIKARAKLEAKLSAKN

SEQ ID NO: 204985 - protein, 20 aa, Mycobacterium bovis
RAILDEWKTISGVDRKVDDA

SEQ ID NO: 204986 - protein, 25 aa, Mycobacterium bovis
RAISEIGGLVTRVSVSGDADRAYLV

SEQ ID NO: 204987 - protein, 17 aa, Mycobacterium bovis
RAKAMAVVMLALPGVVF

SEQ ID NO: 204988 - protein, 20 aa, Mycobacterium bovis
RAKANGINLWRVDADHVSVA

SEQ ID NO: 204989 - protein, 18 aa, Mycobacterium bovis
RAKHAVFDRLVYRKLRAA

SEQ ID NO: 204990 - protein, 22 aa, Mycobacterium bovis
RAKIATGLAKPAGIYQLTDANW

SEQ ID NO: 204991 - protein, 25 aa, Mycobacterium bovis
RAKLARKEKIMGFGHRVYRHGDSRV

SEQ ID NO: 204992 - protein, 19 aa, Mycobacterium bovis
RALAEVCRRGWAQSVAERE

SEQ ID NO: 204993 - protein, 22 aa, Mycobacterium bovis
RALAQRPAWLAAAEALTTEGAD

SEQ ID NO: 204994 - protein, 23 aa, Mycobacterium bovis
RALCLRLLTARSRTRAELAGQLA

SEQ ID NO: 204995 - protein, 23 aa, Mycobacterium bovis
RALEGRAAALIANHGLVAVGPRP

SEQ ID NO: 204996 - protein, 24 aa, Mycobacterium bovis
RALEHGVEVIGYWGEAVATPAQAR

SEQ ID NO: 204997 - protein, 36 aa, Mycobacterium bovis
RALGFPTRMFTVLFALGRLPGWIAHWREMHDEGDSK

SEQ ID NO: 204998 - protein, 17 aa, Mycobacterium bovis
RALGYRLDGVHIAAVVW

SEQ ID NO: 204999 - protein, 19 aa, Mycobacterium bovis
RALICRRWAGIAATAVSGL

SEQ ID NO: 205000 - protein, 34 aa, Mycobacterium bovis
RALLEHVWALMGMPCGKYLVVMHDLWLPLLTAAG

SEQ ID NO: 205001 - protein, 19 aa, Mycobacterium bovis
RALMHAWVGYLERDVFPGG

SEQ ID NO: 205002 - protein, 19 aa, Mycobacterium bovis
RALTTMPIPVIAAVRGLAV

SEQ ID NO: 205003 - protein, 17 aa, Mycobacterium bovis
RALVLCDFESMTGALPT

SEQ ID NO: 205004 - protein, 29 aa, Mycobacterium bovis
RALVPDDLRPEWVLPRADEIAFGYSDDGI

SEQ ID NO: 205005 - protein, 20 aa, Mycobacterium bovis
RALYELGMTGIPIVNVNNNC

SEQ ID NO: 205006 - protein, 17 aa, Mycobacterium bovis
RAMLRPGDHVVIPDDAY

SEQ ID NO: 205007 - protein, 24 aa, Mycobacterium bovis
RAMRDGRVSVFMGMGGNFASATPD

SEQ ID NO: 205008 - protein, 25 aa, Mycobacterium bovis
RAMTRAGRHIPVFAHVTVETTGTML

SEQ ID NO: 205009 - protein, 20 aa, Mycobacterium bovis
RANITVCVGGGIGTPRRAAE

SEQ ID NO: 205010 - protein, 19 aa, Mycobacterium bovis
RANLGLKARIIGIDDSDCA

SEQ ID NO: 205011 - protein, 18 aa, Mycobacterium bovis
RAPALRPSPVRVFVTGQG

SEQ ID NO: 205012 - protein, 19 aa, Mycobacterium bovis
RAPALRWGMGSLQEIDHVP

SEQ ID NO: 205013 - protein, 19 aa, Mycobacterium bovis
RAPGALPLDTTWHRPGWTI

SEQ ID NO: 205014 - protein, 24 aa, Mycobacterium bovis
RAPLAPIRLRIGMHTGEVSSPDEG

SEQ ID NO: 205015 - protein, 22 aa, Mycobacterium bovis
RAPVPFHLLPHVARELGKHTEI

SEQ ID NO: 205016 - protein, 19 aa, Mycobacterium bovis
RAQCLRMVADYAADHPGQP

SEQ ID NO: 205017 - protein, 24 aa, Mycobacterium bovis
RAQTRFANAPIRWLHADIMTAELP

SEQ ID NO: 205018 - protein, 18 aa, Mycobacterium bovis
RAQWRMPMGPVVNLTRWM

SEQ ID NO: 205019 - protein, 24 aa, Mycobacterium bovis
RARAGEITAEMAFIAAREDMSAEL

SEQ ID NO: 205020 - protein, 20 aa, Mycobacterium bovis
RARDVWNTRVQPFAHNLAQR

SEQ ID NO: 205021 - protein, 17 aa, Mycobacterium bovis
RARFRPILRPQFTLGDG

SEQ ID NO: 205022 - protein, 19 aa, Mycobacterium bovis
RARGELMGIGMSFFTEAVG

SEQ ID NO: 205023 - protein, 19 aa, Mycobacterium bovis
RARHAKFATVIARDRAEAI

SEQ ID NO: 205024 - protein, 19 aa, Mycobacterium bovis
RARIEAIVASGAHRGNAAQ

SEQ ID NO: 205025 - protein, 19 aa, Mycobacterium bovis
RARLACSLADQGRAVAVVS

SEQ ID NO: 205026 - protein, 26 aa, Mycobacterium bovis
RARLFPRGLAAFIELRDQRCRTPYCD

SEQ ID NO: 205027 - protein, 18 aa, Mycobacterium bovis
RARLIERINNLRVGHSLD

SEQ ID NO: 205028 - protein, 20 aa, Mycobacterium bovis
RARLRIFFEFLRGADETGTS

SEQ ID NO: 205029 - protein, 26 aa, Mycobacterium bovis
RARLWPRPVDAYADFDSCQSWTERGI

SEQ ID NO: 205030 - protein, 25 aa, Mycobacterium bovis
RARPCGHSPLVLWALGPARLDEVAP

SEQ ID NO: 205031 - protein, 20 aa, Mycobacterium bovis
RARPRIKGLRLRATDLDWTI

SEQ ID NO: 205032 - protein, 20 aa, Mycobacterium bovis
RARQANGFELVRAHLEMARR

SEQ ID NO: 205033 - protein, 18 aa, Mycobacterium bovis
RARQEWLAERLATLNRSE

SEQ ID NO: 205034 - protein, 25 aa, Mycobacterium bovis
RARRFPKGLAAFIGLRDQRCRMPYC

SEQ ID NO: 205035 - protein, 23 aa, Mycobacterium bovis
RARRSLDSAAGWLAPLGGAHLRS

SEQ ID NO: 205036 - protein, 18 aa, Mycobacterium bovis
RARSVLAVARRAQELGWH

SEQ ID NO: 205037 - protein, 21 aa, Mycobacterium bovis
RARTRTGASIVAIVRDEDVLA

SEQ ID NO: 205038 - protein, 17 aa, Mycobacterium bovis
RARVLAITVRRNGTRLD

SEQ ID NO: 205039 - protein, 18 aa, Mycobacterium bovis
RARYACFDHACADDGQAY

SEQ ID NO: 205040 - protein, 19 aa, Mycobacterium bovis
RARYEEAVAIAAATMSSIR

SEQ ID NO: 205041 - protein, 17 aa, Mycobacterium bovis
RASALSYSSVLSTLTGE

SEQ ID NO: 205042 - protein, 25 aa, Mycobacterium bovis
RASDAVACALGLQRAPLAPIRLRIG

SEQ ID NO: 205043 - protein, 20 aa, Mycobacterium bovis
RASDDLLLVGGMRVRQRDKL

SEQ ID NO: 205044 - protein, 24 aa, Mycobacterium bovis
RASDPTCWWMHHFQMPSRVETWVP

SEQ ID NO: 205045 - protein, 18 aa, Mycobacterium bovis
RASELGMSRSEFFTKAAQ

SEQ ID NO: 205046 - protein, 19 aa, Mycobacterium bovis
RASFMPKPFGQHPGSAMHT

SEQ ID NO: 205047 - protein, 18 aa, Mycobacterium bovis
RASGLEVRDEFVVGSLAG

SEQ ID NO: 205048 - protein, 23 aa, Mycobacterium bovis
RASGLPAAVINWGPWSEVGVAQA

SEQ ID NO: 205049 - protein, 19 aa, Mycobacterium bovis
RASGVPIEHIVCVDGAPPG

SEQ ID NO: 205050 - protein, 25 aa, Mycobacterium bovis
RASILVDADDGWSYAVAEGTAQLTP

SEQ ID NO: 205051 - protein, 17 aa, Mycobacterium bovis
RASKATVYRRWPSKAEL

SEQ ID NO: 205052 - protein, 25 aa, Mycobacterium bovis
RASLAKILAGFGYRVQESAFEAMLT

SEQ ID NO: 205053 - protein, 18 aa, Mycobacterium bovis
RASQYTFMVENIGELTDE

SEQ ID NO: 205054 - protein, 24 aa, Mycobacterium bovis
RATDFSLPLARMVLTSAPVTVLEV

SEQ ID NO: 205055 - protein, 17 aa, Mycobacterium bovis
RATIEAVLAKLAAPGAC

SEQ ID NO: 205056 - protein, 18 aa, Mycobacterium bovis
RATIEAVLAKLAAPGACN

SEQ ID NO: 205057 - protein, 24 aa, Mycobacterium bovis
RATMKVSWRLYAYVSKDADRAQRR

SEQ ID NO: 205058 - protein, 28 aa, Mycobacterium bovis
RATSVEVAELWSTFMQKWIAYTAAVIDA

SEQ ID NO: 205059 - protein, 19 aa, Mycobacterium bovis
RAVAELALLAAAETTTNGS

SEQ ID NO: 205060 - protein, 19 aa, Mycobacterium bovis
RAVCDGRRLVTLDGPEIGA

SEQ ID NO: 205061 - protein, 18 aa, Mycobacterium bovis
RAVDAGAAGHIFNLGHGV

SEQ ID NO: 205062 - protein, 20 aa, Mycobacterium bovis
RAVEKFDYTKGYKFSTYATW

SEQ ID NO: 205063 - protein, 26 aa, Mycobacterium bovis
RAVEVALRSARRFGAPVIVHVVTRKG

SEQ ID NO: 205064 - protein, 22 aa, Mycobacterium bovis
RAVGRYLAGRAGEAGVGKLGFE

SEQ ID NO: 205065 - protein, 21 aa, Mycobacterium bovis
RAVIIGTGFSGLGMAIALQKQ

SEQ ID NO: 205066 - protein, 17 aa, Mycobacterium bovis
RAVKVQAPGPVTLVAGL

SEQ ID NO: 205067 - protein, 26 aa, Mycobacterium bovis
RAVLRAEERWRPGLPPPPEQFYRVLA

SEQ ID NO: 205068 - protein, 19 aa, Mycobacterium bovis
RAVLVFDRRCRIEFDPHQH

SEQ ID NO: 205069 - protein, 17 aa, Mycobacterium bovis
RAVMIGRAYLWGLAANG

SEQ ID NO: 205070 - protein, 26 aa, Mycobacterium bovis
RAVQAWRGFSRWLMRAYDVLVDEDQI

SEQ ID NO: 205071 - protein, 23 aa, Mycobacterium bovis
RAVRRWTEFYKHESCGKCTPCRE

SEQ ID NO: 205072 - protein, 19 aa, Mycobacterium bovis
RAVRWHRYSLDNGDMHRTC

SEQ ID NO: 205073 - protein, 21 aa, Mycobacterium bovis
RAVSAALEIGCRLIDTAYAYG

SEQ ID NO: 205074 - protein, 21 aa, Mycobacterium bovis
RAVVARARQKGCTLLVTDGDW

SEQ ID NO: 205075 - protein, 28 aa, Mycobacterium bovis
RAVVTRYELVPGFPRFDVDDVYLGNGVS

SEQ ID NO: 205076 - protein, 18 aa, Mycobacterium bovis
RAVWEKFGEFGLDARAFS

SEQ ID NO: 205077 - protein, 25 aa, Mycobacterium bovis
RAVYRLTGELAEWFGIGAGTLRQGD

SEQ ID NO: 205078 - protein, 20 aa, Mycobacterium bovis
RAWITGQIERGWASCAITQN

SEQ ID NO: 205079 - protein, 17 aa, Mycobacterium bovis
RAYRLDWQPGTTVFEID

SEQ ID NO: 205080 - protein, 20 aa, Mycobacterium bovis
RAYTPWYLVRYWRLLRFKLA

SEQ ID NO: 205081 - protein, 21 aa, Mycobacterium bovis
RCAPRGCPLHSPRPSATSSAH

SEQ ID NO: 205082 - protein, 17 aa, Mycobacterium bovis
RCATPGPHRAFHIATGG

SEQ ID NO: 205083 - protein, 25 aa, Mycobacterium bovis
RCDCGPQLDAALAMVAREGRGVVLY

SEQ ID NO: 205084 - protein, 19 aa, Mycobacterium bovis
RCFEPRLQELIGYGLYAGK

SEQ ID NO: 205085 - protein, 24 aa, Mycobacterium bovis
RCGPSRARYLMLRLLERAGEQRVA

SEQ ID NO: 205086 - protein, 17 aa, Mycobacterium bovis
RCGRCGRKASWYDRGAG

SEQ ID NO: 205087 - protein, 20 aa, Mycobacterium bovis
RCLGATFAMVEMRVVLREIL

SEQ ID NO: 205088 - protein, 23 aa, Mycobacterium bovis
RCPSEHWEVVRIEMPASVARYVV

SEQ ID NO: 205089 - protein, 17 aa, Mycobacterium bovis
RCRACTTTLAGTHADVR

SEQ ID NO: 205090 - protein, 29 aa, Mycobacterium bovis
RCSKGSFYLRPIVRPVILVAGGTGLSAIL

SEQ ID NO: 205091 - protein, 24 aa, Mycobacterium bovis
RCVDYARGRFDAIVPDEVIAQLPY

SEQ ID NO: 205092 - protein, 22 aa, Mycobacterium bovis
RCVPGARGTFFARCEQALRAAG

SEQ ID NO: 205093 - protein, 19 aa, Mycobacterium bovis
RDAAAVGFDVTVCIHPSQI

SEQ ID NO: 205094 - protein, 17 aa, Mycobacterium bovis
RDADRVCFTTGAMRVEP

SEQ ID NO: 205095 - protein, 22 aa, Mycobacterium bovis
RDALPRIAQAVVVAATRNYGVP

SEQ ID NO: 205096 - protein, 21 aa, Mycobacterium bovis
RDALRCFASLFGDEALDPLDY

SEQ ID NO: 205097 - protein, 23 aa, Mycobacterium bovis
RDAMPTFRQVFLAGASGMALERR

SEQ ID NO: 205098 - protein, 26 aa, Mycobacterium bovis
RDASVRCARLYRAAVHAGAKGLTVRL

SEQ ID NO: 205099 - protein, 23 aa, Mycobacterium bovis
RDDAASVAVLWGAGGTFCAGADL

SEQ ID NO: 205100 - protein, 26 aa, Mycobacterium bovis
RDDLLRLGELICREVGQHASTIRAVL

SEQ ID NO: 205101 - protein, 21 aa, Mycobacterium bovis
RDELLAGLAGVVAGRPEAGVV

SEQ ID NO: 205102 - protein, 26 aa, Mycobacterium bovis
RDEPELRFELCLGVSGVHYPHETGRE

SEQ ID NO: 205103 - protein, 18 aa, Mycobacterium bovis
RDEVPVLLVRGQVSDIVR

SEQ ID NO: 205104 - protein, 24 aa, Mycobacterium bovis
RDFTLPGERIHVVFRSDESGTTDN

SEQ ID NO: 205105 - protein, 23 aa, Mycobacterium bovis
RDGEAIGALLTRMGAQDTRLVWE

SEQ ID NO: 205106 - protein, 23 aa, Mycobacterium bovis
RDGFVFGEAGALMLIETEEHAKA

SEQ ID NO: 205107 - protein, 17 aa, Mycobacterium bovis
RDGGRGVLRLEYSAHPS

SEQ ID NO: 205108 - protein, 19 aa, Mycobacterium bovis
RDGKVCALWDIANPDKFTG

SEQ ID NO: 205109 - protein, 19 aa, Mycobacterium bovis
RDGLLRLLVDVQYTRNDMS

SEQ ID NO: 205110 - protein, 25 aa, Mycobacterium bovis
RDGPVVVHPSWWSAARVEVVTAAAR

SEQ ID NO: 205111 - protein, 22 aa, Mycobacterium bovis
RDGRAIEVIGRYHPKEEPSLIE

SEQ ID NO: 205112 - protein, 26 aa, Mycobacterium bovis
RDGRDAGRRRPPVLSEAEFLARREAV

SEQ ID NO: 205113 - protein, 17 aa, Mycobacterium bovis
RDGTCVLVIAPAPALPD

SEQ ID NO: 205114 - protein, 24 aa, Mycobacterium bovis
RDGVHWSRIRLADRAHLEPWEPSA

SEQ ID NO: 205115 - protein, 22 aa, Mycobacterium bovis
RDGWRISWMPGVVVVVLGGDTV

SEQ ID NO: 205116 - protein, 25 aa, Mycobacterium bovis
RDIKKLPTLRGRTVVTMFYENSTRT

SEQ ID NO: 205117 - protein, 19 aa, Mycobacterium bovis
RDIPLSGLVRAHRLGHARF

SEQ ID NO: 205118 - protein, 17 aa, Mycobacterium bovis
RDIPVLIGGGGERKTLR

SEQ ID NO: 205119 - protein, 24 aa, Mycobacterium bovis
RDIRFVRLWFTDVLGFLKSVAIAP

SEQ ID NO: 205120 - protein, 24 aa, Mycobacterium bovis
RDISAKKNEPDWMLQSRLKALRIF

SEQ ID NO: 205121 - protein, 20 aa, Mycobacterium bovis
RDKRSLVFPVKRLADLGFRV

SEQ ID NO: 205122 - protein, 25 aa, Mycobacterium bovis
RDLGAELRKCWNIDFDDAGAIGRRY

SEQ ID NO: 205123 - protein, 20 aa, Mycobacterium bovis
RDLLHLACCQRRGVTRIKTF

SEQ ID NO: 205124 - protein, 23 aa, Mycobacterium bovis
RDLPCHTGIRLLGGGSHALGRVN

SEQ ID NO: 205125 - protein, 21 aa, Mycobacterium bovis
RDLPVNVARQILAPDTLIGRS

SEQ ID NO: 205126 - protein, 21 aa, Mycobacterium bovis
RDLRLRVLSWGAAPAPDALLR

SEQ ID NO: 205127 - protein, 17 aa, Mycobacterium bovis
RDMAGRFEVHAQTVEDE

SEQ ID NO: 205128 - protein, 17 aa, Mycobacterium bovis
RDMVHPLIARPLPAETG

SEQ ID NO: 205129 - protein, 25 aa, Mycobacterium bovis
RDNRAVHALARIMLHGRISHIQTSW

SEQ ID NO: 205130 - protein, 23 aa, Mycobacterium bovis
RDPGIPVVIGRNVSGPVSGPNED

SEQ ID NO: 205131 - protein, 21 aa, Mycobacterium bovis
RDPMAMLPFLGYNVGDYFQHW

SEQ ID NO: 205132 - protein, 17 aa, Mycobacterium bovis
RDQALKFGATHVYPDIN

SEQ ID NO: 205133 - protein, 19 aa, Mycobacterium bovis
RDQARAFARSGCRRPALLA

SEQ ID NO: 205134 - protein, 17 aa, Mycobacterium bovis
RDRFEQMLQRAEARLHP

SEQ ID NO: 205135 - protein, 24 aa, Mycobacterium bovis
RDRLKELGESVAIAAAPPDSYSVH

SEQ ID NO: 205136 - protein, 26 aa, Mycobacterium bovis
RDRMAFRSAAYWDILAKLDASVSDPD

SEQ ID NO: 205137 - protein, 18 aa, Mycobacterium bovis
RDRMPVFPVPDGHDQASW

SEQ ID NO: 205138 - protein, 18 aa, Mycobacterium bovis
RDRRMPYTVGLLGSVPRL

SEQ ID NO: 205139 - protein, 20 aa, Mycobacterium bovis
RDSDEVLVPFVRAIVTSVSL

SEQ ID NO: 205140 - protein, 19 aa, Mycobacterium bovis
RDTLGFSVLHVVRDNPTSI

SEQ ID NO: 205141 - protein, 17 aa, Mycobacterium bovis
RDTLKKLGVRIRWVGSR

SEQ ID NO: 205142 - protein, 20 aa, Mycobacterium bovis
RDTLLWAKLIDKYQGTMTAA

SEQ ID NO: 205143 - protein, 17 aa, Mycobacterium bovis
RDTRSCPQRNHDALNAG

SEQ ID NO: 205144 - protein, 23 aa, Mycobacterium bovis
RDVIDAFLAWYVPGLDISDHTML

SEQ ID NO: 205145 - protein, 17 aa, Mycobacterium bovis
RDVKRVKDRFGVTINDV

SEQ ID NO: 205146 - protein, 20 aa, Mycobacterium bovis
RDVPYDVLASFRYLAQGHHR

SEQ ID NO: 205147 - protein, 17 aa, Mycobacterium bovis
RDWAHAVVSDLILHIDE

SEQ ID NO: 205148 - protein, 23 aa, Mycobacterium bovis
RDYKRVLQAIALAERDGVDVDKA

SEQ ID NO: 205149 - protein, 18 aa, Mycobacterium bovis
REAAPMWSARCPHPVLPP

SEQ ID NO: 205150 - protein, 19 aa, Mycobacterium bovis
REAERLWRNHQLPPVGDVT

SEQ ID NO: 205151 - protein, 23 aa, Mycobacterium bovis
REAKLRQAPILALGGRPEELREI

SEQ ID NO: 205152 - protein, 24 aa, Mycobacterium bovis
REAKTRLGDPVLAWADIQADPERR

SEQ ID NO: 205153 - protein, 24 aa, Mycobacterium bovis
REALKSALQYPALAGPVFDALTVE

SEQ ID NO: 205154 - protein, 20 aa, Mycobacterium bovis
REALRQAALVRFLAQGVEAT

SEQ ID NO: 205155 - protein, 17 aa, Mycobacterium bovis
REARKGTGHPAGEQPRD

SEQ ID NO: 205156 - protein, 19 aa, Mycobacterium bovis
REAYPGDVFYLHSRLLERC

SEQ ID NO: 205157 - protein, 18 aa, Mycobacterium bovis
REDARILYHAALAHASNH

SEQ ID NO: 205158 - protein, 18 aa, Mycobacterium bovis
REDFRLLAAEHRVVPVTR

SEQ ID NO: 205159 - protein, 22 aa, Mycobacterium bovis
REEIIRMVDLMISRVAGQLKSK

SEQ ID NO: 205160 - protein, 20 aa, Mycobacterium bovis
REFGVTTGRRRRCGWFDAVI

SEQ ID NO: 205161 - protein, 17 aa, Mycobacterium bovis
REFKTGAARMALEAQVP

SEQ ID NO: 205162 - protein, 22 aa, Mycobacterium bovis
REFMLHPVMMDIALQTLGATRT

SEQ ID NO: 205163 - protein, 23 aa, Mycobacterium bovis
REGFPVELLSYFEVFTKTTISAE

SEQ ID NO: 205164 - protein, 25 aa, Mycobacterium bovis
REGRALDDFATWCALAETYGDDWHR

SEQ ID NO: 205165 - protein, 22 aa, Mycobacterium bovis
REGRPRSDILAFALPGFATGEH

SEQ ID NO: 205166 - protein, 28 aa, Mycobacterium bovis
REGVNLTFLPFFAKAVIDALKIHPNINA

SEQ ID NO: 205167 - protein, 17 aa, Mycobacterium bovis
REGWLALMADDVVIEDP

SEQ ID NO: 205168 - protein, 27 aa, Mycobacterium bovis
REHDILAFERQWWKFAGVKEEAIKELF

SEQ ID NO: 205169 - protein, 17 aa, Mycobacterium bovis
REHIKEIQAFFKELSAA

SEQ ID NO: 205170 - protein, 22 aa, Mycobacterium bovis
REHPRPVAAGLYGDLTATLSAL

SEQ ID NO: 205171 - protein, 20 aa, Mycobacterium bovis
REIADALLAALERRHEVADA

SEQ ID NO: 205172 - protein, 21 aa, Mycobacterium bovis
REIHLTLIPFALRPTAEVPTT

SEQ ID NO: 205173 - protein, 17 aa, Mycobacterium bovis
REIIYRMGVTPPQAKQI

SEQ ID NO: 205174 - protein, 17 aa, Mycobacterium bovis
REILRRVELSTTTTSGE

SEQ ID NO: 205175 - protein, 21 aa, Mycobacterium bovis
REIQTRGAVTIVIAEEGDETV

SEQ ID NO: 205176 - protein, 19 aa, Mycobacterium bovis
REIYWPRGKVLGGSSSMNA

SEQ ID NO: 205177 - protein, 24 aa, Mycobacterium bovis
REKASEGTPVIVFFDEMDSIFRTR

SEQ ID NO: 205178 - protein, 20 aa, Mycobacterium bovis
RELAEICGYIAGLPLDRDRP

SEQ ID NO: 205179 - protein, 30 aa, Mycobacterium bovis
RELALQVAEAFGRYGAYLSQLNVLPIYGGS

SEQ ID NO: 205180 - protein, 17 aa, Mycobacterium bovis
RELATYFVGQVVGSLDR

SEQ ID NO: 205181 - protein, 17 aa, Mycobacterium bovis
RELEAFAAFASDLDAAS

SEQ ID NO: 205182 - protein, 22 aa, Mycobacterium bovis
RELERGGFRMAVDAAVQAAKSR

SEQ ID NO: 205183 - protein, 25 aa, Mycobacterium bovis
RELGASFAEFGGWLMPVSYAGTVSE

SEQ ID NO: 205184 - protein, 19 aa, Mycobacterium bovis
RELGIPVSRLHSHALDLRR

SEQ ID NO: 205185 - protein, 25 aa, Mycobacterium bovis
RELHVVNVLPRRGIGKVDRAALVRR

SEQ ID NO: 205186 - protein, 23 aa, Mycobacterium bovis
RELKLGSGGLRDVEFAVQLLQLV

SEQ ID NO: 205187 - protein, 19 aa, Mycobacterium bovis
RELPRVAAIIEPDVSKIGV

SEQ ID NO: 205188 - protein, 24 aa, Mycobacterium bovis
RELQELRKSTGLDVSDRIRVVMSV

SEQ ID NO: 205189 - protein, 20 aa, Mycobacterium bovis
RELQPGKSLIVRYGPGMGQA

SEQ ID NO: 205190 - protein, 22 aa, Mycobacterium bovis
RELRENPAWITGIEHRIESPAL

SEQ ID NO: 205191 - protein, 17 aa, Mycobacterium bovis
RELRPLHPYGVSKAATD

SEQ ID NO: 205192 - protein, 20 aa, Mycobacterium bovis
RELRPSAAVVELPGLGHYPQ

SEQ ID NO: 205193 - protein, 20 aa, Mycobacterium bovis
RELRQITGRVPVEIPRMRGA

SEQ ID NO: 205194 - protein, 20 aa, Mycobacterium bovis
RELRQLWEDRGCPRMPPRPR

SEQ ID NO: 205195 - protein, 22 aa, Mycobacterium bovis
RELTAELALALGAAAARRLSRS

SEQ ID NO: 205196 - protein, 23 aa, Mycobacterium bovis
RELTARTGGVVGRRVCAVVGSGD

SEQ ID NO: 205197 - protein, 19 aa, Mycobacterium bovis
RELTGGRRSFILVPGIDVP

SEQ ID NO: 205198 - protein, 20 aa, Mycobacterium bovis
RELVGEGTLFLLKVIGDSMV

SEQ ID NO: 205199 - protein, 23 aa, Mycobacterium bovis
RENMWRTGINVFFETFGSHKAVT

SEQ ID NO: 205200 - protein, 22 aa, Mycobacterium bovis
RENRLRTALAALDNFDFDYVFV

SEQ ID NO: 205201 - protein, 19 aa, Mycobacterium bovis
REPIAVAGEQIWRVPPLGH

SEQ ID NO: 205202 - protein, 17 aa, Mycobacterium bovis
REPIPGMGHAIELRVYR

SEQ ID NO: 205203 - protein, 24 aa, Mycobacterium bovis
REPKPMVYSGLYPVDGSDYPNLRD

SEQ ID NO: 205204 - protein, 23 aa, Mycobacterium bovis
REPRPYPKLLLADRDSIFEYTYE

SEQ ID NO: 205205 - protein, 24 aa, Mycobacterium bovis
REPTGDGLVEWEGIGTVEAWTTPV

SEQ ID NO: 205206 - protein, 26 aa, Mycobacterium bovis
REPVRSLVWIRGCLHQIPPAELVETL

SEQ ID NO: 205207 - protein, 18 aa, Mycobacterium bovis
REPVVVVVDGVRVGLTVC

SEQ ID NO: 205208 - protein, 21 aa, Mycobacterium bovis
REQALRFGADLRMEDVESVSL

SEQ ID NO: 205209 - protein, 17 aa, Mycobacterium bovis
REQFAYLSYGRVMDTTR

SEQ ID NO: 205210 - protein, 20 aa, Mycobacterium bovis
REQPLPLGLRRLLTDLHNAG

SEQ ID NO: 205211 - protein, 17 aa, Mycobacterium bovis
REREANLIPGGKSLSGG

SEQ ID NO: 205212 - protein, 20 aa, Mycobacterium bovis
RERGWPQFADRLLELAREAE

SEQ ID NO: 205213 - protein, 17 aa, Mycobacterium bovis
RERLDAVLAAVVDGHEV

SEQ ID NO: 205214 - protein, 23 aa, Mycobacterium bovis
RERLDFSCALFDPDGNLVANAPH

SEQ ID NO: 205215 - protein, 18 aa, Mycobacterium bovis
RERWRIVLVDEFQDTDPM

SEQ ID NO: 205216 - protein, 23 aa, Mycobacterium bovis
REVAAEFERPVLLFSGGKDSIVM

SEQ ID NO: 205217 - protein, 20 aa, Mycobacterium bovis
REVHHMAALVGFGAAAINPY

SEQ ID NO: 205218 - protein, 19 aa, Mycobacterium bovis
REVLFCPDQFLGAHVRRVT

SEQ ID NO: 205219 - protein, 26 aa, Mycobacterium bovis
REVPADLRQDWPAALRDAGFDPTART

SEQ ID NO: 205220 - protein, 17 aa, Mycobacterium bovis
REVPGLKAGQIHIRAGS

SEQ ID NO: 205221 - protein, 23 aa, Mycobacterium bovis
REWFTANATLGWATCPLTEAGFV

SEQ ID NO: 205222 - protein, 17 aa, Mycobacterium bovis
REYPPVRGVIHAAGVLD

SEQ ID NO: 205223 - protein, 20 aa, Mycobacterium bovis
RFAECPTFPAPPPREILDAA

SEQ ID NO: 205224 - protein, 25 aa, Mycobacterium bovis
RFAFTSWKTLGWVDANVWRHVVPKG

SEQ ID NO: 205225 - protein, 18 aa, Mycobacterium bovis
RFAGIIRLYTARQVVEQR

SEQ ID NO: 205226 - protein, 21 aa, Mycobacterium bovis
RFAGMLVAGVFLREFVAESVD

SEQ ID NO: 205227 - protein, 23 aa, Mycobacterium bovis
RFAPRSLLLPAIRIGNRLRGGPS

SEQ ID NO: 205228 - protein, 23 aa, Mycobacterium bovis
RFARLRESVGLMRQLWSGDRVDF

SEQ ID NO: 205229 - protein, 23 aa, Mycobacterium bovis
RFATCCRALGIAVYQRKRPPDLA

SEQ ID NO: 205230 - protein, 17 aa, Mycobacterium bovis
RFDREISPIQAPVLDEQ

SEQ ID NO: 205231 - protein, 18 aa, Mycobacterium bovis
RFDVDDVYLGNGVSELIT

SEQ ID NO: 205232 - protein, 18 aa, Mycobacterium bovis
RFEIAVAADHVWLMSTAS

SEQ ID NO: 205233 - protein, 19 aa, Mycobacterium bovis
RFETGRLALQAAGAVVAYL

SEQ ID NO: 205234 - protein, 26 aa, Mycobacterium bovis
RFFLPRIAAGDLHFSIGYSEPGAGTD

SEQ ID NO: 205235 - protein, 17 aa, Mycobacterium bovis
RFGDAFIPMDETLAHAA

SEQ ID NO: 205236 - protein, 21 aa, Mycobacterium bovis
RFGSPELQQGWGVSAVSGDRI

SEQ ID NO: 205237 - protein, 28 aa, Mycobacterium bovis
RFGTELPPLEGIYLAAFAGRPALLSEMT

SEQ ID NO: 205238 - protein, 18 aa, Mycobacterium bovis
RFHVVPVLAYSPDPGPVA

SEQ ID NO: 205239 - protein, 24 aa, Mycobacterium bovis
RFIDALRSSINFDQSPKDLLRNTI

SEQ ID NO: 205240 - protein, 24 aa, Mycobacterium bovis
RFIVTDIFPGGRLPTIETIEEHVT

SEQ ID NO: 205241 - protein, 21 aa, Mycobacterium bovis
RFLLTAGAIGSLFKERASISG

SEQ ID NO: 205242 - protein, 20 aa, Mycobacterium bovis
RFLMRNPRRALSRTEILDRV

SEQ ID NO: 205243 - protein, 21 aa, Mycobacterium bovis
RFNLREFAIRPAYGLAEATVY

SEQ ID NO: 205244 - protein, 20 aa, Mycobacterium bovis
RFPFERYRRLCDVGCADGLL

SEQ ID NO: 205245 - protein, 17 aa, Mycobacterium bovis
RFPWPPFEPDVRLSPYL

SEQ ID NO: 205246 - protein, 19 aa, Mycobacterium bovis
RFQQVESWLVAKPNTSVLI

SEQ ID NO: 205247 - protein, 23 aa, Mycobacterium bovis
RFQSGDGPPIFLLSLKAGGTGLN

SEQ ID NO: 205248 - protein, 17 aa, Mycobacterium bovis
RFRSHPDLEVLTHGLTL

SEQ ID NO: 205249 - protein, 27 aa, Mycobacterium bovis
RFSEQLLPEHLHKVSLSFLVDDLVMHR

SEQ ID NO: 205250 - protein, 29 aa, Mycobacterium bovis
RFSFNVKGGRCEACTGDGTIKIEMNFLPD

SEQ ID NO: 205251 - protein, 20 aa, Mycobacterium bovis
RFTLYHLPVALQLPPGATGV

SEQ ID NO: 205252 - protein, 25 aa, Mycobacterium bovis
RFTPGGLVLTEWQGAAVYRELQPGK

SEQ ID NO: 205253 - protein, 25 aa, Mycobacterium bovis
RFVACPFGGSGARMYRTGDLVCWRA

SEQ ID NO: 205254 - protein, 18 aa, Mycobacterium bovis
RFVFANADAFSWSQTFES

SEQ ID NO: 205255 - protein, 19 aa, Mycobacterium bovis
RFVIDVTVWIDLAEAANSD

SEQ ID NO: 205256 - protein, 21 aa, Mycobacterium bovis
RFVLAEARLAAYARELGEEPV

SEQ ID NO: 205257 - protein, 23 aa, Mycobacterium bovis
RFVSRQCRLFACLAQIWEGDANG

SEQ ID NO: 205258 - protein, 19 aa, Mycobacterium bovis
RFYDSCRVLPQGDEQPTDL

SEQ ID NO: 205259 - protein, 24 aa, Mycobacterium bovis
RFYERKEIRDIVAYLRVLDNPGDA

SEQ ID NO: 205260 - protein, 17 aa, Mycobacterium bovis
RFYGFLGGETDQWYPDL

SEQ ID NO: 205261 - protein, 26 aa, Mycobacterium bovis
RGAEYSVDFVPKVRIEVVVDDSIVDK

SEQ ID NO: 205262 - protein, 20 aa, Mycobacterium bovis
RGAFHGRSGYTLSLTNTKPT

SEQ ID NO: 205263 - protein, 21 aa, Mycobacterium bovis
RGAGDLWRHYVSAQSDRLVVL

SEQ ID NO: 205264 - protein, 18 aa, Mycobacterium bovis
RGAHGVAVYNGETVTECA

SEQ ID NO: 205265 - protein, 17 aa, Mycobacterium bovis
RGAQLIAVCASWGSGPG

SEQ ID NO: 205266 - protein, 19 aa, Mycobacterium bovis
RGAQRYVGRWSMISEYIGS

SEQ ID NO: 205267 - protein, 18 aa, Mycobacterium bovis
RGARKRPTSGWGALTPTE

SEQ ID NO: 205268 - protein, 21 aa, Mycobacterium bovis
RGATALRGIWGFYGDHKPHGD

SEQ ID NO: 205269 - protein, 23 aa, Mycobacterium bovis
RGAWLVCRAAGRVLLEQGQGGSV

SEQ ID NO: 205270 - protein, 22 aa, Mycobacterium bovis
RGCSRPGCDAPAYHSEVHHVTP

SEQ ID NO: 205271 - protein, 18 aa, Mycobacterium bovis
RGDKRALAETVHRNAEDA

SEQ ID NO: 205272 - protein, 19 aa, Mycobacterium bovis
RGDLAELTQCFAPDVEQFV

SEQ ID NO: 205273 - protein, 26 aa, Mycobacterium bovis
RGDVEPCAAVGVELRRRGHAVHMAVP

SEQ ID NO: 205274 - protein, 17 aa, Mycobacterium bovis
RGDVLELIDDIKDAIPG

SEQ ID NO: 205275 - protein, 22 aa, Mycobacterium bovis
RGEAEAMLLAGFVIPVRKKGVR

SEQ ID NO: 205276 - protein, 28 aa, Mycobacterium bovis
RGEIARRVFATCRRLGLGTVAVYTDPDA

SEQ ID NO: 205277 - protein, 21 aa, Mycobacterium bovis
RGELLKEVWGPAYATETHYLR

SEQ ID NO: 205278 - protein, 24 aa, Mycobacterium bovis
RGERDAVAGRRCGGLVRAVNDLTE

SEQ ID NO: 205279 - protein, 20 aa, Mycobacterium bovis
RGERNWDYRYAWIRDSTFAL

SEQ ID NO: 205280 - protein, 26 aa, Mycobacterium bovis
RGESMSGRLIGKVALVSGGARGMGAS

SEQ ID NO: 205281 - protein, 19 aa, Mycobacterium bovis
RGFFTSRVIGTFVNEALAM

SEQ ID NO: 205282 - protein, 21 aa, Mycobacterium bovis
RGFYAGAVGWCDGRGDGHWVV

SEQ ID NO: 205283 - protein, 19 aa, Mycobacterium bovis
RGGALAGIHPVDLGALAWR

SEQ ID NO: 205284 - protein, 21 aa, Mycobacterium bovis
RGGCMAAKFFTGLPLDGPDPE

SEQ ID NO: 205285 - protein, 20 aa, Mycobacterium bovis
RGGIILCNDPAIAKKINSAV

SEQ ID NO: 205286 - protein, 21 aa, Mycobacterium bovis
RGGKISFTHLLGYALVQAVKK

SEQ ID NO: 205287 - protein, 18 aa, Mycobacterium bovis
RGGKLSLRVIALVNGTVI

SEQ ID NO: 205288 - protein, 24 aa, Mycobacterium bovis
RGGLADCVLALGFEKMQPGALGGG

SEQ ID NO: 205289 - protein, 18 aa, Mycobacterium bovis
RGGLTGMLLGSVSNAVLH

SEQ ID NO: 205290 - protein, 18 aa, Mycobacterium bovis
RGGRRANVPITRRGGLSF

SEQ ID NO: 205291 - protein, 19 aa, Mycobacterium bovis
RGGSSIGVSRVSSWDQLPA

SEQ ID NO: 205292 - protein, 19 aa, Mycobacterium bovis
RGGTVLCAIEVAREEISAY

SEQ ID NO: 205293 - protein, 17 aa, Mycobacterium bovis
RGGYAGMLVGSVGETVA

SEQ ID NO: 205294 - protein, 25 aa, Mycobacterium bovis
RGHLRKFGLSRVRVRQLAHDGHLPG

SEQ ID NO: 205295 - protein, 24 aa, Mycobacterium bovis
RGHPMWECYIIDGIERGRIAILLK

SEQ ID NO: 205296 - protein, 17 aa, Mycobacterium bovis
RGIACAYLTNTTTRTRR

SEQ ID NO: 205297 - protein, 23 aa, Mycobacterium bovis
RGIAEPYLRPGQLEEHLVYPVTT

SEQ ID NO: 205298 - protein, 17 aa, Mycobacterium bovis
RGIEQYCKPGANFTYNS

SEQ ID NO: 205299 - protein, 17 aa, Mycobacterium bovis
RGIFGQFGAGGAGGAGG

SEQ ID NO: 205300 - protein, 24 aa, Mycobacterium bovis
RGIGATIAEVFARDGAHVVAIDVE

SEQ ID NO: 205301 - protein, 17 aa, Mycobacterium bovis
RGINIPVVDHATGRVAV

SEQ ID NO: 205302 - protein, 24 aa, Mycobacterium bovis
RGKGCDICKPVVASILASTGSDHI

SEQ ID NO: 205303 - protein, 20 aa, Mycobacterium bovis
RGKPAIPAWEDVLLGVRSGG

SEQ ID NO: 205304 - protein, 21 aa, Mycobacterium bovis
RGKWPEIWVAAHGPRMLRATG

SEQ ID NO: 205305 - protein, 18 aa, Mycobacterium bovis
RGLAKATLFGPAEVAERY

SEQ ID NO: 205306 - protein, 20 aa, Mycobacterium bovis
RGLEHMVRIYPRRDAASDTW

SEQ ID NO: 205307 - protein, 19 aa, Mycobacterium bovis
RGLLAPGCFIPVAESINLA

SEQ ID NO: 205308 - protein, 17 aa, Mycobacterium bovis
RGLLLTTLWYIREVDPT

SEQ ID NO: 205309 - protein, 21 aa, Mycobacterium bovis
RGLMQLLAATNWFGQNAPALM

SEQ ID NO: 205310 - protein, 18 aa, Mycobacterium bovis
RGLPPKRRHEVFKALHDK

SEQ ID NO: 205311 - protein, 18 aa, Mycobacterium bovis
RGLRLSGFEVATAVDGAE

SEQ ID NO: 205312 - protein, 27 aa, Mycobacterium bovis
RGLRRTHGWPAAMGILREMGMAHHRKW

SEQ ID NO: 205313 - protein, 22 aa, Mycobacterium bovis
RGLSMAHLRGTLDAFARAEFGP

SEQ ID NO: 205314 - protein, 18 aa, Mycobacterium bovis
RGMCLYFDELPVIVLNGS

SEQ ID NO: 205315 - protein, 19 aa, Mycobacterium bovis
RGPAGAYLVGWDPLLQSGL

SEQ ID NO: 205316 - protein, 19 aa, Mycobacterium bovis
RGPAKRPARKAARKVPAKK

SEQ ID NO: 205317 - protein, 25 aa, Mycobacterium bovis
RGPEHLPEDLVFRVNYLGGDMPTFT

SEQ ID NO: 205318 - protein, 19 aa, Mycobacterium bovis
RGPHRVLRGDLAFAGLPGV

SEQ ID NO: 205319 - protein, 26 aa, Mycobacterium bovis
RGPNAGSRFLLDQAITSAGRHPDSDI

SEQ ID NO: 205320 - protein, 17 aa, Mycobacterium bovis
RGPNLFENMGFTYIGPV

SEQ ID NO: 205321 - protein, 19 aa, Mycobacterium bovis
RGPQVPFTDVFLHGLIRDE

SEQ ID NO: 205322 - protein, 20 aa, Mycobacterium bovis
RGPVATVLVQRGTLRVGDSV

SEQ ID NO: 205323 - protein, 17 aa, Mycobacterium bovis
RGPVHLVALSRFPEPSS

SEQ ID NO: 205324 - protein, 17 aa, Mycobacterium bovis
RGPVPAVSTLVVFGKTA

SEQ ID NO: 205325 - protein, 25 aa, Mycobacterium bovis
RGQDGHWRLGPAITELATHVDDPLL

SEQ ID NO: 205326 - protein, 24 aa, Mycobacterium bovis
RGQGSVLVPFSWQGVSLHAAGASA

SEQ ID NO: 205327 - protein, 27 aa, Mycobacterium bovis
RGQRLLQRCPVCLYAGSIMPDDLLAQC

SEQ ID NO: 205328 - protein, 21 aa, Mycobacterium bovis
RGRDMPVGVLVGSWHTIEGLV

SEQ ID NO: 205329 - protein, 19 aa, Mycobacterium bovis
RGRELTVSVGDLYIDYSKH

SEQ ID NO: 205330 - protein, 21 aa, Mycobacterium bovis
RGRGAMIAVELVKSGTTEPDA

SEQ ID NO: 205331 - protein, 30 aa, Mycobacterium bovis
RGRIGRGEHPSVCLLASWVPPDTPAGQRLR

SEQ ID NO: 205332 - protein, 26 aa, Mycobacterium bovis
RGRLPVVAGCVFRYIAYHGRSRENGY

SEQ ID NO: 205333 - protein, 20 aa, Mycobacterium bovis
RGRNGVLYAGEVNWDAAGLG

SEQ ID NO: 205334 - protein, 19 aa, Mycobacterium bovis
RGRPAKRYRLTAAGRAKLD

SEQ ID NO: 205335 - protein, 17 aa, Mycobacterium bovis
RGRTMYPPEVGLHAEAS

SEQ ID NO: 205336 - protein, 26 aa, Mycobacterium bovis
RGRVKQLLLKIGWPAEDLAGYVDGEA

SEQ ID NO: 205337 - protein, 28 aa, Mycobacterium bovis
RGRVQSVLLPRLLDWMSYAPDPDGGLLA

SEQ ID NO: 205338 - protein, 20 aa, Mycobacterium bovis
RGSGCGLSGAARPVEGGLLI

SEQ ID NO: 205339 - protein, 26 aa, Mycobacterium bovis
RGSLLKELRSILAPECAARAREISTR

SEQ ID NO: 205340 - protein, 28 aa, Mycobacterium bovis
RGSTRGWFMCWLARAHPELVSRYRELYR

SEQ ID NO: 205341 - protein, 17 aa, Mycobacterium bovis
RGSWRGRDFTGTEYVDA

SEQ ID NO: 205342 - protein, 27 aa, Mycobacterium bovis
RGTAYRWFRAGLLSVMARRVGRLILVD

SEQ ID NO: 205343 - protein, 17 aa, Mycobacterium bovis
RGTGARGLRAIMEEVLL

SEQ ID NO: 205344 - protein, 24 aa, Mycobacterium bovis
RGTGGFTPRTWVALATEYFLAGRA

SEQ ID NO: 205345 - protein, 20 aa, Mycobacterium bovis
RGTPVVAMPLLRRGNKEVHG

SEQ ID NO: 205346 - protein, 23 aa, Mycobacterium bovis
RGVDGSVCKWARVLVYEPPSRVL

SEQ ID NO: 205347 - protein, 20 aa, Mycobacterium bovis
RGVEAAERLATRRRQLLSAG

SEQ ID NO: 205348 - protein, 17 aa, Mycobacterium bovis
RGVLSVRAKIKVRLTQL

SEQ ID NO: 205349 - protein, 17 aa, Mycobacterium bovis
RGVLVEMYREAKTRLGD

SEQ ID NO: 205350 - protein, 17 aa, Mycobacterium bovis
RGVNCDHVLISETAHTA

SEQ ID NO: 205351 - protein, 19 aa, Mycobacterium bovis
RGVPPMPVVDAIRRGAQAI

SEQ ID NO: 205352 - protein, 19 aa, Mycobacterium bovis
RGVTISTLVQMAWATTLSA

SEQ ID NO: 205353 - protein, 19 aa, Mycobacterium bovis
RGWEHRWALSVLHTALGGG

SEQ ID NO: 205354 - protein, 19 aa, Mycobacterium bovis
RGWLTAPVIVLSARTDSSD

SEQ ID NO: 205355 - protein, 18 aa, Mycobacterium bovis
RGYPRAVNNLALQALVAA

SEQ ID NO: 205356 - protein, 19 aa, Mycobacterium bovis
RGYVLRRLLRRVIRSAKLL

SEQ ID NO: 205357 - protein, 19 aa, Mycobacterium bovis
RHAKGWNHFLDRLVVAGQH

SEQ ID NO: 205358 - protein, 17 aa, Mycobacterium bovis
RHALALGPSKALLDGQI

SEQ ID NO: 205359 - protein, 23 aa, Mycobacterium bovis
RHARIPVSVMPNAGLPVLGAKGA

SEQ ID NO: 205360 - protein, 17 aa, Mycobacterium bovis
RHARVFLDSVLPALGEE

SEQ ID NO: 205361 - protein, 22 aa, Mycobacterium bovis
RHEKVQHRYGWIVVRVVAEDHP

SEQ ID NO: 205362 - protein, 18 aa, Mycobacterium bovis
RHELLSGLVPQISIILGK

SEQ ID NO: 205363 - protein, 17 aa, Mycobacterium bovis
RHFRPEFFAAMRELCDE

SEQ ID NO: 205364 - protein, 17 aa, Mycobacterium bovis
RHFSALRPIGGGRFTVI

SEQ ID NO: 205365 - protein, 17 aa, Mycobacterium bovis
RHGHPAAVLISADDLAS

SEQ ID NO: 205366 - protein, 19 aa, Mycobacterium bovis
RHGKELTWSQVLMAANTPM

SEQ ID NO: 205367 - protein, 17 aa, Mycobacterium bovis
RHHLHRFLPGASTRRSP

SEQ ID NO: 205368 - protein, 18 aa, Mycobacterium bovis
RHHLKLAGRDDALFSDDA

SEQ ID NO: 205369 - protein, 17 aa, Mycobacterium bovis
RHHTVLKGLGRKVGEAP

SEQ ID NO: 205370 - protein, 27 aa, Mycobacterium bovis
RHIEWKHGVCDALGWPHADQADIAAAW

SEQ ID NO: 205371 - protein, 17 aa, Mycobacterium bovis
RHIRAVVRFGDSVRSAH

SEQ ID NO: 205372 - protein, 24 aa, Mycobacterium bovis
RHLLDMRSGVAFSENYDDPAAEIH

SEQ ID NO: 205373 - protein, 26 aa, Mycobacterium bovis
RHLSYKTVWYGSALVVADRWFPSSKT

SEQ ID NO: 205374 - protein, 22 aa, Mycobacterium bovis
RHPEVFRDASPIQRVTRNAPPF

SEQ ID NO: 205375 - protein, 29 aa, Mycobacterium bovis
RHPFDAELVSYVRGVLYFRTKRWPDVLAQ

SEQ ID NO: 205376 - protein, 17 aa, Mycobacterium bovis
RHPGLAIGAVAVVNGAA

SEQ ID NO: 205377 - protein, 26 aa, Mycobacterium bovis
RHPRWRGKKALLLQGRLWQGNVVATL

SEQ ID NO: 205378 - protein, 20 aa, Mycobacterium bovis
RHPWPAPARCCRHEWRTMRR

SEQ ID NO: 205379 - protein, 24 aa, Mycobacterium bovis
RHRAMIQAFVQWRAQSRSELTEVG

SEQ ID NO: 205380 - protein, 19 aa, Mycobacterium bovis
RHRAVLRAADRLELAEGLR

SEQ ID NO: 205381 - protein, 26 aa, Mycobacterium bovis
RHRDGPRPTLCVIHGFMGSSYLLNGL

SEQ ID NO: 205382 - protein, 28 aa, Mycobacterium bovis
RHTLKKLSGLRARNGLLTASGDNASGSG

SEQ ID NO: 205383 - protein, 23 aa, Mycobacterium bovis
RHVSRGKLLPRERVDRLLDPGSP

SEQ ID NO: 205384 - protein, 19 aa, Mycobacterium bovis
RIAALKPDLIVAINAGVDA

SEQ ID NO: 205385 - protein, 25 aa, Mycobacterium bovis
RIAEHEMPGLMSLRREYAEVQPLKG

SEQ ID NO: 205386 - protein, 27 aa, Mycobacterium bovis
RIARFKIPRYLWIVDEFPMTVTGKVRK

SEQ ID NO: 205387 - protein, 18 aa, Mycobacterium bovis
RIAVPLPVPHAGAHDERT

SEQ ID NO: 205388 - protein, 22 aa, Mycobacterium bovis
RIDALSRPGSWLASNVPGAGFL

SEQ ID NO: 205389 - protein, 19 aa, Mycobacterium bovis
RIDGRFAGLRRWDGNTRAE

SEQ ID NO: 205390 - protein, 26 aa, Mycobacterium bovis
RIDGTDSIELWAWVGAYDHVALCQLW

SEQ ID NO: 205391 - protein, 23 aa, Mycobacterium bovis
RIDHIIGLFRLWWIPDGAPPTQG

SEQ ID NO: 205392 - protein, 19 aa, Mycobacterium bovis
RIDPFRAAKTLNINFFVHD

SEQ ID NO: 205393 - protein, 24 aa, Mycobacterium bovis
RIEAHALGMVFGRKRPGSGPLMIG

SEQ ID NO: 205394 - protein, 18 aa, Mycobacterium bovis
RIEEDVVRAALADHDGVL

SEQ ID NO: 205395 - protein, 17 aa, Mycobacterium bovis
RIFAASANHSVWFHRQV

SEQ ID NO: 205396 - protein, 17 aa, Mycobacterium bovis
RIFCVRADIAVEGTAVT

SEQ ID NO: 205397 - protein, 20 aa, Mycobacterium bovis
RIGAEVRDGDILVGKVTPKG

SEQ ID NO: 205398 - protein, 25 aa, Mycobacterium bovis
RIGHLPKGLGVIGLLIEDPKPLRLD

SEQ ID NO: 205399 - protein, 17 aa, Mycobacterium bovis
RIGIPAFGKSQWAHVER

SEQ ID NO: 205400 - protein, 18 aa, Mycobacterium bovis
RIGLALNCEIVPWCRFAR

SEQ ID NO: 205401 - protein, 20 aa, Mycobacterium bovis
RIGNCSGFYGDRLSAMREML

SEQ ID NO: 205402 - protein, 22 aa, Mycobacterium bovis
RIGRLAVRLDVSRLVVVGTGRS

SEQ ID NO: 205403 - protein, 19 aa, Mycobacterium bovis
RIGRQCLNAGLGFGGGCLP

SEQ ID NO: 205404 - protein, 19 aa, Mycobacterium bovis
RIHPLRNVMILAGAGVGGG

SEQ ID NO: 205405 - protein, 20 aa, Mycobacterium bovis
RIHQGWILTVLWVIDTGVTA

SEQ ID NO: 205406 - protein, 19 aa, Mycobacterium bovis
RILGEPITLLGYAPETIIA

SEQ ID NO: 205407 - protein, 17 aa, Mycobacterium bovis
RILGHKSAKVTLDTYAD

SEQ ID NO: 205408 - protein, 18 aa, Mycobacterium bovis
RILVSGIITDSSIAFHIA

SEQ ID NO: 205409 - protein, 17 aa, Mycobacterium bovis
RIMRGGNPLAYLDSGAT

SEQ ID NO: 205410 - protein, 22 aa, Mycobacterium bovis
RINGVNRLACKVLMRDLLPKKK

SEQ ID NO: 205411 - protein, 20 aa, Mycobacterium bovis
RINHAYLFSGPRGCGKTSSA

SEQ ID NO: 205412 - protein, 25 aa, Mycobacterium bovis
RINLDRPAYVYPIFEQALRIAYGES

SEQ ID NO: 205413 - protein, 23 aa, Mycobacterium bovis
RIPAATMRRAWTMLAHYHGQLFS

SEQ ID NO: 205414 - protein, 18 aa, Mycobacterium bovis
RIPPFAAVQCISGPRHTR

SEQ ID NO: 205415 - protein, 30 aa, Mycobacterium bovis
RIPQGVPMCAGYVPGIPRLGVPALLMSDAG

SEQ ID NO: 205416 - protein, 18 aa, Mycobacterium bovis
RIPSLPDLDGIRVLRSFD

SEQ ID NO: 205417 - protein, 24 aa, Mycobacterium bovis
RIQEGVVSLGLYSRIFRNNILASG

SEQ ID NO: 205418 - protein, 21 aa, Mycobacterium bovis
RIQGGWLEFDAAIAAPDQMAK

SEQ ID NO: 205419 - protein, 21 aa, Mycobacterium bovis
RIQLEPVRPFVALRHIRFSSL

SEQ ID NO: 205420 - protein, 21 aa, Mycobacterium bovis
RIQPTQLLRVWVRDVRRLTPG

SEQ ID NO: 205421 - protein, 24 aa, Mycobacterium bovis
RIQRELPDWLSADVAILGEPTAGC

SEQ ID NO: 205422 - protein, 25 aa, Mycobacterium bovis
RIRARSTGLLSAWVATGFDVLASRV

SEQ ID NO: 205423 - protein, 27 aa, Mycobacterium bovis
RIRARVAAALPEYMLPAAYVVLDEIPI

SEQ ID NO: 205424 - protein, 18 aa, Mycobacterium bovis
RIRELIREGARIALNPSP

SEQ ID NO: 205425 - protein, 18 aa, Mycobacterium bovis
RIRERLGLRGNDQVEITE

SEQ ID NO: 205426 - protein, 18 aa, Mycobacterium bovis
RIRIAIAGADASHFAILP

SEQ ID NO: 205427 - protein, 17 aa, Mycobacterium bovis
RIRVDGVAYDREEQTEG

SEQ ID NO: 205428 - protein, 21 aa, Mycobacterium bovis
RISDVLLPFLVTRQLICGAGK

SEQ ID NO: 205429 - protein, 27 aa, Mycobacterium bovis
RISEFAEIMGFYGLSYWYPFQVTALGL

SEQ ID NO: 205430 - protein, 20 aa, Mycobacterium bovis
RISGAKAWLGTALALKPLLS

SEQ ID NO: 205431 - protein, 31 aa, Mycobacterium bovis
RISHLKRGYGWDRGRIGGLEGTRTWVGHGVF

SEQ ID NO: 205432 - protein, 17 aa, Mycobacterium bovis
RISNALVAMAIESLGAH

SEQ ID NO: 205433 - protein, 18 aa, Mycobacterium bovis
RITACLLANGGIFADGHT

SEQ ID NO: 205434 - protein, 23 aa, Mycobacterium bovis
RITPELIKALGAVRRHHDELMRL

SEQ ID NO: 205435 - protein, 27 aa, Mycobacterium bovis
RITVPAFGIPFTLQFQTNVPALQPPGG

SEQ ID NO: 205436 - protein, 25 aa, Mycobacterium bovis
RIVLPEMLYERVVEVDERVTADGRV

SEQ ID NO: 205437 - protein, 27 aa, Mycobacterium bovis
RIVPLKRRRQWLPAAEVIGELVRLGPD

SEQ ID NO: 205438 - protein, 24 aa, Mycobacterium bovis
RIVSPRTGSLLDHAQRVAEGRLLD

SEQ ID NO: 205439 - protein, 24 aa, Mycobacterium bovis
RIVSYPGSSLWDMVRPRPSSRPAA

SEQ ID NO: 205440 - protein, 20 aa, Mycobacterium bovis
RIVTIEAIEHFGFERYDDFF

SEQ ID NO: 205441 - protein, 25 aa, Mycobacterium bovis
RIVVLGDAWELLKFFNDDQYVIDPK

SEQ ID NO: 205442 - protein, 25 aa, Mycobacterium bovis
RKADELGCRSLALVAFGTGVGGFPL

SEQ ID NO: 205443 - protein, 19 aa, Mycobacterium bovis
RKAIELITLRGFHRDRDLA

SEQ ID NO: 205444 - protein, 24 aa, Mycobacterium bovis
RKANLYRAALMLSLKDAISRDKRR

SEQ ID NO: 205445 - protein, 17 aa, Mycobacterium bovis
RKASLPFTARRTLFNNT

SEQ ID NO: 205446 - protein, 28 aa, Mycobacterium bovis
RKAVLAVGSVCWLVGCSSGASSTTASTG

SEQ ID NO: 205447 - protein, 18 aa, Mycobacterium bovis
RKAYNWTVAQLKADIQAW

SEQ ID NO: 205448 - protein, 20 aa, Mycobacterium bovis
RKCIECFLCQNVCHVVRDHE

SEQ ID NO: 205449 - protein, 22 aa, Mycobacterium bovis
RKCSVPYLYRFELMGTEDDVAA

SEQ ID NO: 205450 - protein, 30 aa, Mycobacterium bovis
RKDRVYCPGWVALFRWLKPLLSTRVGQRPI

SEQ ID NO: 205451 - protein, 26 aa, Mycobacterium bovis
RKDWIPRLATMGVIASYCLTEPGAGS

SEQ ID NO: 205452 - protein, 18 aa, Mycobacterium bovis
RKGFEFEELEAAGLSRQG

SEQ ID NO: 205453 - protein, 18 aa, Mycobacterium bovis
RKGIARAKSVVALAYAGG

SEQ ID NO: 205454 - protein, 18 aa, Mycobacterium bovis
RKGRYPDRKTARRVAEVV

SEQ ID NO: 205455 - protein, 18 aa, Mycobacterium bovis
RKGVSVDVPENFDPTRRS

SEQ ID NO: 205456 - protein, 19 aa, Mycobacterium bovis
RKHPHSMGEWSMASRTHVA

SEQ ID NO: 205457 - protein, 25 aa, Mycobacterium bovis
RKLDRKATLAFAFSHRSYLDGMLLP

SEQ ID NO: 205458 - protein, 19 aa, Mycobacterium bovis
RKLDTMAANLARLTDLTTE

SEQ ID NO: 205459 - protein, 20 aa, Mycobacterium bovis
RKLPAKARKAILEGADEQVH

SEQ ID NO: 205460 - protein, 17 aa, Mycobacterium bovis
RKLQAIIVKTHQGAAEM

SEQ ID NO: 205461 - protein, 23 aa, Mycobacterium bovis
RKLRDAWLTARRDLVDRRNRARE

SEQ ID NO: 205462 - protein, 20 aa, Mycobacterium bovis
RKLYQACRRWPKLMRRLLLW

SEQ ID NO: 205463 - protein, 26 aa, Mycobacterium bovis
RKMLRFGRVTVRFGKPMDFSRFEGLA

SEQ ID NO: 205464 - protein, 20 aa, Mycobacterium bovis
RKNLMLFAGRAHPELAEQVA

SEQ ID NO: 205465 - protein, 18 aa, Mycobacterium bovis
RKPAPSWRHTACPVNELS

SEQ ID NO: 205466 - protein, 17 aa, Mycobacterium bovis
RKPRQVFTRDVLLEQVW

SEQ ID NO: 205467 - protein, 26 aa, Mycobacterium bovis
RKQLTWSTERPSLWHFRDRGGAEVDL

SEQ ID NO: 205468 - protein, 18 aa, Mycobacterium bovis
RKQPGAQVFATFDGDGQH

SEQ ID NO: 205469 - protein, 24 aa, Mycobacterium bovis
RKQVFRKLEHGVFCGDTLGEHGEN

SEQ ID NO: 205470 - protein, 24 aa, Mycobacterium bovis
RKRAAELLEQFSLVHAGKRRVGTY

SEQ ID NO: 205471 - protein, 25 aa, Mycobacterium bovis
RKRDIYKFAAGSVFSRPFQGGILDV

SEQ ID NO: 205472 - protein, 19 aa, Mycobacterium bovis
RKRGHWMWFVFPQLRGLGS

SEQ ID NO: 205473 - protein, 18 aa, Mycobacterium bovis
RKRLAGKGVDAHRIEIPD

SEQ ID NO: 205474 - protein, 19 aa, Mycobacterium bovis
RKSGKNFVAPLLYITDRNN

SEQ ID NO: 205475 - protein, 20 aa, Mycobacterium bovis
RKTPVFVKWLLRRTAIKNLP

SEQ ID NO: 205476 - protein, 19 aa, Mycobacterium bovis
RKTVRAFAEREILPHVDEW

SEQ ID NO: 205477 - protein, 36 aa, Mycobacterium bovis; identical to SEQ ID NO: 17410

SEQ ID NO: 205478 - protein, 18 aa, Mycobacterium bovis
RKVKKWLAHGDFDVLHLH

SEQ ID NO: 205479 - protein, 25 aa, Mycobacterium bovis
RKVMPRLLNVGPWATLALANPSLLN

SEQ ID NO: 205480 - protein, 24 aa, Mycobacterium bovis
RKVRRLRRLAGLWLADQEERWAAV

SEQ ID NO: 205481 - protein, 20 aa, Mycobacterium bovis
RKVVELRPDIAWDKGKALDW

SEQ ID NO: 205482 - protein, 25 aa, Mycobacterium bovis
RKVVEWARGRGVLVVSDECYLGLGW

SEQ ID NO: 205483 - protein, 24 aa, Mycobacterium bovis
RLAAAKTRLAPVFSAQTRENVVLA

SEQ ID NO: 205484 - protein, 26 aa, Mycobacterium bovis
RLAAALPDYPFAYLITVDDGHRVHTV

SEQ ID NO: 205485 - protein, 18 aa, Mycobacterium bovis
RLAAHLRFLGQVDDAGKA

SEQ ID NO: 205486 - protein, 18 aa, Mycobacterium bovis
RLAARVCGYEITPALRGV

SEQ ID NO: 205487 - protein, 24 aa, Mycobacterium bovis
RLADRLIPHRAWIFVYQLYLWDMR

SEQ ID NO: 205488 - protein, 26 aa, Mycobacterium bovis
RLAEAIRRFGPIFAQYYGQSEAPMVI

SEQ ID NO: 205489 - protein, 21 aa, Mycobacterium bovis
RLAEERVLDALGLDVLPAEWL

SEQ ID NO: 205490 - protein, 18 aa, Mycobacterium bovis
RLAEIRKALGHARQADVA

SEQ ID NO: 205491 - protein, 17 aa, Mycobacterium bovis
RLAGLVAHQEVLFGTEG

SEQ ID NO: 205492 - protein, 19 aa, Mycobacterium bovis
RLAHLRGATVLAHNYQLPA

SEQ ID NO: 205493 - protein, 17 aa, Mycobacterium bovis
RLAHWLWQRGARLLARA

SEQ ID NO: 205494 - protein, 25 aa, Mycobacterium bovis
RLAKELDFRPRKSLGQNFVHDANTV

SEQ ID NO: 205495 - protein, 22 aa, Mycobacterium bovis
RLAKRIAAIVASAIEYEIKDPG

SEQ ID NO: 205496 - protein, 25 aa, Mycobacterium bovis
RLANALRSWSVLRFEVTEDPSPGVD

SEQ ID NO: 205497 - protein, 19 aa, Mycobacterium bovis
RLAPEPVYTDAEWVSNYRI

SEQ ID NO: 205498 - protein, 20 aa, Mycobacterium bovis
RLAPKGTGAVLSFELAGGIE

SEQ ID NO: 205499 - protein, 18 aa, Mycobacterium bovis
RLAQLRPGDPILGEEGGG

SEQ ID NO: 205500 - protein, 17 aa, Mycobacterium bovis
RLARAGAVGALSVVDLL

SEQ ID NO: 205501 - protein, 23 aa, Mycobacterium bovis
RLARHRPEIPIGVNIGKTKKTPA

SEQ ID NO: 205502 - protein, 17 aa, Mycobacterium bovis
RLARPSETATRFVADPF

SEQ ID NO: 205503 - protein, 25 aa, Mycobacterium bovis
RLASLDKFSTAWDYRARARAARALH

SEQ ID NO: 205504 - protein, 17 aa, Mycobacterium bovis
RLASVLRRCTVLDAHLR

SEQ ID NO: 205505 - protein, 20 aa, Mycobacterium bovis
RLATAPVITEWCELPTGSSP

SEQ ID NO: 205506 - protein, 20 aa, Mycobacterium bovis
RLATRHLRRYPGLQRAAGRG

SEQ ID NO: 205507 - protein, 24 aa, Mycobacterium bovis
RLAYPEVRAALAAAARNHDLTESE

SEQ ID NO: 205508 - protein, 25 aa, Mycobacterium bovis
RLCRDNCHYCTFVTVPGKLRAQGSS

SEQ ID NO: 205509 - protein, 19 aa, Mycobacterium bovis
RLCTACFDGKYPIELPRET

SEQ ID NO: 205510 - protein, 21 aa, Mycobacterium bovis
RLDAEILALVKRRAEVSKAIG

SEQ ID NO: 205511 - protein, 19 aa, Mycobacterium bovis
RLDAIAAELDRAVPDQDQL

SEQ ID NO: 205512 - protein, 19 aa, Mycobacterium bovis
RLDDLPVLYELAAEEAGAA

SEQ ID NO: 205513 - protein, 25 aa, Mycobacterium bovis
RLDERGVLRLRALMESFWSDELDRL

SEQ ID NO: 205514 - protein, 18 aa, Mycobacterium bovis
RLDGVPLAIELAAARTDT

SEQ ID NO: 205515 - protein, 19 aa, Mycobacterium bovis
RLDIPAATAVRFEPGIPQI

SEQ ID NO: 205516 - protein, 18 aa, Mycobacterium bovis
RLDKARFRSHPDLEVLTH

SEQ ID NO: 205517 - protein, 31 aa, Mycobacterium bovis
RLDNGNWVWRYDAIRTFGDFAGLWDDVDALS

SEQ ID NO: 205518 - protein, 18 aa, Mycobacterium bovis
RLDPGLPLPSRAHDGDAG

SEQ ID NO: 205519 - protein, 22 aa, Mycobacterium bovis
RLDRPGWFYPPTVITDISKDMA

SEQ ID NO: 205520 - protein, 24 aa, Mycobacterium bovis
RLDSKRSAVDLALRRLVGEPLGRD

SEQ ID NO: 205521 - protein, 20 aa, Mycobacterium bovis
RLEDIWSTFTKLAPKQLIVD

SEQ ID NO: 205522 - protein, 17 aa, Mycobacterium bovis
RLEGRAFGDVPLNLEYK

SEQ ID NO: 205523 - protein, 20 aa, Mycobacterium bovis
RLEGYRRLAAASSDREVAAV

SEQ ID NO: 205524 - protein, 20 aa, Mycobacterium bovis
RLELKKFCPNCGKHQAHRET

SEQ ID NO: 205525 - protein, 19 aa, Mycobacterium bovis
RLFAGPRPTELHPFVELTG

SEQ ID NO: 205526 - protein, 24 aa, Mycobacterium bovis
RLGDVRLAERLARAALDRSDALAA

SEQ ID NO: 205527 - protein, 23 aa, Mycobacterium bovis
RLGEAGGGFGIMMQTVLPWFNLG

SEQ ID NO: 205528 - protein, 29 aa, Mycobacterium bovis
RLGELRPLYRPGLVHIYHALTWGPLMREI

SEQ ID NO: 205529 - protein, 21 aa, Mycobacterium bovis
RLGEMCSLAGIAMKRATQALL

SEQ ID NO: 205530 - protein, 21 aa, Mycobacterium bovis
RLGGPGSWLLAVPPYHIAGLA

SEQ ID NO: 205531 - protein, 24 aa, Mycobacterium bovis
RLGITTDWKSRWYADKQYAEYVKE

SEQ ID NO: 205532 - protein, 20 aa, Mycobacterium bovis
RLGLILEIAAAAGLIASGMP

SEQ ID NO: 205533 - protein, 18 aa, Mycobacterium bovis
RLGLLPMYAVNQDKHGTA

SEQ ID NO: 205534 - protein, 18 aa, Mycobacterium bovis
RLGLPRAGRWREVLNTDA

SEQ ID NO: 205535 - protein, 25 aa, Mycobacterium bovis
RLGRPEELAGLYLYLASEASSYMTG

SEQ ID NO: 205536 - protein, 31 aa, Mycobacterium bovis
RLGRPLRIAHAWSFTFDAAWQPLVALLDGHA

SEQ ID NO: 205537 - protein, 25 aa, Mycobacterium bovis
RLGVEEELLRLGARSGCAVTIGEMT

SEQ ID NO: 205538 - protein, 20 aa, Mycobacterium bovis
RLGVGYTVERRGRRRAEPLG

SEQ ID NO: 205539 - protein, 19 aa, Mycobacterium bovis
RLGVTDLQFRPEVSDGLFL

SEQ ID NO: 205540 - protein, 26 aa, Mycobacterium bovis
RLHNGTVYRWNRPVYDVVDGRPHLRL

SEQ ID NO: 205541 - protein, 17 aa, Mycobacterium bovis
RLHRVLGPLAHVNLIPL

SEQ ID NO: 205542 - protein, 21 aa, Mycobacterium bovis
RLIDRAGRWLLNYRPQPLAVG

SEQ ID NO: 205543 - protein, 18 aa, Mycobacterium bovis
RLIEEGFALYGDQPPFDL

SEQ ID NO: 205544 - protein, 20 aa, Mycobacterium bovis
RLIKRLQAILTDCTAPPASS

SEQ ID NO: 205545 - protein, 21 aa, Mycobacterium bovis
RLIPHLDRRSAACCAAMSGIY

SEQ ID NO: 205546 - protein, 24 aa, Mycobacterium bovis
RLKNEYPGKIFAILDSDHSMNHVL

SEQ ID NO: 205547 - protein, 23 aa, Mycobacterium bovis
RLLARAAAEFTRILTGVDIHPGA

SEQ ID NO: 205548 - protein, 21 aa, Mycobacterium bovis
RLLDCCQETDGAVAIVVTSAA

SEQ ID NO: 205549 - protein, 25 aa, Mycobacterium bovis
RLLETRFGVPVPNLTAWRRSVTGDM

SEQ ID NO: 205550 - protein, 19 aa, Mycobacterium bovis
RLLGGELRQGAKGGIMADA

SEQ ID NO: 205551 - protein, 25 aa, Mycobacterium bovis
RLLGKSAYHALTFGWLMSGLARAVT

SEQ ID NO: 205552 - protein, 20 aa, Mycobacterium bovis
RLLGRFVRRYGKAFTANILM

SEQ ID NO: 205553 - protein, 17 aa, Mycobacterium bovis
RLLISASEWSGRGLWAN

SEQ ID NO: 205554 - protein, 18 aa, Mycobacterium bovis
RLLPEWEPIRDLPPRDVA

SEQ ID NO: 205555 - protein, 17 aa, Mycobacterium bovis
RLLPKLRKHRGYDFFCL

SEQ ID NO: 205556 - protein, 25 aa, Mycobacterium bovis
RLLPPTFRGDIFWCQLFSEPGAGSD

SEQ ID NO: 205557 - protein, 24 aa, Mycobacterium bovis
RLLQRLGADVADYGFIETSAKQDG

SEQ ID NO: 205558 - protein, 25 aa, Mycobacterium bovis
RLLRESFADAVSWVAKNLPARPAVP

SEQ ID NO: 205559 - protein, 21 aa, Mycobacterium bovis
RLLRSGGVIVVHRAALGGRAG

SEQ ID NO: 205560 - protein, 22 aa, Mycobacterium bovis
RLMTLIHLWLVHRFKAQAVHYV

SEQ ID NO: 205561 - protein, 19 aa, Mycobacterium bovis
RLNQNYLRDIRLIRRGKID

SEQ ID NO: 205562 - protein, 23 aa, Mycobacterium bovis
RLPEFDKPALIAWSADDVFFALE

SEQ ID NO: 205563 - protein, 27 aa, Mycobacterium bovis
RLPEIPQLRWRVTGAPLGLDRPWFVED

SEQ ID NO: 205564 - protein, 19 aa, Mycobacterium bovis
RLPKPEPLRTFVARLEAAL

SEQ ID NO: 205565 - protein, 24 aa, Mycobacterium bovis
RLPPPHRIAPVAVHAYLADITSSN

SEQ ID NO: 205566 - protein, 23 aa, Mycobacterium bovis
RLPQKVGIGLARRMSLTGDYLSA

SEQ ID NO: 205567 - protein, 20 aa, Mycobacterium bovis
RLPRKGPWQQKVIKELPQTF

SEQ ID NO: 205568 - protein, 19 aa, Mycobacterium bovis
RLPTGRRYGVVAGTGRLLE

SEQ ID NO: 205569 - protein, 20 aa, Mycobacterium bovis
RLPTVRDLAGQLGVAANTVA

SEQ ID NO: 205570 - protein, 17 aa, Mycobacterium bovis
RLQAERPGDAVLSEEAH

SEQ ID NO: 205571 - protein, 30 aa, Mycobacterium bovis
RLQLQVSLPAKRWLAQRGFDPVYGARPLRR

SEQ ID NO: 205572 - protein, 20 aa, Mycobacterium bovis
RLQVRYVIVSAVSGAMGGSA

SEQ ID NO: 205573 - protein, 21 aa, Mycobacterium bovis
RLRAEAFTTPELMSAAEIADE

SEQ ID NO: 205574 - protein, 24 aa, Mycobacterium bovis
RLRDGRWHWHWDPAMMTAPGHDPQ

SEQ ID NO: 205575 - protein, 19 aa, Mycobacterium bovis
RLRELTGAGMLACKNALAE

SEQ ID NO: 205576 - protein, 22 aa, Mycobacterium bovis
RLRGVCKRYGSITAVSNLDLDV

SEQ ID NO: 205577 - protein, 20 aa, Mycobacterium bovis
RLRHAGGVAAAIARAGGPEL

SEQ ID NO: 205578 - protein, 21 aa, Mycobacterium bovis
RLRIVKRDVAAAIFDSHGLSV

SEQ ID NO: 205579 - protein, 19 aa, Mycobacterium bovis
RLRKPTVLVIDQIPDREGE

SEQ ID NO: 205580 - protein, 25 aa, Mycobacterium bovis
RLRPDQRVAFVLHDGFAVPFAEVAE

SEQ ID NO: 205581 - protein, 22 aa, Mycobacterium bovis
RLRPQSAMSFRELLTATRDIAS

SEQ ID NO: 205582 - protein, 20 aa, Mycobacterium bovis
RLRPSGRGTDVWADLHPTAD

SEQ ID NO: 205583 - protein, 20 aa, Mycobacterium bovis
RLRQAGTFADAALRRVLEVI

SEQ ID NO: 205584 - protein, 21 aa, Mycobacterium bovis
RLRRHTRLRKKLSGTAERPRL

SEQ ID NO: 205585 - protein, 23 aa, Mycobacterium bovis
RLRRRDMGVGELLGMVQAGLNHT

SEQ ID NO: 205586 - protein, 24 aa, Mycobacterium bovis
RLRRRGPVHVVDWHNVAGLTPSAL

SEQ ID NO: 205587 - protein, 22 aa, Mycobacterium bovis
RLRSDPSIEFVDRFAEQLAGVR

SEQ ID NO: 205588 - protein, 19 aa, Mycobacterium bovis
RLRWKGYLKPGSRDDASEI

SEQ ID NO: 205589 - protein, 22 aa, Mycobacterium bovis
RLSALARNAAELALIPDTNHLE

SEQ ID NO: 205590 - protein, 24 aa, Mycobacterium bovis
RLSDGQARMWFVQMADPSGALLNI

SEQ ID NO: 205591 - protein, 18 aa, Mycobacterium bovis
RLSFGRFGDEPALTASDD

SEQ ID NO: 205592 - protein, 18 aa, Mycobacterium bovis
RLSIPFTTGLLVGIGETL

SEQ ID NO: 205593 - protein, 19 aa, Mycobacterium bovis
RLSLTDFPPNFNILHIDGN

SEQ ID NO: 205594 - protein, 20 aa, Mycobacterium bovis
RLSPYLALHGICRWGGSDSC

SEQ ID NO: 205595 - protein, 19 aa, Mycobacterium bovis
RLSRRILHQLYLGYPDSAA

SEQ ID NO: 205596 - protein, 20 aa, Mycobacterium bovis
RLSSLVGHGRARAMLLSAEK

SEQ ID NO: 205597 - protein, 17 aa, Mycobacterium bovis
RLSTELSSLAALAYATR

SEQ ID NO: 205598 - protein, 19 aa, Mycobacterium bovis
RLTCVFVDHGLLRAGERAQ

SEQ ID NO: 205599 - protein, 25 aa, Mycobacterium bovis
RLTDPKAGPLIAVKLHILTRKTLGG

SEQ ID NO: 205600 - protein, 17 aa, Mycobacterium bovis
RLTKVLGLPGPHRRTQR

SEQ ID NO: 205601 - protein, 18 aa, Mycobacterium bovis
RLTPPVPSIPGRRSKPTI

SEQ ID NO: 205602 - protein, 24 aa, Mycobacterium bovis
RLTSCGRPTLFARVALLDEHGKPV

SEQ ID NO: 205603 - protein, 18 aa, Mycobacterium bovis
RLTVGAFAHEGPMAARLG

SEQ ID NO: 205604 - protein, 26 aa, Mycobacterium bovis
RLVDGDIIWAPAIDGAFVLTTRGGDF

SEQ ID NO: 205605 - protein, 18 aa, Mycobacterium bovis
RLVDLGVIRGFYTDIDPV

SEQ ID NO: 205606 - protein, 17 aa, Mycobacterium bovis
RLVTSCEHFHRQAVGIV

SEQ ID NO: 205607 - protein, 18 aa, Mycobacterium bovis
RLWQEVAGLPAERIQRRG

SEQ ID NO: 205608 - protein, 25 aa, Mycobacterium bovis
RLWQRLCTELELPALHVPPEHGGLG

SEQ ID NO: 205609 - protein, 18 aa, Mycobacterium bovis
RLYHQRLPLDMATPVIDG

SEQ ID NO: 205610 - protein, 19 aa, Mycobacterium bovis
RLYREAPLMGIWEGSGNVS

SEQ ID NO: 205611 - protein, 19 aa, Mycobacterium bovis
RMAAKLAGFGYVVLLPDVY

SEQ ID NO: 205612 - protein, 22 aa, Mycobacterium bovis
RMASLRGLLKFRTGVRPPVPLD

SEQ ID NO: 205613 - protein, 28 aa, Mycobacterium bovis
RMEADWEASYLLSLRAAWQADNNIPNSK

SEQ ID NO: 205614 - protein, 23 aa, Mycobacterium bovis
RMLAEHRLPGLLVTAGAGKQYAV

SEQ ID NO: 205615 - protein, 18 aa, Mycobacterium bovis
RMLMDAAIFKDTLIMSYE

SEQ ID NO: 205616 - protein, 19 aa, Mycobacterium bovis
RMNGGFFPSVREYSVRYGL

SEQ ID NO: 205617 - protein, 18 aa, Mycobacterium bovis
RMNSMAFDVMVPLKEALA

SEQ ID NO: 205618 - protein, 19 aa, Mycobacterium bovis
RMPLHPVAIELLREVGPMA

SEQ ID NO: 205619 - protein, 23 aa, Mycobacterium bovis
RMQGRVGFEVKIHRIGADGAAVL

SEQ ID NO: 205620 - protein, 19 aa, Mycobacterium bovis
RMRCAHVLTDDSGYLYTRY

SEQ ID NO: 205621 - protein, 18 aa, Mycobacterium bovis
RMRGAGGSDLDTTRLMPA

SEQ ID NO: 205622 - protein, 18 aa, Mycobacterium bovis
RMSKRAGTVLTLDDLVEA

SEQ ID NO: 205623 - protein, 22 aa, Mycobacterium bovis
RMTILANRWRAYGFDLDMNELV

SEQ ID NO: 205624 - protein, 24 aa, Mycobacterium bovis
RMVGRNVLHALGFDAFGLPAEQYA

SEQ ID NO: 205625 - protein, 20 aa, Mycobacterium bovis
RMVIAPWLLAPGILSDRVRG

SEQ ID NO: 205626 - protein, 21 aa, Mycobacterium bovis
RMVIPRPGGLTDIGYLTALLR

SEQ ID NO: 205627 - protein, 19 aa, Mycobacterium bovis
RMYCGPGSGPMLAAAAAWD

SEQ ID NO: 205628 - protein, 25 aa, Mycobacterium bovis
RNADEISRALTLLAELWSRYHNVLV

SEQ ID NO: 205629 - protein, 24 aa, Mycobacterium bovis
RNAESDSGWVLHARGVLGAKAVAP

SEQ ID NO: 205630 - protein, 32 aa, Mycobacterium bovis
RNAFAQLVMSNWFGLNAPLIAAVEGAYEQMWA

SEQ ID NO: 205631 - protein, 20 aa, Mycobacterium bovis
RNAKARLLRDNIVVAENLSI

SEQ ID NO: 205632 - protein, 23 aa, Mycobacterium bovis
RNAKLASIPVGFAGRAALGLGKR

SEQ ID NO: 205633 - protein, 25 aa, Mycobacterium bovis
RNDVCPDKLTWIMPRDSWLIDRATL

SEQ ID NO: 205634 - protein, 26 aa, Mycobacterium bovis
RNEDSRWTVQLAWKAGRSDNLAHFRF

SEQ ID NO: 205635 - protein, 33 aa, Mycobacterium bovis
RNEEDPRWRFGVPPANNANYAWIQHILYKLAPG

SEQ ID NO: 205636 - protein, 23 aa, Mycobacterium bovis
RNEHKRHRYAFTPFGGGVHKCIG

SEQ ID NO: 205637 - protein, 21 aa, Mycobacterium bovis
RNFLLPRGLAIVASRGAQKQA

SEQ ID NO: 205638 - protein, 17 aa, Mycobacterium bovis
RNFSRFLATKAHDITRV

SEQ ID NO: 205639 - protein, 21 aa, Mycobacterium bovis
RNGERYQFLRWGQGAFDDFKV

SEQ ID NO: 205640 - protein, 25 aa, Mycobacterium bovis
RNHVLDYLAAKGWQPEGVSLAELFR

SEQ ID NO: 205641 - protein, 26 aa, Mycobacterium bovis
RNILESFKLLTNVSRLFAQRCIAGLT

SEQ ID NO: 205642 - protein, 24 aa, Mycobacterium bovis
RNIWSGTAKFLFTRTTVGEIGILP

SEQ ID NO: 205643 - protein, 20 aa, Mycobacterium bovis
RNLMAIMTRVTWGCEPDDVS

SEQ ID NO: 205644 - protein, 17 aa, Mycobacterium bovis
RNLPTPSGNTFEWDPNS

SEQ ID NO: 205645 - protein, 18 aa, Mycobacterium bovis
RNMWRFWYQIPMSLPVIG

SEQ ID NO: 205646 - protein, 24 aa, Mycobacterium bovis
RNNIERMTWRSCRAGDFIDICNLK

SEQ ID NO: 205647 - protein, 19 aa, Mycobacterium bovis
RNNVVLSRRAWLEQTQSEV

SEQ ID NO: 205648 - protein, 19 aa, Mycobacterium bovis
RNPGSPAERLRALRRACAA

SEQ ID NO: 205649 - protein, 20 aa, Mycobacterium bovis
RNQAPLSFPIPGWNICVDFP

SEQ ID NO: 205650 - protein, 23 aa, Mycobacterium bovis
RNQIELFTALLLSLPGSPVLYYG

SEQ ID NO: 205651 - protein, 22 aa, Mycobacterium bovis
RNRISGTLGVRFARSGETAVTL

SEQ ID NO: 205652 - protein, 23 aa, Mycobacterium bovis
RNRRGELEMSVVMVIANHPDLAA

SEQ ID NO: 205653 - protein, 18 aa, Mycobacterium bovis
RNVSRGLVDVALFAIAQV

SEQ ID NO: 205654 - protein, 21 aa, Mycobacterium bovis
RNYITGLSCHGAIVVGGSSGA

SEQ ID NO: 205655 - protein, 18 aa, Mycobacterium bovis
RPAALMVPDGVLRARKLP

SEQ ID NO: 205656 - protein, 19 aa, Mycobacterium bovis
RPACGVCVLAKDCPSFGLG

SEQ ID NO: 205657 - protein, 22 aa, Mycobacterium bovis
RPAEEMLYLAMEDFRVDVVVGK

SEQ ID NO: 205658 - protein, 17 aa, Mycobacterium bovis
RPAGIWAYEAHRVAHRV

SEQ ID NO: 205659 - protein, 19 aa, Mycobacterium bovis
RPAPSELLVAVHACGVCRT

SEQ ID NO: 205660 - protein, 21 aa, Mycobacterium bovis
RPCDAPGWFLYLTDIPRAGVE

SEQ ID NO: 205661 - protein, 17 aa, Mycobacterium bovis
RPDAIVFTGDLADKGEP

SEQ ID NO: 205662 - protein, 22 aa, Mycobacterium bovis
RPDETVPCLTQRQVLDQAPDAV

SEQ ID NO: 205663 - protein, 21 aa, Mycobacterium bovis
RPDIMIVVGGVIPPGDFDELY

SEQ ID NO: 205664 - protein, 24 aa, Mycobacterium bovis
RPDPDWDGRTGLVTDLLDERMLAS

SEQ ID NO: 205665 - protein, 20 aa, Mycobacterium bovis
RPDPPGPHLLVLARGPEGYR

SEQ ID NO: 205666 - protein, 17 aa, Mycobacterium bovis
RPDRAIETNVEFWAAVV

SEQ ID NO: 205667 - protein, 24 aa, Mycobacterium bovis
RPDRFKAISQRGTHYKVIEGIEAV

SEQ ID NO: 205668 - protein, 29 aa, Mycobacterium bovis
RPDRSTTLALRWLVGYSRQRREKTMIERL

SEQ ID NO: 205669 - protein, 19 aa, Mycobacterium bovis
RPDVLVAMNPAALKANIGD

SEQ ID NO: 205670 - protein, 24 aa, Mycobacterium bovis
RPEARWRQAREWLGERGYDSTLSY

SEQ ID NO: 205671 - protein, 21 aa, Mycobacterium bovis
RPEDLRFLVRLARQQGERLGR

SEQ ID NO: 205672 - protein, 19 aa, Mycobacterium bovis
RPEETRMTFGARLQSPLAE

SEQ ID NO: 205673 - protein, 19 aa, Mycobacterium bovis
RPEFLNRIDDIIVFHQLTR

SEQ ID NO: 205674 - protein, 25 aa, Mycobacterium bovis
RPELKLPDLELIFAPAPFYDEALVP

SEQ ID NO: 205675 - protein, 17 aa, Mycobacterium bovis
RPELRAVTVDGDLVGAG

SEQ ID NO: 205676 - protein, 19 aa, Mycobacterium bovis
RPEVARRWLAALSADQIGI

SEQ ID NO: 205677 - protein, 21 aa, Mycobacterium bovis
RPEVESVLAGVGRLFAEGVAV

SEQ ID NO: 205678 - protein, 19 aa, Mycobacterium bovis
RPFGVPFIHIPATRDTRTE

SEQ ID NO: 205679 - protein, 18 aa, Mycobacterium bovis
RPFHIDWDLAAAEKGGYE

SEQ ID NO: 205680 - protein, 24 aa, Mycobacterium bovis
RPFYELVSRVGLERARRVVDLGCG

SEQ ID NO: 205681 - protein, 19 aa, Mycobacterium bovis
RPFYFGVLTWYMDRVLELV

SEQ ID NO: 205682 - protein, 21 aa, Mycobacterium bovis
RPGAQIKYLVRMRSWPGGHAR

SEQ ID NO: 205683 - protein, 24 aa, Mycobacterium bovis
RPGDIAIVSMHWGSNWGYATAPGD

SEQ ID NO: 205684 - protein, 17 aa, Mycobacterium bovis
RPGDTLFAISTSGNSMS

SEQ ID NO: 205685 - protein, 19 aa, Mycobacterium bovis
RPGEGIVTLEHIARNQHGE

SEQ ID NO: 205686 - protein, 18 aa, Mycobacterium bovis
RPGESDGTCGRGEPQAGR

SEQ ID NO: 205687 - protein, 17 aa, Mycobacterium bovis
RPGETVLAASLTRTPGG

SEQ ID NO: 205688 - protein, 26 aa, Mycobacterium bovis
RPGEVQRFPADISLAKSIGFQPQVEI

SEQ ID NO: 205689 - protein, 27 aa, Mycobacterium bovis
RPGGTIGVISWTCEGFFGRMLATIRPY

SEQ ID NO: 205690 - protein, 25 aa, Mycobacterium bovis
RPGNYRYAINNSFGFGGHNVAIAFG

SEQ ID NO: 205691 - protein, 19 aa, Mycobacterium bovis
RPGPEFRPSEVARLGYLAG

SEQ ID NO: 205692 - protein, 18 aa, Mycobacterium bovis
RPGPPPARTGADRTSAVL

SEQ ID NO: 205693 - protein, 20 aa, Mycobacterium bovis
RPGQYEAPLGITLRELLDYA

SEQ ID NO: 205694 - protein, 28 aa, Mycobacterium bovis
RPHIEKRFSMPWGHPARRMREFVAALRA

SEQ ID NO: 205695 - protein, 19 aa, Mycobacterium bovis
RPHLRLENRVLPAGPTVVD

SEQ ID NO: 205696 - protein, 18 aa, Mycobacterium bovis
RPHPRTGIIEGGPNTNVL

SEQ ID NO: 205697 - protein, 18 aa, Mycobacterium bovis
RPHVSLAVAERIAPEVDE

SEQ ID NO: 205698 - protein, 19 aa, Mycobacterium bovis
RPHVVLKGGAIAWAAMGDA

SEQ ID NO: 205699 - protein, 18 aa, Mycobacterium bovis
RPIFVTGLVRTGTTALHR

SEQ ID NO: 205700 - protein, 23 aa, Mycobacterium bovis
RPIPGPLKWDLTRGVATDTPESL

SEQ ID NO: 205701 - protein, 18 aa, Mycobacterium bovis
RPKINTTMHLLDDSLQPV

SEQ ID NO: 205702 - protein, 25 aa, Mycobacterium bovis
RPKKLFRPKVPVTIVVGERIEPTLP

SEQ ID NO: 205703 - protein, 17 aa, Mycobacterium bovis
RPLAAPVVRKLAKELAV

SEQ ID NO: 205704 - protein, 19 aa, Mycobacterium bovis
RPLAIPVIVLAGQVSLDKS

SEQ ID NO: 205705 - protein, 18 aa, Mycobacterium bovis
RPLDAALRGLRRVSRARS

SEQ ID NO: 205706 - protein, 25 aa, Mycobacterium bovis
RPLGTLRCWRHSDIGPARGIVVTPA

SEQ ID NO: 205707 - protein, 18 aa, Mycobacterium bovis
RPLMSDAMLRVFFEAYEI

SEQ ID NO: 205708 - protein, 18 aa, Mycobacterium bovis
RPLPSAWLNYAALDVELL

SEQ ID NO: 205709 - protein, 17 aa, Mycobacterium bovis
RPLRPLAPVAHLDFDEP

SEQ ID NO: 205710 - protein, 24 aa, Mycobacterium bovis
RPLSCAIAAVSVGVVDGRIRVDLP

SEQ ID NO: 205711 - protein, 20 aa, Mycobacterium bovis
RPLYRFPVFGFFALSIGAAA

SEQ ID NO: 205712 - protein, 26 aa, Mycobacterium bovis
RPLYYLEMPPALFAPIVENLANVRLL

SEQ ID NO: 205713 - protein, 19 aa, Mycobacterium bovis
RPMHEKIVGRIAVSDLARR

SEQ ID NO: 205714 - protein, 18 aa, Mycobacterium bovis
RPMILKRFVKGISAEAVF

SEQ ID NO: 205715 - protein, 18 aa, Mycobacterium bovis
RPMPPEVADHVAAVTLFG

SEQ ID NO: 205716 - protein, 29 aa, Mycobacterium bovis
RPNPSRLCDWCPHQQRCPAFGGTPPPYPG

SEQ ID NO: 205717 - protein, 19 aa, Mycobacterium bovis
RPPGRKDPAAFVLENFTPA

SEQ ID NO: 205718 - protein, 19 aa, Mycobacterium bovis
RPPGRPEVIAKLDAEGLLP

SEQ ID NO: 205719 - protein, 21 aa, Mycobacterium bovis
RPPLMKRIVLQTGARLSRRGR

SEQ ID NO: 205720 - protein, 18 aa, Mycobacterium bovis
RPPRETWESNPLYRQLDA

SEQ ID NO: 205721 - protein, 24 aa, Mycobacterium bovis
RPPRGRVTLHWGPRYDAHLLIPEV

SEQ ID NO: 205722 - protein, 17 aa, Mycobacterium bovis
RPPRQVPGASYWYAHTD

SEQ ID NO: 205723 - protein, 22 aa, Mycobacterium bovis
RPPRTRSGAALPRSSDPVTDIA

SEQ ID NO: 205724 - protein, 24 aa, Mycobacterium bovis
RPPVPLDAAILFAPVGDLVLPALE

SEQ ID NO: 205725 - protein, 22 aa, Mycobacterium bovis
RPPVRRLGGGLVEIPRAPDIDP

SEQ ID NO: 205726 - protein, 18 aa, Mycobacterium bovis
RPQDGAIITGWDYPACEA

SEQ ID NO: 205727 - protein, 25 aa, Mycobacterium bovis
RPQSAPFDLCIEAMGAIDTQQRLGV

SEQ ID NO: 205728 - protein, 23 aa, Mycobacterium bovis
RPRAGLIGCAFADLAEVMAGVFA

SEQ ID NO: 205729 - protein, 19 aa, Mycobacterium bovis
RPRGISVLSGTRRGYELDA

SEQ ID NO: 205730 - protein, 24 aa, Mycobacterium bovis
RPRLHSISFIFKGRPGEVYLTVTG

SEQ ID NO: 205731 - protein, 20 aa, Mycobacterium bovis
RPRMLYDYFHQLFAQVTNPP

SEQ ID NO: 205732 - protein, 18 aa, Mycobacterium bovis
RPRSPLELLDTVPDSLLR

SEQ ID NO: 205733 - protein, 19 aa, Mycobacterium bovis
RPRVFCMDEPLSNLDAKLR

SEQ ID NO: 205734 - protein, 19 aa, Mycobacterium bovis
RPSALVAIAALSRLGAVAV

SEQ ID NO: 205735 - protein, 21 aa, Mycobacterium bovis
RPSAWIAEGLLVYLSAEAQQR

SEQ ID NO: 205736 - protein, 17 aa, Mycobacterium bovis
RPSSSRDTAFFWDGVKA

SEQ ID NO: 205737 - protein, 31 aa, Mycobacterium bovis
RPSYSLAEIRHWLQIFVQRFYSFSQFKRSAL

SEQ ID NO: 205738 - protein, 20 aa, Mycobacterium bovis
RPTELHPFVELTGPRHTAPA

SEQ ID NO: 205739 - protein, 19 aa, Mycobacterium bovis
RPVHDPARYDQIWKDHVLA

SEQ ID NO: 205740 - protein, 17 aa, Mycobacterium bovis
RPVKSSFREGLTVLEYF

SEQ ID NO: 205741 - protein, 24 aa, Mycobacterium bovis
RPVMVKAQVKIGGRGKAGGVKYAA

SEQ ID NO: 205742 - protein, 17 aa, Mycobacterium bovis
RPVPAGDTMVFFGGIEP

SEQ ID NO: 205743 - protein, 19 aa, Mycobacterium bovis
RPVPFIIGVAGSVAVGKST

SEQ ID NO: 205744 - protein, 26 aa, Mycobacterium bovis
RPVPHWPKYWIQALAKHFQRQLKPSP

SEQ ID NO: 205745 - protein, 25 aa, Mycobacterium bovis
RPVPRLLAMGLLRRIDAETVILPRH

SEQ ID NO: 205746 - protein, 20 aa, Mycobacterium bovis
RPVQPAAVALRLVQTTGADT

SEQ ID NO: 205747 - protein, 26 aa, Mycobacterium bovis
RPVWDVEPWDRWLRDFFGPAATTDWY

SEQ ID NO: 205748 - protein, 22 aa, Mycobacterium bovis
RPYLQLCDEMRALPVPREVLED

SEQ ID NO: 205749 - protein, 23 aa, Mycobacterium bovis
RPYQQRGLAWLAFLSSLGLGSCL

SEQ ID NO: 205750 - protein, 19 aa, Mycobacterium bovis
RPYYNAIVWQDTRTDRIAS

SEQ ID NO: 205751 - protein, 17 aa, Mycobacterium bovis
RQAIQIPAAAHCALEYQ

SEQ ID NO: 205752 - protein, 20 aa, Mycobacterium bovis
RQALADGIIDCVATDHAPHA

SEQ ID NO: 205753 - protein, 19 aa, Mycobacterium bovis
RQAMLPGHAVVLHPGPMVR

SEQ ID NO: 205754 - protein, 19 aa, Mycobacterium bovis
RQDIDDIFWLQATIAQELA

SEQ ID NO: 205755 - protein, 17 aa, Mycobacterium bovis
RQDIDWITFAQNPSGPR

SEQ ID NO: 205756 - protein, 28 aa, Mycobacterium bovis
RQDVAPVDGCIRIGLRYINEIRASLAEP

SEQ ID NO: 205757 - protein, 18 aa, Mycobacterium bovis
RQFDEWDVCIVPRERLRL

SEQ ID NO: 205758 - protein, 21 aa, Mycobacterium bovis
RQFVMATLFHKTRSWSNLLKV

SEQ ID NO: 205759 - protein, 18 aa, Mycobacterium bovis
RQGIRVNALCPGPVNTPL

SEQ ID NO: 205760 - protein, 18 aa, Mycobacterium bovis
RQGPGVLQHPDLVILRGR

SEQ ID NO: 205761 - protein, 25 aa, Mycobacterium bovis
RQHAPTLDGARDWARQQIDALPPEL

SEQ ID NO: 205762 - protein, 19 aa, Mycobacterium bovis
RQHLAQAWRKHIGPPRQLP

SEQ ID NO: 205763 - protein, 17 aa, Mycobacterium bovis
RQIPYTLACDLLLTGRH

SEQ ID NO: 205764 - protein, 19 aa, Mycobacterium bovis
RQLADALGATVLLKGNVTV

SEQ ID NO: 205765 - protein, 17 aa, Mycobacterium bovis
RQLFQDIYVWAGDLRTV

SEQ ID NO: 205766 - protein, 18 aa, Mycobacterium bovis
RQLGFCRSTPPTIPHSRN

SEQ ID NO: 205767 - protein, 24 aa, Mycobacterium bovis
RQLNAVAVAAGWRNDDGGEFLDNY

SEQ ID NO: 205768 - protein, 24 aa, Mycobacterium bovis
RQLPIVCGLDLTRRVAMTPDILAR

SEQ ID NO: 205769 - protein, 25 aa, Mycobacterium bovis
RQLVELVCFHAAIVLGRKSSHDIDP

SEQ ID NO: 205770 - protein, 18 aa, Mycobacterium bovis
RQMIADRELETWLVVDMS

SEQ ID NO: 205771 - protein, 20 aa, Mycobacterium bovis
RQPGRLRIALSTRVPTPLPV

SEQ ID NO: 205772 - protein, 25 aa, Mycobacterium bovis
RQPPPRLANLLPLIRPHEHMPDSVR

SEQ ID NO: 205773 - protein, 25 aa, Mycobacterium bovis
RQPQAIGCAGWRAIDAAEIARGSAD

SEQ ID NO: 205774 - protein, 25 aa, Mycobacterium bovis
RQPVTRARVSAVRGVNVDAVMRTLL

SEQ ID NO: 205775 - protein, 23 aa, Mycobacterium bovis
RQQRGRFLCIADFIRSRELAAER

SEQ ID NO: 205776 - protein, 23 aa, Mycobacterium bovis
RQQTMRASVDWSHALLTGPEQVL

SEQ ID NO: 205777 - protein, 26 aa, Mycobacterium bovis
RQRENLSWSAPRLHLVDLQYSDVRLD

SEQ ID NO: 205778 - protein, 30 aa, Mycobacterium bovis
RQRHEAGLRRCLRPRPAVATELDLASNDYL

SEQ ID NO: 205779 - protein, 19 aa, Mycobacterium bovis
RQRHWVEPNHTVWAQAPGA

SEQ ID NO: 205780 - protein, 32 aa, Mycobacterium bovis
RQRLPRGRCTPIAAWLAGLGLFTKRSHEKCVP

SEQ ID NO: 205781 - protein, 19 aa, Mycobacterium bovis
RQRSWFRRDHRVHWLDAGV

SEQ ID NO: 205782 - protein, 19 aa, Mycobacterium bovis
RQRVAAAGFGHRVEIDLCD

SEQ ID NO: 205783 - protein, 17 aa, Mycobacterium bovis
RQRVLVISTGSELASPG

SEQ ID NO: 205784 - protein, 39 aa, Mycobacterium bovis
RQVAERLLPALGFRVRFGVLVIRCALCTDTVKRLGTLPN

SEQ ID NO: 205785 - protein, 17 aa, Mycobacterium bovis
RQVISLHGADPARIDVV

SEQ ID NO: 205786 - protein, 25 aa, Mycobacterium bovis
RQYGIEPQQLFGYLQERNQLPTMFA

SEQ ID NO: 205787 - protein, 24 aa, Mycobacterium bovis
RRAARRARCGVARRVPLIRDETGS

SEQ ID NO: 205788 - protein, 17 aa, Mycobacterium bovis
RRADARLLAGQRRLASA

SEQ ID NO: 205789 - protein, 24 aa, Mycobacterium bovis
RRAEKLERLGLWGLMPRTVYDTLI

SEQ ID NO: 205790 - protein, 22 aa, Mycobacterium bovis
RRAELIERFGLDPTKKARTYSK

SEQ ID NO: 205791 - protein, 18 aa, Mycobacterium bovis
RRAFDMMCERALSRQTRH

SEQ ID NO: 205792 - protein, 18 aa, Mycobacterium bovis
RRAGIGVAVVSGDRSHAV

SEQ ID NO: 205793 - protein, 29 aa, Mycobacterium bovis
RRAGVPMQRIRPSLDWLIKNVGPHALASQ

SEQ ID NO: 205794 - protein, 25 aa, Mycobacterium bovis
RRAILRYPKWRVAEIDGELETVALD

SEQ ID NO: 205795 - protein, 18 aa, Mycobacterium bovis
RRAIQSFLESGVDLDDVL

SEQ ID NO: 205796 - protein, 18 aa, Mycobacterium bovis
RRALSELLRRGTRNLTGA

SEQ ID NO: 205797 - protein, 22 aa, Mycobacterium bovis
RRANVPITRRGGLSFDLRRINP

SEQ ID NO: 205798 - protein, 25 aa, Mycobacterium bovis
RRARKGEFRKLWIARINAAARLNDI

SEQ ID NO: 205799 - protein, 20 aa, Mycobacterium bovis
RRARVLMRFIELVNDTIDEL

SEQ ID NO: 205800 - protein, 24 aa, Mycobacterium bovis
RRASARPGNCVRRTDGRGSRPGCP

SEQ ID NO: 205801 - protein, 17 aa, Mycobacterium bovis
RRASAWFAENGYLHEAV

SEQ ID NO: 205802 - protein, 21 aa, Mycobacterium bovis
RRASGRRKAWLRQAINHLEKL

SEQ ID NO: 205803 - protein, 20 aa, Mycobacterium bovis
RRASKPGARLYMFEFGEHNV

SEQ ID NO: 205804 - protein, 21 aa, Mycobacterium bovis
RRATTWCRELLTATGRSSDFA

SEQ ID NO: 205805 - protein, 21 aa, Mycobacterium bovis
RRAVLCGNIGSAVLDVLDEPA

SEQ ID NO: 205806 - protein, 20 aa, Mycobacterium bovis
RRCNEADAGVPARRRGRGVA

SEQ ID NO: 205807 - protein, 17 aa, Mycobacterium bovis
RRCRIPVFVELAGGIVR

SEQ ID NO: 205808 - protein, 17 aa, Mycobacterium bovis
RRDGFAVGEDYTVTDRS

SEQ ID NO: 205809 - protein, 24 aa, Mycobacterium bovis
RRDHGGVIFIDLRDASGIAQVVFR

SEQ ID NO: 205810 - protein, 20 aa, Mycobacterium bovis
RRDKRARLLAQGRDPYPVAV

SEQ ID NO: 205811 - protein, 22 aa, Mycobacterium bovis
RREALPRVQLWPIGPDGNYGEP

SEQ ID NO: 205812 - protein, 26 aa, Mycobacterium bovis
RREDKPFWWAHFDRLNYPVDEWSDST

SEQ ID NO: 205813 - protein, 28 aa, Mycobacterium bovis
RREFDRIKLGPSLWHRDFHDAVIVECPD

SEQ ID NO: 205814 - protein, 29 aa, Mycobacterium bovis
RRELSALVARSPFGQGAAWPVVQTVQRDG

SEQ ID NO: 205815 - protein, 21 aa, Mycobacterium bovis
RRELVARLATGWVLEEVHDFE

SEQ ID NO: 205816 - protein, 20 aa, Mycobacterium bovis
RRESRFPISEIIAQTPPIPD

SEQ ID NO: 205817 - protein, 21 aa, Mycobacterium bovis
RRFARHYVHAGMIGWDGHKMS

SEQ ID NO: 205818 - protein, 23 aa, Mycobacterium bovis
RRFDRSIGYFWTATHQQIYRTLR

SEQ ID NO: 205819 - protein, 20 aa, Mycobacterium bovis
RRFLESEGWIAWSGPAISEL

SEQ ID NO: 205820 - protein, 24 aa, Mycobacterium bovis
RRFLPRCAAGAISAFLLTEPDVGS

SEQ ID NO: 205821 - protein, 21 aa, Mycobacterium bovis
RRFNFPDGETHTWAYWRAPLQ

SEQ ID NO: 205822 - protein, 20 aa, Mycobacterium bovis
RRFPDAAVVRLERDYRSTPQ

SEQ ID NO: 205823 - protein, 25 aa, Mycobacterium bovis
RRFPEELGKMGFVFNFITYGGHQID

SEQ ID NO: 205824 - protein, 18 aa, Mycobacterium bovis
RRFRDAFTATAHFQVNEA

SEQ ID NO: 205825 - protein, 26 aa, Mycobacterium bovis
RRFSGSSGQLAREWVAAGARIVGGCC

SEQ ID NO: 205826 - protein, 25 aa, Mycobacterium bovis
RRFTLTVGLMLPRRAFLPPPHVDSA

SEQ ID NO: 205827 - protein, 19 aa, Mycobacterium bovis
RRGDGWVKLVGDWIDRQIG

SEQ ID NO: 205828 - protein, 24 aa, Mycobacterium bovis
RRGHRKLVRFQARRAIGPIRPTSA

SEQ ID NO: 205829 - protein, 20 aa, Mycobacterium bovis
RRGIGKVDRAALVRRFAGEA

SEQ ID NO: 205830 - protein, 18 aa, Mycobacterium bovis
RRGIMFADVPWRGNRINR

SEQ ID NO: 205831 - protein, 28 aa, Mycobacterium bovis
RRGPAHSAFTLPELIGLTAGADVVLDPG

SEQ ID NO: 205832 - protein, 17 aa, Mycobacterium bovis
RRGRDRIIVGYEGATVL

SEQ ID NO: 205833 - protein, 19 aa, Mycobacterium bovis
RRGRPEWIAAGQFAQRYEQ

SEQ ID NO: 205834 - protein, 17 aa, Mycobacterium bovis
RRGSHFAELDRERSGVR

SEQ ID NO: 205835 - protein, 17 aa, Mycobacterium bovis
RRGVFGGPTPAPRGLAT

SEQ ID NO: 205836 - protein, 18 aa, Mycobacterium bovis
RRHGTLLAAHFGEDKGMR

SEQ ID NO: 205837 - protein, 27 aa, Mycobacterium bovis
RRHLSYKTGWYGSALVVADRWFPSLSV

SEQ ID NO: 205838 - protein, 23 aa, Mycobacterium bovis
RRHLSYKTGWYGSQLVVADRWFP

SEQ ID NO: 205839 - protein, 26 aa, Mycobacterium bovis
RRHLSYKTGWYGSSLVVADRWFPSSK

SEQ ID NO: 205840 - protein, 20 aa, Mycobacterium bovis
RRIAAGIVRRRAKTPFTSTA

SEQ ID NO: 205841 - protein, 17 aa, Mycobacterium bovis
RRIAEEIGYPVLVRPSY

SEQ ID NO: 205842 - protein, 18 aa, Mycobacterium bovis
RRIEPLLATLRAIAVDVD

SEQ ID NO: 205843 - protein, 21 aa, Mycobacterium bovis
RRILRRLGYAAYGWGLGRNIG

SEQ ID NO: 205844 - protein, 18 aa, Mycobacterium bovis
RRITLTLPAIQRSREVWL

SEQ ID NO: 205845 - protein, 19 aa, Mycobacterium bovis
RRKAMEELHRIRKEGEAGE

SEQ ID NO: 205846 - protein, 20 aa, Mycobacterium bovis
RRKAYNWAVATLKADIEAWR

SEQ ID NO: 205847 - protein, 20 aa, Mycobacterium bovis
RRKAYNWTVATLKADIDAWQ

SEQ ID NO: 205848 - protein, 20 aa, Mycobacterium bovis
RRKAYNWTVATLKADIQAWH

SEQ ID NO: 205849 - protein, 20 aa, Mycobacterium bovis
RRKLISVLRHRGRILQSAPD

SEQ ID NO: 205850 - protein, 18 aa, Mycobacterium bovis
RRKLVNAGFTRKRVKDKE

SEQ ID NO: 205851 - protein, 21 aa, Mycobacterium bovis
RRKPFSVVLFDEIEKAHQEIY

SEQ ID NO: 205852 - protein, 23 aa, Mycobacterium bovis
RRLAECYRRTRAVRRDAIHCCCR

SEQ ID NO: 205853 - protein, 23 aa, Mycobacterium bovis
RRLAERPANLAFFLRALTDRRRA

SEQ ID NO: 205854 - protein, 26 aa, Mycobacterium bovis
RRLAIPELPDAVFIESLRQLIAVDKA

SEQ ID NO: 205855 - protein, 19 aa, Mycobacterium bovis
RRLALLLTFPRFLPTTGPI

SEQ ID NO: 205856 - protein, 22 aa, Mycobacterium bovis
RRLARECPVEADLVIGVPESGT

SEQ ID NO: 205857 - protein, 20 aa, Mycobacterium bovis
RRLDGIPLAIEFAAARVRSM

SEQ ID NO: 205858 - protein, 20 aa, Mycobacterium bovis
RRLDGMPLAIELAAARLRSL

SEQ ID NO: 205859 - protein, 24 aa, Mycobacterium bovis
RRLFADLMWVYPFGDRHTAMTVLV

SEQ ID NO: 205860 - protein, 20 aa, Mycobacterium bovis
RRLFAGGGFGGRRFDSGFGG

SEQ ID NO: 205861 - protein, 21 aa, Mycobacterium bovis
RRLGADAGVPVIFLHHLGAVL

SEQ ID NO: 205862 - protein, 36 aa, Mycobacterium bovis
RRLGLKRLLRSDILPISFGFPFGFSAAIPPNLPLPA

SEQ ID NO: 205863 - protein, 19 aa, Mycobacterium bovis
RRLHGCGLEIEWVGTGKRV

SEQ ID NO: 205864 - protein, 18 aa, Mycobacterium bovis
RRLLSWARAAGFDDVTPT

SEQ ID NO: 205865 - protein, 18 aa, Mycobacterium bovis
RRLMTWRGGYHGDTFLAM

SEQ ID NO: 205866 - protein, 20 aa, Mycobacterium bovis
RRLPEELARVDALLDDPAFF

SEQ ID NO: 205867 - protein, 26 aa, Mycobacterium bovis
RRLRAKARLKFLIKDWGIAKFREVLE

SEQ ID NO: 205868 - protein, 20 aa, Mycobacterium bovis
RRLREMRDLLAYMENVVSDA

SEQ ID NO: 205869 - protein, 20 aa, Mycobacterium bovis
RRLRHACALIADNLTQPLTL

SEQ ID NO: 205870 - protein, 25 aa, Mycobacterium bovis
RRLRKEIFELYGYTAVVHVLSASGI

SEQ ID NO: 205871 - protein, 19 aa, Mycobacterium bovis
RRLSRLPVVAAVGKYDATL

SEQ ID NO: 205872 - protein, 19 aa, Mycobacterium bovis
RRLSTLGIVPVEVYRQRRA

SEQ ID NO: 205873 - protein, 18 aa, Mycobacterium bovis
RRLVGLFCQQGHFDRSKA

SEQ ID NO: 205874 - protein, 20 aa, Mycobacterium bovis
RRMPWRLHVFTPVHDVPGVS

SEQ ID NO: 205875 - protein, 25 aa, Mycobacterium bovis
RRMRQEITEVIALQERLGLDVLVHG

SEQ ID NO: 205876 - protein, 20 aa, Mycobacterium bovis
RRNDPLLGRHVIITGASSGI

SEQ ID NO: 205877 - protein, 23 aa, Mycobacterium bovis
RRNRGAAARCRICNNELNTSAAV

SEQ ID NO: 205878 - protein, 30 aa, Mycobacterium bovis
RRPAVPHLVSLPGYPFARQRHWVEPNHTVW

SEQ ID NO: 205879 - protein, 20 aa, Mycobacterium bovis
RRPAYVVVMDALRRMEYRGY

SEQ ID NO: 205880 - protein, 22 aa, Mycobacterium bovis
RRPDIAVTILRLANMIGPAMDT

SEQ ID NO: 205881 - protein, 23 aa, Mycobacterium bovis
RRPEMPALLAELGLSDRQLASTG

SEQ ID NO: 205882 - protein, 28 aa, Mycobacterium bovis
RRPHRSLTSLGQWSWRTETEVDLDYHVR

SEQ ID NO: 205883 - protein, 20 aa, Mycobacterium bovis
RRPPWEVHFIEGLEGGRFAI

SEQ ID NO: 205884 - protein, 22 aa, Mycobacterium bovis
RRPTLVPVEAIEFLRGEVQYTE

SEQ ID NO: 205885 - protein, 22 aa, Mycobacterium bovis
RRRAEEAWPKIEIADVDSTGLP

SEQ ID NO: 205886 - protein, 20 aa, Mycobacterium bovis
RRRCRAKRWGGAAPVTRAGD

SEQ ID NO: 205887 - protein, 20 aa, Mycobacterium bovis
RRRFEHPAMLSADRAFAAVP

SEQ ID NO: 205888 - protein, 21 aa, Mycobacterium bovis
RRRFSTVIEFFSYTPQELIAL

SEQ ID NO: 205889 - protein, 21 aa, Mycobacterium bovis
RRRGACMAVLDVSHPDICDFV

SEQ ID NO: 205890 - protein, 17 aa, Mycobacterium bovis
RRRGHRPVRTAVLAATT

SEQ ID NO: 205891 - protein, 30 aa, Mycobacterium bovis
RRRIAPGGFRYGPAFGVELQFWVYEETVIR

SEQ ID NO: 205892 - protein, 18 aa, Mycobacterium bovis
RRRIPLVAEISNFDPEAP

SEQ ID NO: 205893 - protein, 21 aa, Mycobacterium bovis
RRRLIKYISQIDVERYRSLIE

SEQ ID NO: 205894 - protein, 17 aa, Mycobacterium bovis
RRRLRMICHGLGHVEGF

SEQ ID NO: 205895 - protein, 21 aa, Mycobacterium bovis
RRRPLDPARRAAFETLRAVSA

SEQ ID NO: 205896 - protein, 19 aa, Mycobacterium bovis
RRRRELLRRNNLDGTLQEI

SEQ ID NO: 205897 - protein, 21 aa, Mycobacterium bovis
RRRRFDVGRGPLIRFLLIELP

SEQ ID NO: 205898 - protein, 17 aa, Mycobacterium bovis
RRRRSVVAPGLRHHHVQ

SEQ ID NO: 205899 - protein, 18 aa, Mycobacterium bovis
RRRTGWSVVVTGLATEVS

SEQ ID NO: 205900 - protein, 23 aa, Mycobacterium bovis
RRRWYPLTACLPLAPDHTNPDTP

SEQ ID NO: 205901 - protein, 18 aa, Mycobacterium bovis
RRRYVEVFAAGQGGGSKG

SEQ ID NO: 205902 - protein, 22 aa, Mycobacterium bovis
RRSAESLYDFNLATYDEGDSFD

SEQ ID NO: 205903 - protein, 18 aa, Mycobacterium bovis
RRSALMTRIAGAGAMASV

SEQ ID NO: 205904 - protein, 17 aa, Mycobacterium bovis
RRSCPECGRRFTTVETA

SEQ ID NO: 205905 - protein, 17 aa, Mycobacterium bovis
RRSEIIAAVSGDAVVVE

SEQ ID NO: 205906 - protein, 21 aa, Mycobacterium bovis
RRSGASWSDIGKSMGVTKQAA

SEQ ID NO: 205907 - protein, 17 aa, Mycobacterium bovis
RRSGLFAVLCKTDPNAT

SEQ ID NO: 205908 - protein, 25 aa, Mycobacterium bovis
RRSKFPYRWWWVALTDEAFPRLSVI

SEQ ID NO: 205909 - protein, 17 aa, Mycobacterium bovis
RRSPNCSPWPPPLTSHP

SEQ ID NO: 205910 - protein, 23 aa, Mycobacterium bovis
RRTGAFAHRYGFRHSVITRSPSA

SEQ ID NO: 205911 - protein, 23 aa, Mycobacterium bovis
RRTGATLRWYGVTDDGRIDLDSL

SEQ ID NO: 205912 - protein, 18 aa, Mycobacterium bovis
RRTGLPGSPTRGPANSIT

SEQ ID NO: 205913 - protein, 19 aa, Mycobacterium bovis
RRTLVFPPGMYWRTPDMLS

SEQ ID NO: 205914 - protein, 17 aa, Mycobacterium bovis
RRTMLSLVKTNVFGQNT

SEQ ID NO: 205915 - protein, 19 aa, Mycobacterium bovis
RRTPADAMTQGWFTGLIPI

SEQ ID NO: 205916 - protein, 25 aa, Mycobacterium bovis
RRTSAVKAFTAWAVRRGLLAGDPAA

SEQ ID NO: 205917 - protein, 18 aa, Mycobacterium bovis
RRVESRAVDGVSFRLPRA

SEQ ID NO: 205918 - protein, 20 aa, Mycobacterium bovis
RRVFAPKVTGSWRLHVATAA

SEQ ID NO: 205919 - protein, 18 aa, Mycobacterium bovis
RRVGEGFVGLRVVPWLWG

SEQ ID NO: 205920 - protein, 20 aa, Mycobacterium bovis
RRVGGDLYGSFLPGTQQNLE

SEQ ID NO: 205921 - protein, 19 aa, Mycobacterium bovis
RRVGPIIGTVAMQLPRLSR

SEQ ID NO: 205922 - protein, 20 aa, Mycobacterium bovis
RRVIHAAAPCPVQIKEQMIH

SEQ ID NO: 205923 - protein, 17 aa, Mycobacterium bovis
RRVPLGLIAGARSGDKG

SEQ ID NO: 205924 - protein, 22 aa, Mycobacterium bovis
RRVRARLARRMTAQRSTTNPVL

SEQ ID NO: 205925 - protein, 17 aa, Mycobacterium bovis
RRVRLWGDQTWRSAPEH

SEQ ID NO: 205926 - protein, 18 aa, Mycobacterium bovis
RRWPDTRSIMASMLTSHI

SEQ ID NO: 205927 - protein, 25 aa, Mycobacterium bovis
RRWWPRRYRRSSVYWRLMALDQRFG

SEQ ID NO: 205928 - protein, 18 aa, Mycobacterium bovis
RRYDWSVVASQIMRVYET

SEQ ID NO: 205929 - protein, 21 aa, Mycobacterium bovis
RRYRCYTDRLTRLSCGYSATS

SEQ ID NO: 205930 - protein, 17 aa, Mycobacterium bovis
RRYSVARRLAGLFASYA

SEQ ID NO: 205931 - protein, 18 aa, Mycobacterium bovis
RRYYRVSGADAYTMRRDS

SEQ ID NO: 205932 - protein, 20 aa, Mycobacterium bovis
RSADLADLFMLIFTSGTSGD

SEQ ID NO: 205933 - protein, 24 aa, Mycobacterium bovis
RSADLPPAVGVLVEYRGDDAAAAH

SEQ ID NO: 205934 - protein, 19 aa, Mycobacterium bovis
RSAEPRWIAAKDVAEGDFL

SEQ ID NO: 205935 - protein, 26 aa, Mycobacterium bovis
RSAIARFTAAGIRKTWVFQAFDDAHE

SEQ ID NO: 205936 - protein, 25 aa, Mycobacterium bovis
RSAREWLEHMYDKWSAELDFPVPSF

SEQ ID NO: 205937 - protein, 17 aa, Mycobacterium bovis
RSAWQCALDYARQRTQF

SEQ ID NO: 205938 - protein, 19 aa, Mycobacterium bovis
RSCGMTAIVKGLRTGTDFE

SEQ ID NO: 205939 - protein, 18 aa, Mycobacterium bovis
RSDALAWSVKLVGEHTEE

SEQ ID NO: 205940 - protein, 24 aa, Mycobacterium bovis
RSDPRPALDAIRAAVCNRHGLSVA

SEQ ID NO: 205941 - protein, 20 aa, Mycobacterium bovis
RSEGDAFGRLIMLYDPDGSD

SEQ ID NO: 205942 - protein, 18 aa, Mycobacterium bovis
RSEQDVIDVLDWCAREGI

SEQ ID NO: 205943 - protein, 24 aa, Mycobacterium bovis
RSEVLNIGDAILFYTDGLIERPGR

SEQ ID NO: 205944 - protein, 17 aa, Mycobacterium bovis
RSGAGLFGSIAQLVKVR

SEQ ID NO: 205945 - protein, 18 aa, Mycobacterium bovis
RSGAHLVRHPINLGQGAA

SEQ ID NO: 205946 - protein, 19 aa, Mycobacterium bovis
RSGARVALVAGDRDIEAGT

SEQ ID NO: 205947 - protein, 17 aa, Mycobacterium bovis
RSGECDLALAGGVTVMA

SEQ ID NO: 205948 - protein, 24 aa, Mycobacterium bovis
RSGEEMARLFAWCPEAVTAAAELG

SEQ ID NO: 205949 - protein, 23 aa, Mycobacterium bovis
RSGKHLRRLAALAAELEAVEVIV

SEQ ID NO: 205950 - protein, 22 aa, Mycobacterium bovis
RSGKLPPPEPVVYPLDQAAAAI

SEQ ID NO: 205951 - protein, 24 aa, Mycobacterium bovis
RSGKNVVTPLGWFYPSEKEAAPLE

SEQ ID NO: 205952 - protein, 24 aa, Mycobacterium bovis
RSGLAALCAAVLVSSGCARFNDAQ

SEQ ID NO: 205953 - protein, 17 aa, Mycobacterium bovis
RSGMAWCIQAFGRQEML

SEQ ID NO: 205954 - protein, 19 aa, Mycobacterium bovis
RSGQYVFKEIVEHYLQQIS

SEQ ID NO: 205955 - protein, 17 aa, Mycobacterium bovis
RSGRTPDRRDWRLVREV

SEQ ID NO: 205956 - protein, 27 aa, Mycobacterium bovis
RSGYPLELLVRAAAAGWRVVELDVSYG

SEQ ID NO: 205957 - protein, 17 aa, Mycobacterium bovis
RSHRVRNNFSWLNSYYD

SEQ ID NO: 205958 - protein, 25 aa, Mycobacterium bovis
RSIAREGLLPGGLRVRRRAKVWYDR

SEQ ID NO: 205959 - protein, 19 aa, Mycobacterium bovis
RSIGCSWCVDFGAMLQRLD

SEQ ID NO: 205960 - protein, 17 aa, Mycobacterium bovis
RSKSCWSAVMTSRKAAT

SEQ ID NO: 205961 - protein, 25 aa, Mycobacterium bovis
RSLAEVGIGFCFAPRFHPSYRHAAA

SEQ ID NO: 205962 - protein, 20 aa, Mycobacterium bovis
RSLAHAVLMMIPEAWERHES

SEQ ID NO: 205963 - protein, 32 aa, Mycobacterium bovis
RSLEEVLIRAGIPYKVVGGVRFYERKEIRDIV

SEQ ID NO: 205964 - protein, 19 aa, Mycobacterium bovis
RSLEHLVDVVLHFEGDRNG

SEQ ID NO: 205965 - protein, 23 aa, Mycobacterium bovis
RSLNATKVFAWPDAEVAVMGAKA

SEQ ID NO: 205966 - protein, 22 aa, Mycobacterium bovis
RSLPAVGIDGVYAACDADGRVI

SEQ ID NO: 205967 - protein, 21 aa, Mycobacterium bovis
RSLRVRLGIHPVYKTVDTCAA

SEQ ID NO: 205968 - protein, 26 aa, Mycobacterium bovis
RSMVKRLPLARALRTAQRHDYLGHYV

SEQ ID NO: 205969 - protein, 18 aa, Mycobacterium bovis
RSMVLQWGATDRGLVEAL

SEQ ID NO: 205970 - protein, 20 aa, Mycobacterium bovis
RSPAELFTALLTSPDHQLLR

SEQ ID NO: 205971 - protein, 19 aa, Mycobacterium bovis
RSPAGKPDYRWAKEQTEAR

SEQ ID NO: 205972 - protein, 20 aa, Mycobacterium bovis
RSPDEFSGKILAPAHLPQEQ

SEQ ID NO: 205973 - protein, 19 aa, Mycobacterium bovis
RSPSPPGLRGLVKQLPEVH

SEQ ID NO: 205974 - protein, 18 aa, Mycobacterium bovis
RSPVLVDCLGTWLTAIMD

SEQ ID NO: 205975 - protein, 22 aa, Mycobacterium bovis
RSQLKAIHAWGTQKPSDLTSIG

SEQ ID NO: 205976 - protein, 17 aa, Mycobacterium bovis
RSQLRSMLVEDVRARLR

SEQ ID NO: 205977 - protein, 23 aa, Mycobacterium bovis
RSQVRPGDLVFPHPGHVQLAIGN

SEQ ID NO: 205978 - protein, 22 aa, Mycobacterium bovis
RSRAGFLPWRAAHAARAHLRLV

SEQ ID NO: 205979 - protein, 17 aa, Mycobacterium bovis
RSRANITVCVGGGIGTP

SEQ ID NO: 205980 - protein, 21 aa, Mycobacterium bovis
RSRGSMKAGVFSDGALAEPAD

SEQ ID NO: 205981 - protein, 25 aa, Mycobacterium bovis
RSRHGLAGMFTLRFDQFAHTLLSRA

SEQ ID NO: 205982 - protein, 20 aa, Mycobacterium bovis
RSRLDAELVGNVSIRVVDIG

SEQ ID NO: 205983 - protein, 20 aa, Mycobacterium bovis
RSRLLPGLPADRIVALGAED

SEQ ID NO: 205984 - protein, 19 aa, Mycobacterium bovis
RSRLVRFADRLTLVHTRYD

SEQ ID NO: 205985 - protein, 19 aa, Mycobacterium bovis
RSRRFSCESFPLAEVREVS

SEQ ID NO: 205986 - protein, 17 aa, Mycobacterium bovis
RSRRGGRGWVVPAGGAV

SEQ ID NO: 205987 - protein, 18 aa, Mycobacterium bovis
RSRVPDLSAIKVPMLVCG

SEQ ID NO: 205988 - protein, 19 aa, Mycobacterium bovis
RSSAYAEFFDIDWELGDGR

SEQ ID NO: 205989 - protein, 18 aa, Mycobacterium bovis
RSSEMIICGGVNIAPDEV

SEQ ID NO: 205990 - protein, 26 aa, Mycobacterium bovis
RSSKEPGRFCWRDKWHRSAYYTTAHL

SEQ ID NO: 205991 - protein, 20 aa, Mycobacterium bovis
RSSVASAAWTGELADRKARN

SEQ ID NO: 205992 - protein, 24 aa, Mycobacterium bovis
RSTAHAAEALECLGGNGYVEDSGM

SEQ ID NO: 205993 - protein, 23 aa, Mycobacterium bovis
RSTCSRLPVIASVDERLSVLKPV

SEQ ID NO: 205994 - protein, 18 aa, Mycobacterium bovis
RSTLRRNLTLMVAAETER

SEQ ID NO: 205995 - protein, 18 aa, Mycobacterium bovis
RSTPSWSPASPTRASVVG

SEQ ID NO: 205996 - protein, 17 aa, Mycobacterium bovis
RSTTVAMDFGRITLGED

SEQ ID NO: 205997 - protein, 17 aa, Mycobacterium bovis
RSTVAVDLLRNVGLTVQ

SEQ ID NO: 205998 - protein, 20 aa, Mycobacterium bovis
RSVALRWAQRASFPGEPMWR

SEQ ID NO: 205999 - protein, 24 aa, Mycobacterium bovis
RSVKRHMGSDWSIEIDGKKYTAPE

SEQ ID NO: 206000 - protein, 19 aa, Mycobacterium bovis
RSYAASVHRATRPGATLLL

SEQ ID NO: 206001 - protein, 25 aa, Mycobacterium bovis
RSYYADFEGVLAFLQRKMSQTESEQ

SEQ ID NO: 206002 - protein, 19 aa, Mycobacterium bovis
RTADGYASNWLCDHAQVGM

SEQ ID NO: 206003 - protein, 22 aa, Mycobacterium bovis
RTADQMTEFYAGLLGAYPLVSI

SEQ ID NO: 206004 - protein, 20 aa, Mycobacterium bovis
RTAEELGRAFPGTAVITSAG

SEQ ID NO: 206005 - protein, 21 aa, Mycobacterium bovis
RTAGSGEAWLAICPATPQLVQ

SEQ ID NO: 206006 - protein, 17 aa, Mycobacterium bovis
RTAKQYRFVLPGPSLTV

SEQ ID NO: 206007 - protein, 19 aa, Mycobacterium bovis
RTAQELREFFASRPDETGA

SEQ ID NO: 206008 - protein, 17 aa, Mycobacterium bovis
RTAQRRCCAAVHGGRVV

SEQ ID NO: 206009 - protein, 20 aa, Mycobacterium bovis
RTATHLPLRLVYSDGTATGA

SEQ ID NO: 206010 - protein, 18 aa, Mycobacterium bovis
RTAVERFGGLDVMVNNAG

SEQ ID NO: 206011 - protein, 24 aa, Mycobacterium bovis
RTCAATGCELHLVEPLGFDLSEPK

SEQ ID NO: 206012 - protein, 17 aa, Mycobacterium bovis
RTCSAAWSVNGSRRPSA

SEQ ID NO: 206013 - protein, 25 aa, Mycobacterium bovis
RTDEARQILGHRAMIVAGGSNRTDT

SEQ ID NO: 206014 - protein, 31 aa, Mycobacterium bovis
RTDEIRWSLDLLRRRFAKVIWVPGNHELWTT

SEQ ID NO: 206015 - protein, 23 aa, Mycobacterium bovis
RTDQLPLVRALVDMAGLPPQAAG

SEQ ID NO: 206016 - protein, 24 aa, Mycobacterium bovis
RTEDARVGKSLVIQLKYGPSRERS

SEQ ID NO: 206017 - protein, 20 aa, Mycobacterium bovis
RTEPGRAVFRTEVAGSDGAE

SEQ ID NO: 206018 - protein, 24 aa, Mycobacterium bovis
RTFNVAWPKVFRPPVIAATVTTPV

SEQ ID NO: 206019 - protein, 19 aa, Mycobacterium bovis
RTFPLRSSFAPSYNMTINL

SEQ ID NO: 206020 - protein, 19 aa, Mycobacterium bovis
RTFPMPSPFLVMATQNPIE

SEQ ID NO: 206021 - protein, 32 aa, Mycobacterium bovis
RTFSKAYGLAGLRIGYAIGHPDVITALDKVYV

SEQ ID NO: 206022 - protein, 19 aa, Mycobacterium bovis
RTFTVKYKLAILDEYDRAD

SEQ ID NO: 206023 - protein, 17 aa, Mycobacterium bovis
RTFTWKPLSGVNVPHVG

SEQ ID NO: 206024 - protein, 23 aa, Mycobacterium bovis
RTGDLIPLCHPLGLDAVSVTITP

SEQ ID NO: 206025 - protein, 20 aa, Mycobacterium bovis
RTGEKFVPFDPAADYHTYVD

SEQ ID NO: 206026 - protein, 29 aa, Mycobacterium bovis
RTGEVLSVPVGDGFLGRVVNPLGQPIDGR

SEQ ID NO: 206027 - protein, 22 aa, Mycobacterium bovis
RTGGADAGWHLKLPAGPDKRTE

SEQ ID NO: 206028 - protein, 26 aa, Mycobacterium bovis
RTGHMPVRRLDLIWISARNAARRELD

SEQ ID NO: 206029 - protein, 21 aa, Mycobacterium bovis
RTGTLTVCTMVPMRSVPHRVV

SEQ ID NO: 206030 - protein, 28 aa, Mycobacterium bovis
RTHLQFRRFAACPICHLHLRSFANRHQE

SEQ ID NO: 206031 - protein, 24 aa, Mycobacterium bovis
RTHTRFGPVQADGRYLLRTDAGEE

SEQ ID NO: 206032 - protein, 25 aa, Mycobacterium bovis
RTIFKRLYDAGLIYRAERLVNWSPV

SEQ ID NO: 206033 - protein, 18 aa, Mycobacterium bovis
RTILTLDRRHFSALRPIG

SEQ ID NO: 206034 - protein, 18 aa, Mycobacterium bovis
RTKIDNICYEMGQCELSI

SEQ ID NO: 206035 - protein, 25 aa, Mycobacterium bovis
RTKLYKAMNARGWKTKEPGIESIVR

SEQ ID NO: 206036 - protein, 27 aa, Mycobacterium bovis
RTLFRRDQIGIVFQFFNLIPTLTVLEN

SEQ ID NO: 206037 - protein, 19 aa, Mycobacterium bovis
RTLLRTEFGITRMPPLGHE

SEQ ID NO: 206038 - protein, 24 aa, Mycobacterium bovis
RTLNELYMAAAHRPELQRLARLWP

SEQ ID NO: 206039 - protein, 22 aa, Mycobacterium bovis
RTLPAHELATALNLMNERTLFA

SEQ ID NO: 206040 - protein, 19 aa, Mycobacterium bovis
RTLTANGLRQLIAFISRMT

SEQ ID NO: 206041 - protein, 18 aa, Mycobacterium bovis
RTMKEGWIVYARSTTIQA

SEQ ID NO: 206042 - protein, 23 aa, Mycobacterium bovis
RTNGDRWLAHRLKNQKDQKVFEF

SEQ ID NO: 206043 - protein, 17 aa, Mycobacterium bovis
RTPDRFVAGTVGQPGNR

SEQ ID NO: 206044 - protein, 19 aa, Mycobacterium bovis
RTPGFTGWLQEEWLHHCGD

SEQ ID NO: 206045 - protein, 19 aa, Mycobacterium bovis
RTPIPKVYLCSAATPPGAG

SEQ ID NO: 206046 - protein, 24 aa, Mycobacterium bovis
RTPPRGRCLRAPESARLGRRSAAH

SEQ ID NO: 206047 - protein, 24 aa, Mycobacterium bovis
RTPRGRVATALAWTHLGMTPPVGA

SEQ ID NO: 206048 - protein, 17 aa, Mycobacterium bovis
RTPWRLNQNYLRDIRLI

SEQ ID NO: 206049 - protein, 20 aa, Mycobacterium bovis
RTQSSWELVTDALARSRSGV

SEQ ID NO: 206050 - protein, 25 aa, Mycobacterium bovis
RTQWWGRQMLIWGVHVHVGIRSAHK

SEQ ID NO: 206051 - protein, 19 aa, Mycobacterium bovis
RTRLTPICQLPTAAIDSTA

SEQ ID NO: 206052 - protein, 21 aa, Mycobacterium bovis
RTRPVRIAPRVAVAVNALDSI

SEQ ID NO: 206053 - protein, 24 aa, Mycobacterium bovis
RTRVSFEVAGKWMSADVINVSAAG

SEQ ID NO: 206054 - protein, 24 aa, Mycobacterium bovis
RTSDLIPLCHQLALTGVDVDFTVG

SEQ ID NO: 206055 - protein, 18 aa, Mycobacterium bovis
RTSHRFGKVIGTLAEAIR

SEQ ID NO: 206056 - protein, 18 aa, Mycobacterium bovis
RTSIAAVIALVDAIESAL

SEQ ID NO: 206057 - protein, 22 aa, Mycobacterium bovis
RTSNEAAFCYQLLVRSFGTNNL

SEQ ID NO: 206058 - protein, 25 aa, Mycobacterium bovis
RTSVPPFTWWRGLRARELLENYFTA

SEQ ID NO: 206059 - protein, 27 aa, Mycobacterium bovis
RTTEHRPEILLSFGFVPKVETRIGLIN

SEQ ID NO: 206060 - protein, 19 aa, Mycobacterium bovis
RTTGGIGGTGGNAGLLNGS

SEQ ID NO: 206061 - protein, 24 aa, Mycobacterium bovis
RTTLYVTCEVVRIAALLIQPVMPE

SEQ ID NO: 206062 - protein, 18 aa, Mycobacterium bovis
RTTPSIVAFARNGEVLVG

SEQ ID NO: 206063 - protein, 27 aa, Mycobacterium bovis
RTTVNLKACIKAAADRVVFINTGFLDR

SEQ ID NO: 206064 - protein, 18 aa, Mycobacterium bovis
RTVDFKNTVLIFTSNLGT

SEQ ID NO: 206065 - protein, 27 aa, Mycobacterium bovis
RTVFIELLAWQFASPVRWIETQDLLFI

SEQ ID NO: 206066 - protein, 20 aa, Mycobacterium bovis
RTVGRQALDMYFNLANYRNN

SEQ ID NO: 206067 - protein, 28 aa, Mycobacterium bovis
RTVLRLDPRLAPVKAAVLPLSRHADLSP

SEQ ID NO: 206068 - protein, 21 aa, Mycobacterium bovis
RTYALLKRRGTQFVVVSAAEP

SEQ ID NO: 206069 - protein, 20 aa, Mycobacterium bovis
RTYQPRIVFVDAYNKPIDMG

SEQ ID NO: 206070 - protein, 17 aa, Mycobacterium bovis
RVAATASVLADWLDGPG

SEQ ID NO: 206071 - protein, 18 aa, Mycobacterium bovis
RVAATSARSARSLATTHP

SEQ ID NO: 206072 - protein, 17 aa, Mycobacterium bovis
RVADHGWGLGYMLNQRG

SEQ ID NO: 206073 - protein, 27 aa, Mycobacterium bovis
RVAGGFTLDGLGGWFIDGVQGNPSNVI

SEQ ID NO: 206074 - protein, 24 aa, Mycobacterium bovis
RVAGILAAAGWPLAGVDVGESESG

SEQ ID NO: 206075 - protein, 20 aa, Mycobacterium bovis
RVAGTFTGMGLRGNASAPMA

SEQ ID NO: 206076 - protein, 26 aa, Mycobacterium bovis
RVAHWLMPGQRAFQIATQLALVGQSD

SEQ ID NO: 206077 - protein, 19 aa, Mycobacterium bovis
RVALSALTMAEWFRDEQGQ

SEQ ID NO: 206078 - protein, 20 aa, Mycobacterium bovis
RVCGAIGVIECDRPVDLAVA

SEQ ID NO: 206079 - protein, 20 aa, Mycobacterium bovis
RVCHARRPACGVCVLAKDCP

SEQ ID NO: 206080 - protein, 23 aa, Mycobacterium bovis
RVDGRSGVWLPGRPARKVAAIGV

SEQ ID NO: 206081 - protein, 25 aa, Mycobacterium bovis
RVDNDPDIRCCILTGAGGYFCAGMD

SEQ ID NO: 206082 - protein, 20 aa, Mycobacterium bovis
RVDVVLRRVDAHYADPLDLR

SEQ ID NO: 206083 - protein, 24 aa, Mycobacterium bovis
RVELRSCSRRGAAIDVVAARAREN

SEQ ID NO: 206084 - protein, 23 aa, Mycobacterium bovis
RVFEELSLRGCVAALDGSDVIRA

SEQ ID NO: 206085 - protein, 23 aa, Mycobacterium bovis
RVFPNLFATHRVRAVDDYASHLL

SEQ ID NO: 206086 - protein, 18 aa, Mycobacterium bovis
RVGARLAARAQIRDIRLL

SEQ ID NO: 206087 - protein, 18 aa, Mycobacterium bovis
RVGVRIVARRTRSWDHRK

SEQ ID NO: 206088 - protein, 20 aa, Mycobacterium bovis
RVGWNRRQLSAVGGRGQQLF

SEQ ID NO: 206089 - protein, 26 aa, Mycobacterium bovis
RVGYFRFELDAGLWLLATGSESELGL

SEQ ID NO: 206090 - protein, 22 aa, Mycobacterium bovis
RVHAAGARWILDLGPGDILTRL

SEQ ID NO: 206091 - protein, 27 aa, Mycobacterium bovis
RVHGWPNQQFALLFVDWLAANPGARED

SEQ ID NO: 206092 - protein, 17 aa, Mycobacterium bovis
RVHPAPMETCGAVADLD

SEQ ID NO: 206093 - protein, 23 aa, Mycobacterium bovis
RVHRVPSRMFPKVTTLPLGVPTF

SEQ ID NO: 206094 - protein, 19 aa, Mycobacterium bovis
RVHRVWADIRNEVLGGQYL

SEQ ID NO: 206095 - protein, 24 aa, Mycobacterium bovis
RVHVPEIPAHVTVEVPVNIPITAS

SEQ ID NO: 206096 - protein, 19 aa, Mycobacterium bovis
RVICRRSALMTRIAGAGAM

SEQ ID NO: 206097 - protein, 22 aa, Mycobacterium bovis
RVILIHWDDFFRPLSKPLRALP

SEQ ID NO: 206098 - protein, 20 aa, Mycobacterium bovis
RVKLERGVELLIGLEAISEP

SEQ ID NO: 206099 - protein, 27 aa, Mycobacterium bovis
RVKRGMAEMLKGGVIMDVVTPEQARIA

SEQ ID NO: 206100 - protein, 18 aa, Mycobacterium bovis
RVLAFFVSACSAPGHIRY

SEQ ID NO: 206101 - protein, 17 aa, Mycobacterium bovis
RVLDGVADLGFPLSIHL

SEQ ID NO: 206102 - protein, 19 aa, Mycobacterium bovis
RVLEALLLVIDTPVTADAL

SEQ ID NO: 206103 - protein, 17 aa, Mycobacterium bovis
RVLEMVASIQGVRPPTR

SEQ ID NO: 206104 - protein, 24 aa, Mycobacterium bovis
RVLGDPALPHLFFVEGGALAVENA

SEQ ID NO: 206105 - protein, 21 aa, Mycobacterium bovis
RVLGVGVDGDWAWLHTDALPG

SEQ ID NO: 206106 - protein, 17 aa, Mycobacterium bovis
RVLLVLDHCEHLLDACA

SEQ ID NO: 206107 - protein, 17 aa, Mycobacterium bovis
RVLRVSWCTVLRSSGGE

SEQ ID NO: 206108 - protein, 25 aa, Mycobacterium bovis
RVLSGYIASVNIMFAIDPFTRDTGA

SEQ ID NO: 206109 - protein, 27 aa, Mycobacterium bovis
RVLSRDGVFPLAAFRKIVDINLVGTFN

SEQ ID NO: 206110 - protein, 20 aa, Mycobacterium bovis
RVLVWDGEGAIGRWRGGRSE

SEQ ID NO: 206111 - protein, 26 aa, Mycobacterium bovis
RVMFKIKHLRTADCVVAGYRVHKSGS

SEQ ID NO: 206112 - protein, 26 aa, Mycobacterium bovis
RVPCLPSDRLLNLLIYIKGYLDGTLT

SEQ ID NO: 206113 - protein, 25 aa, Mycobacterium bovis
RVPGADAFRSWRLLVSKYGTQAPGP

SEQ ID NO: 206114 - protein, 25 aa, Mycobacterium bovis
RVPPQRRGIGFVFQHYAAFKHLTVR

SEQ ID NO: 206115 - protein, 27 aa, Mycobacterium bovis
RVQPGCDAWCLAALAAVLVQENLCNEA

SEQ ID NO: 206116 - protein, 20 aa, Mycobacterium bovis
RVQVGHGLVVDFVRSCGMTA

SEQ ID NO: 206117 - protein, 24 aa, Mycobacterium bovis
RVRAGELTPALAAQQILEIANLTD

SEQ ID NO: 206118 - protein, 19 aa, Mycobacterium bovis
RVRATLVLDGDTLRVETNS

SEQ ID NO: 206119 - protein, 19 aa, Mycobacterium bovis
RVRESDVYTPTLFLTARDS

SEQ ID NO: 206120 - protein, 18 aa, Mycobacterium bovis
RVRFTSPHPAEFTDDVIE

SEQ ID NO: 206121 - protein, 29 aa, Mycobacterium bovis
RVRGAALPWQDLRAAFTERGWLDLTHTRR

SEQ ID NO: 206122 - protein, 23 aa, Mycobacterium bovis
RVRLCKRDGELFARPQQLPQTDD

SEQ ID NO: 206123 - protein, 22 aa, Mycobacterium bovis
RVRTEPPLPGTRYTQIAVLEDG

SEQ ID NO: 206124 - protein, 23 aa, Mycobacterium bovis
RVRTRLIELFELFDPADPEVVAG

SEQ ID NO: 206125 - protein, 17 aa, Mycobacterium bovis
RVRTRWINFATRGKPTG

SEQ ID NO: 206126 - protein, 25 aa, Mycobacterium bovis
RVSAELRAAGFTLPPSQANFVWLPL

SEQ ID NO: 206127 - protein, 17 aa, Mycobacterium bovis
RVSFVGRSMVRNMRVAR

SEQ ID NO: 206128 - protein, 20 aa, Mycobacterium bovis
RVSGCQLALAGDNAATLALA

SEQ ID NO: 206129 - protein, 19 aa, Mycobacterium bovis
RVSLAHALIGWTRGTGLMG

SEQ ID NO: 206130 - protein, 19 aa, Mycobacterium bovis
RVSRAMFNELWAGFDPDEV

SEQ ID NO: 206131 - protein, 23 aa, Mycobacterium bovis
RVTHAQFVPAMFVRMLKLPEAVR

SEQ ID NO: 206132 - protein, 18 aa, Mycobacterium bovis
RVTLELGGKSANIVFHDC

SEQ ID NO: 206133 - protein, 20 aa, Mycobacterium bovis
RVVAFVGRIQPLKAPDIVLR

SEQ ID NO: 206134 - protein, 25 aa, Mycobacterium bovis
RVVAKIYCGLGLLKRENIREVHRAD

SEQ ID NO: 206135 - protein, 20 aa, Mycobacterium bovis
RVVDRPAWIRSAAESMRAMT

SEQ ID NO: 206136 - protein, 25 aa, Mycobacterium bovis
RVVEMGGPFSLELCGGTHVSNTAQI

SEQ ID NO: 206137 - protein, 17 aa, Mycobacterium bovis
RVVGHKVGLSSPIMQQM

SEQ ID NO: 206138 - protein, 17 aa, Mycobacterium bovis
RVVNPRWMAAMRRHGYK

SEQ ID NO: 206139 - protein, 23 aa, Mycobacterium bovis
RVVPEVLETVGLSGKANRLPDEL

SEQ ID NO: 206140 - protein, 27 aa, Mycobacterium bovis
RVVTNATKLPGLRGWRRPQGELDESSR

SEQ ID NO: 206141 - protein, 24 aa, Mycobacterium bovis
RVVVPDFQLSLAIGKEGQNARLAA

SEQ ID NO: 206142 - protein, 17 aa, Mycobacterium bovis
RVWAPKATGALRMHEAT

SEQ ID NO: 206143 - protein, 25 aa, Mycobacterium bovis
RVWVNCYHLYPAHAAFGGYKQSGIG

SEQ ID NO: 206144 - protein, 17 aa, Mycobacterium bovis
RVYGLVMRVLRDTGYSE

SEQ ID NO: 206145 - protein, 25 aa, Mycobacterium bovis
RVYGTLPWHPDLWLDSEDALDLQGR

SEQ ID NO: 206146 - protein, 20 aa, Mycobacterium bovis
RVYPEMPENLVAVVQDGWRN

SEQ ID NO: 206147 - protein, 25 aa, Mycobacterium bovis
RVYRWKPAPLGGVFDHLVTGIARRQ

SEQ ID NO: 206148 - protein, 24 aa, Mycobacterium bovis
RWAILIKIHHCMAGAMSAAHLLAR

SEQ ID NO: 206149 - protein, 19 aa, Mycobacterium bovis
RWARERAQRAVSGMASVAI

SEQ ID NO: 206150 - protein, 21 aa, Mycobacterium bovis
RWFLDRTCTHILAWEGDDDNE

SEQ ID NO: 206151 - protein, 19 aa, Mycobacterium bovis
RWFLMASPILRGGNLIVTE

SEQ ID NO: 206152 - protein, 19 aa, Mycobacterium bovis
RWIEAMPQYGPGHADVVAE

SEQ ID NO: 206153 - protein, 22 aa, Mycobacterium bovis
RWLREEHYRRMYLAINRTSHVE

SEQ ID NO: 206154 - protein, 23 aa, Mycobacterium bovis
RWMAAMRRHGYKGAFEMAATVDY

SEQ ID NO: 206155 - protein, 19 aa, Mycobacterium bovis
RWMQLLATSGRCFSAAPNF

SEQ ID NO: 206156 - protein, 19 aa, Mycobacterium bovis
RWMTAAALVRPRGAGGVVT

SEQ ID NO: 206157 - protein, 25 aa, Mycobacterium bovis
RWPSKAELVLAAFIEGIRQVAVPPN

SEQ ID NO: 206158 - protein, 18 aa, Mycobacterium bovis
RWREYCLSSVTTHDLPPT

SEQ ID NO: 206159 - protein, 19 aa, Mycobacterium bovis
RWTAGQAPDASGYWPAPAV

SEQ ID NO: 206160 - protein, 20 aa, Mycobacterium bovis
RWVVDPDFNLDFHVRRVRVS

SEQ ID NO: 206161 - protein, 20 aa, Mycobacterium bovis
RWVVEHGFRGLSLRPFMIGR

SEQ ID NO: 206162 - protein, 27 aa, Mycobacterium bovis
RYAATRLRELCKMDGAVVLSTDGSRIV

SEQ ID NO: 206163 - protein, 28 aa, Mycobacterium bovis
RYACELYDLPTLWQIAAHNPWLSVSPVS

SEQ ID NO: 206164 - protein, 17 aa, Mycobacterium bovis
RYCCTGRQNLCDMGATI

SEQ ID NO: 206165 - protein, 24 aa, Mycobacterium bovis
RYDDLRPGLRMNIIANPGIPKANF

SEQ ID NO: 206166 - protein, 20 aa, Mycobacterium bovis
RYDVTFSLGDGLRPGSIADA

SEQ ID NO: 206167 - protein, 26 aa, Mycobacterium bovis
RYGPAFRGLTAMWARGEEIFAEVRLP

SEQ ID NO: 206168 - protein, 19 aa, Mycobacterium bovis
RYGRRRHVRSLGSQVIDVR

SEQ ID NO: 206169 - protein, 23 aa, Mycobacterium bovis
RYGSFRRSFRLPAHVTSEAIAAS

SEQ ID NO: 206170 - protein, 18 aa, Mycobacterium bovis
RYIDYWGTAVTAFDLHAP

SEQ ID NO: 206171 - protein, 19 aa, Mycobacterium bovis
RYILPSFIEHSSFGVKESN

SEQ ID NO: 206172 - protein, 24 aa, Mycobacterium bovis
RYIVRIEPFASLPAEQIVQTIAPN

SEQ ID NO: 206173 - protein, 23 aa, Mycobacterium bovis
RYMLDRRRALGGFVPERRTKSKA

SEQ ID NO: 206174 - protein, 24 aa, Mycobacterium bovis
RYNPWDQRLCLIPDADLYNAITSG

SEQ ID NO: 206175 - protein, 25 aa, Mycobacterium bovis
RYNVANCLVALAILDTVGVSPEQAV

SEQ ID NO: 206176 - protein, 32 aa, Mycobacterium bovis
RYPNGYTCHFVRPGWRLPRRTAESALRASLSP

SEQ ID NO: 206177 - protein, 17 aa, Mycobacterium bovis
RYPNMLRLRYEKKRNLP

SEQ ID NO: 206178 - protein, 24 aa, Mycobacterium bovis
RYQRLLHPWVNMAMDTVVAIEPEI

SEQ ID NO: 206179 - protein, 26 aa, Mycobacterium bovis
RYRCTTPQCGRAVFNQDLANVDQYLV

SEQ ID NO: 206180 - protein, 25 aa, Mycobacterium bovis
RYRDRGRPFLAFLYGIAAHKVADAH

SEQ ID NO: 206181 - protein, 21 aa, Mycobacterium bovis
RYRDRIPILIGGGGEKKTFAI

SEQ ID NO: 206182 - protein, 18 aa, Mycobacterium bovis
RYRIGCKRILNSSTYYPA

SEQ ID NO: 206183 - protein, 20 aa, Mycobacterium bovis
RYRQRCWLRQLTPHANRDQE

SEQ ID NO: 206184 - protein, 18 aa, Mycobacterium bovis
RYTLGVNWRSDRALVESL

SEQ ID NO: 206185 - protein, 19 aa, Mycobacterium bovis
RYTYSSAWFDAISAPPKLG

SEQ ID NO: 206186 - protein, 19 aa, Mycobacterium bovis
RYVAECLAVARAEGARLDD

SEQ ID NO: 206187 - protein, 26 aa, Mycobacterium bovis
RYVDLVCSWGPMILGHAHPAVVEAVA

SEQ ID NO: 206188 - protein, 19 aa, Mycobacterium bovis
SAAAARAAGAAAQAKAVAS

SEQ ID NO: 206189 - protein, 20 aa, Mycobacterium bovis
SAAASLRYSDPDSVAVENIS

SEQ ID NO: 206190 - protein, 19 aa, Mycobacterium bovis
SAAASSYVAAEAVNVEQSL

SEQ ID NO: 206191 - protein, 18 aa, Mycobacterium bovis
SAADPFVIALAMVNNATV

SEQ ID NO: 206192 - protein, 28 aa, Mycobacterium bovis
SAADWEVLEAGLVQRSRLLDAILADLYG

SEQ ID NO: 206193 - protein, 18 aa, Mycobacterium bovis
SAALLTRVIASAVAEGLQ

SEQ ID NO: 206194 - protein, 26 aa, Mycobacterium bovis
SAANSWLDAFAHWRQAQGLPATAIAW

SEQ ID NO: 206195 - protein, 17 aa, Mycobacterium bovis
SAAPLEGVLDVINAPAL

SEQ ID NO: 206196 - protein, 18 aa, Mycobacterium bovis
SAAPVWRHDPAPTVLNAH

SEQ ID NO: 206197 - protein, 17 aa, Mycobacterium bovis
SAARAAALITIADPQRP

SEQ ID NO: 206198 - protein, 20 aa, Mycobacterium bovis
SAAVARQQVAPWWRRRPHRS

SEQ ID NO: 206199 - protein, 31 aa, Mycobacterium bovis
SADEVSVAVAALFGTHAQEYQTVSAQVATFH

SEQ ID NO: 206200 - protein, 25 aa, Mycobacterium bovis
SADGSPPYVVRWLVNGHETTVYPGS

SEQ ID NO: 206201 - protein, 22 aa, Mycobacterium bovis
SAEALGEGWFWPAAAAHPSLPR

SEQ ID NO: 206202 - protein, 26 aa, Mycobacterium bovis
SAEGRVAALRRCVPMVGQIKDPTLRD

SEQ ID NO: 206203 - protein, 25 aa, Mycobacterium bovis
SAELALRLAEHGLRDERLADILTRY

SEQ ID NO: 206204 - protein, 18 aa, Mycobacterium bovis
SAELRWVAENEVADLPLH

SEQ ID NO: 206205 - protein, 25 aa, Mycobacterium bovis
SAENGRSWSRWSFIGAGAPTALTVR

SEQ ID NO: 206206 - protein, 19 aa, Mycobacterium bovis
SAETLRARGLWYIDGAGNA

SEQ ID NO: 206207 - protein, 25 aa, Mycobacterium bovis
SAFHPLGVGSPFWAAIDLQRYGLTW

SEQ ID NO: 206208 - protein, 24 aa, Mycobacterium bovis
SAGGDGGRGGFGGDGLDASSGGNG

SEQ ID NO: 206209 - protein, 26 aa, Mycobacterium bovis
SAGIGRAGLVGKLSVPQGWTVAAPEI

SEQ ID NO: 206210 - protein, 17 aa, Mycobacterium bovis
SAGLPAVGINWGPWADV

SEQ ID NO: 206211 - protein, 20 aa, Mycobacterium bovis
SAGPPCFLAPELRHLNDDGS

SEQ ID NO: 206212 - protein, 22 aa, Mycobacterium bovis
SAGRGGDAGFFYGNGGAGGSGA

SEQ ID NO: 206213 - protein, 17 aa, Mycobacterium bovis
SAGRIAVIGGYAHLGVP

SEQ ID NO: 206214 - protein, 17 aa, Mycobacterium bovis
SAGRIVWDPVNGTLNGL

SEQ ID NO: 206215 - protein, 25 aa, Mycobacterium bovis
SAGSSRKAFGGDGGVGGDGASALGT

SEQ ID NO: 206216 - protein, 18 aa, Mycobacterium bovis
SAGVKVLMALPVGMGCSD

SEQ ID NO: 206217 - protein, 26 aa, Mycobacterium bovis
SAGVRALRDGVVWRIAAETFTDMLEA

SEQ ID NO: 206218 - protein, 19 aa, Mycobacterium bovis
SAIAQHWMYEGKHVLIIFD

SEQ ID NO: 206219 - protein, 24 aa, Mycobacterium bovis
SAIHTGARVHAHWADQPVGAITDI

SEQ ID NO: 206220 - protein, 27 aa, Mycobacterium bovis
SAKELYEIRTLFGVLFQDGALFGSMNL

SEQ ID NO: 206221 - protein, 21 aa, Mycobacterium bovis
SAKPRGFLTGRITGAQTGAVL

SEQ ID NO: 206222 - protein, 20 aa, Mycobacterium bovis
SALDDGYRVFAELSPHPLLT

SEQ ID NO: 206223 - protein, 18 aa, Mycobacterium bovis
SALGLGRVEHVVCDVTST

SEQ ID NO: 206224 - protein, 29 aa, Mycobacterium bovis
SALIKSIGLRLGVPWYAYDTVTFSGEVTA

SEQ ID NO: 206225 - protein, 24 aa, Mycobacterium bovis
SALLFPALCTPTGDPPRPDPARAD

SEQ ID NO: 206226 - protein, 18 aa, Mycobacterium bovis
SALLSRRDVVVVASVSCI

SEQ ID NO: 206227 - protein, 21 aa, Mycobacterium bovis
SALQNAASIAGLFLTTEAVVA

SEQ ID NO: 206228 - protein, 25 aa, Mycobacterium bovis
SALQPLWSQGRMREGLAWLESILER

SEQ ID NO: 206229 - protein, 17 aa, Mycobacterium bovis
SAMFRTRRFRVYTTDDV

SEQ ID NO: 206230 - protein, 22 aa, Mycobacterium bovis
SANRPTTFEVFARRLPTGRRYG

SEQ ID NO: 206231 - protein, 24 aa, Mycobacterium bovis
SAPMLQAAAAWDGLAAELGTAASS

SEQ ID NO: 206232 - protein, 23 aa, Mycobacterium bovis
SAPPRLVGQVIDALRGYASITVV

SEQ ID NO: 206233 - protein, 18 aa, Mycobacterium bovis
SAPPSKIFRTRALRVPGV

SEQ ID NO: 206234 - protein, 20 aa, Mycobacterium bovis
SAPRPAPFRLRVVKRHTLGY

SEQ ID NO: 206235 - protein, 26 aa, Mycobacterium bovis
SAQAAAFHQQFVRALSSAAGSYAAAE

SEQ ID NO: 206236 - protein, 17 aa, Mycobacterium bovis
SAQAAAIHEMFVNTLQM

SEQ ID NO: 206237 - protein, 24 aa, Mycobacterium bovis
SAQACAWLASAIETAYCAPPPVRR

SEQ ID NO: 206238 - protein, 27 aa, Mycobacterium bovis
SAQAWVPRSRSHAVTFPRDLTCRSEME

SEQ ID NO: 206239 - protein, 23 aa, Mycobacterium bovis
SAQRAKIVADYLVARGVAGDHIA

SEQ ID NO: 206240 - protein, 28 aa, Mycobacterium bovis
SAQVATFHDRFVQTLSAAASSYVAAEAV

SEQ ID NO: 206241 - protein, 20 aa, Mycobacterium bovis
SAQWCPRPWPDRPRRRLTTP

SEQ ID NO: 206242 - protein, 20 aa, Mycobacterium bovis
SARLAEFLDHVDVAVSLHGY

SEQ ID NO: 206243 - protein, 17 aa, Mycobacterium bovis
SARMGRFGDVDRLAERA

SEQ ID NO: 206244 - protein, 20 aa, Mycobacterium bovis
SARNETEWQRLMVALSAFDL

SEQ ID NO: 206245 - protein, 17 aa, Mycobacterium bovis
SARPGDTLFAISTSGNS

SEQ ID NO: 206246 - protein, 20 aa, Mycobacterium bovis
SARPYAFEITRMLTTLAAEA

SEQ ID NO: 206247 - protein, 21 aa, Mycobacterium bovis
SARRGDYRVVYAIDDGHHRVE

SEQ ID NO: 206248 - protein, 21 aa, Mycobacterium bovis
SARTRSCPRLTDSIEHAVAEG

SEQ ID NO: 206249 - protein, 23 aa, Mycobacterium bovis
SARVAELRPVYLPPDPASRTTYV

SEQ ID NO: 206250 - protein, 20 aa, Mycobacterium bovis
SARVRRWVEFAANNDGTLPH

SEQ ID NO: 206251 - protein, 17 aa, Mycobacterium bovis
SASASWAANGKITSDDR

SEQ ID NO: 206252 - protein, 23 aa, Mycobacterium bovis
SASGRMTTKWGGFVSDVDAFDAD

SEQ ID NO: 206253 - protein, 17 aa, Mycobacterium bovis
SATARRALAEGADVVIS

SEQ ID NO: 206254 - protein, 19 aa, Mycobacterium bovis
SATLFRAAIQVMRAPAARN

SEQ ID NO: 206255 - protein, 20 aa, Mycobacterium bovis
SATQAAALVAEFEAVRAAMV

SEQ ID NO: 206256 - protein, 23 aa, Mycobacterium bovis
SAVEFLGSVGLKILAATSEKIGQ

SEQ ID NO: 206257 - protein, 18 aa, Mycobacterium bovis
SAVLAELLERIRASVERL

SEQ ID NO: 206258 - protein, 20 aa, Mycobacterium bovis
SAVLRRLLISASEWSGRGLW

SEQ ID NO: 206259 - protein, 20 aa, Mycobacterium bovis
SAVRARIAPVGPSAVSIELA

SEQ ID NO: 206260 - protein, 27 aa, Mycobacterium bovis
SAVRRLAQRLALAAGRRLDDAQPWVDG

SEQ ID NO: 206261 - protein, 18 aa, Mycobacterium bovis
SAYACGVERLLASYRSIP

SEQ ID NO: 206262 - protein, 17 aa, Mycobacterium bovis
SCAYAVLAQESVRCRRR

SEQ ID NO: 206263 - protein, 34 aa, Mycobacterium bovis
SCDGCQDGILTIVGFAWRGDHVQILDSLPELFDA

SEQ ID NO: 206264 - protein, 18 aa, Mycobacterium bovis
SCLSRCCRLDCRRRGPAV

SEQ ID NO: 206265 - protein, 20 aa, Mycobacterium bovis
SCPAEKRRDMLFDHVGALAA

SEQ ID NO: 206266 - protein, 26 aa, Mycobacterium bovis
SCPPETKLSCPIYAFIGDKDWIATQD

SEQ ID NO: 206267 - protein, 21 aa, Mycobacterium bovis
SCQAIWRLDDGYLAASDPRRD

SEQ ID NO: 206268 - protein, 17 aa, Mycobacterium bovis
SCRGGCMAAKFFTGLPL

SEQ ID NO: 206269 - protein, 24 aa, Mycobacterium bovis
SCTPEALRAFGIRECADAARALDN

SEQ ID NO: 206270 - protein, 24 aa, Mycobacterium bovis
SDAARRWPDRLAVADAGDRPGHGG

SEQ ID NO: 206271 - protein, 23 aa, Mycobacterium bovis
SDAAWLRAELNNERGYVFDLETD

SEQ ID NO: 206272 - protein, 21 aa, Mycobacterium bovis
SDADGLRALFTTWITAPQPDI

SEQ ID NO: 206273 - protein, 34 aa, Mycobacterium bovis
SDAELRIAQAQLVGWLEGLFHGIQTALFAQQMAA

SEQ ID NO: 206274 - protein, 24 aa, Mycobacterium bovis
SDAERLRVDLGRDFPVRSYQNRRA

SEQ ID NO: 206275 - protein, 27 aa, Mycobacterium bovis
SDALAARLPLAYALGWQGRGREADAVL

SEQ ID NO: 206276 - protein, 17 aa, Mycobacterium bovis
SDALRQISFRLAADDDQ

SEQ ID NO: 206277 - protein, 20 aa, Mycobacterium bovis
SDDEFGFFVVMLAVAGNETT

SEQ ID NO: 206278 - protein, 17 aa, Mycobacterium bovis
SDDRYLCINPFFHNFGY

SEQ ID NO: 206279 - protein, 20 aa, Mycobacterium bovis
SDEFGALPGRVAVGGDSAGG

SEQ ID NO: 206280 - protein, 20 aa, Mycobacterium bovis
SDEFSGVVVLTGSNTGTPHQ

SEQ ID NO: 206281 - protein, 18 aa, Mycobacterium bovis
SDELDRLVADAAHYPPSQ

SEQ ID NO: 206282 - protein, 28 aa, Mycobacterium bovis
SDELIGLLARLGYRFAPTQIPGTVDYYL

SEQ ID NO: 206283 - protein, 31 aa, Mycobacterium bovis
SDEVPVVVLLWSPRSEVCVDLLDTLSGLAAA

SEQ ID NO: 206284 - protein, 24 aa, Mycobacterium bovis
SDFGQIRIGPDFSLVELPAKLPRA

SEQ ID NO: 206285 - protein, 22 aa, Mycobacterium bovis
SDFWGGAGSAACQGFITQLGRN

SEQ ID NO: 206286 - protein, 21 aa, Mycobacterium bovis
SDGFAGLGGSGGRGGDAGLIG

SEQ ID NO: 206287 - protein, 23 aa, Mycobacterium bovis
SDGFWDEVFRELSIPYLPVRWST

SEQ ID NO: 206288 - protein, 22 aa, Mycobacterium bovis
SDGKPTRIGYRVDEETGKRVRI

SEQ ID NO: 206289 - protein, 25 aa, Mycobacterium bovis
SDGQWRLSPKAMRRLGETALRDVAQ

SEQ ID NO: 206290 - protein, 27 aa, Mycobacterium bovis
SDGSIFLRPFLKYQIITVVAPNSPLAA

SEQ ID NO: 206291 - protein, 20 aa, Mycobacterium bovis
SDHVLQHWTVDISIDEHEGL

SEQ ID NO: 206292 - protein, 21 aa, Mycobacterium bovis
SDIAGAYLCRLLRHMADNGYT

SEQ ID NO: 206293 - protein, 19 aa, Mycobacterium bovis
SDIALAGGVYVMLEPRRFA

SEQ ID NO: 206294 - protein, 17 aa, Mycobacterium bovis
SDIKRELSQAAGVLNAD

SEQ ID NO: 206295 - protein, 20 aa, Mycobacterium bovis
SDITPINAFYVRNHGPVPDI

SEQ ID NO: 206296 - protein, 28 aa, Mycobacterium bovis
SDLAVLGYYEWREGLLRGLAAHHAGMLP

SEQ ID NO: 206297 - protein, 20 aa, Mycobacterium bovis
SDLLICQKMDMNVHGKPDGL

SEQ ID NO: 206298 - protein, 17 aa, Mycobacterium bovis
SDLLVAECLRTGAWEGL

SEQ ID NO: 206299 - protein, 19 aa, Mycobacterium bovis
SDLMEVWRAPIIDDTVLRL

SEQ ID NO: 206300 - protein, 19 aa, Mycobacterium bovis
SDLPVTLVRSITWDQGIEM

SEQ ID NO: 206301 - protein, 24 aa, Mycobacterium bovis
SDNTRWTNNFAILAGDYRFATASQ

SEQ ID NO: 206302 - protein, 24 aa, Mycobacterium bovis
SDPHIPSLFAIYPTNDWHERETYD

SEQ ID NO: 206303 - protein, 19 aa, Mycobacterium bovis
SDPRKVLAAVGVGDVDNAE

SEQ ID NO: 206304 - protein, 17 aa, Mycobacterium bovis
SDRPWRLAMSTAGTFEN

SEQ ID NO: 206305 - protein, 19 aa, Mycobacterium bovis
SDTAEFGGYLSGPRVIDAG

SEQ ID NO: 206306 - protein, 24 aa, Mycobacterium bovis
SDTALAAYLVRPGQRSFTLDDLSL

SEQ ID NO: 206307 - protein, 20 aa, Mycobacterium bovis
SDTGVNMLFTMRAAVVEADL

SEQ ID NO: 206308 - protein, 18 aa, Mycobacterium bovis
SDTLELLLRSTGYNDDVT

SEQ ID NO: 206309 - protein, 25 aa, Mycobacterium bovis
SDTVDAFALPDCAGHPTWYEPSEWL

SEQ ID NO: 206310 - protein, 18 aa, Mycobacterium bovis
SDVAGRAAPLPAPPPSGC

SEQ ID NO: 206311 - protein, 21 aa, Mycobacterium bovis
SDVALAGGVALMLEPRKAAAG

SEQ ID NO: 206312 - protein, 18 aa, Mycobacterium bovis
SDVFWCTADIGWVTGHTY

SEQ ID NO: 206313 - protein, 21 aa, Mycobacterium bovis
SDVVFDIDMVFSWVDGSDPEF

SEQ ID NO: 206314 - protein, 26 aa, Mycobacterium bovis
SDWGGTPSWECALAGLDQECGAQIDA

SEQ ID NO: 206315 - protein, 21 aa, Mycobacterium bovis
SDYRTRWEIPIGLRETDLTPA

SEQ ID NO: 206316 - protein, 22 aa, Mycobacterium bovis
SDYTPLMLCAKMIHALARLPQQ

SEQ ID NO: 206317 - protein, 21 aa, Mycobacterium bovis
SEADPPLWTQMNFAAAQANFL

SEQ ID NO: 206318 - protein, 26 aa, Mycobacterium bovis
SEAGRICASLGLPERVLTQRLRTLSG

SEQ ID NO: 206319 - protein, 22 aa, Mycobacterium bovis
SEALKRRCLYLHIDFPTPELER

SEQ ID NO: 206320 - protein, 26 aa, Mycobacterium bovis
SEALREYGVRVLVIRPGQVRTRMSAH

SEQ ID NO: 206321 - protein, 24 aa, Mycobacterium bovis
SEANLDQLIGFFINIVVLRNDLRG

SEQ ID NO: 206322 - protein, 17 aa, Mycobacterium bovis
SEARYTYSSAWFDAISA

SEQ ID NO: 206323 - protein, 40 aa, Mycobacterium bovis
SEAVMLGGLALKWRWRQRVGSWKGRMPNLVMGSNVQVVWE

SEQ ID NO: 206324 - protein, 20 aa, Mycobacterium bovis
SECMHIFGGAGYLVDETTLG

SEQ ID NO: 206325 - protein, 19 aa, Mycobacterium bovis
SECYVRNQVPFFVDYVRRY

SEQ ID NO: 206326 - protein, 24 aa, Mycobacterium bovis
SEDDFRQVLPVGGWEITYLGTTTY

SEQ ID NO: 206327 - protein, 21 aa, Mycobacterium bovis
SEFPPLSWRRDLSVDALLARN

SEQ ID NO: 206328 - protein, 27 aa, Mycobacterium bovis
SEFPWCGQAAEVLRSHFGASLPVRVCT

SEQ ID NO: 206329 - protein, 18 aa, Mycobacterium bovis
SEGAGVLVVERLVDARRL

SEQ ID NO: 206330 - protein, 17 aa, Mycobacterium bovis
SEGATPCEIAADELPQA

SEQ ID NO: 206331 - protein, 23 aa, Mycobacterium bovis
SEGLELVGLMGIPPLDWDPDEAF

SEQ ID NO: 206332 - protein, 20 aa, Mycobacterium bovis
SEGMPGSLVHRLRTQYRDYV

SEQ ID NO: 206333 - protein, 26 aa, Mycobacterium bovis
SEGVDVPALDAVLFLNPRNSIVDVVQ

SEQ ID NO: 206334 - protein, 23 aa, Mycobacterium bovis
SEHRVWRADTEIRLSHKEFTLLE

SEQ ID NO: 206335 - protein, 24 aa, Mycobacterium bovis
SEIAILDRHAHGFDPRDLSAINPV

SEQ ID NO: 206336 - protein, 18 aa, Mycobacterium bovis
SEIRPELRRLDLGKLLEL

SEQ ID NO: 206337 - protein, 24 aa, Mycobacterium bovis
SEKDVKRQLLLDALADELQVQVGQ

SEQ ID NO: 206338 - protein, 21 aa, Mycobacterium bovis
SEKHFRRARGRKVELVLSDGS

SEQ ID NO: 206339 - protein, 19 aa, Mycobacterium bovis
SELAPLLCAGIIGYRSLLR

SEQ ID NO: 206340 - protein, 19 aa, Mycobacterium bovis
SELGLSYLLPRAIGSSRAF

SEQ ID NO: 206341 - protein, 24 aa, Mycobacterium bovis
SELIRLARYPLLVVDEVGYIPFEP

SEQ ID NO: 206342 - protein, 20 aa, Mycobacterium bovis
SELRARVGLSSSALAERVPG

SEQ ID NO: 206343 - protein, 17 aa, Mycobacterium bovis
SELRWPGDPSLDAGIDV

SEQ ID NO: 206344 - protein, 26 aa, Mycobacterium bovis
SEPLPRAHGGPVRVVVPGFIGARSVK

SEQ ID NO: 206345 - protein, 25 aa, Mycobacterium bovis
SEPLTEAIPLWKRPQDGAIITGWDY

SEQ ID NO: 206346 - protein, 18 aa, Mycobacterium bovis
SEPMIIGKAFAVKVNANI

SEQ ID NO: 206347 - protein, 19 aa, Mycobacterium bovis
SERLLTLGWQQRALPEVGD

SEQ ID NO: 206348 - protein, 22 aa, Mycobacterium bovis
SESAGFKWLAPYTGSAIAQHWM

SEQ ID NO: 206349 - protein, 18 aa, Mycobacterium bovis
SESLRLAREREANLIPGG

SEQ ID NO: 206350 - protein, 19 aa, Mycobacterium bovis
SESNAMWALSIPVPFTKPV

SEQ ID NO: 206351 - protein, 20 aa, Mycobacterium bovis
SESQERMCAVVSPKNVDAFL

SEQ ID NO: 206352 - protein, 17 aa, Mycobacterium bovis
SETFPGLAGLGDLIVTC

SEQ ID NO: 206353 - protein, 19 aa, Mycobacterium bovis
SEVAMEIALNAVRIHGGYG

SEQ ID NO: 206354 - protein, 18 aa, Mycobacterium bovis
SFAHVVRAVHRCLLAGRF

SEQ ID NO: 206355 - protein, 19 aa, Mycobacterium bovis
SFDRVVEMVGALRANQLRD

SEQ ID NO: 206356 - protein, 20 aa, Mycobacterium bovis
SFEPKADWKHLFSYWDEILG

SEQ ID NO: 206357 - protein, 34 aa, Mycobacterium bovis
SFFGLLWADVKFEWHALPYLLGFKKACAGFRSLG

SEQ ID NO: 206358 - protein, 19 aa, Mycobacterium bovis
SFGVIQRADSFTFYASIDH

SEQ ID NO: 206359 - protein, 23 aa, Mycobacterium bovis
SFIEGRAAMFAGLADSTLLRDDG

SEQ ID NO: 206360 - protein, 31 aa, Mycobacterium bovis
SFNNELGHPWTVLRATRRTDYLILEMAARHH

SEQ ID NO: 206361 - protein, 18 aa, Mycobacterium bovis
SFQPSVSVPVDLDGARKV

SEQ ID NO: 206362 - protein, 18 aa, Mycobacterium bovis
SFRLPRASTLAIVGESGS

SEQ ID NO: 206363 - protein, 23 aa, Mycobacterium bovis
SFRSELRLLYLTVTDPASGNLIS

SEQ ID NO: 206364 - protein, 22 aa, Mycobacterium bovis
SFSQFKRSALPNGPKVSHGGAL

SEQ ID NO: 206365 - protein, 17 aa, Mycobacterium bovis
SFSTGIANTGDYNTGSF

SEQ ID NO: 206366 - protein, 30 aa, Mycobacterium bovis
SGAAGFDIASLWPVKPLLSLSALETHFAIP

SEQ ID NO: 206367 - protein, 29 aa, Mycobacterium bovis
SGAAGGVGGRGGWLLGNGGTGGAGGAAGA

SEQ ID NO: 206368 - protein, 24 aa, Mycobacterium bovis
SGAFLAKLGCSYVVVGHSERRTYH

SEQ ID NO: 206369 - protein, 26 aa, Mycobacterium bovis
SGAIGPRGRLGWEQVADWDFVCEQLA

SEQ ID NO: 206370 - protein, 19 aa, Mycobacterium bovis
SGAIWRPVDPAPRLLPAPE

SEQ ID NO: 206371 - protein, 17 aa, Mycobacterium bovis
SGALLNICVSYRITGDI

SEQ ID NO: 206372 - protein, 19 aa, Mycobacterium bovis
SGAPEHRAAAIVKATTFFD

SEQ ID NO: 206373 - protein, 24 aa, Mycobacterium bovis
SGAPGGAGGLLFGNGGAGGPGASG

SEQ ID NO: 206374 - protein, 22 aa, Mycobacterium bovis
SGAPGQRGGAGGAAGLIGNGGN

SEQ ID NO: 206375 - protein, 17 aa, Mycobacterium bovis
SGARRGGAVSGIGGHNA

SEQ ID NO: 206376 - protein, 20 aa, Mycobacterium bovis
SGASRAAVRLQIDQPGRLDA

SEQ ID NO: 206377 - protein, 23 aa, Mycobacterium bovis
SGDARRLATMVLLIAQSTIQSAD

SEQ ID NO: 206378 - protein, 18 aa, Mycobacterium bovis
SGDPEVRQLVLLDAPVVL

SEQ ID NO: 206379 - protein, 25 aa, Mycobacterium bovis
SGDPYRLAAQLGMPPWRVQKAQKQA

SEQ ID NO: 206380 - protein, 17 aa, Mycobacterium bovis
SGDVLMVAWMNDEALAR

SEQ ID NO: 206381 - protein, 25 aa, Mycobacterium bovis
SGELPQRHIGVGWAALRSLPPPAPQ

SEQ ID NO: 206382 - protein, 24 aa, Mycobacterium bovis
SGERFVLGVGFGWNVEELADHGVP

SEQ ID NO: 206383 - protein, 25 aa, Mycobacterium bovis
SGERLAVGVPKAFYQLDGQTLIERA

SEQ ID NO: 206384 - protein, 22 aa, Mycobacterium bovis
SGFPVTIKGLSRFTDAAESRAV

SEQ ID NO: 206385 - protein, 24 aa, Mycobacterium bovis
SGGAGARGANGIDSIGGTGGAGGG

SEQ ID NO: 206386 - protein, 26 aa, Mycobacterium bovis
SGGAGGAGGWLWGNGGAGGNGGVGVA

SEQ ID NO: 206387 - protein, 27 aa, Mycobacterium bovis
SGGAGRWRGGDGAVRRLEFTEPMTVST

SEQ ID NO: 206388 - protein, 22 aa, Mycobacterium bovis
SGGGARWLIPRLDLPAKKRDAI

SEQ ID NO: 206389 - protein, 18 aa, Mycobacterium bovis
SGGNGAPGAPGQAGGAGG

SEQ ID NO: 206390 - protein, 20 aa, Mycobacterium bovis
SGGRPAALYRFTDSQLRVTD

SEQ ID NO: 206391 - protein, 18 aa, Mycobacterium bovis
SGGVWGRERGYCLMIGGD

SEQ ID NO: 206392 - protein, 19 aa, Mycobacterium bovis
SGIGFGLGVDRTVLALRAE

SEQ ID NO: 206393 - protein, 20 aa, Mycobacterium bovis
SGILNRGADISGVYNTGALG

SEQ ID NO: 206394 - protein, 25 aa, Mycobacterium bovis
SGILNRGAGISGVYNTGALGVVTAA

SEQ ID NO: 206395 - protein, 25 aa, Mycobacterium bovis
SGILNRGAGISGVYNTGTLGLVTSA

SEQ ID NO: 206396 - protein, 28 aa, Mycobacterium bovis
SGINAAICCAAAEFATRTQATATGVAAA

SEQ ID NO: 206397 - protein, 24 aa, Mycobacterium bovis
SGKVKHVGFRWAADKQLRDAVCDF

SEQ ID NO: 206398 - protein, 24 aa, Mycobacterium bovis
SGKVRRAECVKLYRHNEFTRLDAK

SEQ ID NO: 206399 - protein, 17 aa, Mycobacterium bovis
SGLAPALIAVAGFDPLR

SEQ ID NO: 206400 - protein, 27 aa, Mycobacterium bovis
SGLDSRAWRLPWPDGTVVYELDQPKVL

SEQ ID NO: 206401 - protein, 24 aa, Mycobacterium bovis
SGLDSRAYRLAWPAQTVVYEIDQP

SEQ ID NO: 206402 - protein, 25 aa, Mycobacterium bovis
SGLDSRAYRLPWPTRTVVYEIDQPK

SEQ ID NO: 206403 - protein, 20 aa, Mycobacterium bovis
SGLQRRLGTTTVYVTHDQVE

SEQ ID NO: 206404 - protein, 19 aa, Mycobacterium bovis
SGMPRLYREAPLMGIWEGS

SEQ ID NO: 206405 - protein, 17 aa, Mycobacterium bovis
SGNRGSYNIGPANLGNY

SEQ ID NO: 206406 - protein, 17 aa, Mycobacterium bovis
SGNVGWANMGLGNIGFG

SEQ ID NO: 206407 - protein, 31 aa, Mycobacterium bovis
SGNYSNGAFWRGDYQGLLGFSYTSTIIPEFT

SEQ ID NO: 206408 - protein, 17 aa, Mycobacterium bovis
SGPAADDMAVAWAASAA

SEQ ID NO: 206409 - protein, 18 aa, Mycobacterium bovis
SGPARWFLDHARVALSSG

SEQ ID NO: 206410 - protein, 22 aa, Mycobacterium bovis
SGPPGAAALAFPSLSSSVPILG

SEQ ID NO: 206411 - protein, 24 aa, Mycobacterium bovis
SGPSLARWARANGWSAPPGAGAKE

SEQ ID NO: 206412 - protein, 22 aa, Mycobacterium bovis
SGPYRFVYRKRFHKRCETELTV

SEQ ID NO: 206413 - protein, 19 aa, Mycobacterium bovis
SGQEPFVFHGQFTPDRVGL

SEQ ID NO: 206414 - protein, 18 aa, Mycobacterium bovis
SGQIGFGSLNSGSHNIGL

SEQ ID NO: 206415 - protein, 27 aa, Mycobacterium bovis
SGQPGQFGSPGADGRGGAGGAGGGGGA

SEQ ID NO: 206416 - protein, 24 aa, Mycobacterium bovis
SGQYPRELPFVIGSEVCGTVEAVG

SEQ ID NO: 206417 - protein, 20 aa, Mycobacterium bovis
SGRESIEIPAIRRSVDPRRQ

SEQ ID NO: 206418 - protein, 19 aa, Mycobacterium bovis
SGREVLYRLADHHLAHIVL

SEQ ID NO: 206419 - protein, 19 aa, Mycobacterium bovis
SGRFCGGDVVELRAPDAAM

SEQ ID NO: 206420 - protein, 17 aa, Mycobacterium bovis
SGRMYCGPGSGPMLAAA

SEQ ID NO: 206421 - protein, 23 aa, Mycobacterium bovis
SGRRAALAMVRRHRLLETFLVNE

SEQ ID NO: 206422 - protein, 24 aa, Mycobacterium bovis
SGRSELRLAAEAVLDALADAGLSP

SEQ ID NO: 206423 - protein, 33 aa, Mycobacterium bovis
SGSFNNGALWTGDYHGLVGFSFSIDIAGSTLLD

SEQ ID NO: 206424 - protein, 21 aa, Mycobacterium bovis
SGSGARYGRQGIEYWEHQGEV

SEQ ID NO: 206425 - protein, 19 aa, Mycobacterium bovis
SGSGRPWDRDQLLRALGLR

SEQ ID NO: 206426 - protein, 20 aa, Mycobacterium bovis
SGSSDYLAGRAFSFISAIDS

SEQ ID NO: 206427 - protein, 17 aa, Mycobacterium bovis
SGSSRDWAAKGTLLLGV

SEQ ID NO: 206428 - protein, 19 aa, Mycobacterium bovis
SGTASWTLIELMRHRDAYA

SEQ ID NO: 206429 - protein, 17 aa, Mycobacterium bovis
SGTAVFEIFFRKLPPGR

SEQ ID NO: 206430 - protein, 17 aa, Mycobacterium bovis
SGTPGADFHPSLDTSAI

SEQ ID NO: 206431 - protein, 26 aa, Mycobacterium bovis
SGTPRASGPAGMTGMPMVPPGALGAG

SEQ ID NO: 206432 - protein, 19 aa, Mycobacterium bovis
SGTQLRGGIEVVDVPHIDG

SEQ ID NO: 206433 - protein, 30 aa, Mycobacterium bovis
SGTVGAFPFGFGWQQSPGFFNSTTTPSSGF

SEQ ID NO: 206434 - protein, 19 aa, Mycobacterium bovis
SGVALRLDDGCTINADLLL

SEQ ID NO: 206435 - protein, 26 aa, Mycobacterium bovis
SGVELRNRLQMAIGLPGLSLPRTLIF

SEQ ID NO: 206436 - protein, 21 aa, Mycobacterium bovis
SGVSIDGLIAILTFPPAESVF

SEQ ID NO: 206437 - protein, 17 aa, Mycobacterium bovis
SGWRVVEAVDEPSAITT

SEQ ID NO: 206438 - protein, 18 aa, Mycobacterium bovis
SHALRPGDQLVLGASNPV

SEQ ID NO: 206439 - protein, 23 aa, Mycobacterium bovis
SHCSWSVAGTGQFLAHDGASPAI

SEQ ID NO: 206440 - protein, 21 aa, Mycobacterium bovis
SHDIPRFVSLWQSGRLPVESL

SEQ ID NO: 206441 - protein, 24 aa, Mycobacterium bovis
SHDRLKAELDQLIANRPVIAAEIN

SEQ ID NO: 206442 - protein, 20 aa, Mycobacterium bovis
SHEARFVLIGTMNPEEGELR

SEQ ID NO: 206443 - protein, 20 aa, Mycobacterium bovis
SHFRLDWSTPQDVGRKAIAQ

SEQ ID NO: 206444 - protein, 18 aa, Mycobacterium bovis
SHGGALSPRGDWRAPSDM

SEQ ID NO: 206445 - protein, 17 aa, Mycobacterium bovis
SHLAFGFGTHFCLGNQL

SEQ ID NO: 206446 - protein, 22 aa, Mycobacterium bovis
SHLYPDSLRTMGYDVGSAGFEL

SEQ ID NO: 206447 - protein, 20 aa, Mycobacterium bovis
SHVYPTGASLYFTVVAGQRG

SEQ ID NO: 206448 - protein, 19 aa, Mycobacterium bovis
SIAALRGEPVDSYGVGTSL

SEQ ID NO: 206449 - protein, 19 aa, Mycobacterium bovis
SIADAARWASTDRIVEPSA

SEQ ID NO: 206450 - protein, 22 aa, Mycobacterium bovis
SIATERLLRPIGRVSAAELAQL

SEQ ID NO: 206451 - protein, 24 aa, Mycobacterium bovis
SIDARLADRLAVNRGLAPVADVRA

SEQ ID NO: 206452 - protein, 33 aa, Mycobacterium bovis
SIDTTNLTGVMTFGLPLAMTLNAVGSPITTAIA

SEQ ID NO: 206453 - protein, 25 aa, Mycobacterium bovis
SIEEIRARQPVALVLSGGPASVYAD

SEQ ID NO: 206454 - protein, 19 aa, Mycobacterium bovis
SILIRGLMNYTFWMPNGSP

SEQ ID NO: 206455 - protein, 17 aa, Mycobacterium bovis
SIMPGKVNPVLPEAVTQ

SEQ ID NO: 206456 - protein, 24 aa, Mycobacterium bovis
SINDCLIAALAIRHGARIVHRDAD

SEQ ID NO: 206457 - protein, 25 aa, Mycobacterium bovis
SIPEIDIHTLVAFACRELLLSEDVR

SEQ ID NO: 206458 - protein, 17 aa, Mycobacterium bovis
SIPTVQSLIRWDPVGHA

SEQ ID NO: 206459 - protein, 25 aa, Mycobacterium bovis
SISPITVRIDPVFDLGPITVQDITI

SEQ ID NO: 206460 - protein, 18 aa, Mycobacterium bovis
SISTFQAVQFMLADMAMK

SEQ ID NO: 206461 - protein, 35 aa, Mycobacterium bovis
SITLRPETQIAISAWGLLSPQGRCAAFDAAADGFV

SEQ ID NO: 206462 - protein, 24 aa, Mycobacterium bovis
SITMAAAVAPYVAWISVTAGQAEQ

SEQ ID NO: 206463 - protein, 22 aa, Mycobacterium bovis
SIVAVTGGLLWPTRQNDARMED

SEQ ID NO: 206464 - protein, 18 aa, Mycobacterium bovis
SIVLWPQVVKEVAPVPVL

SEQ ID NO: 206465 - protein, 19 aa, Mycobacterium bovis
SKAARKVWDTADKFTRDTL

SEQ ID NO: 206466 - protein, 22 aa, Mycobacterium bovis
SKAGGFGVLGAVGFTPEQLEIE

SEQ ID NO: 206467 - protein, 17 aa, Mycobacterium bovis
SKALLRPVIAISDARRV

SEQ ID NO: 206468 - protein, 25 aa, Mycobacterium bovis
SKARAGGLVEGRRLTKVLGLPGPHR

SEQ ID NO: 206469 - protein, 19 aa, Mycobacterium bovis
SKATMYVCGITPYDATHLG

SEQ ID NO: 206470 - protein, 20 aa, Mycobacterium bovis
SKCGTERGLASAMNVLTYQS

SEQ ID NO: 206471 - protein, 17 aa, Mycobacterium bovis
SKDLPFAQKRFCGAEGT

SEQ ID NO: 206472 - protein, 23 aa, Mycobacterium bovis
SKDSTRYLVHFTQSGIGLPDESY

SEQ ID NO: 206473 - protein, 22 aa, Mycobacterium bovis
SKEQCFLELLLADNETLGNSIR

SEQ ID NO: 206474 - protein, 18 aa, Mycobacterium bovis
SKETIAYCRIGERSSHTW

SEQ ID NO: 206475 - protein, 17 aa, Mycobacterium bovis
SKGGDPRSPGWYHNLKA

SEQ ID NO: 206476 - protein, 24 aa, Mycobacterium bovis
SKGWNLPGLMCAQVILSNRRDAHD

SEQ ID NO: 206477 - protein, 17 aa, Mycobacterium bovis
SKIRGREPIRIHPDDAA

SEQ ID NO: 206478 - protein, 17 aa, Mycobacterium bovis
SKLKANIAQILKNEGYI

SEQ ID NO: 206479 - protein, 22 aa, Mycobacterium bovis
SKLPKVFFVNWFRRGDDGRFLW

SEQ ID NO: 206480 - protein, 20 aa, Mycobacterium bovis
SKRIAPIVVLTAFSQRDLVE

SEQ ID NO: 206481 - protein, 19 aa, Mycobacterium bovis
SKSPRCTWPAHIVDVKRAI

SEQ ID NO: 206482 - protein, 25 aa, Mycobacterium bovis
SKTGERARCAPMHALEQLADYGFAW

SEQ ID NO: 206483 - protein, 19 aa, Mycobacterium bovis
SKTGREFGVTTGRRRRCGW

SEQ ID NO: 206484 - protein, 18 aa, Mycobacterium bovis
SKVAIGQSVELAFDTARL

SEQ ID NO: 206485 - protein, 19 aa, Mycobacterium bovis
SKYRGEFEERLKAVLDDIK

SEQ ID NO: 206486 - protein, 17 aa, Mycobacterium bovis
SLAEAMSDVAGRAAPLP

SEQ ID NO: 206487 - protein, 23 aa, Mycobacterium bovis
SLAGYRAGFVVGDLEIVAELLAV

SEQ ID NO: 206488 - protein, 22 aa, Mycobacterium bovis
SLAHLSQWCFVLARTEKGSQRH

SEQ ID NO: 206489 - protein, 26 aa, Mycobacterium bovis
SLALDGAGLGTVWGRQLATSMLADAG

SEQ ID NO: 206490 - protein, 18 aa, Mycobacterium bovis
SLARPVADTVWPTPFLAH

SEQ ID NO: 206491 - protein, 17 aa, Mycobacterium bovis
SLASPRIADTVRVLYGG

SEQ ID NO: 206492 - protein, 29 aa, Mycobacterium bovis
SLDARIAGRLGLRADVRRVPLFGLGCVAG

SEQ ID NO: 206493 - protein, 19 aa, Mycobacterium bovis
SLDDLAKRLIVLVEPVEAI

SEQ ID NO: 206494 - protein, 35 aa, Mycobacterium bovis
SLDISPLQARCGWAVGWRKDAFFGRAALLAEKAAG

SEQ ID NO: 206495 - protein, 21 aa, Mycobacterium bovis
SLDPRLPVFDLIAEPLQANGF

SEQ ID NO: 206496 - protein, 20 aa, Mycobacterium bovis
SLDRIKSVKQAAGVTVNDAV

SEQ ID NO: 206497 - protein, 23 aa, Mycobacterium bovis
SLEAFQSGLSWLIILRKRENFRR

SEQ ID NO: 206498 - protein, 33 aa, Mycobacterium bovis
SLFHFTRTGEEFSWRAAELFDAIGSEAITVAVG

SEQ ID NO: 206499 - protein, 26 aa, Mycobacterium bovis
SLGAPGARVLLVWDAPNLDMGLGSIL

SEQ ID NO: 206500 - protein, 19 aa, Mycobacterium bovis
SLGFLMARFNIWGRPDLRR

SEQ ID NO: 206501 - protein, 19 aa, Mycobacterium bovis
SLGGSCCWSCPDHPDYSER

SEQ ID NO: 206502 - protein, 22 aa, Mycobacterium bovis
SLGHARKGLFLVHSDAVDSVLG

SEQ ID NO: 206503 - protein, 23 aa, Mycobacterium bovis
SLGLEFIGFGGPDVREGLAAHRE

SEQ ID NO: 206504 - protein, 26 aa, Mycobacterium bovis
SLHAAKGLEWDAVFLVGLADGTLPIS

SEQ ID NO: 206505 - protein, 19 aa, Mycobacterium bovis
SLHLGRLKDRVGLRPDQVS

SEQ ID NO: 206506 - protein, 17 aa, Mycobacterium bovis
SLIGAGMRSHPGVTATF

SEQ ID NO: 206507 - protein, 18 aa, Mycobacterium bovis
SLIPWYSALQQWLAENLL

SEQ ID NO: 206508 - protein, 17 aa, Mycobacterium bovis
SLLAAGITAVSGRFCGG

SEQ ID NO: 206509 - protein, 18 aa, Mycobacterium bovis
SLLLDGLRRIGIDRLAPT

SEQ ID NO: 206510 - protein, 18 aa, Mycobacterium bovis
SLLMPAFTRAALRGYRDM

SEQ ID NO: 206511 - protein, 26 aa, Mycobacterium bovis
SLLPSRIVADLGAPVRLARRPFSSYT

SEQ ID NO: 206512 - protein, 24 aa, Mycobacterium bovis
SLLRCGEMLSAVLLDATMAGLATC

SEQ ID NO: 206513 - protein, 22 aa, Mycobacterium bovis
SLMDAWAGPVVMQLMEAAKPFV

SEQ ID NO: 206514 - protein, 21 aa, Mycobacterium bovis
SLMHCMTVSLALDGAGLGTVW

SEQ ID NO: 206515 - protein, 18 aa, Mycobacterium bovis
SLPACEWVAPHVRAALVG

SEQ ID NO: 206516 - protein, 22 aa, Mycobacterium bovis
SLPDAMGALLARSIVGIVEQVE

SEQ ID NO: 206517 - protein, 20 aa, Mycobacterium bovis
SLPDLLPLLEKVAGTGKPLL

SEQ ID NO: 206518 - protein, 31 aa, Mycobacterium bovis
SLPGMLMAAARLDLAAVFLYAGSILPGRAKL

SEQ ID NO: 206519 - protein, 24 aa, Mycobacterium bovis
SLPIFGFGGAPGFGNDTTAPSSGF

SEQ ID NO: 206520 - protein, 18 aa, Mycobacterium bovis
SLPLTVTEWDEWGNPLND

SEQ ID NO: 206521 - protein, 24 aa, Mycobacterium bovis
SLQLRWPLRMLLGGKPLQHIAADK

SEQ ID NO: 206522 - protein, 25 aa, Mycobacterium bovis
SLQRLRLPWWHLWRAAEAAGAATPK

SEQ ID NO: 206523 - protein, 17 aa, Mycobacterium bovis
SLQTTRMAFHAIKAGEG

SEQ ID NO: 206524 - protein, 19 aa, Mycobacterium bovis
SLRDPYHAYTIDWLPEGWF

SEQ ID NO: 206525 - protein, 20 aa, Mycobacterium bovis
SLRLPLAHGDLLVMGGSCQR

SEQ ID NO: 206526 - protein, 20 aa, Mycobacterium bovis
SLRLPRDHYVRCDSNDYSVH

SEQ ID NO: 206527 - protein, 21 aa, Mycobacterium bovis
SLRLVACGGSAVPESLMRTFE

SEQ ID NO: 206528 - protein, 22 aa, Mycobacterium bovis
SLRTLGLRRIRHSVIREDNAAT

SEQ ID NO: 206529 - protein, 18 aa, Mycobacterium bovis
SLRYLRRELRAETPQQQQ

SEQ ID NO: 206530 - protein, 20 aa, Mycobacterium bovis
SLTAPAPFVYGLGAVGPALT

SEQ ID NO: 206531 - protein, 24 aa, Mycobacterium bovis
SLTPDVRNGIDFKIADLSLADFGR

SEQ ID NO: 206532 - protein, 23 aa, Mycobacterium bovis
SLTSPRGKRQFRRAILDHQAGTV

SEQ ID NO: 206533 - protein, 17 aa, Mycobacterium bovis
SLVTRSRLTDILRAGGR

SEQ ID NO: 206534 - protein, 19 aa, Mycobacterium bovis
SLYGAWSANPFPFLRQIIA

SEQ ID NO: 206535 - protein, 21 aa, Mycobacterium bovis
SLYLDDRVKVVAFTHHSNVTG

SEQ ID NO: 206536 - protein, 17 aa, Mycobacterium bovis
SMCARLYGKRAAENRTK

SEQ ID NO: 206537 - protein, 24 aa, Mycobacterium bovis
SMDTEWPLPLLDLARIASDRGDAE

SEQ ID NO: 206538 - protein, 23 aa, Mycobacterium bovis
SMEQGRLAAYHAFGEPTDGITEL

SEQ ID NO: 206539 - protein, 24 aa, Mycobacterium bovis
SMGFKTFGFGFGRVDQWEPDEVYW

SEQ ID NO: 206540 - protein, 19 aa, Mycobacterium bovis
SMGGMLAFEVALRYQSAGH

SEQ ID NO: 206541 - protein, 23 aa, Mycobacterium bovis
SMGRNGGGWAHYVGQEKVRPLTG

SEQ ID NO: 206542 - protein, 19 aa, Mycobacterium bovis
SMLELLLRELDVHPGDVIE

SEQ ID NO: 206543 - protein, 19 aa, Mycobacterium bovis
SMLSHVLHAIAKLAPQRLI

SEQ ID NO: 206544 - protein, 28 aa, Mycobacterium bovis
SMNNGLLWRADRQGLLAANYTITIERPA

SEQ ID NO: 206545 - protein, 22 aa, Mycobacterium bovis
SMPAMIRAGGKMYGADGKLKDT

SEQ ID NO: 206546 - protein, 21 aa, Mycobacterium bovis
SMSLAAWLHTRIVDRATREGN

SEQ ID NO: 206547 - protein, 30 aa, Mycobacterium bovis
SMVGTGGFGPIPIGISIGGTPGFGNSTTGP

SEQ ID NO: 206548 - protein, 27 aa, Mycobacterium bovis
SMVVSRARLQLAIAWANILLQRPAPAT

SEQ ID NO: 206549 - protein, 23 aa, Mycobacterium bovis
SMWPIKSTPGLRCQLDCAPQTNR

SEQ ID NO: 206550 - protein, 18 aa, Mycobacterium bovis
SNATLWPLYHDVIVKPLY

SEQ ID NO: 206551 - protein, 18 aa, Mycobacterium bovis
SNGGLLMGIMLTGYPEKF

SEQ ID NO: 206552 - protein, 26 aa, Mycobacterium bovis
SNGLAAELLRRLPFELTAGQREVLDV

SEQ ID NO: 206553 - protein, 26 aa, Mycobacterium bovis
SNGMLWRGDHEGLFGLSYGITIPQFP

SEQ ID NO: 206554 - protein, 17 aa, Mycobacterium bovis
SNHVLPTAGCARHSSGL

SEQ ID NO: 206555 - protein, 18 aa, Mycobacterium bovis
SNICTAQVLLAVLAAMYA

SEQ ID NO: 206556 - protein, 18 aa, Mycobacterium bovis
SNIRWGFDPTHRRRYGLD

SEQ ID NO: 206557 - protein, 19 aa, Mycobacterium bovis
SNKAFGRWGEVFGGDDVVA

SEQ ID NO: 206558 - protein, 20 aa, Mycobacterium bovis
SNKPFGRWGEVFGDDVVAAA

SEQ ID NO: 206559 - protein, 17 aa, Mycobacterium bovis
SNQLPGAVAQRLHCDDE

SEQ ID NO: 206560 - protein, 17 aa, Mycobacterium bovis
SNTEPLLRLNVEGRSVG

SEQ ID NO: 206561 - protein, 18 aa, Mycobacterium bovis
SNTSWPLPGQDVIDHAGG

SEQ ID NO: 206562 - protein, 22 aa, Mycobacterium bovis
SNVVDALAWVMGEQGAKTLRGG

SEQ ID NO: 206563 - protein, 18 aa, Mycobacterium bovis
SPAACRRIAIAAHDGLAR

SEQ ID NO: 206564 - protein, 24 aa, Mycobacterium bovis
SPAQVRVGFRLGEPAAGELGVRDA

SEQ ID NO: 206565 - protein, 21 aa, Mycobacterium bovis
SPARGSRHLGFAKALVYEMPH

SEQ ID NO: 206566 - protein, 19 aa, Mycobacterium bovis
SPCGLAELCDRTDLPRATA

SEQ ID NO: 206567 - protein, 18 aa, Mycobacterium bovis
SPDEFSGKILAPAHLPQE

SEQ ID NO: 206568 - protein, 19 aa, Mycobacterium bovis
SPDGTPCRLQGKGRIDKHL

SEQ ID NO: 206569 - protein, 22 aa, Mycobacterium bovis
SPDKLRRVVAHMMEKPESVQHW

SEQ ID NO: 206570 - protein, 18 aa, Mycobacterium bovis
SPDLPWDLLQRSRISAVS

SEQ ID NO: 206571 - protein, 18 aa, Mycobacterium bovis
SPEALAWPLLAVIDASLD

SEQ ID NO: 206572 - protein, 22 aa, Mycobacterium bovis
SPEEMYKYLVAVSREPDHDKIR

SEQ ID NO: 206573 - protein, 18 aa, Mycobacterium bovis
SPEPFGAGTTRIVEMRGG

SEQ ID NO: 206574 - protein, 26 aa, Mycobacterium bovis
SPFGPGRPGWHVECAAIALSRIGSGL

SEQ ID NO: 206575 - protein, 25 aa, Mycobacterium bovis
SPGAFCLTCGAPVREPTDIMRDVAA

SEQ ID NO: 206576 - protein, 25 aa, Mycobacterium bovis
SPGELRFGPLQARDELAACEILADA

SEQ ID NO: 206577 - protein, 18 aa, Mycobacterium bovis
SPGFTLYSLSGHVTRPGQ

SEQ ID NO: 206578 - protein, 25 aa, Mycobacterium bovis
SPGSTMTLPLISMRFEGEDWILGST

SEQ ID NO: 206579 - protein, 24 aa, Mycobacterium bovis
SPHLGTLEVRICDGVSNLRELGAL

SEQ ID NO: 206580 - protein, 19 aa, Mycobacterium bovis
SPIGKRNGWLSGLHATELL

SEQ ID NO: 206581 - protein, 18 aa, Mycobacterium bovis
SPIVFLRLRKAARRHRVP

SEQ ID NO: 206582 - protein, 19 aa, Mycobacterium bovis
SPLAAARWGLAALADGVVD

SEQ ID NO: 206583 - protein, 17 aa, Mycobacterium bovis
SPLALARQALAVLPKEQ

SEQ ID NO: 206584 - protein, 29 aa, Mycobacterium bovis
SPLLRRPDLLVSLLTYWQRHPSLSYLFAG

SEQ ID NO: 206585 - protein, 21 aa, Mycobacterium bovis
SPLNLLRWTSARSIKETFVAA

SEQ ID NO: 206586 - protein, 18 aa, Mycobacterium bovis
SPMLRCQRTVEPLAEALC

SEQ ID NO: 206587 - protein, 33 aa, Mycobacterium bovis
SPMSLLRFIKFILTEIFPGGRLPRISQVDYYSS

SEQ ID NO: 206588 - protein, 29 aa, Mycobacterium bovis
SPPDMKLPISLALGWPRRVSGAAAACDFH

SEQ ID NO: 206589 - protein, 17 aa, Mycobacterium bovis
SPPEVHSALLSSGPGPG

SEQ ID NO: 206590 - protein, 28 aa, Mycobacterium bovis
SPRERPGRLLGFHWTKVHPDHPGLGEVY

SEQ ID NO: 206591 - protein, 22 aa, Mycobacterium bovis
SPRSFCAGVERAIETVKRVLDV

SEQ ID NO: 206592 - protein, 20 aa, Mycobacterium bovis
SPRSVARWTAGQVVPQRLNK

SEQ ID NO: 206593 - protein, 20 aa, Mycobacterium bovis
SPSAWRSVTHRKRGVGVRPS

SEQ ID NO: 206594 - protein, 17 aa, Mycobacterium bovis
SPTFGRWDSVLLDDQDR

SEQ ID NO: 206595 - protein, 25 aa, Mycobacterium bovis
SPTPFNLLGIYRWIRNFFYLTYYDS

SEQ ID NO: 206596 - protein, 25 aa, Mycobacterium bovis
SPTTSICPWKGLAHYYNVVVDGPYG

SEQ ID NO: 206597 - protein, 18 aa, Mycobacterium bovis
SPTVTALLQLAAYADALV

SEQ ID NO: 206598 - protein, 32 aa, Mycobacterium bovis
SPVAGTVRFNWDPLRWFEEDEPIYGHPRNPYQ

SEQ ID NO: 206599 - protein, 17 aa, Mycobacterium bovis
SPVRVFVTGQGWRHLPD

SEQ ID NO: 206600 - protein, 20 aa, Mycobacterium bovis
SPYVLPRLVPVAGDSAGGVG

SEQ ID NO: 206601 - protein, 26 aa, Mycobacterium bovis
SQAAKDWLCLLEAFDAPQRSGLVRAA

SEQ ID NO: 206602 - protein, 26 aa, Mycobacterium bovis
SQAGCGMACPFCATGQGGLTRNLSTA

SEQ ID NO: 206603 - protein, 24 aa, Mycobacterium bovis
SQALRAGMSLGIMADLAVGVHPNG

SEQ ID NO: 206604 - protein, 24 aa, Mycobacterium bovis
SQESMPLAGLVFNRTHPMLCALPI

SEQ ID NO: 206605 - protein, 19 aa, Mycobacterium bovis
SQFAGPISTVRCFQDNALL

SEQ ID NO: 206606 - protein, 17 aa, Mycobacterium bovis
SQFRGSELIAEKWNLSR

SEQ ID NO: 206607 - protein, 24 aa, Mycobacterium bovis
SQGRSEVRILFAFDPARQAIMLAA

SEQ ID NO: 206608 - protein, 18 aa, Mycobacterium bovis
SQIATLILPADVCWSDGA

SEQ ID NO: 206609 - protein, 23 aa, Mycobacterium bovis
SQLRSRFGFLAIHGGGLEQVTDL

SEQ ID NO: 206610 - protein, 21 aa, Mycobacterium bovis
SQMTWRSMIRDGLTMRHGKEL

SEQ ID NO: 206611 - protein, 18 aa, Mycobacterium bovis
SQNLIPRVFWMTYQNSRD

SEQ ID NO: 206612 - protein, 19 aa, Mycobacterium bovis
SQQRLAFFADIHMIAVLTE

SEQ ID NO: 206613 - protein, 18 aa, Mycobacterium bovis
SQRLYSWAQERPYTTPFV

SEQ ID NO: 206614 - protein, 25 aa, Mycobacterium bovis
SQSSWRCVQAHDREGWLALMADDVV

SEQ ID NO: 206615 - protein, 22 aa, Mycobacterium bovis
SQTRRRVAVLGGNRIPFARSDG

SEQ ID NO: 206616 - protein, 17 aa, Mycobacterium bovis
SQTSAKVAQLYMDNDPQ

SEQ ID NO: 206617 - protein, 19 aa, Mycobacterium bovis
SRAKELVFSGRFFDAEEAL

SEQ ID NO: 206618 - protein, 30 aa, Mycobacterium bovis
SRAKLNWWESRALYGWTVLVPRTKDQAGEM

SEQ ID NO: 206619 - protein, 18 aa, Mycobacterium bovis
SRALQALRADLAAAQQAL

SEQ ID NO: 206620 - protein, 22 aa, Mycobacterium bovis
SRANARGLVVVRIGTETKASEG

SEQ ID NO: 206621 - protein, 20 aa, Mycobacterium bovis
SRAVPLRLVSVIKPTHPSPD

SEQ ID NO: 206622 - protein, 20 aa, Mycobacterium bovis
SRAYASWMSSVGYRPVTTRH

SEQ ID NO: 206623 - protein, 23 aa, Mycobacterium bovis
SRDIPLRLLYAIEPDDPGYAAHG

SEQ ID NO: 206624 - protein, 20 aa, Mycobacterium bovis
SRDLQPWLAVPDRLLPLPAG

SEQ ID NO: 206625 - protein, 20 aa, Mycobacterium bovis
SRDPERHPGLAIGAVAVVNG

SEQ ID NO: 206626 - protein, 21 aa, Mycobacterium bovis
SREEQDRWGVRSQNRAEEAIK

SEQ ID NO: 206627 - protein, 19 aa, Mycobacterium bovis
SREIEVLEFVPAADVDPMM

SEQ ID NO: 206628 - protein, 19 aa, Mycobacterium bovis
SREIYEAPGAMVLITAHTE

SEQ ID NO: 206629 - protein, 26 aa, Mycobacterium bovis
SREPIGMAGEITWRVPSMSITDEAVE

SEQ ID NO: 206630 - protein, 22 aa, Mycobacterium bovis
SREVGLSVLQVWQALTEAVSRR

SEQ ID NO: 206631 - protein, 26 aa, Mycobacterium bovis
SRFRGMCEARGLPAVRIGVVDQGSDA

SEQ ID NO: 206632 - protein, 19 aa, Mycobacterium bovis
SRFWMGGPHIAVRKAPEVA

SEQ ID NO: 206633 - protein, 19 aa, Mycobacterium bovis
SRGAGGFGGVGQAGGKGWD

SEQ ID NO: 206634 - protein, 19 aa, Mycobacterium bovis
SRGAPWRRVESRAVDGVSF

SEQ ID NO: 206635 - protein, 24 aa, Mycobacterium bovis
SRGEPHRDICLIPSSAHGTNAASA

SEQ ID NO: 206636 - protein, 23 aa, Mycobacterium bovis
SRGKWDTLRAMGFDDDHIGDSRT

SEQ ID NO: 206637 - protein, 24 aa, Mycobacterium bovis
SRGPFPGALWLQVRDLEATQTELV

SEQ ID NO: 206638 - protein, 20 aa, Mycobacterium bovis
SRGPLLSGMFGTFPVAQTFH

SEQ ID NO: 206639 - protein, 28 aa, Mycobacterium bovis
SRGPLRYAGWSSCFRREAGSHGKDTRGI

SEQ ID NO: 206640 - protein, 22 aa, Mycobacterium bovis
SRGRLAMAMAAIRARRSLDSAA

SEQ ID NO: 206641 - protein, 20 aa, Mycobacterium bovis
SRHCSLWLSLAQMWAGNLTE

SEQ ID NO: 206642 - protein, 30 aa, Mycobacterium bovis
SRIEAIAATGRWVPDFLSLPIAVENSLKNQ

SEQ ID NO: 206643 - protein, 19 aa, Mycobacterium bovis
SRILSEFNVKITAARADQR

SEQ ID NO: 206644 - protein, 22 aa, Mycobacterium bovis
SRISFADGRVIVWSEELGESQY

SEQ ID NO: 206645 - protein, 26 aa, Mycobacterium bovis
SRKLARNTFYGMARWQASLEKKQGFL

SEQ ID NO: 206646 - protein, 25 aa, Mycobacterium bovis
SRKMSVSKLLRPVLDEFVQRETGRI

SEQ ID NO: 206647 - protein, 21 aa, Mycobacterium bovis
SRKSVRPRPHRPAGARAAFKP

SEQ ID NO: 206648 - protein, 17 aa, Mycobacterium bovis
SRLAELMQRAFTELQTE

SEQ ID NO: 206649 - protein, 21 aa, Mycobacterium bovis
SRLALQIGAQIAHEFTYGRWD

SEQ ID NO: 206650 - protein, 25 aa, Mycobacterium bovis
SRLGETRRLRVCGPLNTVVNAAWVF

SEQ ID NO: 206651 - protein, 19 aa, Mycobacterium bovis
SRLHPLATMERTFIAPSRF

SEQ ID NO: 206652 - protein, 19 aa, Mycobacterium bovis
SRLRGVRDFILNRHAAPPQ

SEQ ID NO: 206653 - protein, 17 aa, Mycobacterium bovis
SRLRPLLPDTPATATLR

SEQ ID NO: 206654 - protein, 17 aa, Mycobacterium bovis
SRLVGAVLIGRDRAAVA

SEQ ID NO: 206655 - protein, 20 aa, Mycobacterium bovis
SRMGRIAWSWFRHPVKSHEF

SEQ ID NO: 206656 - protein, 22 aa, Mycobacterium bovis
SRNPRSLRVCTLLRKPDAVHAN

SEQ ID NO: 206657 - protein, 25 aa, Mycobacterium bovis
SRNRKGSTWVLSLSAGRLVTADHIG

SEQ ID NO: 206658 - protein, 23 aa, Mycobacterium bovis
SRPEPPIGHAMVRRSGTDVTVVT

SEQ ID NO: 206659 - protein, 23 aa, Mycobacterium bovis
SRPLMQAAAAWQRLANELTATAA

SEQ ID NO: 206660 - protein, 20 aa, Mycobacterium bovis
SRPVIPPAILASGVDYHTSD

SEQ ID NO: 206661 - protein, 24 aa, Mycobacterium bovis
SRQRPELAWFPSLAHHLQDASRGH

SEQ ID NO: 206662 - protein, 18 aa, Mycobacterium bovis
SRRIPGSHGHRAVKAKLA

SEQ ID NO: 206663 - protein, 19 aa, Mycobacterium bovis
SRRLLQMVGRDLGLDIKRY

SEQ ID NO: 206664 - protein, 23 aa, Mycobacterium bovis
SRRPDRPGVRQLLRHGATDRVLL

SEQ ID NO: 206665 - protein, 24 aa, Mycobacterium bovis
SRRRAEELLARVNLAERMNHRPGD

SEQ ID NO: 206666 - protein, 19 aa, Mycobacterium bovis
SRRWLLNLVITRGTPPRLE

SEQ ID NO: 206667 - protein, 21 aa, Mycobacterium bovis
SRSPIALSVTLQAVRRAAKLD

SEQ ID NO: 206668 - protein, 22 aa, Mycobacterium bovis
SRSTPWPGGELPDWYRRCYDPV

SEQ ID NO: 206669 - protein, 20 aa, Mycobacterium bovis
SRTAFQLGVLERGLQMTAEY

SEQ ID NO: 206670 - protein, 17 aa, Mycobacterium bovis
SRTALAAALETQDGPRL

SEQ ID NO: 206671 - protein, 21 aa, Mycobacterium bovis
SRTGKMLPPKLGLMSYVADAY

SEQ ID NO: 206672 - protein, 20 aa, Mycobacterium bovis
SRTKLLRLFPTIFKGAHVEL

SEQ ID NO: 206673 - protein, 18 aa, Mycobacterium bovis
SRVLKWIVDRIEHKAGGA

SEQ ID NO: 206674 - protein, 18 aa, Mycobacterium bovis
SRVRLCPTPGHLHFFAVD

SEQ ID NO: 206675 - protein, 21 aa, Mycobacterium bovis
SRWWKEEREGVFVDFNQNAKD

SEQ ID NO: 206676 - protein, 28 aa, Mycobacterium bovis
SRYGIDAHIDRVRWDDVVSRVFGRIDPI

SEQ ID NO: 206677 - protein, 25 aa, Mycobacterium bovis
SRYLSPRVEVEVGFILAADLPGAGC

SEQ ID NO: 206678 - protein, 21 aa, Mycobacterium bovis
SRYPVKLRAALDKVKAGDIAW

SEQ ID NO: 206679 - protein, 27 aa, Mycobacterium bovis
SSAADRLWLRGGLPPSFTARSNEDSAA

SEQ ID NO: 206680 - protein, 19 aa, Mycobacterium bovis
SSAEQVRWVLQDSEAVVLF

SEQ ID NO: 206681 - protein, 18 aa, Mycobacterium bovis
SSAIPFVFEPVRVRGATW

SEQ ID NO: 206682 - protein, 17 aa, Mycobacterium bovis
SSALFAMLSGQHAVDTL

SEQ ID NO: 206683 - protein, 19 aa, Mycobacterium bovis
SSALIGYAQGGSGGLGGFG

SEQ ID NO: 206684 - protein, 26 aa, Mycobacterium bovis
SSARGVTFSRGWLPFLPTSDPPAHTR

SEQ ID NO: 206685 - protein, 24 aa, Mycobacterium bovis
SSDGSPPYVVRWLETDHVATVIPG

SEQ ID NO: 206686 - protein, 19 aa, Mycobacterium bovis
SSEIMRLLIAREAVDAHLT

SEQ ID NO: 206687 - protein, 25 aa, Mycobacterium bovis
SSELWQLERERIFNRSWMLVAHVDQ

SEQ ID NO: 206688 - protein, 24 aa, Mycobacterium bovis
SSEPIAIVGMSCRFPGGVDSPEGL

SEQ ID NO: 206689 - protein, 18 aa, Mycobacterium bovis
SSGFLNWGAGSASGLLNF

SEQ ID NO: 206690 - protein, 21 aa, Mycobacterium bovis
SSGNPYLAFSAMLMAGLDGIK

SEQ ID NO: 206691 - protein, 23 aa, Mycobacterium bovis
SSIDVRLDCLFRVFNNTRYTHID

SEQ ID NO: 206692 - protein, 19 aa, Mycobacterium bovis
SSIGSGVRRVEAYVGLDSF

SEQ ID NO: 206693 - protein, 18 aa, Mycobacterium bovis
SSKVGLIAGCLVTSGVMR

SEQ ID NO: 206694 - protein, 29 aa, Mycobacterium bovis
SSLDQGGPCARTVLDTALLHQVIAGHDPR

SEQ ID NO: 206695 - protein, 20 aa, Mycobacterium bovis
SSLGSAPRQAFVFPGQGGHW

SEQ ID NO: 206696 - protein, 18 aa, Mycobacterium bovis
SSLVAVHLACRSLSTWDC

SEQ ID NO: 206697 - protein, 18 aa, Mycobacterium bovis
SSNGALFLVLRPLLVDYV

SEQ ID NO: 206698 - protein, 24 aa, Mycobacterium bovis
SSNSALVVPVRFAGVHVYGDITRG

SEQ ID NO: 206699 - protein, 22 aa, Mycobacterium bovis
SSPDEIAHILVLHSEFDGGFTS

SEQ ID NO: 206700 - protein, 25 aa, Mycobacterium bovis
SSRACQVRFAIYLGDLGRDTAARAR

SEQ ID NO: 206701 - protein, 20 aa, Mycobacterium bovis
SSRAPRIVFRTDRRTAVRVG

SEQ ID NO: 206702 - protein, 24 aa, Mycobacterium bovis
SSSEPIAVIGMGCRFPGGVNNPEQ

SEQ ID NO: 206703 - protein, 20 aa, Mycobacterium bovis
SSSLVAIHLACQSLRLRETD

SEQ ID NO: 206704 - protein, 18 aa, Mycobacterium bovis
SSSLVAVHLACQSLRGRE

SEQ ID NO: 206705 - protein, 18 aa, Mycobacterium bovis
SSSLVAVHLACQSLRLRE

SEQ ID NO: 206706 - protein, 24 aa, Mycobacterium bovis
SSSPRVALALGSGGARGYAHIGVI

SEQ ID NO: 206707 - protein, 23 aa, Mycobacterium bovis
SSSWCAGRRALAEAACRAFDALA

SEQ ID NO: 206708 - protein, 26 aa, Mycobacterium bovis
SSTLKWPKLMSGPSWEDDAMRAGADA

SEQ ID NO: 206709 - protein, 18 aa, Mycobacterium bovis
SSVISGLTGDDWLGPSAL

SEQ ID NO: 206710 - protein, 17 aa, Mycobacterium bovis
SSVPQFWAGELQTVTSP

SEQ ID NO: 206711 - protein, 20 aa, Mycobacterium bovis
SSWINRLYWNLADYAGSPVR

SEQ ID NO: 206712 - protein, 22 aa, Mycobacterium bovis
SSYHAELFWWTGAFETSEGIPH

SEQ ID NO: 206713 - protein, 36 aa, Mycobacterium bovis
STADALRMLTLPATFGLYVERAWPRHRRLSIGADDG

SEQ ID NO: 206714 - protein, 19 aa, Mycobacterium bovis
STAEAFPGLAHTAALVRLV

SEQ ID NO: 206715 - protein, 23 aa, Mycobacterium bovis
STALYPPKRFLGAARNIEEGGSL

SEQ ID NO: 206716 - protein, 19 aa, Mycobacterium bovis
STAVAHGIRVTWAVLNDGQ

SEQ ID NO: 206717 - protein, 32 aa, Mycobacterium bovis
STDLLYKLLRSEWLEPRWMVGIDPESDGLARA

SEQ ID NO: 206718 - protein, 19 aa, Mycobacterium bovis
STEALVRVVREFRPHVMTT

SEQ ID NO: 206719 - protein, 17 aa, Mycobacterium bovis
STEEIFTYWSMRPRGAQ

SEQ ID NO: 206720 - protein, 22 aa, Mycobacterium bovis
STFLPTLGEFVDFVRDYRFEGQ

SEQ ID NO: 206721 - protein, 27 aa, Mycobacterium bovis
STFTNGALIFGEFDLPQLVVHPYTLTG

SEQ ID NO: 206722 - protein, 23 aa, Mycobacterium bovis
STGKELFAAQGLPPFEDDHITRF

SEQ ID NO: 206723 - protein, 17 aa, Mycobacterium bovis
STGLYRYSLLDIIDIAD

SEQ ID NO: 206724 - protein, 18 aa, Mycobacterium bovis
STIAGRLLGSVPANVSRR

SEQ ID NO: 206725 - protein, 18 aa, Mycobacterium bovis
STIALGLLHRLTAMVAKV

SEQ ID NO: 206726 - protein, 28 aa, Mycobacterium bovis
STIEILPVIGLPEFRPGDDLSAAVAAAA

SEQ ID NO: 206727 - protein, 17 aa, Mycobacterium bovis
STIGRRLAKALGVGLLD

SEQ ID NO: 206728 - protein, 17 aa, Mycobacterium bovis
STKDLADAFAFNVGTAH

SEQ ID NO: 206729 - protein, 20 aa, Mycobacterium bovis
STLIVEPWMGPAAAAMAAAA

SEQ ID NO: 206730 - protein, 24 aa, Mycobacterium bovis
STLLGVPMESMIGLLAVAALDDLD

SEQ ID NO: 206731 - protein, 18 aa, Mycobacterium bovis
STLPGVLMTIPWAVISGF

SEQ ID NO: 206732 - protein, 17 aa, Mycobacterium bovis
STLPMAVPVNLRAEGDA

SEQ ID NO: 206733 - protein, 25 aa, Mycobacterium bovis
STLPPEINSALIFGGAGSEPMSAAA

SEQ ID NO: 206734 - protein, 18 aa, Mycobacterium bovis
STLSRTAFQLGVLERGLQ

SEQ ID NO: 206735 - protein, 24 aa, Mycobacterium bovis
STNLPRVLGGLGVAIISTSSGLLT

SEQ ID NO: 206736 - protein, 24 aa, Mycobacterium bovis
STPGCTKQACDFRDNLGDFTTAGL

SEQ ID NO: 206737 - protein, 19 aa, Mycobacterium bovis
STPLLKLLLVRAAHATELP

SEQ ID NO: 206738 - protein, 18 aa, Mycobacterium bovis
STRFFPMLTTAAGTVKPA

SEQ ID NO: 206739 - protein, 17 aa, Mycobacterium bovis
STRGVATFLVLRTRRDG

SEQ ID NO: 206740 - protein, 20 aa, Mycobacterium bovis
STSLFAFWAVDAAYSLDGRR

SEQ ID NO: 206741 - protein, 29 aa, Mycobacterium bovis
STVFPQTFYLSGLFFFGPVNLSASTLTVP

SEQ ID NO: 206742 - protein, 18 aa, Mycobacterium bovis
STVLAAAYRDFRSVNADF

SEQ ID NO: 206743 - protein, 28 aa, Mycobacterium bovis
STVSSIFLMCLPDRVLAYGDCAIIPNPT

SEQ ID NO: 206744 - protein, 18 aa, Mycobacterium bovis
STVVHGWDLAVATGQAGE

SEQ ID NO: 206745 - protein, 26 aa, Mycobacterium bovis
STVVRRMRLQPGRMFLVDTAQGRIVS

SEQ ID NO: 206746 - protein, 19 aa, Mycobacterium bovis
STYIRSCVDAGDMVAAMEA

SEQ ID NO: 206747 - protein, 30 aa, Mycobacterium bovis
SVADWLTDHGWRARSQRAPDEMRRVGRWVE

SEQ ID NO: 206748 - protein, 17 aa, Mycobacterium bovis
SVATIAWMGYHPPPNPL

SEQ ID NO: 206749 - protein, 21 aa, Mycobacterium bovis
SVAVLARLDLGSVLIPMPAAG

SEQ ID NO: 206750 - protein, 24 aa, Mycobacterium bovis
SVCRACPRLVSWREEVAVVKRRAF

SEQ ID NO: 206751 - protein, 24 aa, Mycobacterium bovis
SVDAVLVAQAWHWVDPARAIPEVA

SEQ ID NO: 206752 - protein, 24 aa, Mycobacterium bovis
SVDERLHHLFARMPDARVHLYGKA

SEQ ID NO: 206753 - protein, 24 aa, Mycobacterium bovis
SVDYRLAPRYRFPTAATDVRAAWD

SEQ ID NO: 206754 - protein, 28 aa, Mycobacterium bovis
SVEVICAELLRLRDWFVSAAPEITPFAL

SEQ ID NO: 206755 - protein, 26 aa, Mycobacterium bovis
SVFELQARATLGLAVDTLMISPGAAR

SEQ ID NO: 206756 - protein, 18 aa, Mycobacterium bovis
SVFRADFLSELDAPAQAG

SEQ ID NO: 206757 - protein, 21 aa, Mycobacterium bovis
SVGGPVFERGLRVVAATRGDP

SEQ ID NO: 206758 - protein, 19 aa, Mycobacterium bovis
SVGLLSVGAYRPERVVTND

SEQ ID NO: 206759 - protein, 17 aa, Mycobacterium bovis
SVGRVIPTVAARVVDQN

SEQ ID NO: 206760 - protein, 22 aa, Mycobacterium bovis
SVHVRGSVVLDRLSRKSQSAGS

SEQ ID NO: 206761 - protein, 23 aa, Mycobacterium bovis
SVKGEVIASTFDRPPSDHTSVAE

SEQ ID NO: 206762 - protein, 27 aa, Mycobacterium bovis
SVLADCWRIAAKSLRPLPVAHKEMSEE

SEQ ID NO: 206763 - protein, 26 aa, Mycobacterium bovis
SVLAYPRVVWIAGGLLKGASLHAEVA

SEQ ID NO: 206764 - protein, 23 aa, Mycobacterium bovis
SVLGRSWPVVCDELLGHYEAVRG

SEQ ID NO: 206765 - protein, 19 aa, Mycobacterium bovis
SVLPALGEEGIYIVTWADL

SEQ ID NO: 206766 - protein, 31 aa, Mycobacterium bovis
SVMTIPGMRLPFTSIVPFVVYYGPVELPQST

SEQ ID NO: 206767 - protein, 22 aa, Mycobacterium bovis
SVNARIAVNLGAPVLLTVRAKD

SEQ ID NO: 206768 - protein, 18 aa, Mycobacterium bovis
SVNGTVVVSVWQPGEPAA

SEQ ID NO: 206769 - protein, 23 aa, Mycobacterium bovis
SVPHYGIGYGLLRYVYAPTGRVL

SEQ ID NO: 206770 - protein, 22 aa, Mycobacterium bovis
SVPRTLAGLTIVVTGSLTGFSR

SEQ ID NO: 206771 - protein, 23 aa, Mycobacterium bovis
SVPSIILGGIDWFRSMGSEKSPG

SEQ ID NO: 206772 - protein, 19 aa, Mycobacterium bovis
SVPVGGLLAPLQPVTVTLT

SEQ ID NO: 206773 - protein, 24 aa, Mycobacterium bovis
SVQRESGIEFGRYLTEAVCEPLGM

SEQ ID NO: 206774 - protein, 25 aa, Mycobacterium bovis
SVRDVRLATVLSRCSYLRDGIVVRD

SEQ ID NO: 206775 - protein, 24 aa, Mycobacterium bovis
SVRGCDAFVLQSCPAPVNRWLMEQ

SEQ ID NO: 206776 - protein, 25 aa, Mycobacterium bovis
SVSGELRNDIELHLRRGIESDALRL

SEQ ID NO: 206777 - protein, 17 aa, Mycobacterium bovis
SVSLKFQGFEVYTATNG

SEQ ID NO: 206778 - protein, 25 aa, Mycobacterium bovis
SVSSSLVRRAGCPVAVIHSDDAVIP

SEQ ID NO: 206779 - protein, 31 aa, Mycobacterium bovis
SVTISGLRRDYRWAEADRHLWIADERGTWHL

SEQ ID NO: 206780 - protein, 17 aa, Mycobacterium bovis
SVTSDLASQAWQGPAAA

SEQ ID NO: 206781 - protein, 23 aa, Mycobacterium bovis
SVTSELTSGAWLGPSAAAMMAVA

SEQ ID NO: 206782 - protein, 42 aa, Mycobacterium bovis
SVTSGLADAAWRGPAAVAMARAVAPYLGWLISATAQAEQAAA

SEQ ID NO: 206783 - protein, 17 aa, Mycobacterium bovis
SVTSGLVGGAWQGASSS

SEQ ID NO: 206784 - protein, 17 aa, Mycobacterium bovis
SVTSGLVGGIWQGPSSV

SEQ ID NO: 206785 - protein, 17 aa, Mycobacterium bovis
SVTTGLTGQAWQGPASA

SEQ ID NO: 206786 - protein, 20 aa, Mycobacterium bovis
SVVATSLYSRLNCSIVNTGA

SEQ ID NO: 206787 - protein, 22 aa, Mycobacterium bovis
SVVINPFFDWAYDRSPRTPYHE

SEQ ID NO: 206788 - protein, 17 aa, Mycobacterium bovis
SVYARVNPFGFIETPYR

SEQ ID NO: 206789 - protein, 23 aa, Mycobacterium bovis
SVYWRLMALDQRFGIADRFENSR

SEQ ID NO: 206790 - protein, 18 aa, Mycobacterium bovis
SWDLRKFLWAPRLGCYGI

SEQ ID NO: 206791 - protein, 19 aa, Mycobacterium bovis
SWGDVAMMLSLPYQGLGNA

SEQ ID NO: 206792 - protein, 23 aa, Mycobacterium bovis
SWLETETSCTFGRGPNPLLVSVR

SEQ ID NO: 206793 - protein, 21 aa, Mycobacterium bovis
SWLRRWVRDGYAWVQPRLSPV

SEQ ID NO: 206794 - protein, 25 aa, Mycobacterium bovis
SWWKEERGARIFIDFNQNARDRTMA

SEQ ID NO: 206795 - protein, 24 aa, Mycobacterium bovis
SYADVRTPFGLWPNVPPQVIADAL

SEQ ID NO: 206796 - protein, 25 aa, Mycobacterium bovis
SYANRFGYNVVRDFTGHGIGTTFHN

SEQ ID NO: 206797 - protein, 24 aa, Mycobacterium bovis
SYARQRPGLLAAWLDGDLGELPGD

SEQ ID NO: 206798 - protein, 25 aa, Mycobacterium bovis
SYGRFMRIRIFDCWMHEQDIRAAVQ

SEQ ID NO: 206799 - protein, 22 aa, Mycobacterium bovis
SYLFQPGHRIRIAIAGADASHF

SEQ ID NO: 206800 - protein, 28 aa, Mycobacterium bovis
SYLGFNEFRAIAGIGEMFDTLLVYENFP

SEQ ID NO: 206801 - protein, 23 aa, Mycobacterium bovis
SYLPSELVAAFLWAQFEEAERIT

SEQ ID NO: 206802 - protein, 19 aa, Mycobacterium bovis
SYNHYSVGWAHAMDTPYQW

SEQ ID NO: 206803 - protein, 34 aa, Mycobacterium bovis
SYPVLAVTLGEEFPRLMVYRGPRRKGVRYFGPYS

SEQ ID NO: 206804 - protein, 18 aa, Mycobacterium bovis
SYQCAIDAMSSRCFPSYA

SEQ ID NO: 206805 - protein, 20 aa, Mycobacterium bovis
SYSESFGLVAVEAQACGTPV

SEQ ID NO: 206806 - protein, 29 aa, Mycobacterium bovis
SYSNGILWRGDYQGLIGYSDTLSIPAIPL

SEQ ID NO: 206807 - protein, 19 aa, Mycobacterium bovis
SYVLHPYQMVKDLRTEYEV

SEQ ID NO: 206808 - protein, 21 aa, Mycobacterium bovis
TAADLRRLRGAVAGLGDPELM

SEQ ID NO: 206809 - protein, 34 aa, Mycobacterium bovis
TAAFSRMLSLFFRQHINYVLARPKLRPITGDDPA

SEQ ID NO: 206810 - protein, 17 aa, Mycobacterium bovis
TAAKREYEASVSRAQAE

SEQ ID NO: 206811 - protein, 23 aa, Mycobacterium bovis
TAAKRLCRSRVGIDAEAGPTEIA

SEQ ID NO: 206812 - protein, 17 aa, Mycobacterium bovis
TAALFALDSPARVAEFT

SEQ ID NO: 206813 - protein, 21 aa, Mycobacterium bovis
TAALSGLVDRFGLAGERLDMV

SEQ ID NO: 206814 - protein, 23 aa, Mycobacterium bovis
TAAQAAAMIAEFEAVKTAVVQPM

SEQ ID NO: 206815 - protein, 24 aa, Mycobacterium bovis
TAARRCPEATFLPSNPAAYNAASE

SEQ ID NO: 206816 - protein, 18 aa, Mycobacterium bovis
TACSNLRNPAGVGADDGA

SEQ ID NO: 206817 - protein, 19 aa, Mycobacterium bovis
TADLAMWPPAGAVPVEVAD

SEQ ID NO: 206818 - protein, 26 aa, Mycobacterium bovis
TADLNFAWPTARIAVIGADGAAQLLM

SEQ ID NO: 206819 - protein, 30 aa, Mycobacterium bovis
TAEALRGPLWRWYPGLRAGGKLMHNPHWPA

SEQ ID NO: 206820 - protein, 19 aa, Mycobacterium bovis
TAEAMYLTSGYVYGSAAVA

SEQ ID NO: 206821 - protein, 20 aa, Mycobacterium bovis
TAEAVVDCRVLPGRRAAFEA

SEQ ID NO: 206822 - protein, 21 aa, Mycobacterium bovis
TAEGPRRAAVSSFGLGGTNAH

SEQ ID NO: 206823 - protein, 28 aa, Mycobacterium bovis
TAELLADCARLLLQIPAVLGLAFDGGWW

SEQ ID NO: 206824 - protein, 25 aa, Mycobacterium bovis
TAEQMKMFLTRLGFGSKVVVTGDVT

SEQ ID NO: 206825 - protein, 26 aa, Mycobacterium bovis
TAFAESVPMWGPRGAALIQAIPEATQ

SEQ ID NO: 206826 - protein, 18 aa, Mycobacterium bovis
TAFFDEYFLATADAGVRQ

SEQ ID NO: 206827 - protein, 18 aa, Mycobacterium bovis
TAFVYIGEICRYLLNQPA

SEQ ID NO: 206828 - protein, 25 aa, Mycobacterium bovis
TAGCVIGGTAWDFANGNRVPKASLD

SEQ ID NO: 206829 - protein, 18 aa, Mycobacterium bovis
TAGDRPDVLVAMNPAALK

SEQ ID NO: 206830 - protein, 28 aa, Mycobacterium bovis
TAGLPFHFQRWAEFEGFVYDQKKTGIID

SEQ ID NO: 206831 - protein, 18 aa, Mycobacterium bovis
TAGLPFLIHAVSARAQAP

SEQ ID NO: 206832 - protein, 26 aa, Mycobacterium bovis
TAGRVKRPQIAIATWIVPSIVAFGTD

SEQ ID NO: 206833 - protein, 17 aa, Mycobacterium bovis
TAHWYGRTLHFGVREHA

SEQ ID NO: 206834 - protein, 17 aa, Mycobacterium bovis
TAIEEIVRWTSPSPSKR

SEQ ID NO: 206835 - protein, 24 aa, Mycobacterium bovis
TAIQARAAALAFEQAYAMTLPPPV

SEQ ID NO: 206836 - protein, 26 aa, Mycobacterium bovis
TAISARSEWAPEFAIHDLDSLDALAA

SEQ ID NO: 206837 - protein, 17 aa, Mycobacterium bovis
TAIVARVPVRAFINPAN

SEQ ID NO: 206838 - protein, 24 aa, Mycobacterium bovis
TAKMTARYSQWVRSRPLLLAGKSV

SEQ ID NO: 206839 - protein, 23 aa, Mycobacterium bovis
TAKREIRLLSRFTGANPTVPVVG

SEQ ID NO: 206840 - protein, 23 aa, Mycobacterium bovis
TAKRLGANPGRCVVIDSCQTGLR

SEQ ID NO: 206841 - protein, 25 aa, Mycobacterium bovis
TAKSMPYKSGFGPFAPEIYRAPLSY

SEQ ID NO: 206842 - protein, 17 aa, Mycobacterium bovis
TALAMAMGHVILSECYV

SEQ ID NO: 206843 - protein, 18 aa, Mycobacterium bovis
TALARRVRRGELAAPDDD

SEQ ID NO: 206844 - protein, 22 aa, Mycobacterium bovis
TALCAGEKMMLLFESANFDEAV

SEQ ID NO: 206845 - protein, 20 aa, Mycobacterium bovis
TALDLARRYPVGKAVAAIDA

SEQ ID NO: 206846 - protein, 24 aa, Mycobacterium bovis
TALEFRPKVIIAGWSAYPRVLDFA

SEQ ID NO: 206847 - protein, 18 aa, Mycobacterium bovis
TALGCYAEPGWARERGWP

SEQ ID NO: 206848 - protein, 17 aa, Mycobacterium bovis
TALRDSLDIYGVMATPG

SEQ ID NO: 206849 - protein, 22 aa, Mycobacterium bovis
TALRLPRDAELVVDGQDVVTDV

SEQ ID NO: 206850 - protein, 22 aa, Mycobacterium bovis
TALTDATRDFAIGLAGIPPSLQ

SEQ ID NO: 206851 - protein, 19 aa, Mycobacterium bovis
TALVPGRPAPTLVTAAAVE

SEQ ID NO: 206852 - protein, 24 aa, Mycobacterium bovis
TAMLRRLGIEGDFKGGFRVTTPEV

SEQ ID NO: 206853 - protein, 29 aa, Mycobacterium bovis
TANAYLGAWGIVDCFERGADVVVTGRVTD

SEQ ID NO: 206854 - protein, 27 aa, Mycobacterium bovis
TAPAGFRAAGVAAGIKASGALDLALVF

SEQ ID NO: 206855 - protein, 26 aa, Mycobacterium bovis
TAPEISARILMKLKRDAEAYLGEDIT

SEQ ID NO: 206856 - protein, 19 aa, Mycobacterium bovis
TAPLKEWVEPNAVKLDPAK

SEQ ID NO: 206857 - protein, 19 aa, Mycobacterium bovis
TAPQCTHYPLAEAADAIRA

SEQ ID NO: 206858 - protein, 17 aa, Mycobacterium bovis
TAPSGRKPLRFTSFGDQ

SEQ ID NO: 206859 - protein, 18 aa, Mycobacterium bovis
TAPTAIGLRGIYRGIAGA

SEQ ID NO: 206860 - protein, 28 aa, Mycobacterium bovis
TAPTLIRMFMKWGREIPDSHDLSSLRLL

SEQ ID NO: 206861 - protein, 22 aa, Mycobacterium bovis
TAQKYPAILAMTSLNDTRVYYV

SEQ ID NO: 206862 - protein, 17 aa, Mycobacterium bovis
TAQRIVLTRNPRWWGAR

SEQ ID NO: 206863 - protein, 19 aa, Mycobacterium bovis
TAQVLLAVLAAMYASYHGA

SEQ ID NO: 206864 - protein, 18 aa, Mycobacterium bovis
TARIQLRLADPGESQMGH

SEQ ID NO: 206865 - protein, 19 aa, Mycobacterium bovis
TARMVRSRLDAELVGNVSI

SEQ ID NO: 206866 - protein, 17 aa, Mycobacterium bovis
TASHHRRALGIQRLLAA

SEQ ID NO: 206867 - protein, 26 aa, Mycobacterium bovis
TATPLRPGIWRAYADHRMAMAGAIIG

SEQ ID NO: 206868 - protein, 23 aa, Mycobacterium bovis
TATPRAYPFTNLIGPASTNDIVV

SEQ ID NO: 206869 - protein, 25 aa, Mycobacterium bovis
TATSAEFRKLLADWKAAGRASKDVD

SEQ ID NO: 206870 - protein, 19 aa, Mycobacterium bovis
TATVIERWVQEYLEATARL

SEQ ID NO: 206871 - protein, 17 aa, Mycobacterium bovis
TAVAAGILRTSAQVVAL

SEQ ID NO: 206872 - protein, 22 aa, Mycobacterium bovis
TAVAGYGARFAGVAYPGETLTV

SEQ ID NO: 206873 - protein, 22 aa, Mycobacterium bovis
TAVEEIVRWASPVVYMRRTLTQ

SEQ ID NO: 206874 - protein, 20 aa, Mycobacterium bovis
TAVICARAGLNVQVVEAQAT

SEQ ID NO: 206875 - protein, 27 aa, Mycobacterium bovis
TAVPVKLHVPIFLDIPVTGTLGTFTVH

SEQ ID NO: 206876 - protein, 23 aa, Mycobacterium bovis
TAVQARAAWDAVNADIARYNARC

SEQ ID NO: 206877 - protein, 17 aa, Mycobacterium bovis
TAVRRRVTWAFHDRRGR

SEQ ID NO: 206878 - protein, 21 aa, Mycobacterium bovis
TAVRWKNVLRQAAVYSACQKW

SEQ ID NO: 206879 - protein, 23 aa, Mycobacterium bovis
TAVSGFPDFLAKDVIDIQVTVES

SEQ ID NO: 206880 - protein, 24 aa, Mycobacterium bovis
TAVYVCGPPGMLEAVRVARNQHAD

SEQ ID NO: 206881 - protein, 19 aa, Mycobacterium bovis
TAWLAEGMLIYLPPDPRTG

SEQ ID NO: 206882 - protein, 17 aa, Mycobacterium bovis
TAYFGERQRAVGGAGRF

SEQ ID NO: 206883 - protein, 19 aa, Mycobacterium bovis
TCDRSRLTADGIWLHCLYA

SEQ ID NO: 206884 - protein, 26 aa, Mycobacterium bovis
TCIECPAGTIGEIWVKGDNVAEGYWN

SEQ ID NO: 206885 - protein, 17 aa, Mycobacterium bovis
TCQTGGKALADRRMSRL

SEQ ID NO: 206886 - protein, 18 aa, Mycobacterium bovis
TCRSLEFHRAVEVIAVGR

SEQ ID NO: 206887 - protein, 21 aa, Mycobacterium bovis
TCSPTRYGGVKGAHRIDLDAI

SEQ ID NO: 206888 - protein, 22 aa, Mycobacterium bovis
TCTAADVPFFFKQWGGRTPKAF

SEQ ID NO: 206889 - protein, 23 aa, Mycobacterium bovis
TCVGRLRYLGLVLYDVDQVLQAA

SEQ ID NO: 206890 - protein, 20 aa, Mycobacterium bovis
TDADGGPALVEFAGRACYQS

SEQ ID NO: 206891 - protein, 18 aa, Mycobacterium bovis
TDAELGWIATAFDPNVLT

SEQ ID NO: 206892 - protein, 27 aa, Mycobacterium bovis
TDAEPRWPTFGIRLSARPGIPPTRPVQ

SEQ ID NO: 206893 - protein, 22 aa, Mycobacterium bovis
TDAETTWKLLLDRQSGIRTLDD

SEQ ID NO: 206894 - protein, 17 aa, Mycobacterium bovis
TDAGAQWRQAGCSMCLG

SEQ ID NO: 206895 - protein, 25 aa, Mycobacterium bovis
TDAGRRIRDAFVVGDGYAELMTADY

SEQ ID NO: 206896 - protein, 19 aa, Mycobacterium bovis
TDALEHFIDLVARVEAAAT

SEQ ID NO: 206897 - protein, 24 aa, Mycobacterium bovis
TDAPRPALTINFCVGFVRQQVNQQ

SEQ ID NO: 206898 - protein, 28 aa, Mycobacterium bovis
TDARRREVYWARYCDGIRTVGPAVNAAA

SEQ ID NO: 206899 - protein, 18 aa, Mycobacterium bovis
TDCHLIALAARYGGRLVT

SEQ ID NO: 206900 - protein, 23 aa, Mycobacterium bovis
TDDARFGIPLGKLGVTTGFTEAD

SEQ ID NO: 206901 - protein, 18 aa, Mycobacterium bovis
TDDCGPIIAGWLEQHGFS

SEQ ID NO: 206902 - protein, 20 aa, Mycobacterium bovis
TDEIKRRILAMAQPDADGNR

SEQ ID NO: 206903 - protein, 25 aa, Mycobacterium bovis
TDELDFLRLAVFDALLVLQADTAPV

SEQ ID NO: 206904 - protein, 25 aa, Mycobacterium bovis
TDEMKRQALAWAMSVAGKRANALLA

SEQ ID NO: 206905 - protein, 26 aa, Mycobacterium bovis
TDERGRRFLIHTARIAYVEIGVADAR

SEQ ID NO: 206906 - protein, 17 aa, Mycobacterium bovis
TDFFSDTTFRVFQAPYV

SEQ ID NO: 206907 - protein, 25 aa, Mycobacterium bovis
TDGDLPPRFPIVGGHEGSGVIEEVG

SEQ ID NO: 206908 - protein, 31 aa, Mycobacterium bovis
TDGRTAAAFALACQRAGVPMQRYEHRADLPC

SEQ ID NO: 206909 - protein, 22 aa, Mycobacterium bovis
TDIANAVAWLASEEARYVTGVT

SEQ ID NO: 206910 - protein, 17 aa, Mycobacterium bovis
TDIPVTVKFRIGIDDAH

SEQ ID NO: 206911 - protein, 19 aa, Mycobacterium bovis
TDIWDKGKAAVICSETTAT

SEQ ID NO: 206912 - protein, 21 aa, Mycobacterium bovis
TDLRTRLDAALAKPAAQQPTW

SEQ ID NO: 206913 - protein, 25 aa, Mycobacterium bovis
TDLTLEEGVVFNAEISAAIEERLSR

SEQ ID NO: 206914 - protein, 24 aa, Mycobacterium bovis
TDMFWPGWRMAPSPAQLAFLQQVD

SEQ ID NO: 206915 - protein, 29 aa, Mycobacterium bovis
TDMPGVTPAMWAWWFGWHGSDTRRYKLWH

SEQ ID NO: 206916 - protein, 19 aa, Mycobacterium bovis
TDMVLRLAAGMERRTTHGG

SEQ ID NO: 206917 - protein, 24 aa, Mycobacterium bovis
TDPDGWSWPKARQMFEERAHLLPV

SEQ ID NO: 206918 - protein, 26 aa, Mycobacterium bovis
TDPQELHELLTLPFRSASEFIDATLA

SEQ ID NO: 206919 - protein, 24 aa, Mycobacterium bovis
TDRPVFICGPGPFMQAARDALAAL

SEQ ID NO: 206920 - protein, 19 aa, Mycobacterium bovis
TDSYIKLVFVDDDVDVGRL

SEQ ID NO: 206921 - protein, 20 aa, Mycobacterium bovis
TDTKIAWKGDEAVELTSSTE

SEQ ID NO: 206922 - protein, 23 aa, Mycobacterium bovis
TDVAHGWIPPGIALPEGVRLLAP

SEQ ID NO: 206923 - protein, 17 aa, Mycobacterium bovis
TDVAIMLGLAYVLATES

SEQ ID NO: 206924 - protein, 20 aa, Mycobacterium bovis
TDVRSGLLFVWHDHEGNPPD

SEQ ID NO: 206925 - protein, 25 aa, Mycobacterium bovis
TEACGDCPRVVLGSPLAGESLDEVL

SEQ ID NO: 206926 - protein, 22 aa, Mycobacterium bovis
TEAELRAIVDIAARHGARVIAD

SEQ ID NO: 206927 - protein, 25 aa, Mycobacterium bovis
TEALTNWYVRRSRSRFWAEDADAID

SEQ ID NO: 206928 - protein, 23 aa, Mycobacterium bovis
TEALVGRKLIGDGAHGAPGTGQA

SEQ ID NO: 206929 - protein, 17 aa, Mycobacterium bovis
TEALVRWQHPTRGLLAP

SEQ ID NO: 206930 - protein, 30 aa, Mycobacterium bovis
TEAPAEMHFYFPRFRALCMAENATHNLHNL

SEQ ID NO: 206931 - protein, 23 aa, Mycobacterium bovis
TEARGLFPRHLDTIVNVPAPSWD

SEQ ID NO: 206932 - protein, 28 aa, Mycobacterium bovis
TEAVARGDFRAALVVGDRLDTDIEGANA

SEQ ID NO: 206933 - protein, 31 aa, Mycobacterium bovis
TEAWMRLQHRPRWQVTVSVVFDDWAAAVAAT

SEQ ID NO: 206934 - protein, 33 aa, Mycobacterium bovis
TECRRLRPDFATGLMPLRWGTGFMLGSAKYGPF

SEQ ID NO: 206935 - protein, 22 aa, Mycobacterium bovis
TEDLKLLGVHIFGTSATEMVHI

SEQ ID NO: 206936 - protein, 17 aa, Mycobacterium bovis
TEEFSIRVFPGDHFYLN

SEQ ID NO: 206937 - protein, 27 aa, Mycobacterium bovis
TEEQKKWAVLAAERGWGSTMVLTEPDA

SEQ ID NO: 206938 - protein, 19 aa, Mycobacterium bovis
TEFELLAAAARDAFGLDVH

SEQ ID NO: 206939 - protein, 22 aa, Mycobacterium bovis
TEFLPGSLIDRAEFEAENRRVV

SEQ ID NO: 206940 - protein, 22 aa, Mycobacterium bovis
TEFVKLQEWARHSGARLVVIFE

SEQ ID NO: 206941 - protein, 22 aa, Mycobacterium bovis
TEGLPRLRALTGELAAGVRLGM

SEQ ID NO: 206942 - protein, 22 aa, Mycobacterium bovis
TEGRTALRFLPMEELIAAFLPV

SEQ ID NO: 206943 - protein, 24 aa, Mycobacterium bovis
TEGTRIWTRHGILTHNLIKISSLA

SEQ ID NO: 206944 - protein, 28 aa, Mycobacterium bovis
TEGVPRWRKATGLGWLTAEYAMLPSATH

SEQ ID NO: 206945 - protein, 23 aa, Mycobacterium bovis
TEHLPGIAVPTVFTHGTADPFGT

SEQ ID NO: 206946 - protein, 25 aa, Mycobacterium bovis
TEIDNLRAAFAWSRENGHITEALQL

SEQ ID NO: 206947 - protein, 24 aa, Mycobacterium bovis
TEIDNWRWAGVPIFVRAGKELPAK

SEQ ID NO: 206948 - protein, 18 aa, Mycobacterium bovis
TEIGRELTARTGGVVGRR

SEQ ID NO: 206949 - protein, 25 aa, Mycobacterium bovis
TEIPRGGRRLFVFLGSTIGNLTPGP

SEQ ID NO: 206950 - protein, 25 aa, Mycobacterium bovis
TELLEYHWGPDWVVWDAAKTAQQHG

SEQ ID NO: 206951 - protein, 22 aa, Mycobacterium bovis
TELRAIAGLVLVAGFETTVNLL

SEQ ID NO: 206952 - protein, 21 aa, Mycobacterium bovis
TELRTTGWFTGLVPITVPVAS

SEQ ID NO: 206953 - protein, 23 aa, Mycobacterium bovis
TELRVRCVRQLRDAMQQHVEELR

SEQ ID NO: 206954 - protein, 17 aa, Mycobacterium bovis
TELTGITGARTWCGHGV

SEQ ID NO: 206955 - protein, 18 aa, Mycobacterium bovis
TELVAWLNGHPDFNDLPV

SEQ ID NO: 206956 - protein, 18 aa, Mycobacterium bovis
TELVCSNAAIVLGHSGTE

SEQ ID NO: 206957 - protein, 18 aa, Mycobacterium bovis
TELVYRYLDTEAIAVVQG

SEQ ID NO: 206958 - protein, 17 aa, Mycobacterium bovis
TEMPARIADDFLAGLHR

SEQ ID NO: 206959 - protein, 24 aa, Mycobacterium bovis
TEPAGLKGLHEFFTPVLRNLGRCG

SEQ ID NO: 206960 - protein, 22 aa, Mycobacterium bovis
TEPDAFKWIQRAAMDRRTTMKR

SEQ ID NO: 206961 - protein, 23 aa, Mycobacterium bovis
TEPDIGPIIVPSFVLSVPTFAIA

SEQ ID NO: 206962 - protein, 28 aa, Mycobacterium bovis
TEPGYRPSVKLAAFVRARDLTCRAPGCD

SEQ ID NO: 206963 - protein, 21 aa, Mycobacterium bovis
TEPIEVWSFDVMSFVDHTATM

SEQ ID NO: 206964 - protein, 21 aa, Mycobacterium bovis
TEPQLRELAARGAAELDGATA

SEQ ID NO: 206965 - protein, 25 aa, Mycobacterium bovis
TEPVAVVGIGCRFPGGVDGPDGLWD

SEQ ID NO: 206966 - protein, 21 aa, Mycobacterium bovis
TEQDFRLFSGMSAHYDSLPRL

SEQ ID NO: 206967 - protein, 21 aa, Mycobacterium bovis
TEQSLRFTAALDELLAPLAEP

SEQ ID NO: 206968 - protein, 21 aa, Mycobacterium bovis
TERHIRLIFQRAREKASEGTP

SEQ ID NO: 206969 - protein, 25 aa, Mycobacterium bovis
TERILFRRLAVFVGGFDLTAASEVA

SEQ ID NO: 206970 - protein, 20 aa, Mycobacterium bovis
TERILYYTGINYKIGEVHDG

SEQ ID NO: 206971 - protein, 22 aa, Mycobacterium bovis
TERLPGKWGEYLLASRATTIYG

SEQ ID NO: 206972 - protein, 20 aa, Mycobacterium bovis
TERMCARIAAVMGYTDQSTV

SEQ ID NO: 206973 - protein, 18 aa, Mycobacterium bovis
TERVRLAPEPVYTDAEWV

SEQ ID NO: 206974 - protein, 23 aa, Mycobacterium bovis
TESALRFVGAATFEALSGEPVCT

SEQ ID NO: 206975 - protein, 37 aa, Mycobacterium bovis
TESAMRVCGGAAFSKHLPIERAFRDARAGSVMAPTAD

SEQ ID NO: 206976 - protein, 19 aa, Mycobacterium bovis
TETADRWEDVFLQMRNQAH

SEQ ID NO: 206977 - protein, 26 aa, Mycobacterium bovis
TETFDAVVCSLVLCSVSDPGAVLAHL

SEQ ID NO: 206978 - protein, 18 aa, Mycobacterium bovis
TEVISNFASYLAIVLRVD

SEQ ID NO: 206979 - protein, 20 aa, Mycobacterium bovis
TEVIVAPGYAPGALDVLARK

SEQ ID NO: 206980 - protein, 36 aa, Mycobacterium bovis
TEVPIGAGCKICNRTSCAQRAFPYLGGRVAVDENAG

SEQ ID NO: 206981 - protein, 27 aa, Mycobacterium bovis
TEVPRKLLEEWLAMWSGHYQLKDKLRV

SEQ ID NO: 206982 - protein, 24 aa, Mycobacterium bovis
TEVRLRLLDTLDLFGIALGMAAFR

SEQ ID NO: 206983 - protein, 18 aa, Mycobacterium bovis
TEVSCKFRPQAVGAELAA

SEQ ID NO: 206984 - protein, 25 aa, Mycobacterium bovis
TEVTLRFPDGEVVTMHVISVVEETP

SEQ ID NO: 206985 - protein, 20 aa, Mycobacterium bovis
TEYNVRFTAVVPVPNDGKGA

SEQ ID NO: 206986 - protein, 24 aa, Mycobacterium bovis
TFARRHLRGLVGLMIDPIADVTAA

SEQ ID NO: 206987 - protein, 22 aa, Mycobacterium bovis
TFDAPRRLGLMHGDAHPGNFML

SEQ ID NO: 206988 - protein, 20 aa, Mycobacterium bovis
TFETACTWDGFDTLHAAVTD

SEQ ID NO: 206989 - protein, 18 aa, Mycobacterium bovis
TFETEFFARHGFTEIEGT

SEQ ID NO: 206990 - protein, 22 aa, Mycobacterium bovis
TFFVRGLRDWDQCAGGIVGQPE

SEQ ID NO: 206991 - protein, 17 aa, Mycobacterium bovis
TFGPRTALWLLLAKGGG

SEQ ID NO: 206992 - protein, 17 aa, Mycobacterium bovis
TFHAQFVQTLSAGAGAY

SEQ ID NO: 206993 - protein, 19 aa, Mycobacterium bovis
TFIEVCYLLIYGELPDTDQ

SEQ ID NO: 206994 - protein, 17 aa, Mycobacterium bovis
TFKAAGHVIEIRGTSVL

SEQ ID NO: 206995 - protein, 18 aa, Mycobacterium bovis
TFLAMSICDPHGGMHSLW

SEQ ID NO: 206996 - protein, 22 aa, Mycobacterium bovis
TFLEIPEVLSIVDRVLSETAIL

SEQ ID NO: 206997 - protein, 25 aa, Mycobacterium bovis
TFLRAIGAIPRFSARSSARTWLLAI

SEQ ID NO: 206998 - protein, 19 aa, Mycobacterium bovis
TFQVLPWATSSGHHHSARM

SEQ ID NO: 206999 - protein, 20 aa, Mycobacterium bovis
TFREALRLGHNYIGTEHLLL

SEQ ID NO: 207000 - protein, 24 aa, Mycobacterium bovis
TFRGCEGDALLMLLDANGIECSTG

SEQ ID NO: 207001 - protein, 23 aa, Mycobacterium bovis
TFSEAYKNAALDVMNKMRALNQF

SEQ ID NO: 207002 - protein, 17 aa, Mycobacterium bovis
TGAAVALMVLRAAVAAL

SEQ ID NO: 207003 - protein, 37 aa, Mycobacterium bovis
TGADALASIMSWQGWEELFELARFVGVSRPGYELRNE

SEQ ID NO: 207004 - protein, 20 aa, Mycobacterium bovis
TGAIVKRPRVVVDASGNESI

SEQ ID NO: 207005 - protein, 23 aa, Mycobacterium bovis
TGAKEILCIRVLGGSSRRYAGIG

SEQ ID NO: 207006 - protein, 18 aa, Mycobacterium bovis
TGALLRRTGTVVVEHRFD

SEQ ID NO: 207007 - protein, 17 aa, Mycobacterium bovis
TGAMYRIVTLAVLRAGA

SEQ ID NO: 207008 - protein, 17 aa, Mycobacterium bovis
TGAPLGLDRPWFVEDEE

SEQ ID NO: 207009 - protein, 27 aa, Mycobacterium bovis
TGASPRFLLDFSRRFPDAAVVRLERDY

SEQ ID NO: 207010 - protein, 19 aa, Mycobacterium bovis
TGCAEMFRIGYIDVNQFTC

SEQ ID NO: 207011 - protein, 23 aa, Mycobacterium bovis
TGDELRATLLALLGSPHLCSRAF

SEQ ID NO: 207012 - protein, 26 aa, Mycobacterium bovis
TGDLVCWRADGQLEFLGRTDDQVKIR

SEQ ID NO: 207013 - protein, 29 aa, Mycobacterium bovis
TGDYSNGLLWRGGYEGLVGVRVGPTISQF

SEQ ID NO: 207014 - protein, 19 aa, Mycobacterium bovis
TGFDFPFAAMGAIHTENHI

SEQ ID NO: 207015 - protein, 18 aa, Mycobacterium bovis
TGFEDGLFAGWRSDPAFV

SEQ ID NO: 207016 - protein, 23 aa, Mycobacterium bovis
TGFPEAVAAHWLTTEERHGLGND

SEQ ID NO: 207017 - protein, 25 aa, Mycobacterium bovis
TGGAGGRGGLLIGDGGAGGAGGVGG

SEQ ID NO: 207018 - protein, 21 aa, Mycobacterium bovis
TGGAGGTVFGGGKGGAGGAGG

SEQ ID NO: 207019 - protein, 18 aa, Mycobacterium bovis
TGGFTEFVPLPFVHQNSP

SEQ ID NO: 207020 - protein, 27 aa, Mycobacterium bovis
TGGGGGNGGTGWNGGKGDTGSGGGAGD

SEQ ID NO: 207021 - protein, 22 aa, Mycobacterium bovis
TGGLGGLGLFLAEKMAAAGCGR

SEQ ID NO: 207022 - protein, 21 aa, Mycobacterium bovis
TGGLGGLGLFLAEKMANAGAG

SEQ ID NO: 207023 - protein, 28 aa, Mycobacterium bovis
TGGLGGLGLVVARWLVDRGAGRVVLGGR

SEQ ID NO: 207024 - protein, 20 aa, Mycobacterium bovis
TGGPPLPGQAGMGAAGGAGG

SEQ ID NO: 207025 - protein, 24 aa, Mycobacterium bovis
TGGQRIDLFGARVDQLPLIWQRLV

SEQ ID NO: 207026 - protein, 22 aa, Mycobacterium bovis
TGGRIPREYIPSVDAGAQDAMQ

SEQ ID NO: 207027 - protein, 24 aa, Mycobacterium bovis
TGGTAHLGPLAIIGQSGQPGQFGS

SEQ ID NO: 207028 - protein, 23 aa, Mycobacterium bovis
TGGYSPPTNLLINGQAVTIDQTP

SEQ ID NO: 207029 - protein, 20 aa, Mycobacterium bovis
TGHVLLPGFVDLHTHLREPG

SEQ ID NO: 207030 - protein, 31 aa, Mycobacterium bovis
TGIALAMVCAARGYRCVLTMPETMSLERRML

SEQ ID NO: 207031 - protein, 20 aa, Mycobacterium bovis
TGIDEPRLGLILEIAAAAGL

SEQ ID NO: 207032 - protein, 17 aa, Mycobacterium bovis
TGIRRAGADIVLTYWAV

SEQ ID NO: 207033 - protein, 29 aa, Mycobacterium bovis
TGIVSRGGSIMAAWCLAHHRESFLYTNFE

SEQ ID NO: 207034 - protein, 23 aa, Mycobacterium bovis
TGKLRPPVFGILRYITDAVDEID

SEQ ID NO: 207035 - protein, 23 aa, Mycobacterium bovis
TGKPDALVPLARRVTGECLAEDL

SEQ ID NO: 207036 - protein, 18 aa, Mycobacterium bovis
TGKPHGWIHDELRRRCGG

SEQ ID NO: 207037 - protein, 26 aa, Mycobacterium bovis
TGKSELWPDLNLGLPFTYHQGYQSSP

SEQ ID NO: 207038 - protein, 21 aa, Mycobacterium bovis
TGLLAPHWPAPYGRGASPAEQ

SEQ ID NO: 207039 - protein, 20 aa, Mycobacterium bovis
TGLLDLLNRLGITPLPNTAG

SEQ ID NO: 207040 - protein, 18 aa, Mycobacterium bovis
TGMELRAAIDAGDVVVAE

SEQ ID NO: 207041 - protein, 24 aa, Mycobacterium bovis
TGNARPAQIAAFAVAMTMKAPTAD

SEQ ID NO: 207042 - protein, 26 aa, Mycobacterium bovis
TGNWASIVPHTWLWAMPMSGPTGGEI

SEQ ID NO: 207043 - protein, 24 aa, Mycobacterium bovis
TGPELLSRAAALNWDTTAPATVLV

SEQ ID NO: 207044 - protein, 24 aa, Mycobacterium bovis
TGPFFLLDIDSFWTPSGGSIPEYN

SEQ ID NO: 207045 - protein, 24 aa, Mycobacterium bovis
TGPYDYLLHIRVCDTADLDRLLRR

SEQ ID NO: 207046 - protein, 23 aa, Mycobacterium bovis
TGQAGGPGGILYGNGGNGGSGAP

SEQ ID NO: 207047 - protein, 23 aa, Mycobacterium bovis
TGQAGGPGGLLYGNGGNGGSGGV

SEQ ID NO: 207048 - protein, 18 aa, Mycobacterium bovis
TGQNGGDGGWLYGNGGNG

SEQ ID NO: 207049 - protein, 25 aa, Mycobacterium bovis
TGQRAAGLSQIWSRQLGRAIGPDSS

SEQ ID NO: 207050 - protein, 18 aa, Mycobacterium bovis
TGRCCGHVDFGNLGVADR

SEQ ID NO: 207051 - protein, 18 aa, Mycobacterium bovis
TGRNALALARRGHPVDVV

SEQ ID NO: 207052 - protein, 22 aa, Mycobacterium bovis
TGRPTGEWSAAVSRLAAAEAAV

SEQ ID NO: 207053 - protein, 17 aa, Mycobacterium bovis
TGRRWFDEHGISFTRHY

SEQ ID NO: 207054 - protein, 17 aa, Mycobacterium bovis
TGRTHLQFRRFAACPIC

SEQ ID NO: 207055 - protein, 25 aa, Mycobacterium bovis
TGSHPFMKFEGWTPLAQLKVGDRIA

SEQ ID NO: 207056 - protein, 23 aa, Mycobacterium bovis
TGSVPQRLWAKPAITVIGIDTTS

SEQ ID NO: 207057 - protein, 19 aa, Mycobacterium bovis
TGSWLRRDRRTFTATQLVL

SEQ ID NO: 207058 - protein, 24 aa, Mycobacterium bovis
TGTGCRPSRVWVMNRLREKMPHVY

SEQ ID NO: 207059 - protein, 23 aa, Mycobacterium bovis
TGTRAHSARSWLGDNAIHKLGAV

SEQ ID NO: 207060 - protein, 20 aa, Mycobacterium bovis
TGVAFAFGPGVTVEGMLFDI

SEQ ID NO: 207061 - protein, 19 aa, Mycobacterium bovis
TGVAFALVHNRLLSPLVMT

SEQ ID NO: 207062 - protein, 21 aa, Mycobacterium bovis
TGVAPRIPAIPGIDHPMVLTY

SEQ ID NO: 207063 - protein, 24 aa, Mycobacterium bovis
TGVAYIRWLLRARPADYMLALSVA

SEQ ID NO: 207064 - protein, 20 aa, Mycobacterium bovis
TGVGGTVVFRGGQFGGQFRD

SEQ ID NO: 207065 - protein, 27 aa, Mycobacterium bovis
TGVGSCRDSAWLLVSILRQFGLAARFV

SEQ ID NO: 207066 - protein, 22 aa, Mycobacterium bovis
TGVLHWNRRVQAWLAEETGQPP

SEQ ID NO: 207067 - protein, 20 aa, Mycobacterium bovis
TGVMWKRFSETGAIKAKSVI

SEQ ID NO: 207068 - protein, 23 aa, Mycobacterium bovis
TGWTRSRPGDSFIVAPQSDGGPG

SEQ ID NO: 207069 - protein, 21 aa, Mycobacterium bovis
THARTRLIAKMSYTNIGFALA

SEQ ID NO: 207070 - protein, 22 aa, Mycobacterium bovis
THDSGRVLVMIGVRSREPIVEL

SEQ ID NO: 207071 - protein, 23 aa, Mycobacterium bovis
THEVWKAGQPVSLSPTEFTLLRY

SEQ ID NO: 207072 - protein, 18 aa, Mycobacterium bovis
THHYRFTLYHLPVALQLP

SEQ ID NO: 207073 - protein, 25 aa, Mycobacterium bovis
THIESRPAVTLSWIREFPSLGAAAY

SEQ ID NO: 207074 - protein, 23 aa, Mycobacterium bovis
THKHFDHVLGSSVFDQAEVFCAP

SEQ ID NO: 207075 - protein, 18 aa, Mycobacterium bovis
THLGLPADFLLDADGTVA

SEQ ID NO: 207076 - protein, 19 aa, Mycobacterium bovis
THLGWCAHSGWKVDAAKGV

SEQ ID NO: 207077 - protein, 29 aa, Mycobacterium bovis
THLPPGAWPPTSWYADWIRGLDVFTTNVE

SEQ ID NO: 207078 - protein, 23 aa, Mycobacterium bovis
THPEELRDLLGTVYRLTAAGELP

SEQ ID NO: 207079 - protein, 23 aa, Mycobacterium bovis
THSPDRFVTYHVMNPYDDGIGLD

SEQ ID NO: 207080 - protein, 31 aa, Mycobacterium bovis
THTEFPYVFCDATFCKVRVGAHVVSQALVVA

SEQ ID NO: 207081 - protein, 18 aa, Mycobacterium bovis
THYLRVYLAQLRRKLEDD

SEQ ID NO: 207082 - protein, 18 aa, Mycobacterium bovis
TIATSLRGALGSAPASVS

SEQ ID NO: 207083 - protein, 17 aa, Mycobacterium bovis
TIDRPSAHEILSAKLAP

SEQ ID NO: 207084 - protein, 25 aa, Mycobacterium bovis
TIGEIPFDLVAHSTLGPVHILIDLP

SEQ ID NO: 207085 - protein, 17 aa, Mycobacterium bovis
TIHKHKVNLLFFTGDAM

SEQ ID NO: 207086 - protein, 18 aa, Mycobacterium bovis
TIKSALLTAYRHTQGHQT

SEQ ID NO: 207087 - protein, 21 aa, Mycobacterium bovis
TILLECTMAGMATCTLTHLIE

SEQ ID NO: 207088 - protein, 18 aa, Mycobacterium bovis
TIMDRYGAVWQREDVGVI

SEQ ID NO: 207089 - protein, 24 aa, Mycobacterium bovis
TIPAGNHCRRIYATHDTHPVNKYT

SEQ ID NO: 207090 - protein, 17 aa, Mycobacterium bovis
TIPEFLAALEKPRRVLI

SEQ ID NO: 207091 - protein, 32 aa, Mycobacterium bovis
TIRGCGAPLLSLRTDRDWLADIVRFVASRRRG

SEQ ID NO: 207092 - protein, 18 aa, Mycobacterium bovis
TIRGDFALETQFNLVHGS

SEQ ID NO: 207093 - protein, 23 aa, Mycobacterium bovis
TIRQRLGGIEGRRIVIVGDILHS

SEQ ID NO: 207094 - protein, 18 aa, Mycobacterium bovis
TISELRYPATAFTDAIDA

SEQ ID NO: 207095 - protein, 20 aa, Mycobacterium bovis
TISRRVREALAMAESDPSHP

SEQ ID NO: 207096 - protein, 31 aa, Mycobacterium bovis
TITARFPKFDWPRIDAPYMRPGLDEPAMAAL

SEQ ID NO: 207097 - protein, 18 aa, Mycobacterium bovis
TITGCCLITARALVARTR

SEQ ID NO: 207098 - protein, 17 aa, Mycobacterium bovis
TITIERPAAFLNVDIPV

SEQ ID NO: 207099 - protein, 21 aa, Mycobacterium bovis
TKADLYAAVDAMRADMRELLE

SEQ ID NO: 207100 - protein, 17 aa, Mycobacterium bovis
TKARLSDGVLGVRAEYL

SEQ ID NO: 207101 - protein, 20 aa, Mycobacterium bovis
TKFADEWVRCAAGTDTALAM

SEQ ID NO: 207102 - protein, 18 aa, Mycobacterium bovis
TKFFDEFFMDATRAGIRQ

SEQ ID NO: 207103 - protein, 30 aa, Mycobacterium bovis
TKFFPATDVAILFRLGCRSVGESREQEASA

SEQ ID NO: 207104 - protein, 22 aa, Mycobacterium bovis
TKIRLLTRIAFGFRSPEALIAL

SEQ ID NO: 207105 - protein, 30 aa, Mycobacterium bovis
TKIVGLRARAKAAFAEREGVNLTFLPFFAK

SEQ ID NO: 207106 - protein, 18 aa, Mycobacterium bovis
TKKHWRAPSKLAYIDAGL

SEQ ID NO: 207107 - protein, 29 aa, Mycobacterium bovis
TKLPWSDWLPRQRWYAGRNRELATVKPGV

SEQ ID NO: 207108 - protein, 17 aa, Mycobacterium bovis
TKLRLGTSVLCNSYRHP

SEQ ID NO: 207109 - protein, 25 aa, Mycobacterium bovis
TKNSEVSTVWTWPDKPGVAGCAAMD

SEQ ID NO: 207110 - protein, 25 aa, Mycobacterium bovis
TKRGCGAALPFKRRLFGQIVAAAVR

SEQ ID NO: 207111 - protein, 26 aa, Mycobacterium bovis
TKRLASPAQRIMLFANDRGCTKPGCD

SEQ ID NO: 207112 - protein, 17 aa, Mycobacterium bovis
TKRSETFTTADDNQPSV

SEQ ID NO: 207113 - protein, 22 aa, Mycobacterium bovis
TKRSLNHWYRMFGPAFETSLGL

SEQ ID NO: 207114 - protein, 26 aa, Mycobacterium bovis
TKSGAWCVAADFSVGMLAAGAARKVP

SEQ ID NO: 207115 - protein, 17 aa, Mycobacterium bovis
TLAELRVGVLAAATTDI

SEQ ID NO: 207116 - protein, 20 aa, Mycobacterium bovis
TLAGGLWLRTVDEVGECYPD

SEQ ID NO: 207117 - protein, 23 aa, Mycobacterium bovis
TLAQRWDLTASELARNVHTHPTM

SEQ ID NO: 207118 - protein, 19 aa, Mycobacterium bovis
TLASQAAHVVMRFQQGLAE

SEQ ID NO: 207119 - protein, 20 aa, Mycobacterium bovis
TLATWKRLCDPMAQQISTVW

SEQ ID NO: 207120 - protein, 17 aa, Mycobacterium bovis
TLAVNGFQIPAITLRAL

SEQ ID NO: 207121 - protein, 25 aa, Mycobacterium bovis
TLAVSFSECNAGLVVDEVDADLLAA

SEQ ID NO: 207122 - protein, 23 aa, Mycobacterium bovis
TLDALVSLVLDWHRPVKIFVETK

SEQ ID NO: 207123 - protein, 18 aa, Mycobacterium bovis
TLDELDCLLDRLDGTVPF

SEQ ID NO: 207124 - protein, 24 aa, Mycobacterium bovis
TLDGRFRVPFVMRAEEKLLSYNRN

SEQ ID NO: 207125 - protein, 19 aa, Mycobacterium bovis
TLDGWQDWAKQRGHRGLAY

SEQ ID NO: 207126 - protein, 26 aa, Mycobacterium bovis
TLDKSLGRPAIKSFIVPREHPGVTVE

SEQ ID NO: 207127 - protein, 24 aa, Mycobacterium bovis
TLDVPELEALLAYEQATKARAPFQ

SEQ ID NO: 207128 - protein, 36 aa, Mycobacterium bovis
TLEGRWWRRDIGGVMVRFVVCRRGDRHVIAARDGDM

SEQ ID NO: 207129 - protein, 18 aa, Mycobacterium bovis
TLELGGKSPNIFFADVLA

SEQ ID NO: 207130 - protein, 20 aa, Mycobacterium bovis
TLESGMVPKVEACLRAVIGG

SEQ ID NO: 207131 - protein, 17 aa, Mycobacterium bovis
TLFNFGFANDGTLNLGN

SEQ ID NO: 207132 - protein, 32 aa, Mycobacterium bovis
TLGLDFMRSCSIRHRMASVIFSLEMSKSEIVM

SEQ ID NO: 207133 - protein, 23 aa, Mycobacterium bovis
TLGLVEVLCIRRRIRTGDQPLAL

SEQ ID NO: 207134 - protein, 26 aa, Mycobacterium bovis
TLGPKGRNVVLEKKWGAPTITNDGVS

SEQ ID NO: 207135 - protein, 25 aa, Mycobacterium bovis
TLGSYRWLRPSGRRTAKEIAAEFST

SEQ ID NO: 207136 - protein, 19 aa, Mycobacterium bovis
TLHRHFNWVRSWYDFAVEG

SEQ ID NO: 207137 - protein, 25 aa, Mycobacterium bovis
TLHSVKVIPSRGAWLEFDVDKRDTV

SEQ ID NO: 207138 - protein, 27 aa, Mycobacterium bovis
TLIAMPALRLDAAFAHLNLGDSHGNAA

SEQ ID NO: 207139 - protein, 19 aa, Mycobacterium bovis
TLILWDVADQPIWAGAVQR

SEQ ID NO: 207140 - protein, 18 aa, Mycobacterium bovis
TLLGRPLVGDGADGASGP

SEQ ID NO: 207141 - protein, 23 aa, Mycobacterium bovis
TLLYKKSSVMFGIDLAKRDIAKG

SEQ ID NO: 207142 - protein, 24 aa, Mycobacterium bovis
TLMALMCSAATMYTPERVTFFCIG

SEQ ID NO: 207143 - protein, 25 aa, Mycobacterium bovis
TLNLKEWKAEWGVADPREARGALTT

SEQ ID NO: 207144 - protein, 24 aa, Mycobacterium bovis
TLNLTDVHIGWVFTRTVRNNARTH

SEQ ID NO: 207145 - protein, 21 aa, Mycobacterium bovis
TLNSMKALWARPKEEVSEQEY

SEQ ID NO: 207146 - protein, 22 aa, Mycobacterium bovis
TLPAGAPHEVWWGSEDYVSGLF

SEQ ID NO: 207147 - protein, 18 aa, Mycobacterium bovis
TLPALIDRRGYVLIVSSL

SEQ ID NO: 207148 - protein, 17 aa, Mycobacterium bovis
TLPGGFTISARKAYGRN

SEQ ID NO: 207149 - protein, 21 aa, Mycobacterium bovis
TLPHLQRLAVYTGEALDQLAA

SEQ ID NO: 207150 - protein, 20 aa, Mycobacterium bovis
TLPHRPGVYLFRGPSGEVLY

SEQ ID NO: 207151 - protein, 26 aa, Mycobacterium bovis
TLPPHPAHFLWLNWGPCPPRQDMAYS

SEQ ID NO: 207152 - protein, 18 aa, Mycobacterium bovis
TLQGAGWTTAAPHGAAGT

SEQ ID NO: 207153 - protein, 21 aa, Mycobacterium bovis
TLRAGIELDDGPAFVDDFAVV

SEQ ID NO: 207154 - protein, 17 aa, Mycobacterium bovis
TLRDVLGGAGWDIESLE

SEQ ID NO: 207155 - protein, 24 aa, Mycobacterium bovis
TLRISSQLLANWLRHGVITSADVR

SEQ ID NO: 207156 - protein, 27 aa, Mycobacterium bovis
TLRRARPVLEPMAGKIIHCGAAGAGQA

SEQ ID NO: 207157 - protein, 18 aa, Mycobacterium bovis
TLRRSLRLLADFRYEQRD

SEQ ID NO: 207158 - protein, 20 aa, Mycobacterium bovis
TLRRWRYGRRRHVRSLGSQV

SEQ ID NO: 207159 - protein, 23 aa, Mycobacterium bovis
TLSALTCEFLFLCSGYYNYDEGY

SEQ ID NO: 207160 - protein, 20 aa, Mycobacterium bovis
TLSQIDYWQVVGIFISGQPI

SEQ ID NO: 207161 - protein, 20 aa, Mycobacterium bovis
TLSTLTWRVVTNATKLPGLR

SEQ ID NO: 207162 - protein, 23 aa, Mycobacterium bovis
TLTGDGIGIVFRKGLPLEDMEFH

SEQ ID NO: 207163 - protein, 18 aa, Mycobacterium bovis
TLTTLVLRGQGGFGGARG

SEQ ID NO: 207164 - protein, 19 aa, Mycobacterium bovis
TLVGARRGDLEVAAKELDV

SEQ ID NO: 207165 - protein, 27 aa, Mycobacterium bovis
TMADPGSVSYLFSRKGVVTLEKNGLTE

SEQ ID NO: 207166 - protein, 19 aa, Mycobacterium bovis
TMAGMATCTLTHLIESSDS

SEQ ID NO: 207167 - protein, 17 aa, Mycobacterium bovis
TMFADVRRELAIRAAVE

SEQ ID NO: 207168 - protein, 20 aa, Mycobacterium bovis
TMGIGGGYVTSWVGDPGAVT

SEQ ID NO: 207169 - protein, 24 aa, Mycobacterium bovis
TMGLPATVVDWGLWKSLADVQKDA

SEQ ID NO: 207170 - protein, 24 aa, Mycobacterium bovis
TMKHLRAGYWRQVRAQLTVTPVML

SEQ ID NO: 207171 - protein, 25 aa, Mycobacterium bovis
TMLGVALSAYEHWLRDESVSLTEAL

SEQ ID NO: 207172 - protein, 22 aa, Mycobacterium bovis
TMPRPNFPVVNFLDAGAAPLSV

SEQ ID NO: 207173 - protein, 24 aa, Mycobacterium bovis
TMPVPEPMVKMLLNNVLEHLAENL

SEQ ID NO: 207174 - protein, 18 aa, Mycobacterium bovis
TMRGLKTLVLRMQRHSEN

SEQ ID NO: 207175 - protein, 26 aa, Mycobacterium bovis
TMTKSLRAGKVFVDWSQNSGSKTTIA

SEQ ID NO: 207176 - protein, 23 aa, Mycobacterium bovis
TMVCAYSRWLLAMLLPSRCAEDL

SEQ ID NO: 207177 - protein, 23 aa, Mycobacterium bovis
TMVDLLATVLMSWEHEDAVHAVV

SEQ ID NO: 207178 - protein, 21 aa, Mycobacterium bovis
TMVELLPRFETITYRELWARA

SEQ ID NO: 207179 - protein, 24 aa, Mycobacterium bovis
TMVLPELRALANRAGVKGTSGMRK

SEQ ID NO: 207180 - protein, 19 aa, Mycobacterium bovis
TMVVTGLHLLGGARADATR

SEQ ID NO: 207181 - protein, 24 aa, Mycobacterium bovis
TNALCAAAVALECGASVEQVAAAL

SEQ ID NO: 207182 - protein, 20 aa, Mycobacterium bovis
TNALGGPGIELFRRLVEEYE

SEQ ID NO: 207183 - protein, 18 aa, Mycobacterium bovis
TNDYEWDLLLSKTGWSEA

SEQ ID NO: 207184 - protein, 17 aa, Mycobacterium bovis
TNHLAFRAQTYGQLDDA

SEQ ID NO: 207185 - protein, 18 aa, Mycobacterium bovis
TNHLGHFALTGLLIDRLL

SEQ ID NO: 207186 - protein, 23 aa, Mycobacterium bovis
TNIAGLLRDGAGTAAINLGLANH

SEQ ID NO: 207187 - protein, 17 aa, Mycobacterium bovis
TNLGLAIDLQGKDGKRS

SEQ ID NO: 207188 - protein, 24 aa, Mycobacterium bovis
TNLNPVWKVGFQVTEALRANTDGR

SEQ ID NO: 207189 - protein, 20 aa, Mycobacterium bovis
TNLWGAFGLLAEMVKQGRSG

SEQ ID NO: 207190 - protein, 24 aa, Mycobacterium bovis
TNPQIDLTIRWDTPPITLFPNGIS

SEQ ID NO: 207191 - protein, 18 aa, Mycobacterium bovis
TNRWTLRPADPVGAVTVV

SEQ ID NO: 207192 - protein, 19 aa, Mycobacterium bovis
TNTLCAVMGGDAIFDRLKE

SEQ ID NO: 207193 - protein, 18 aa, Mycobacterium bovis
TNVLLLRGMIGKPGAGVC

SEQ ID NO: 207194 - protein, 21 aa, Mycobacterium bovis
TNVVTAWRLLRSVDPHLRTRR

SEQ ID NO: 207195 - protein, 18 aa, Mycobacterium bovis
TNYQSRTSRPIPVVVLTR

SEQ ID NO: 207196 - protein, 19 aa, Mycobacterium bovis
TPAKIRRYAAVGGDHNPIH

SEQ ID NO: 207197 - protein, 20 aa, Mycobacterium bovis
TPALISGFFNTGSNMSGFFG

SEQ ID NO: 207198 - protein, 17 aa, Mycobacterium bovis
TPCRGQEAAQVGAAACL

SEQ ID NO: 207199 - protein, 42 aa, Mycobacterium bovis
TPDEPKGVPVFAWKGETLEEYWWAAEQMLTWPDPDKPANMIL

SEQ ID NO: 207200 - protein, 25 aa, Mycobacterium bovis
TPDHKVLTEYGWRAAGELRKGDRVA

SEQ ID NO: 207201 - protein, 23 aa, Mycobacterium bovis
TPEVARAWSSYAPTVVRLPDGRV

SEQ ID NO: 207202 - protein, 34 aa, Mycobacterium bovis
TPFPTTARLTGRWLRGRLPTLNDWLRGIPVLDRK

SEQ ID NO: 207203 - protein, 18 aa, Mycobacterium bovis
TPGDLLFHIRAETMDVCF

SEQ ID NO: 207204 - protein, 27 aa, Mycobacterium bovis
TPGGAGGDGGLLFGSGGNGAPGAPGQA

SEQ ID NO: 207205 - protein, 23 aa, Mycobacterium bovis
TPGHPEFRHTPGVEITTGPLGQG

SEQ ID NO: 207206 - protein, 19 aa, Mycobacterium bovis
TPGSWRREPLSGIPAATNT

SEQ ID NO: 207207 - protein, 19 aa, Mycobacterium bovis
TPHAGEFARLAGAPPGDDR

SEQ ID NO: 207208 - protein, 24 aa, Mycobacterium bovis
TPHFDGYPAVLVRLAEIEVRDLEE

SEQ ID NO: 207209 - protein, 18 aa, Mycobacterium bovis
TPHVPIPYVYPVDLRFVL

SEQ ID NO: 207210 - protein, 20 aa, Mycobacterium bovis
TPIKMLLRLALDAGSGVLYR

SEQ ID NO: 207211 - protein, 18 aa, Mycobacterium bovis
TPIPRTVALTVYGDLETS

SEQ ID NO: 207212 - protein, 21 aa, Mycobacterium bovis
TPKGVLVHRLIRTGRSLFTAH

SEQ ID NO: 207213 - protein, 22 aa, Mycobacterium bovis
TPLAGQRSFIALEFLLDEPASY

SEQ ID NO: 207214 - protein, 26 aa, Mycobacterium bovis
TPLARLYGWHRAMRIFDGPDEVHLRS

SEQ ID NO: 207215 - protein, 23 aa, Mycobacterium bovis
TPLPPIRALVCNAGLQVVSGIAF

SEQ ID NO: 207216 - protein, 19 aa, Mycobacterium bovis
TPLRTVVRANLKSIYQHAI

SEQ ID NO: 207217 - protein, 20 aa, Mycobacterium bovis
TPLVGRLLMYEALDATYHQI

SEQ ID NO: 207218 - protein, 19 aa, Mycobacterium bovis
TPPFDLPTVVIDRIPVELH

SEQ ID NO: 207219 - protein, 18 aa, Mycobacterium bovis
TPPIYFGFGSTPVQTPVQ

SEQ ID NO: 207220 - protein, 32 aa, Mycobacterium bovis
TPRIRGGKVPFVFRTLPGYTFYASQIEPRVGD

SEQ ID NO: 207221 - protein, 23 aa, Mycobacterium bovis
TPRSRRVLLEGWEKFDEPVDRIV

SEQ ID NO: 207222 - protein, 18 aa, Mycobacterium bovis
TPSGYRLDGVKSLIPAAA

SEQ ID NO: 207223 - protein, 29 aa, Mycobacterium bovis
TPTFGPLRIRFWACGIFEVQRARYGITTS

SEQ ID NO: 207224 - protein, 24 aa, Mycobacterium bovis
TPTSTRGASALSLSLLSISRSGNT

SEQ ID NO: 207225 - protein, 18 aa, Mycobacterium bovis
TPVLHGHVADLFVVPAVA

SEQ ID NO: 207226 - protein, 24 aa, Mycobacterium bovis
TPVPRPERQYYWFGEPIDTTEFMG

SEQ ID NO: 207227 - protein, 25 aa, Mycobacterium bovis
TPVPTCPGWSLGQLFRHVGRGDRWA

SEQ ID NO: 207228 - protein, 27 aa, Mycobacterium bovis
TPVQVLGFREHASWALASDTLEFVDLE

SEQ ID NO: 207229 - protein, 18 aa, Mycobacterium bovis
TPVSWLPFYHDMGLMLGI

SEQ ID NO: 207230 - protein, 25 aa, Mycobacterium bovis
TPWGRGRPGWHLECSAMARSYLGPE

SEQ ID NO: 207231 - protein, 17 aa, Mycobacterium bovis
TPWHHQRFWVTDRSAMS

SEQ ID NO: 207232 - protein, 19 aa, Mycobacterium bovis
TPYSRMWGAYLTGMWLYRL

SEQ ID NO: 207233 - protein, 18 aa, Mycobacterium bovis
TQAALGFLLDNGCHHLQL

SEQ ID NO: 207234 - protein, 25 aa, Mycobacterium bovis
TQALERLETLLALIEGWVQTVVTAA

SEQ ID NO: 207235 - protein, 24 aa, Mycobacterium bovis
TQCANRFDVVQAFTDDALTTCERC

SEQ ID NO: 207236 - protein, 19 aa, Mycobacterium bovis
TQFSSNGWATTPITEAGYV

SEQ ID NO: 207237 - protein, 18 aa, Mycobacterium bovis
TQGKVIPDLITWWCERDG

SEQ ID NO: 207238 - protein, 24 aa, Mycobacterium bovis
TQLLKLLAKLAELVAAAIADIISD

SEQ ID NO: 207239 - protein, 17 aa, Mycobacterium bovis
TQLSGILNRGADISGVY

SEQ ID NO: 207240 - protein, 22 aa, Mycobacterium bovis
TQQDVWRFVAYLSDVGSADDLT

SEQ ID NO: 207241 - protein, 24 aa, Mycobacterium bovis
TQTLLGRPLIGNGTNGAPGTGQAG

SEQ ID NO: 207242 - protein, 17 aa, Mycobacterium bovis
TQVESMILPPIAHQVKV

SEQ ID NO: 207243 - protein, 17 aa, Mycobacterium bovis
TQVPLLLDEYTRNASTG

SEQ ID NO: 207244 - protein, 18 aa, Mycobacterium bovis
TRAALPAIRPVNHLVVDG

SEQ ID NO: 207245 - protein, 19 aa, Mycobacterium bovis
TRADGSIGLAPTAKEVTAL

SEQ ID NO: 207246 - protein, 26 aa, Mycobacterium bovis
TRAGVLRFVVLDGLAKPGRMVGPDPG

SEQ ID NO: 207247 - protein, 22 aa, Mycobacterium bovis
TRALKAPTLRGAIEQLADRART

SEQ ID NO: 207248 - protein, 18 aa, Mycobacterium bovis
TRAPRFGAYIASKAALDS

SEQ ID NO: 207249 - protein, 19 aa, Mycobacterium bovis
TRARERWEALTALAELVDD

SEQ ID NO: 207250 - protein, 20 aa, Mycobacterium bovis
TRASALRWLREVNAEQFADR

SEQ ID NO: 207251 - protein, 19 aa, Mycobacterium bovis
TRDAIEALAPYGLGTAYVN

SEQ ID NO: 207252 - protein, 20 aa, Mycobacterium bovis
TRDETIAAIAARAADLDVLG

SEQ ID NO: 207253 - protein, 23 aa, Mycobacterium bovis
TRDEVRAALAAGDWSSASESKLL

SEQ ID NO: 207254 - protein, 24 aa, Mycobacterium bovis
TRDILDREILGIAEAIRASGLSAG

SEQ ID NO: 207255 - protein, 18 aa, Mycobacterium bovis
TREFFDLLLSERGSGLDW

SEQ ID NO: 207256 - protein, 30 aa, Mycobacterium bovis
TRFDIADMRNWRPGWFPTMHSRCLSNLIHD

SEQ ID NO: 207257 - protein, 24 aa, Mycobacterium bovis
TRFDPDRFAGYEWGVSVVTLGELR

SEQ ID NO: 207258 - protein, 23 aa, Mycobacterium bovis
TRFRSDALQIIAFGRYARTVTAA

SEQ ID NO: 207259 - protein, 19 aa, Mycobacterium bovis
TRFVLVGRPGPPPARTGAD

SEQ ID NO: 207260 - protein, 18 aa, Mycobacterium bovis
TRHPNLRASFLHGNLSRP

SEQ ID NO: 207261 - protein, 18 aa, Mycobacterium bovis
TRHPRVSSALARAEVMRA

SEQ ID NO: 207262 - protein, 22 aa, Mycobacterium bovis
TRIALSRGLRPDRFVAEVRQYG

SEQ ID NO: 207263 - protein, 21 aa, Mycobacterium bovis
TRIGLTYPALFGFLRIATSAR

SEQ ID NO: 207264 - protein, 17 aa, Mycobacterium bovis
TRIGTVLGILKAYTTRV

SEQ ID NO: 207265 - protein, 17 aa, Mycobacterium bovis
TRIPGRQGAGIDLPNTD

SEQ ID NO: 207266 - protein, 17 aa, Mycobacterium bovis
TRIPLHGRIEVDEPYVL

SEQ ID NO: 207267 - protein, 17 aa, Mycobacterium bovis
TRKSRRLRTDLVGGDQA

SEQ ID NO: 207268 - protein, 18 aa, Mycobacterium bovis
TRLAEGLVQAAALMEGHE

SEQ ID NO: 207269 - protein, 17 aa, Mycobacterium bovis
TRLAERQGLPAPQIRVG

SEQ ID NO: 207270 - protein, 20 aa, Mycobacterium bovis
TRLAREIADHFGADQPAIHD

SEQ ID NO: 207271 - protein, 23 aa, Mycobacterium bovis
TRLDPKMCDAWLARLLAGDQSIE

SEQ ID NO: 207272 - protein, 18 aa, Mycobacterium bovis
TRLRVIPNHVCLTTNLVD

SEQ ID NO: 207273 - protein, 20 aa, Mycobacterium bovis
TRLRWAQRTVELPAGRYQTI

SEQ ID NO: 207274 - protein, 23 aa, Mycobacterium bovis
TRMARLAVHPNAYIRPSPTSGTL

SEQ ID NO: 207275 - protein, 18 aa, Mycobacterium bovis
TRMGAQDTRLVWEERRLR

SEQ ID NO: 207276 - protein, 20 aa, Mycobacterium bovis
TRNGRIGVIGTRATITSHAY

SEQ ID NO: 207277 - protein, 20 aa, Mycobacterium bovis
TRNPWCLNRTPGGSSGGSAA

SEQ ID NO: 207278 - protein, 28 aa, Mycobacterium bovis
TRNRALGLLYRWVEHAFGGREHALTGAY

SEQ ID NO: 207279 - protein, 21 aa, Mycobacterium bovis
TRPALRDPLILPSMCTEWAPR

SEQ ID NO: 207280 - protein, 21 aa, Mycobacterium bovis
TRPGATLLLSCFSNAMPPDEE

SEQ ID NO: 207281 - protein, 17 aa, Mycobacterium bovis
TRPGLVVAAEFRGPDEA

SEQ ID NO: 207282 - protein, 20 aa, Mycobacterium bovis
TRPPSCLGIEFPVGPLMFPL

SEQ ID NO: 207283 - protein, 34 aa, Mycobacterium bovis
TRPTLRGRPVLVGGLGGRGVVAGASYEARAYGAR

SEQ ID NO: 207284 - protein, 21 aa, Mycobacterium bovis
TRPTNIGGLGFSMKWNMGWMH

SEQ ID NO: 207285 - protein, 25 aa, Mycobacterium bovis
TRRDRLFGSWHYWWQAHLLDCLVDA

SEQ ID NO: 207286 - protein, 17 aa, Mycobacterium bovis
TRRGMVVGSPVDLVDGI

SEQ ID NO: 207287 - protein, 19 aa, Mycobacterium bovis
TRRGNWWYYARTFEGKQYG

SEQ ID NO: 207288 - protein, 25 aa, Mycobacterium bovis
TRRGRPTVWSVWGVGGAILLGDALH

SEQ ID NO: 207289 - protein, 26 aa, Mycobacterium bovis
TRRLLPRVPRCIPLAARLAPGTIGCP

SEQ ID NO: 207290 - protein, 20 aa, Mycobacterium bovis
TRRTGLCQFEDAFTQLSGAT

SEQ ID NO: 207291 - protein, 27 aa, Mycobacterium bovis
TRRVRLMRWGLIPSWIKAGPGGAPDAK

SEQ ID NO: 207292 - protein, 20 aa, Mycobacterium bovis
TRRVRRHRAVLRAADRLELA

SEQ ID NO: 207293 - protein, 22 aa, Mycobacterium bovis
TRSGGHCWFLGGVADSVEELVD

SEQ ID NO: 207294 - protein, 20 aa, Mycobacterium bovis
TRSLSDFGFANVDRNPSPGS

SEQ ID NO: 207295 - protein, 21 aa, Mycobacterium bovis
TRTALAIAAGHSFVIFLREGF

SEQ ID NO: 207296 - protein, 18 aa, Mycobacterium bovis
TRTELGTYLFFVDCVGHI

SEQ ID NO: 207297 - protein, 20 aa, Mycobacterium bovis
TRTGAGLAFTPGGLRLASRA

SEQ ID NO: 207298 - protein, 20 aa, Mycobacterium bovis
TRTGVMMGLSSWDYTIVNIE

SEQ ID NO: 207299 - protein, 20 aa, Mycobacterium bovis
TRVDGGWRITGQKIWTTGAQ

SEQ ID NO: 207300 - protein, 29 aa, Mycobacterium bovis
TRVEFWAFDLLYLDGRALLGTRYQDRRKL

SEQ ID NO: 207301 - protein, 19 aa, Mycobacterium bovis
TRVGERLTELPLTLFTDPA

SEQ ID NO: 207302 - protein, 24 aa, Mycobacterium bovis
TRVIWKLIKDMLILPYLDIRLDYY

SEQ ID NO: 207303 - protein, 23 aa, Mycobacterium bovis
TRVPGIGKRGAERMVLELRDKVG

SEQ ID NO: 207304 - protein, 18 aa, Mycobacterium bovis
TRVPRPAPSELLVAVHAC

SEQ ID NO: 207305 - protein, 20 aa, Mycobacterium bovis
TRWAPELCKVAVLDDAAGPL

SEQ ID NO: 207306 - protein, 19 aa, Mycobacterium bovis
TRWWTEIARVLRAGGSYFA

SEQ ID NO: 207307 - protein, 23 aa, Mycobacterium bovis
TSAGLPYERCVGVTYQQLHADRD

SEQ ID NO: 207308 - protein, 25 aa, Mycobacterium bovis
TSAHAGVVSPGFIGAPLALAALGQM

SEQ ID NO: 207309 - protein, 29 aa, Mycobacterium bovis
TSARIERFLQLWAEGSMTIAMPSTPSNYF

SEQ ID NO: 207310 - protein, 18 aa, Mycobacterium bovis
TSASAGWDTVLQSITTIL

SEQ ID NO: 207311 - protein, 26 aa, Mycobacterium bovis
TSCDAFEHFPPPILKPVILAAKSATL

SEQ ID NO: 207312 - protein, 23 aa, Mycobacterium bovis
TSCPGCRATVIVRDWYSIRHYAL

SEQ ID NO: 207313 - protein, 21 aa, Mycobacterium bovis
TSCPNCSGRGILLHADPVDSA

SEQ ID NO: 207314 - protein, 26 aa, Mycobacterium bovis
TSDIKNLLPMLAVFKPTVVVSVPRVF

SEQ ID NO: 207315 - protein, 25 aa, Mycobacterium bovis
TSEAQYGAMWAQDIVAMEGYAGASA

SEQ ID NO: 207316 - protein, 18 aa, Mycobacterium bovis
TSEFLTHPAFTQYRTETS

SEQ ID NO: 207317 - protein, 29 aa, Mycobacterium bovis
TSEGWRMYTRARFAPYVEKLLLDGARTKL

SEQ ID NO: 207318 - protein, 18 aa, Mycobacterium bovis
TSFYDWYADLPVASPQVF

SEQ ID NO: 207319 - protein, 27 aa, Mycobacterium bovis
TSGEQRLSGFLLWQSAYSEMWFTEAHW

SEQ ID NO: 207320 - protein, 30 aa, Mycobacterium bovis; identical to SEQ ID NO: 85300

SEQ ID NO: 207321 - protein, 24 aa, Mycobacterium bovis
TSGLSRVAPYLARTMPQLLSVECW

SEQ ID NO: 207322 - protein, 18 aa, Mycobacterium bovis
TSGSRGFHVYARIAPCWS

SEQ ID NO: 207323 - protein, 28 aa, Mycobacterium bovis
TSGYLCVPLDGAICDRLGLLPMYAVNQD

SEQ ID NO: 207324 - protein, 30 aa, Mycobacterium bovis
TSHKEVLLHLAAEGWARWSGTVCEQLGEPG

SEQ ID NO: 207325 - protein, 19 aa, Mycobacterium bovis
TSIAARFTKPVFPGETLST

SEQ ID NO: 207326 - protein, 17 aa, Mycobacterium bovis
TSIAERVRALLGTPSVD

SEQ ID NO: 207327 - protein, 20 aa, Mycobacterium bovis
TSLDDAGPWAHARAAAEVLI

SEQ ID NO: 207328 - protein, 25 aa, Mycobacterium bovis
TSLGFSYDVLHAFNPRIVLAGSSAF

SEQ ID NO: 207329 - protein, 19 aa, Mycobacterium bovis
TSLNEVICHGIPDSTVITD

SEQ ID NO: 207330 - protein, 26 aa, Mycobacterium bovis
TSLTVATIVRRHWPTPSLARVDAEYE

SEQ ID NO: 207331 - protein, 21 aa, Mycobacterium bovis
TSLYVYARETVGYALMIGGRV

SEQ ID NO: 207332 - protein, 17 aa, Mycobacterium bovis
TSPELATLMAHVKLGLK

SEQ ID NO: 207333 - protein, 17 aa, Mycobacterium bovis
TSPLAFLQRPARWLHSL

SEQ ID NO: 207334 - protein, 19 aa, Mycobacterium bovis
TSRLRLTARASLNAGELEL

SEQ ID NO: 207335 - protein, 21 aa, Mycobacterium bovis
TSRTFKDGWLHTGDLAREDSD

SEQ ID NO: 207336 - protein, 19 aa, Mycobacterium bovis
TSSKVMCWVALDRGAKLAE

SEQ ID NO: 207337 - protein, 25 aa, Mycobacterium bovis
TSTAELLAGNGLRYNRFHTTALCSP

SEQ ID NO: 207338 - protein, 21 aa, Mycobacterium bovis
TSTLRLAPALGASRTVAVVST

SEQ ID NO: 207339 - protein, 34 aa, Mycobacterium bovis
TSTSGPTSEIWVKPSFFPGIRIAPSSGGGATSTQ

SEQ ID NO: 207340 - protein, 26 aa, Mycobacterium bovis
TSVCMFKPPFAWREYLLQCWFVARVS

SEQ ID NO: 207341 - protein, 22 aa, Mycobacterium bovis
TSVLSRGVCGVAGRTLIINLPG

SEQ ID NO: 207342 - protein, 21 aa, Mycobacterium bovis
TSVVATCYLLGVSTRRMERLV

SEQ ID NO: 207343 - protein, 21 aa, Mycobacterium bovis
TTAEGFSWTPVHTMAGPDTSA

SEQ ID NO: 207344 - protein, 20 aa, Mycobacterium bovis
TTALLARCTGLRTCTTRLTR

SEQ ID NO: 207345 - protein, 23 aa, Mycobacterium bovis
TTANAMSWFWYLMALNPQARDHM

SEQ ID NO: 207346 - protein, 20 aa, Mycobacterium bovis
TTARSNVRFGYEVTEPGIPY

SEQ ID NO: 207347 - protein, 18 aa, Mycobacterium bovis
TTDGLRIDTGMYLTGMEQ

SEQ ID NO: 207348 - protein, 23 aa, Mycobacterium bovis
TTFTKRGKLGIRWYSSKQGHGEP

SEQ ID NO: 207349 - protein, 18 aa, Mycobacterium bovis
TTIAFSIDTTNLTGVMTF

SEQ ID NO: 207350 - protein, 32 aa, Mycobacterium bovis
TTIKRWFPGFMTFRFLECGLLTMVSNPLALRS

SEQ ID NO: 207351 - protein, 19 aa, Mycobacterium bovis
TTIRNLVHGIGFQRDVLGA

SEQ ID NO: 207352 - protein, 27 aa, Mycobacterium bovis
TTIRTLRRLGFRCGVVSGGFRRIIEPL

SEQ ID NO: 207353 - protein, 25 aa, Mycobacterium bovis
TTLGYRQYLFWTFAIYTGRLLHGRL

SEQ ID NO: 207354 - protein, 25 aa, Mycobacterium bovis
TTMFRPKLDALALLHRLSLKSPVRH

SEQ ID NO: 207355 - protein, 17 aa, Mycobacterium bovis
TTMRLLDELGLWERFAA

SEQ ID NO: 207356 - protein, 31 aa, Mycobacterium bovis
TTPGGNGGDGGWLFGSGGNGAPGAAGQSGGN

SEQ ID NO: 207357 - protein, 28 aa, Mycobacterium bovis
TTRDYRSVIDFYRQVFGWRTEQISDTDE

SEQ ID NO: 207358 - protein, 20 aa, Mycobacterium bovis
TTRMRVELGYQPKWTTVEAF

SEQ ID NO: 207359 - protein, 29 aa, Mycobacterium bovis
TTSGYPRVIKRWRRGKPLADAETIFEGAG

SEQ ID NO: 207360 - protein, 26 aa, Mycobacterium bovis
TTSPLRPWPGFVPMVYERYSQPFFGG

SEQ ID NO: 207361 - protein, 26 aa, Mycobacterium bovis
TTSWCGYCLRLKTALTANRIAYDEVD

SEQ ID NO: 207362 - protein, 18 aa, Mycobacterium bovis
TTTVARLLALVAEQAELA

SEQ ID NO: 207363 - protein, 25 aa, Mycobacterium bovis
TTVLKAINWFGQFSTRIADKEADYE

SEQ ID NO: 207364 - protein, 19 aa, Mycobacterium bovis
TTVTWQWTIHPRSALAAPV

SEQ ID NO: 207365 - protein, 23 aa, Mycobacterium bovis
TTWPAHLRPALTTAGFATELRNL

SEQ ID NO: 207366 - protein, 17 aa, Mycobacterium bovis
TTWYDGVRFEEVSVGYP

SEQ ID NO: 207367 - protein, 18 aa, Mycobacterium bovis
TVAAWPAVCSGLRSEARN

SEQ ID NO: 207368 - protein, 22 aa, Mycobacterium bovis
TVADIYRHFGLTLSDEARQAMT

SEQ ID NO: 207369 - protein, 24 aa, Mycobacterium bovis
TVAEPGALIGFLGPRVYELLYGDP

SEQ ID NO: 207370 - protein, 18 aa, Mycobacterium bovis
TVAKRGAAIIDARGASSA

SEQ ID NO: 207371 - protein, 25 aa, Mycobacterium bovis
TVANLASIGNTWLADPAPFLQQYLA

SEQ ID NO: 207372 - protein, 27 aa, Mycobacterium bovis
TVDAAWRPDTVWRYRLGSGESSERVYH

SEQ ID NO: 207373 - protein, 23 aa, Mycobacterium bovis
TVDFKRFARDGIVAMSSADALQL

SEQ ID NO: 207374 - protein, 17 aa, Mycobacterium bovis
TVDGDLVGAGWVSGGSD

SEQ ID NO: 207375 - protein, 23 aa, Mycobacterium bovis
TVDWEFAASVGERLARPAPPSTE

SEQ ID NO: 207376 - protein, 25 aa, Mycobacterium bovis
TVEERARNGLSIVIAPEGTRLDTTE

SEQ ID NO: 207377 - protein, 25 aa, Mycobacterium bovis
TVEGRPKHYWSIYQKMIVKGRDFDD

SEQ ID NO: 207378 - protein, 17 aa, Mycobacterium bovis
TVEHTIEILKGLRDRYE

SEQ ID NO: 207379 - protein, 19 aa, Mycobacterium bovis
TVFCERYLPTGHHVEVQVM

SEQ ID NO: 207380 - protein, 23 aa, Mycobacterium bovis
TVFDGGWILPGLVDAHCHVGLGK

SEQ ID NO: 207381 - protein, 25 aa, Mycobacterium bovis
TVFIPAFLRYDLRPVTGEWQIAALR

SEQ ID NO: 207382 - protein, 17 aa, Mycobacterium bovis
TVFRLVAAEALKLTAAD

SEQ ID NO: 207383 - protein, 19 aa, Mycobacterium bovis
TVFTAEAWGSDAYTPLAWW

SEQ ID NO: 207384 - protein, 20 aa, Mycobacterium bovis
TVFVCPSVYEPLGIVNLEAM

SEQ ID NO: 207385 - protein, 25 aa, Mycobacterium bovis
TVGECARCLSPVRGRVQVALTELFA

SEQ ID NO: 207386 - protein, 21 aa, Mycobacterium bovis
TVGRGEIFGLLGPSGAGKSTT

SEQ ID NO: 207387 - protein, 25 aa, Mycobacterium bovis
TVHAPRLSPAPALLALPAAESAWRL

SEQ ID NO: 207388 - protein, 18 aa, Mycobacterium bovis
TVHLPQRVPMGFHGNWAP

SEQ ID NO: 207389 - protein, 25 aa, Mycobacterium bovis
TVIARDRAEAIAGLRALAAGQPRVG

SEQ ID NO: 207390 - protein, 18 aa, Mycobacterium bovis
TVIDVLRGKLEFESGEEG

SEQ ID NO: 207391 - protein, 25 aa, Mycobacterium bovis
TVILARLVARAMLQLPAQRTHRIRA

SEQ ID NO: 207392 - protein, 24 aa, Mycobacterium bovis
TVITRKAYGGAYCVMGSKDMGCDA

SEQ ID NO: 207393 - protein, 22 aa, Mycobacterium bovis
TVLDRLSSWVVFTPVQNVTGVP

SEQ ID NO: 207394 - protein, 26 aa, Mycobacterium bovis
TVNAVKLRLGIGYVIQNAGLMPHQRV

SEQ ID NO: 207395 - protein, 19 aa, Mycobacterium bovis
TVNVCKYNLGWGAIGMCTH

SEQ ID NO: 207396 - protein, 24 aa, Mycobacterium bovis
TVPDNMGMLFRKHLVMFGPREVLL

SEQ ID NO: 207397 - protein, 30 aa, Mycobacterium bovis
TVPGLRALLRLGIYWAQEALAYGMTKRPNT

SEQ ID NO: 207398 - protein, 26 aa, Mycobacterium bovis
TVPPGRLGWGWARFAFTSWKTLGWVD

SEQ ID NO: 207399 - protein, 27 aa, Mycobacterium bovis
TVRSYNCLKREGVHTVGELVARTESDL

SEQ ID NO: 207400 - protein, 17 aa, Mycobacterium bovis
TVSGLYVCEMVTARALI

SEQ ID NO: 207401 - protein, 19 aa, Mycobacterium bovis
TVSLGDWQILLPRAVVGTA

SEQ ID NO: 207402 - protein, 24 aa, Mycobacterium bovis
TVSPQLYIALGISGAIQHRAGMQT

SEQ ID NO: 207403 - protein, 23 aa, Mycobacterium bovis
TVSWPRTAKLLDVLLAAGLDAPF

SEQ ID NO: 207404 - protein, 32 aa, Mycobacterium bovis; identical to SEQ ID NO: 85362

SEQ ID NO: 207405 - protein, 25 aa, Mycobacterium bovis
TVVFPDAPVKIFLTASAETRARRRN

SEQ ID NO: 207406 - protein, 17 aa, Mycobacterium bovis
TVVLERLVKFNGEQHMP

SEQ ID NO: 207407 - protein, 30 aa, Mycobacterium bovis
TVVSWLPLYHDMGLLLGAIMPILAGVPTVL

SEQ ID NO: 207408 - protein, 22 aa, Mycobacterium bovis
TVVVEIAERLVLVAGAEVAAVA

SEQ ID NO: 207409 - protein, 19 aa, Mycobacterium bovis
TWAAIGVALGITRQAAFQR

SEQ ID NO: 207410 - protein, 19 aa, Mycobacterium bovis
TWCALAETYGDDWHRWPKS

SEQ ID NO: 207411 - protein, 22 aa, Mycobacterium bovis
TWFKHAVFYEVLVRAFFDASAD

SEQ ID NO: 207412 - protein, 21 aa, Mycobacterium bovis
TWGVMGIGMGYAIAAAVETGR

SEQ ID NO: 207413 - protein, 22 aa, Mycobacterium bovis
TWIKEFDPRFNVRYRDDKSYPV

SEQ ID NO: 207414 - protein, 20 aa, Mycobacterium bovis
TWLEVPLPPGVLRWQQDHGR

SEQ ID NO: 207415 - protein, 17 aa, Mycobacterium bovis
TWLPMPPEWAALTAEKQ

SEQ ID NO: 207416 - protein, 22 aa, Mycobacterium bovis
TWLRERPREMARTVFIELLAWQ

SEQ ID NO: 207417 - protein, 23 aa, Mycobacterium bovis
TWNGTRLAAAIMRERKRGAIVNM

SEQ ID NO: 207418 - protein, 23 aa, Mycobacterium bovis
TWPPMPYPETWGVWQEDEGRQIV

SEQ ID NO: 207419 - protein, 18 aa, Mycobacterium bovis
TWQPEPLAGQPLDRPFAW

SEQ ID NO: 207420 - protein, 23 aa, Mycobacterium bovis
TWRRLELSVPLVVDPVCASMHGD

SEQ ID NO: 207421 - protein, 24 aa, Mycobacterium bovis
TWRSATCRVLAAATGARTANAGPV

SEQ ID NO: 207422 - protein, 25 aa, Mycobacterium bovis
TWSEVFRRTRIVAHEVRRHCTTGDR

SEQ ID NO: 207423 - protein, 21 aa, Mycobacterium bovis
TWTQFGMRLAAIGAHVQRFAG

SEQ ID NO: 207424 - protein, 24 aa, Mycobacterium bovis
TYAVPRLLARNGLSLQDFDFYEIH

SEQ ID NO: 207425 - protein, 30 aa, Mycobacterium bovis
TYEHPYPHCWRCRNPLIYRSVSSWFVRVTD

SEQ ID NO: 207426 - protein, 22 aa, Mycobacterium bovis
TYFLCADPRPLGYDDSTEFCAA

SEQ ID NO: 207427 - protein, 23 aa, Mycobacterium bovis
TYGFARQRFWLGDNGELSVDQTG

SEQ ID NO: 207428 - protein, 17 aa, Mycobacterium bovis
TYGFTGIDTSQCTGDTV

SEQ ID NO: 207429 - protein, 20 aa, Mycobacterium bovis
TYLYRDGSDFVFMDSQDYEQ

SEQ ID NO: 207430 - protein, 22 aa, Mycobacterium bovis
TYMRAIWTGSIAFGLVNVPVKV

SEQ ID NO: 207431 - protein, 18 aa, Mycobacterium bovis
TYRCPGCDHEIRSGTAHV

SEQ ID NO: 207432 - protein, 21 aa, Mycobacterium bovis
TYRQETIRIFGLPESSLADTL

SEQ ID NO: 207433 - protein, 25 aa, Mycobacterium bovis
TYVDFDPIYCWPKPVTKPYPPLYVG

SEQ ID NO: 207434 - protein, 18 aa, Mycobacterium bovis
VAAAAKVNTLLDVAQANL

SEQ ID NO: 207435 - protein, 18 aa, Mycobacterium bovis
VAAALGISVTDARGLVDR

SEQ ID NO: 207436 - protein, 17 aa, Mycobacterium bovis
VAACRPAGVPVIADGGL

SEQ ID NO: 207437 - protein, 19 aa, Mycobacterium bovis
VAAEADWPDAYRVNRYVRG

SEQ ID NO: 207438 - protein, 20 aa, Mycobacterium bovis
VAAEARLRYLADHDDLTGLH

SEQ ID NO: 207439 - protein, 25 aa, Mycobacterium bovis
VAAEIARLALFLTTPAARHITGQTL

SEQ ID NO: 207440 - protein, 19 aa, Mycobacterium bovis
VAAELDYPALTLAQLRARL

SEQ ID NO: 207441 - protein, 19 aa, Mycobacterium bovis
VAAGLEFYGNRGWLEKPSG

SEQ ID NO: 207442 - protein, 24 aa, Mycobacterium bovis
VAAHDLRPGTALTPGDVRLEKRSA

SEQ ID NO: 207443 - protein, 17 aa, Mycobacterium bovis
VAAHGAWLTLIRDGQPI

SEQ ID NO: 207444 - protein, 24 aa, Mycobacterium bovis
VAAITVGLSRGWSLIKSVRLGNAA

SEQ ID NO: 207445 - protein, 19 aa, Mycobacterium bovis
VAAKDIWVRPTERAHAEVI

SEQ ID NO: 207446 - protein, 17 aa, Mycobacterium bovis
VAALCGSPSQARKHADA

SEQ ID NO: 207447 - protein, 25 aa, Mycobacterium bovis
VAALIGVGADEMWDIRNRGVIPAGA

SEQ ID NO: 207448 - protein, 17 aa, Mycobacterium bovis
VAAMPGLLQRLSSAASV

SEQ ID NO: 207449 - protein, 17 aa, Mycobacterium bovis
VAANRSGLISLVISNLF

SEQ ID NO: 207450 - protein, 18 aa, Mycobacterium bovis
VAAPEIPSPAAALQATRL

SEQ ID NO: 207451 - protein, 25 aa, Mycobacterium bovis
VAAPELAPGRALRCAEAVARGDASA

SEQ ID NO: 207452 - protein, 20 aa, Mycobacterium bovis
VAAPGRAMTSAGLIDIAPHQ

SEQ ID NO: 207453 - protein, 20 aa, Mycobacterium bovis
VAAPRPVRRSTFYRNVEGWL

SEQ ID NO: 207454 - protein, 32 aa, Mycobacterium bovis
VAAQRPAAIPLSFAQRRLWFLDQLQRPAPVYN

SEQ ID NO: 207455 - protein, 18 aa, Mycobacterium bovis
VAAQTARFLLDELGSKAP

SEQ ID NO: 207456 - protein, 17 aa, Mycobacterium bovis
VAARILAEFPDYLTEEQ

SEQ ID NO: 207457 - protein, 19 aa, Mycobacterium bovis
VAARLGARVSVEIVNADAM

SEQ ID NO: 207458 - protein, 18 aa, Mycobacterium bovis
VAARPPAAVVLFSPLIDL

SEQ ID NO: 207459 - protein, 17 aa, Mycobacterium bovis
VAARPVGMFRMVDEHGG

SEQ ID NO: 207460 - protein, 24 aa, Mycobacterium bovis
VAASLRCPWCVDAHTTMLYAAGQT

SEQ ID NO: 207461 - protein, 24 aa, Mycobacterium bovis
VAASWPAGVNPLWTYGGGTPGEAI

SEQ ID NO: 207462 - protein, 18 aa, Mycobacterium bovis
VAAVPLMLEHSGGGSVIN

SEQ ID NO: 207463 - protein, 17 aa, Mycobacterium bovis
VACDGRWSIARHEAGLK

SEQ ID NO: 207464 - protein, 17 aa, Mycobacterium bovis
VACGTAYHSGLLAKYAI

SEQ ID NO: 207465 - protein, 22 aa, Mycobacterium bovis
VADFGCGSGRAVKLMAQAFGAS

SEQ ID NO: 207466 - protein, 23 aa, Mycobacterium bovis
VADFPRYPLNFVSTLNAIAGTYY

SEQ ID NO: 207467 - protein, 36 aa, Mycobacterium bovis
VADFWFDPLCPWCWITSRWILEVAKVRDIEVNFHVM

SEQ ID NO: 207468 - protein, 25 aa, Mycobacterium bovis
VADKLKACPDARVTINGYTDNTGSE

SEQ ID NO: 207469 - protein, 28 aa, Mycobacterium bovis
VADMTYLQWLRRYVELAIGEGNSTADTA

SEQ ID NO: 207470 - protein, 19 aa, Mycobacterium bovis
VADQPIWAGAVQRLKVGSA

SEQ ID NO: 207471 - protein, 24 aa, Mycobacterium bovis
VADQRGASLVVDWPASVQQQVRRI

SEQ ID NO: 207472 - protein, 26 aa, Mycobacterium bovis
VAEALGEHVFDFFLRNKRTEWANYRS

SEQ ID NO: 207473 - protein, 24 aa, Mycobacterium bovis
VAEALRAGGFKHRAKVEICWVASD

SEQ ID NO: 207474 - protein, 26 aa, Mycobacterium bovis
VAEISARLDLPVGVARVLVGDLVTSG

SEQ ID NO: 207475 - protein, 21 aa, Mycobacterium bovis
VAELFPKVVEAYRELVDDGPG

SEQ ID NO: 207476 - protein, 19 aa, Mycobacterium bovis
VAELHRRASAWFAENGYLH

SEQ ID NO: 207477 - protein, 25 aa, Mycobacterium bovis
VAEPPCAQLAALVRCVGPVEAADRV

SEQ ID NO: 207478 - protein, 23 aa, Mycobacterium bovis
VAERLAPGAHRWWQAGHRSSEPG

SEQ ID NO: 207479 - protein, 17 aa, Mycobacterium bovis
VAEVMLGHIAGRPATRK

SEQ ID NO: 207480 - protein, 27 aa, Mycobacterium bovis
VAEVWRRGSVIGSWLLDLTAIALRESP

SEQ ID NO: 207481 - protein, 22 aa, Mycobacterium bovis
VAEYISALALLAKREQWAEFAR

SEQ ID NO: 207482 - protein, 29 aa, Mycobacterium bovis
VAFLRAGDAIACALELQLSTLAPMRPRVG

SEQ ID NO: 207483 - protein, 25 aa, Mycobacterium bovis
VAGALCLPDAAMLVAARGRLMQALP

SEQ ID NO: 207484 - protein, 26 aa, Mycobacterium bovis
VAGALKLGVELGRGAVIVVNLSGRGD

SEQ ID NO: 207485 - protein, 18 aa, Mycobacterium bovis
VAGCAAMDGTVLVNLINT

SEQ ID NO: 207486 - protein, 19 aa, Mycobacterium bovis
VAGCPRPVTRLLAELEPAD

SEQ ID NO: 207487 - protein, 21 aa, Mycobacterium bovis
VAGCSFPIERLRQVAEHADAT

SEQ ID NO: 207488 - protein, 19 aa, Mycobacterium bovis
VAGEAFGRAAEPWEVAATI

SEQ ID NO: 207489 - protein, 18 aa, Mycobacterium bovis
VAGEQIWRVPPLGHGEAI

SEQ ID NO: 207490 - protein, 18 aa, Mycobacterium bovis
VAGFSMGGFGALKYAAKY

SEQ ID NO: 207491 - protein, 24 aa, Mycobacterium bovis
VAGGAGGSVGLWGSGGAGGDGGAA

SEQ ID NO: 207492 - protein, 24 aa, Mycobacterium bovis
VAGHSMGGITIAAWSDRYRHKVRR

SEQ ID NO: 207493 - protein, 30 aa, Mycobacterium bovis
VAGIGGAGGRGGDAGLLFGAAGTGGHGAAG

SEQ ID NO: 207494 - protein, 20 aa, Mycobacterium bovis
VAGPQFLLSLIVSSAVCGTS

SEQ ID NO: 207495 - protein, 23 aa, Mycobacterium bovis
VAGVCIEPTLTLPGLRAAVDGAG

SEQ ID NO: 207496 - protein, 20 aa, Mycobacterium bovis
VAGVPADMGGSFIGPTQDAV

SEQ ID NO: 207497 - protein, 22 aa, Mycobacterium bovis
VAHDQCDAWTGLAAAGDQSIGV

SEQ ID NO: 207498 - protein, 23 aa, Mycobacterium bovis
VAHPDRRTVLLIGDGAAQLTVQE

SEQ ID NO: 207499 - protein, 24 aa, Mycobacterium bovis
VAHPLYCRRMQQKLVEFAEAGFPG

SEQ ID NO: 207500 - protein, 20 aa, Mycobacterium bovis
VAHPTIRWVGSANELNAGYA

SEQ ID NO: 207501 - protein, 18 aa, Mycobacterium bovis
VAIAAAFGAHGQAYQALS

SEQ ID NO: 207502 - protein, 23 aa, Mycobacterium bovis
VAIEGDSAFGFSGMEFETICRYR

SEQ ID NO: 207503 - protein, 26 aa, Mycobacterium bovis
VAIFRARPSPFYIMDEVEAALDDVNL

SEQ ID NO: 207504 - protein, 17 aa, Mycobacterium bovis
VAIKRPIFVTGLVRTGT

SEQ ID NO: 207505 - protein, 25 aa, Mycobacterium bovis
VALARPEEHVICIAGDGAFLMHGTE

SEQ ID NO: 207506 - protein, 24 aa, Mycobacterium bovis
VALAVLACPLAGPAGPAETVAPAR

SEQ ID NO: 207507 - protein, 23 aa, Mycobacterium bovis
VALCDRRGSYIFGRRTLPQMDLA

SEQ ID NO: 207508 - protein, 17 aa, Mycobacterium bovis
VALDFPELVIVCGHVGY

SEQ ID NO: 207509 - protein, 25 aa, Mycobacterium bovis
VALHASFPPERITLHGNNKSVSELT

SEQ ID NO: 207510 - protein, 23 aa, Mycobacterium bovis
VALHKLPVTMVLDRAGITGSDGA

SEQ ID NO: 207511 - protein, 24 aa, Mycobacterium bovis
VALLSRGKLLYGVIDDENQPPGSR

SEQ ID NO: 207512 - protein, 24 aa, Mycobacterium bovis
VALPSRPVQVIGFTSVPGAGDNFL

SEQ ID NO: 207513 - protein, 26 aa, Mycobacterium bovis
VALQPYGGVWLHSWLDRDLGISGRLS

SEQ ID NO: 207514 - protein, 18 aa, Mycobacterium bovis
VALVVGLELEKTVPGDTA

SEQ ID NO: 207515 - protein, 18 aa, Mycobacterium bovis
VAMFPAVEPDDVSALTEC

SEQ ID NO: 207516 - protein, 17 aa, Mycobacterium bovis
VAMVVDMHGRRSRDIVD

SEQ ID NO: 207517 - protein, 19 aa, Mycobacterium bovis
VANALYWLQEFHIDGLRVD

SEQ ID NO: 207518 - protein, 26 aa, Mycobacterium bovis
VANARVRWDLPAAVVERRIRAVTPNP

SEQ ID NO: 207519 - protein, 22 aa, Mycobacterium bovis
VANDGFTFFPGGLTFPRASAGV

SEQ ID NO: 207520 - protein, 34 aa, Mycobacterium bovis
VANLPITLWPGMKIGQLCMLRLTSPSEHPYGSSR

SEQ ID NO: 207521 - protein, 17 aa, Mycobacterium bovis
VAPCTELYHDSRADDSV

SEQ ID NO: 207522 - protein, 17 aa, Mycobacterium bovis
VAPMLGHDVSIAAVNGP

SEQ ID NO: 207523 - protein, 17 aa, Mycobacterium bovis
VAPNVGVSQRFFTSQCN

SEQ ID NO: 207524 - protein, 17 aa, Mycobacterium bovis
VAPRAAAVVGTRAATAY

SEQ ID NO: 207525 - protein, 18 aa, Mycobacterium bovis
VAQGRLLVAAAISFIEDV

SEQ ID NO: 207526 - protein, 20 aa, Mycobacterium bovis
VAQLAPWQQVLRNLGIDIGK

SEQ ID NO: 207527 - protein, 26 aa, Mycobacterium bovis
VAQLCTELKLPLVVDAAQGLGHVDCA

SEQ ID NO: 207528 - protein, 18 aa, Mycobacterium bovis
VAQLHVWARREHPTYEDI

SEQ ID NO: 207529 - protein, 24 aa, Mycobacterium bovis
VAQLRSGMTIGIAGWGSRRKPMAF

SEQ ID NO: 207530 - protein, 19 aa, Mycobacterium bovis
VARDRAQAIAGLRALAAGQ

SEQ ID NO: 207531 - protein, 23 aa, Mycobacterium bovis
VAREDSEFAVLRRQIAVGGQVLQ

SEQ ID NO: 207532 - protein, 17 aa, Mycobacterium bovis
VARENRLRTALAALDNF

SEQ ID NO: 207533 - protein, 17 aa, Mycobacterium bovis
VARGEYKSAANLFTEDG

SEQ ID NO: 207534 - protein, 17 aa, Mycobacterium bovis
VARGVSVYAALKRAADT

SEQ ID NO: 207535 - protein, 23 aa, Mycobacterium bovis
VARHLVSRYGVRQVVLASRAGEH

SEQ ID NO: 207536 - protein, 28 aa, Mycobacterium bovis
VARIRSGPPMGFFRIGWVRTLANLNEFF

SEQ ID NO: 207537 - protein, 24 aa, Mycobacterium bovis
VARQEPRLNWAVGVNADGTTVLVT

SEQ ID NO: 207538 - protein, 21 aa, Mycobacterium bovis
VARRLAGLFASYARQRPGLLA

SEQ ID NO: 207539 - protein, 17 aa, Mycobacterium bovis
VARRLALLLTFPRFLPT

SEQ ID NO: 207540 - protein, 24 aa, Mycobacterium bovis
VARRRPPAGDGWRKAVTKMTFGRV

SEQ ID NO: 207541 - protein, 22 aa, Mycobacterium bovis
VARSLLDYRYRRLPAARRAAHR

SEQ ID NO: 207542 - protein, 27 aa, Mycobacterium bovis
VARTIVELCALWAVHLHFDPSPEPWSI

SEQ ID NO: 207543 - protein, 30 aa, Mycobacterium bovis
VASAARACGGWTVGVIPKMLVYRELADHDA

SEQ ID NO: 207544 - protein, 26 aa, Mycobacterium bovis
VASAFGGGNAFGGRGGDGGDGGDGGT

SEQ ID NO: 207545 - protein, 24 aa, Mycobacterium bovis
VASARWPAARFAVRNVAVQGPNAV

SEQ ID NO: 207546 - protein, 24 aa, Mycobacterium bovis
VASERRIAEETARAEGKPEQALPK

SEQ ID NO: 207547 - protein, 20 aa, Mycobacterium bovis
VASGRVSYVLGLQGPAVSVD

SEQ ID NO: 207548 - protein, 22 aa, Mycobacterium bovis
VASRIRSAGAIFVGPWSPVSLG

SEQ ID NO: 207549 - protein, 23 aa, Mycobacterium bovis
VASRLIRLPMWVGLQEVDQSRVV

SEQ ID NO: 207550 - protein, 23 aa, Mycobacterium bovis
VATKLFAARGYHGTRMDDVADVI

SEQ ID NO: 207551 - protein, 22 aa, Mycobacterium bovis
VATLRRFTERFAPFNLSETAIR

SEQ ID NO: 207552 - protein, 24 aa, Mycobacterium bovis
VATNEIRALMALPPGQAPDPSRLA

SEQ ID NO: 207553 - protein, 18 aa, Mycobacterium bovis
VATRFCAFDSGGLADAVA

SEQ ID NO: 207554 - protein, 17 aa, Mycobacterium bovis
VATRVIPGAGLAVERIG

SEQ ID NO: 207555 - protein, 26 aa, Mycobacterium bovis
VATTCGRPFADFELRIADDGEVLLRG

SEQ ID NO: 207556 - protein, 17 aa, Mycobacterium bovis
VATVAATWRRLELSVPL

SEQ ID NO: 207557 - protein, 27 aa, Mycobacterium bovis
VAVDLRDDWPAALIAAGFDGTQPTAWL

SEQ ID NO: 207558 - protein, 27 aa, Mycobacterium bovis
VAVDLRDEWQIALCNNGFDANRPSAWI

SEQ ID NO: 207559 - protein, 24 aa, Mycobacterium bovis
VAVGDWIAMFSMWPIKSTPGLRCQ

SEQ ID NO: 207560 - protein, 22 aa, Mycobacterium bovis
VAVHGFPNYFFITGPDTAAQAR

SEQ ID NO: 207561 - protein, 23 aa, Mycobacterium bovis
VAVKRGREAAAWLPNNPETGCKS

SEQ ID NO: 207562 - protein, 17 aa, Mycobacterium bovis
VAVLAPRSPADCFETAL

SEQ ID NO: 207563 - protein, 25 aa, Mycobacterium bovis
VAVLEGRLAAWAIELDAAAGRGVSA

SEQ ID NO: 207564 - protein, 24 aa, Mycobacterium bovis
VAVLRTALVGLELPADAVQLLSAA

SEQ ID NO: 207565 - protein, 21 aa, Mycobacterium bovis
VAVMRRLAAGHGRVDVVDDQT

SEQ ID NO: 207566 - protein, 19 aa, Mycobacterium bovis
VAVQRLRAGELVGLHPEAT

SEQ ID NO: 207567 - protein, 18 aa, Mycobacterium bovis
VAVTNCLNFGSPEDPGVM

SEQ ID NO: 207568 - protein, 20 aa, Mycobacterium bovis
VAVVCLHSYLYPGHEREIGT

SEQ ID NO: 207569 - protein, 19 aa, Mycobacterium bovis
VCEPFLVRAGMVARTPRGR

SEQ ID NO: 207570 - protein, 18 aa, Mycobacterium bovis
VCGAELIRGLVTAYEIHI

SEQ ID NO: 207571 - protein, 21 aa, Mycobacterium bovis
VCGVGKPAGKTAFVFAGQGSQ

SEQ ID NO: 207572 - protein, 23 aa, Mycobacterium bovis
VCIVPRERLRLLPGKASQQQVWL

SEQ ID NO: 207573 - protein, 17 aa, Mycobacterium bovis
VCTNTLCAVMGGDAIFD

SEQ ID NO: 207574 - protein, 28 aa, Mycobacterium bovis
VCVHDPLIMRRALEYATGLGVLIAQHAE

SEQ ID NO: 207575 - protein, 30 aa, Mycobacterium bovis
VCVNAETGAVWWPECSKEAYADGIGGAVDA

SEQ ID NO: 207576 - protein, 30 aa, Mycobacterium bovis
VCVNIETGVVWWPECSKEAYADGIDGAVDA

SEQ ID NO: 207577 - protein, 18 aa, Mycobacterium bovis
VCYYPCLDTTRGRSFGAY

SEQ ID NO: 207578 - protein, 24 aa, Mycobacterium bovis
VDAALRPIIDRAYQPGPAPAVNPR

SEQ ID NO: 207579 - protein, 26 aa, Mycobacterium bovis
VDADEWRQELPLIEEWLQFVGEKLPT

SEQ ID NO: 207580 - protein, 23 aa, Mycobacterium bovis
VDAEFRVGTMGLGWDSEAQSVVV

SEQ ID NO: 207581 - protein, 23 aa, Mycobacterium bovis
VDAEGFPVFSGRKDAVVKISGKR

SEQ ID NO: 207582 - protein, 17 aa, Mycobacterium bovis
VDAELALRVRGWPSMTR

SEQ ID NO: 207583 - protein, 17 aa, Mycobacterium bovis
VDAHGAMIRALAGSLEA

SEQ ID NO: 207584 - protein, 18 aa, Mycobacterium bovis
VDAISGWWNTGAATEADG

SEQ ID NO: 207585 - protein, 24 aa, Mycobacterium bovis
VDAKPAQVALAWLISLPGVVAIPG

SEQ ID NO: 207586 - protein, 32 aa, Mycobacterium bovis
VDAKWASSISGYWRRGRTEEMFRKWKKELAEA

SEQ ID NO: 207587 - protein, 27 aa, Mycobacterium bovis
VDALCARFRISGLPVVDDDGALVGIIT

SEQ ID NO: 207588 - protein, 23 aa, Mycobacterium bovis
VDALRKTGLLGLVLPREIGGMGS

SEQ ID NO: 207589 - protein, 18 aa, Mycobacterium bovis
VDAPRLGLPLAQELSAYL

SEQ ID NO: 207590 - protein, 23 aa, Mycobacterium bovis
VDASLRLLVRGGRFLEMGKTDIR

SEQ ID NO: 207591 - protein, 23 aa, Mycobacterium bovis
VDAVVGIYGRYDWEDRSTPERAR

SEQ ID NO: 207592 - protein, 23 aa, Mycobacterium bovis
VDAYLSPVLRRYINQVADQMRGV

SEQ ID NO: 207593 - protein, 19 aa, Mycobacterium bovis
VDCPEEYIGAVTQLMAARK

SEQ ID NO: 207594 - protein, 23 aa, Mycobacterium bovis
VDDLCLPDMLLLLATDVAAVDHH

SEQ ID NO: 207595 - protein, 23 aa, Mycobacterium bovis
VDDLEAAITFYSRLFNAEPAKRK

SEQ ID NO: 207596 - protein, 21 aa, Mycobacterium bovis
VDDLLGIWGRPEITGKPVYSD

SEQ ID NO: 207597 - protein, 25 aa, Mycobacterium bovis
VDDPDFDLGRHVWRIALPRPGNEDQ

SEQ ID NO: 207598 - protein, 20 aa, Mycobacterium bovis
VDEFERWVVEHGFRGLSLRP

SEQ ID NO: 207599 - protein, 17 aa, Mycobacterium bovis
VDEGAVCTAMLDLYQNE

SEQ ID NO: 207600 - protein, 23 aa, Mycobacterium bovis
VDEGGRRVGARIVVVTHLATDAA

SEQ ID NO: 207601 - protein, 17 aa, Mycobacterium bovis
VDELIWLPVPDAMNKLD

SEQ ID NO: 207602 - protein, 18 aa, Mycobacterium bovis
VDERVVAFVGRIQPLKAP

SEQ ID NO: 207603 - protein, 17 aa, Mycobacterium bovis
VDFTLGYEVRSVNAEPD

SEQ ID NO: 207604 - protein, 18 aa, Mycobacterium bovis
VDFYDKFGYDRPVYTLSH

SEQ ID NO: 207605 - protein, 23 aa, Mycobacterium bovis
VDGAIGRGGWFIGTGGMATIGGG

SEQ ID NO: 207606 - protein, 19 aa, Mycobacterium bovis
VDGDERWAAEIRRLAHLRG

SEQ ID NO: 207607 - protein, 22 aa, Mycobacterium bovis
VDGLWLAGSHGFELVAPDGSHH

SEQ ID NO: 207608 - protein, 18 aa, Mycobacterium bovis
VDGMRADLVVARTAAAHA

SEQ ID NO: 207609 - protein, 19 aa, Mycobacterium bovis
VDGRARVVDDFGGPAPTAT

SEQ ID NO: 207610 - protein, 19 aa, Mycobacterium bovis
VDGRLICLVRAESDEDARR

SEQ ID NO: 207611 - protein, 28 aa, Mycobacterium bovis
VDGRSHAWVQAWTGGWWHYDPTNDNEIT

SEQ ID NO: 207612 - protein, 17 aa, Mycobacterium bovis
VDGTSWITGADQPGRHV

SEQ ID NO: 207613 - protein, 24 aa, Mycobacterium bovis
VDHPRLGWRQAPVGPVLADALGLP

SEQ ID NO: 207614 - protein, 20 aa, Mycobacterium bovis
VDKGVKWDPAELGPVVSDLL

SEQ ID NO: 207615 - protein, 24 aa, Mycobacterium bovis
VDLDLPRDALIVFTGLSGSGKSSL

SEQ ID NO: 207616 - protein, 17 aa, Mycobacterium bovis
VDLDPMPGVAWQRVVEV

SEQ ID NO: 207617 - protein, 28 aa, Mycobacterium bovis
VDLFPAHRPRPGYLPVLRAYDYAGDEVV

SEQ ID NO: 207618 - protein, 17 aa, Mycobacterium bovis
VDLGAAIDTQGRNTAVR

SEQ ID NO: 207619 - protein, 22 aa, Mycobacterium bovis
VDLILPGFRYRAAMADGTVENE

SEQ ID NO: 207620 - protein, 25 aa, Mycobacterium bovis
VDLLRFCLERGYQLRVIEQMPLDAG

SEQ ID NO: 207621 - protein, 19 aa, Mycobacterium bovis
VDLRDDWPQALRDSGFDAA

SEQ ID NO: 207622 - protein, 24 aa, Mycobacterium bovis
VDLSRLAEDIIVWSSTEFGYVTLH

SEQ ID NO: 207623 - protein, 18 aa, Mycobacterium bovis
VDLYSCFPSAVQVAAIEL

SEQ ID NO: 207624 - protein, 17 aa, Mycobacterium bovis
VDMTKIVGLRARAKAAF

SEQ ID NO: 207625 - protein, 28 aa, Mycobacterium bovis
VDPARLVLDPGLGFAKTAQHNWAILHAL

SEQ ID NO: 207626 - protein, 24 aa, Mycobacterium bovis
VDPDRPLPEYGLDSLGALELRTRI

SEQ ID NO: 207627 - protein, 17 aa, Mycobacterium bovis
VDPLRGLSRPDFDHDGE

SEQ ID NO: 207628 - protein, 22 aa, Mycobacterium bovis
VDPRAQILSAWIAKEELRTLLS

SEQ ID NO: 207629 - protein, 22 aa, Mycobacterium bovis
VDPTLRCVRCGSDVVRAVVVGA

SEQ ID NO: 207630 - protein, 22 aa, Mycobacterium bovis
VDPWGHFDGLRAWLNGLLDTGY

SEQ ID NO: 207631 - protein, 17 aa, Mycobacterium bovis
VDQARRSGASWSDIGKS

SEQ ID NO: 207632 - protein, 29 aa, Mycobacterium bovis
VDQDRCRGWRMCVSGCPYKKVYFNHKTGK

SEQ ID NO: 207633 - protein, 22 aa, Mycobacterium bovis
VDRDEVLLDIGYKTEGVIPARE

SEQ ID NO: 207634 - protein, 25 aa, Mycobacterium bovis
VDRTLRVAWSLADLAGRTSPGIDEV

SEQ ID NO: 207635 - protein, 21 aa, Mycobacterium bovis
VDRVKDMIVTGGFNVFPREVE

SEQ ID NO: 207636 - protein, 25 aa, Mycobacterium bovis
VDSCRECNSCTRGIEQYCKPGANFT

SEQ ID NO: 207637 - protein, 23 aa, Mycobacterium bovis
VDSEAGWPLYLRRYTDLLCIQVQ

SEQ ID NO: 207638 - protein, 19 aa, Mycobacterium bovis
VDTAVLCDRCQGKGTNGDS

SEQ ID NO: 207639 - protein, 24 aa, Mycobacterium bovis
VDTEIPSPVAGVLVSISADEDATV

SEQ ID NO: 207640 - protein, 18 aa, Mycobacterium bovis
VDTGAFISGSYSNGFLWS

SEQ ID NO: 207641 - protein, 17 aa, Mycobacterium bovis
VDTGAFITGNYSNGLFL

SEQ ID NO: 207642 - protein, 17 aa, Mycobacterium bovis
VDTGAFITGSYSNGFLV

SEQ ID NO: 207643 - protein, 20 aa, Mycobacterium bovis
VDTKAGYAFERIPKAEVEDL

SEQ ID NO: 207644 - protein, 19 aa, Mycobacterium bovis
VDTLAKAGAVFVEETEQVP

SEQ ID NO: 207645 - protein, 25 aa, Mycobacterium bovis
VDTLRRAGERFGFAVESMSLVSEHH

SEQ ID NO: 207646 - protein, 24 aa, Mycobacterium bovis
VDVAPRVAQIFGVQAVPTVVALAA

SEQ ID NO: 207647 - protein, 17 aa, Mycobacterium bovis
VDVLPFQLVTMGQPIAD

SEQ ID NO: 207648 - protein, 33 aa, Mycobacterium bovis
VDVTLRPAQYLPWHPGRCAQVFVGESSVGHAGQ

SEQ ID NO: 207649 - protein, 21 aa, Mycobacterium bovis
VDYRLIPKHSLGMALDDCHDA

SEQ ID NO: 207650 - protein, 19 aa, Mycobacterium bovis
VDYYNFFLSGGFLAPPGRA

SEQ ID NO: 207651 - protein, 24 aa, Mycobacterium bovis
VEAKAAIRQIEFLIRATAQRPDAV

SEQ ID NO: 207652 - protein, 20 aa, Mycobacterium bovis
VEALVGLGFAAKQAEEATDT

SEQ ID NO: 207653 - protein, 33 aa, Mycobacterium bovis
VEARRFWRHEYLLNALIGRFAKPYVALMDGIVM

SEQ ID NO: 207654 - protein, 29 aa, Mycobacterium bovis
VEASHCYPHFRRFLAEVVRVLRPGGYFPY

SEQ ID NO: 207655 - protein, 19 aa, Mycobacterium bovis
VEATLRWAGNSMTTNGVSH

SEQ ID NO: 207656 - protein, 17 aa, Mycobacterium bovis
VEAVLRLLAGVLGNPAS

SEQ ID NO: 207657 - protein, 18 aa, Mycobacterium bovis
VEAVPAHILIAIDEAYVE

SEQ ID NO: 207658 - protein, 19 aa, Mycobacterium bovis
VEAYVGLDSFRHLAKERAL

SEQ ID NO: 207659 - protein, 18 aa, Mycobacterium bovis
VECCSYLLAVDVDLNTVP

SEQ ID NO: 207660 - protein, 19 aa, Mycobacterium bovis
VEDSQLWLLQTRGAERSAQ

SEQ ID NO: 207661 - protein, 25 aa, Mycobacterium bovis
VEEFSKVLADVCVRAPRIGLVSNVT

SEQ ID NO: 207662 - protein, 24 aa, Mycobacterium bovis
VEELLGVVASEGWQGQAAEAFVAA

SEQ ID NO: 207663 - protein, 23 aa, Mycobacterium bovis
VEGFTRDGVHRWRSIPYARAPVG

SEQ ID NO: 207664 - protein, 18 aa, Mycobacterium bovis
VEGILDCAELLVVALCDR

SEQ ID NO: 207665 - protein, 17 aa, Mycobacterium bovis
VEGLRGWLREERIDAVV

SEQ ID NO: 207666 - protein, 25 aa, Mycobacterium bovis
VEGMLALTGYYAWHKICVERAILPG

SEQ ID NO: 207667 - protein, 21 aa, Mycobacterium bovis
VEHGLVLPSGPLIHGGTGGYG

SEQ ID NO: 207668 - protein, 17 aa, Mycobacterium bovis
VEHIGMIEVAQLRARVS

SEQ ID NO: 207669 - protein, 29 aa, Mycobacterium bovis
VEIAEMFQLPPALQRAWHTHGYYGSVSHN

SEQ ID NO: 207670 - protein, 17 aa, Mycobacterium bovis
VEIGRRLARECPVEADL

SEQ ID NO: 207671 - protein, 19 aa, Mycobacterium bovis
VEINEAFAAVALASIRELG

SEQ ID NO: 207672 - protein, 23 aa, Mycobacterium bovis
VEINEAFAPVVMAWLKEIKADPA

SEQ ID NO: 207673 - protein, 28 aa, Mycobacterium bovis
VEIRRLAIECLRQLAAVAPAVFADFEVT

SEQ ID NO: 207674 - protein, 23 aa, Mycobacterium bovis
VEITTCLRRGEIEMVTRFEPNAA

SEQ ID NO: 207675 - protein, 22 aa, Mycobacterium bovis
VEIYRPRVAGPVPQAEDVVAMA

SEQ ID NO: 207676 - protein, 21 aa, Mycobacterium bovis
VELLRQAWLTATRARNALVLV

SEQ ID NO: 207677 - protein, 23 aa, Mycobacterium bovis
VELPLMEVRALLDLGDVAKATRK

SEQ ID NO: 207678 - protein, 20 aa, Mycobacterium bovis
VELRNRLKTATGLTLPPTLI

SEQ ID NO: 207679 - protein, 20 aa, Mycobacterium bovis
VELRNRLKTATGLTLPPTVI

SEQ ID NO: 207680 - protein, 18 aa, Mycobacterium bovis
VELRNRLTAVTAVTLPAT

SEQ ID NO: 207681 - protein, 21 aa, Mycobacterium bovis
VELRRPGGPGVIMGRNVVRKD

SEQ ID NO: 207682 - protein, 19 aa, Mycobacterium bovis
VELSARVAWMSESQLASEI

SEQ ID NO: 207683 - protein, 18 aa, Mycobacterium bovis
VELSKLYLLPGYHGTGAA

SEQ ID NO: 207684 - protein, 25 aa, Mycobacterium bovis
VENYNLNMAIPWIAAERGFIDAVID

SEQ ID NO: 207685 - protein, 21 aa, Mycobacterium bovis
VEPAILRPSFRNWDHPYRRQI

SEQ ID NO: 207686 - protein, 18 aa, Mycobacterium bovis
VEPAWQRAAGHQVQPQTG

SEQ ID NO: 207687 - protein, 24 aa, Mycobacterium bovis
VEPSDFRLWVCLHEVTHRVQFTAN

SEQ ID NO: 207688 - protein, 25 aa, Mycobacterium bovis
VEQIKRFRILPTLWEPGGDEITLTM

SEQ ID NO: 207689 - protein, 17 aa, Mycobacterium bovis
VEQMLPLDGHTPLTTQL

SEQ ID NO: 207690 - protein, 17 aa, Mycobacterium bovis
VERALIAGHDFVLLGER

SEQ ID NO: 207691 - protein, 22 aa, Mycobacterium bovis
VEREFRGVFTALFPGGEGRLRL

SEQ ID NO: 207692 - protein, 20 aa, Mycobacterium bovis
VERFGDLVFDTVITRTVRFP

SEQ ID NO: 207693 - protein, 20 aa, Mycobacterium bovis
VERRAVPLPLEQKIFDAEWT

SEQ ID NO: 207694 - protein, 25 aa, Mycobacterium bovis
VERRYRAWIRWNAAIMVHRAQRPGV

SEQ ID NO: 207695 - protein, 25 aa, Mycobacterium bovis
VESFGFKYGLPMDADMVMDVRFLPN

SEQ ID NO: 207696 - protein, 23 aa, Mycobacterium bovis
VESGWRPGDSVILAAAGASDRRA

SEQ ID NO: 207697 - protein, 25 aa, Mycobacterium bovis
VETARGAVCAAEIAAADPTVGMMWG

SEQ ID NO: 207698 - protein, 22 aa, Mycobacterium bovis
VETCWRKAIQMDYETDTDTELV

SEQ ID NO: 207699 - protein, 19 aa, Mycobacterium bovis
VETERRFYLANSVEMVPRN

SEQ ID NO: 207700 - protein, 33 aa, Mycobacterium bovis
VEVALYRLLMSWGVRPGLVLGHSVGELAAAHVA

SEQ ID NO: 207701 - protein, 20 aa, Mycobacterium bovis
VEVASFAVLRDWGVLPDFVM

SEQ ID NO: 207702 - protein, 19 aa, Mycobacterium bovis
VEVEARLAVRTAEERANAV

SEQ ID NO: 207703 - protein, 17 aa, Mycobacterium bovis
VEYARKYRQTIAAAAVV

SEQ ID NO: 207704 - protein, 17 aa, Mycobacterium bovis
VEYRFTRTGLALPGDPV

SEQ ID NO: 207705 - protein, 19 aa, Mycobacterium bovis
VFDREWPLRVGDIDRAGRL

SEQ ID NO: 207706 - protein, 25 aa, Mycobacterium bovis
VFEGLKAYRWADGSIVSFRADANAA

SEQ ID NO: 207707 - protein, 29 aa, Mycobacterium bovis
VFEHLGRLLIIDCGVLFPGHDEPGVDLIL

SEQ ID NO: 207708 - protein, 24 aa, Mycobacterium bovis
VFGHAVRIFYKDAFAKHQELFDDL

SEQ ID NO: 207709 - protein, 18 aa, Mycobacterium bovis
VFIRAPWVERVGDGVQVL

SEQ ID NO: 207710 - protein, 18 aa, Mycobacterium bovis
VFITYPLWIGTRQADRLR

SEQ ID NO: 207711 - protein, 22 aa, Mycobacterium bovis
VFPEATMCRLGVPLRQVAEPVD

SEQ ID NO: 207712 - protein, 20 aa, Mycobacterium bovis
VFPPGMYWRTPDMLSGAPAL

SEQ ID NO: 207713 - protein, 26 aa, Mycobacterium bovis
VFREPLPRIGLDSLPEQGAWLQPFRP

SEQ ID NO: 207714 - protein, 23 aa, Mycobacterium bovis
VFTRAQLLHEVWGYDFFGGTRTV

SEQ ID NO: 207715 - protein, 17 aa, Mycobacterium bovis
VFVARAGGGIVEDVDGN

SEQ ID NO: 207716 - protein, 17 aa, Mycobacterium bovis
VFVDHGLLRAGERAQVQ

SEQ ID NO: 207717 - protein, 19 aa, Mycobacterium bovis
VFVNARVDTYWLRQHADTT

SEQ ID NO: 207718 - protein, 24 aa, Mycobacterium bovis
VFYLHSRLLERCAKLSDDLGGGSL

SEQ ID NO: 207719 - protein, 37 aa, Mycobacterium bovis
VGAAACLRKTDWLFPQYRELGVYLVRGIPPGHVGVAW

SEQ ID NO: 207720 - protein, 19 aa, Mycobacterium bovis
VGAKLLVDMAHFAGLVAAG

SEQ ID NO: 207721 - protein, 20 aa, Mycobacterium bovis
VGALGLRPTLAALKTGARLA

SEQ ID NO: 207722 - protein, 17 aa, Mycobacterium bovis
VGAPAHRIADQSVVVTM

SEQ ID NO: 207723 - protein, 17 aa, Mycobacterium bovis
VGAQAIVVSVDYRLAPE

SEQ ID NO: 207724 - protein, 28 aa, Mycobacterium bovis
VGAQCRDLLHWRFCRGVPPRATNDTDIA

SEQ ID NO: 207725 - protein, 19 aa, Mycobacterium bovis
VGARLAGTRVLRADALTQL

SEQ ID NO: 207726 - protein, 24 aa, Mycobacterium bovis
VGARQRLMCRLPKRPDPHAWLGDA

SEQ ID NO: 207727 - protein, 18 aa, Mycobacterium bovis
VGAVALVAGWAARNLPAD

SEQ ID NO: 207728 - protein, 22 aa, Mycobacterium bovis
VGAVDCRGGAPGTRETDLLDPA

SEQ ID NO: 207729 - protein, 20 aa, Mycobacterium bovis
VGAVLCNLATHLDDPADRLN

SEQ ID NO: 207730 - protein, 19 aa, Mycobacterium bovis
VGAVVGRYAAGGYEVDFTA

SEQ ID NO: 207731 - protein, 18 aa, Mycobacterium bovis
VGCVDRIVTELAVIDVCA

SEQ ID NO: 207732 - protein, 21 aa, Mycobacterium bovis
VGDAFPLSSLTQIYASDGESN

SEQ ID NO: 207733 - protein, 24 aa, Mycobacterium bovis
VGDAFRAGFLTGRSAGLGLERSAQ

SEQ ID NO: 207734 - protein, 23 aa, Mycobacterium bovis
VGDALKAVAAFRLALPRTMLRFA

SEQ ID NO: 207735 - protein, 18 aa, Mycobacterium bovis
VGDDVAHPELGHGWVQGA

SEQ ID NO: 207736 - protein, 19 aa, Mycobacterium bovis
VGDLGVTLLRTIKATLDPA

SEQ ID NO: 207737 - protein, 23 aa, Mycobacterium bovis
VGDPGLVVAVWDRRLHTGAHAAG

SEQ ID NO: 207738 - protein, 17 aa, Mycobacterium bovis
VGDPIQSIYGWRGASAT

SEQ ID NO: 207739 - protein, 18 aa, Mycobacterium bovis
VGDPSGFVKLVADAKHGE

SEQ ID NO: 207740 - protein, 19 aa, Mycobacterium bovis
VGDRVGGMSPNGCWATFVT

SEQ ID NO: 207741 - protein, 25 aa, Mycobacterium bovis
VGEAWRYLKELRLERGPLSTEEATT

SEQ ID NO: 207742 - protein, 18 aa, Mycobacterium bovis
VGEGDLAGQVAYRYDYVN

SEQ ID NO: 207743 - protein, 17 aa, Mycobacterium bovis
VGEIAAYAIAGVIAADD

SEQ ID NO: 207744 - protein, 18 aa, Mycobacterium bovis
VGEICRRLDGIPLAIEFA

SEQ ID NO: 207745 - protein, 25 aa, Mycobacterium bovis
VGEICVSGPLLAGGYWNLPDETSRT

SEQ ID NO: 207746 - protein, 26 aa, Mycobacterium bovis
VGELGRSAAGYALWCNGIEDFAELRR

SEQ ID NO: 207747 - protein, 24 aa, Mycobacterium bovis
VGEMRAGTVALVIREDRGWAVREI

SEQ ID NO: 207748 - protein, 24 aa, Mycobacterium bovis
VGERWTLLILREAFFGVRRFGQLA

SEQ ID NO: 207749 - protein, 21 aa, Mycobacterium bovis
VGETAEFLRWTAGQAPDASGY

SEQ ID NO: 207750 - protein, 21 aa, Mycobacterium bovis
VGFACQSFAALSLEPPLVLFC

SEQ ID NO: 207751 - protein, 19 aa, Mycobacterium bovis
VGFAGRAALGLGKRLTGKS

SEQ ID NO: 207752 - protein, 18 aa, Mycobacterium bovis
VGFAIFRIEVNLPVDGRW

SEQ ID NO: 207753 - protein, 25 aa, Mycobacterium bovis
VGFDIPNDFVVGYGLDYDERYRDLS

SEQ ID NO: 207754 - protein, 19 aa, Mycobacterium bovis
VGFGRGRRAPVSSSDQLVR

SEQ ID NO: 207755 - protein, 20 aa, Mycobacterium bovis
VGFKGSRKSTPFAAQLAAEN

SEQ ID NO: 207756 - protein, 22 aa, Mycobacterium bovis
VGGACRRYLQELGDLPTNTLTA

SEQ ID NO: 207757 - protein, 32 aa, Mycobacterium bovis
VGGAGGFGGSGGRGGLLLGTGGAGGDGGVGGD

SEQ ID NO: 207758 - protein, 17 aa, Mycobacterium bovis
VGGAGGKGGDGGVGGVG

SEQ ID NO: 207759 - protein, 21 aa, Mycobacterium bovis
VGGECSYWACVPSKALLRPVI

SEQ ID NO: 207760 - protein, 17 aa, Mycobacterium bovis
VGGELAVIGDAKDAGEA

SEQ ID NO: 207761 - protein, 18 aa, Mycobacterium bovis
VGGHPAKRTFQALRIAVN

SEQ ID NO: 207762 - protein, 23 aa, Mycobacterium bovis
VGGLRGGFEYARTGNPTRAALEA

SEQ ID NO: 207763 - protein, 25 aa, Mycobacterium bovis
VGGLRRCVTALKARFGDNPATRRIV

SEQ ID NO: 207764 - protein, 19 aa, Mycobacterium bovis
VGGLSGARPLVAWLDALAT

SEQ ID NO: 207765 - protein, 24 aa, Mycobacterium bovis
VGGLTLGGGVGWTTRRFGLSCDNL

SEQ ID NO: 207766 - protein, 25 aa, Mycobacterium bovis
VGGMGGLGFVVARWLAEQGAGLIVL

SEQ ID NO: 207767 - protein, 26 aa, Mycobacterium bovis
VGGMSPNGCWATFVTCDARLATRLPE

SEQ ID NO: 207768 - protein, 19 aa, Mycobacterium bovis
VGGPLPGLGADLLAVVARL

SEQ ID NO: 207769 - protein, 24 aa, Mycobacterium bovis
VGGSCPLWVVHDAFAQPERIVRQV

SEQ ID NO: 207770 - protein, 25 aa, Mycobacterium bovis
VGHRIRAAIHFDDLQWERRYRRVAA

SEQ ID NO: 207771 - protein, 20 aa, Mycobacterium bovis
VGHRYRWLRGTGLLAAAACA

SEQ ID NO: 207772 - protein, 17 aa, Mycobacterium bovis
VGHSLDPKADYGPLVTG

SEQ ID NO: 207773 - protein, 18 aa, Mycobacterium bovis
VGIREFVDDGAIDPDHAS

SEQ ID NO: 207774 - protein, 19 aa, Mycobacterium bovis
VGISSVLKIGRDLYVIDCG

SEQ ID NO: 207775 - protein, 26 aa, Mycobacterium bovis
VGITRARVHLALSWALSRSPGGRQSR

SEQ ID NO: 207776 - protein, 25 aa, Mycobacterium bovis
VGIVGFCMGGQFALVLSPRGFGATA

SEQ ID NO: 207777 - protein, 17 aa, Mycobacterium bovis
VGLARSFLEEVVTVELG

SEQ ID NO: 207778 - protein, 21 aa, Mycobacterium bovis
VGLFRHVLRPAFLQAETAARQ

SEQ ID NO: 207779 - protein, 33 aa, Mycobacterium bovis
VGLGAVGRAVRWRLSGLGLRVIAHDPYRDDAGH

SEQ ID NO: 207780 - protein, 21 aa, Mycobacterium bovis
VGLIAGCLVTSGVMRRNAKAR

SEQ ID NO: 207781 - protein, 18 aa, Mycobacterium bovis
VGLRVAWRTLENSGINPD

SEQ ID NO: 207782 - protein, 19 aa, Mycobacterium bovis
VGLSSRLAAITTLGPKFWA

SEQ ID NO: 207783 - protein, 17 aa, Mycobacterium bovis
VGMPTFAGRAIAASLGL

SEQ ID NO: 207784 - protein, 28 aa, Mycobacterium bovis
VGMPYVNQRWLGGMLTNFSTVHKRLQRL

SEQ ID NO: 207785 - protein, 17 aa, Mycobacterium bovis
VGMSGLLVKSTVVMKEN

SEQ ID NO: 207786 - protein, 18 aa, Mycobacterium bovis
VGNVRFAGAPVVAHSAVQ

SEQ ID NO: 207787 - protein, 18 aa, Mycobacterium bovis
VGNYPMSLVLDGQALNIT

SEQ ID NO: 207788 - protein, 23 aa, Mycobacterium bovis
VGPDLRLPIYIGDDLTDEDAFDA

SEQ ID NO: 207789 - protein, 27 aa, Mycobacterium bovis
VGPQVARAALLFGMCFDAESAVRHGLA

SEQ ID NO: 207790 - protein, 22 aa, Mycobacterium bovis
VGPTIAAAVTEWFAVDWHREIV

SEQ ID NO: 207791 - protein, 22 aa, Mycobacterium bovis
VGQDIRYGLGAVRNVGANVVGS

SEQ ID NO: 207792 - protein, 30 aa, Mycobacterium bovis
VGQIIPWNFPILMAAWKLAPALAAGNTAVL

SEQ ID NO: 207793 - protein, 17 aa, Mycobacterium bovis
VGQKRFSLEGAESVIPM

SEQ ID NO: 207794 - protein, 23 aa, Mycobacterium bovis
VGQLRPLLAPGLVDSVLAVSRTA

SEQ ID NO: 207795 - protein, 26 aa, Mycobacterium bovis
VGRAARLGHRLTIAMTRWQALVNWSG

SEQ ID NO: 207796 - protein, 23 aa, Mycobacterium bovis
VGRIARVLGPRGLMPNPKTGTVT

SEQ ID NO: 207797 - protein, 18 aa, Mycobacterium bovis
VGRKLLAWERPLRKSDRE

SEQ ID NO: 207798 - protein, 21 aa, Mycobacterium bovis
VGRMKDMLIVYGRNHYPEDIE

SEQ ID NO: 207799 - protein, 17 aa, Mycobacterium bovis
VGRRARAARLLRSVMAR

SEQ ID NO: 207800 - protein, 23 aa, Mycobacterium bovis
VGRRRWNRRGAMVTDRYQRLCHH

SEQ ID NO: 207801 - protein, 24 aa, Mycobacterium bovis
VGRVLRPGGKFIYTVRHTGDAHYG

SEQ ID NO: 207802 - protein, 24 aa, Mycobacterium bovis
VGSFKKGPFRIAMAAKIPIVPIVI

SEQ ID NO: 207803 - protein, 17 aa, Mycobacterium bovis
VGSGAWTAVHHAFTAPK

SEQ ID NO: 207804 - protein, 21 aa, Mycobacterium bovis
VGSGGAGGSRGVLFGTPGANG

SEQ ID NO: 207805 - protein, 18 aa, Mycobacterium bovis
VGSSRANLFTSISGGINA

SEQ ID NO: 207806 - protein, 19 aa, Mycobacterium bovis
VGTALGVALQRADHVVVAC

SEQ ID NO: 207807 - protein, 20 aa, Mycobacterium bovis
VGTAVRYTAKPGAFRRPNGQ

SEQ ID NO: 207808 - protein, 18 aa, Mycobacterium bovis
VGTLRHWRHSDIGPASFT

SEQ ID NO: 207809 - protein, 24 aa, Mycobacterium bovis
VGTRLGMCGVEYFGHPWEFGPRKT

SEQ ID NO: 207810 - protein, 20 aa, Mycobacterium bovis
VGVDTSALWAALRQPDVLAE

SEQ ID NO: 207811 - protein, 22 aa, Mycobacterium bovis
VGVGYAEQADWMLVTADNAVVV

SEQ ID NO: 207812 - protein, 19 aa, Mycobacterium bovis
VGVHPNGADAWALQDVLAQ

SEQ ID NO: 207813 - protein, 17 aa, Mycobacterium bovis
VGVLAGFPVEIAPTAQA

SEQ ID NO: 207814 - protein, 24 aa, Mycobacterium bovis
VGVRLPGMRGVPVVSQGCRPIGYP

SEQ ID NO: 207815 - protein, 18 aa, Mycobacterium bovis
VGVRSRFGAAVLGSRTIR

SEQ ID NO: 207816 - protein, 20 aa, Mycobacterium bovis
VGVSFGGLVTRSFSPRWRGL

SEQ ID NO: 207817 - protein, 26 aa, Mycobacterium bovis
VGVSPSLRFGLAFCEASGPRLVRHTG

SEQ ID NO: 207818 - protein, 17 aa, Mycobacterium bovis
VGWCIIIAMRSIPASVE

SEQ ID NO: 207819 - protein, 30 aa, Mycobacterium bovis
VGYELARDALREWLRRGGKPARLIEIATRL

SEQ ID NO: 207820 - protein, 25 aa, Mycobacterium bovis
VGYPDRVRAGLLLAVGARATADQIG

SEQ ID NO: 207821 - protein, 20 aa, Mycobacterium bovis
VGYPREWRRRKPYSWLRQVL

SEQ ID NO: 207822 - protein, 25 aa, Mycobacterium bovis
VGYWRRAGLTASRFVACPFGGSGAR

SEQ ID NO: 207823 - protein, 24 aa, Mycobacterium bovis
VHADAGIDFFEVFCDTPLQDCERR

SEQ ID NO: 207824 - protein, 24 aa, Mycobacterium bovis
VHARRCGWSLGISAETLRRWAGQA

SEQ ID NO: 207825 - protein, 24 aa, Mycobacterium bovis
VHDAQCTTMSWPQRADHAAQAARL

SEQ ID NO: 207826 - protein, 22 aa, Mycobacterium bovis
VHDGGDHFVVFGAVESLSEVPA

SEQ ID NO: 207827 - protein, 31 aa, Mycobacterium bovis
VHEIKGARAYHPTLLRKGERLLVFLPLAHVL

SEQ ID NO: 207828 - protein, 22 aa, Mycobacterium bovis
VHFKSVAYELLWFLRGDSNIGW

SEQ ID NO: 207829 - protein, 23 aa, Mycobacterium bovis
VHGFRFFDNRDLLGFVDGTENPS

SEQ ID NO: 207830 - protein, 21 aa, Mycobacterium bovis
VHGFSTLWLDDAVNADVKQTS

SEQ ID NO: 207831 - protein, 23 aa, Mycobacterium bovis
VHGRPRRAGVSSFGISGTNAHVI

SEQ ID NO: 207832 - protein, 23 aa, Mycobacterium bovis
VHGRSGPIPVRRTHEMTGITESF

SEQ ID NO: 207833 - protein, 19 aa, Mycobacterium bovis
VHGTWRMLRANAKLAASTG

SEQ ID NO: 207834 - protein, 24 aa, Mycobacterium bovis
VHGVLIPGGFGIRGIEGKIGAIAY

SEQ ID NO: 207835 - protein, 17 aa, Mycobacterium bovis
VHHCHREQWPVAGRMMG

SEQ ID NO: 207836 - protein, 24 aa, Mycobacterium bovis
VHILIDLPAVPGFGNTTGAPSSGF

SEQ ID NO: 207837 - protein, 25 aa, Mycobacterium bovis
VHKKGSALVPSWVAFAVTGLLEQHF

SEQ ID NO: 207838 - protein, 17 aa, Mycobacterium bovis
VHNVMTFGGNMITVTEA

SEQ ID NO: 207839 - protein, 17 aa, Mycobacterium bovis
VHRLPAWSRNLTAKIKK

SEQ ID NO: 207840 - protein, 24 aa, Mycobacterium bovis
VHRPRRASSPFGQFAAVADAVNPA

SEQ ID NO: 207841 - protein, 24 aa, Mycobacterium bovis
VHRRCADVRYLGSWPTGPAAGAQP

SEQ ID NO: 207842 - protein, 18 aa, Mycobacterium bovis
VHSARWRPWRSYATQHLW

SEQ ID NO: 207843 - protein, 18 aa, Mycobacterium bovis
VHTVEFYTAGTAVRRTGS

SEQ ID NO: 207844 - protein, 22 aa, Mycobacterium bovis
VHVPQCPRRWRYLSPAIPADPN

SEQ ID NO: 207845 - protein, 26 aa, Mycobacterium bovis
VHWVAPPEAVWACRSLAATHYASGGW

SEQ ID NO: 207846 - protein, 25 aa, Mycobacterium bovis
VHYPERLGALVLTSCDAFEHFPPPI

SEQ ID NO: 207847 - protein, 19 aa, Mycobacterium bovis
VIAALRAGNLVLMVQPPRG

SEQ ID NO: 207848 - protein, 22 aa, Mycobacterium bovis
VIAANRAQLMVLIATNIFGQNT

SEQ ID NO: 207849 - protein, 18 aa, Mycobacterium bovis
VIADEIWAPVVYGSRHVA

SEQ ID NO: 207850 - protein, 18 aa, Mycobacterium bovis
VIADRTRRPPAFPEDIWV

SEQ ID NO: 207851 - protein, 24 aa, Mycobacterium bovis
VIARGGFPDGCFQTLLVSSGAVEA

SEQ ID NO: 207852 - protein, 25 aa, Mycobacterium bovis
VIATGPRWRCPAGRCRRRPSDRAYR

SEQ ID NO: 207853 - protein, 27 aa, Mycobacterium bovis
VICSKGFPSYFLIVADLISYARSAGIR

SEQ ID NO: 207854 - protein, 22 aa, Mycobacterium bovis
VIDELRELANVLGVARDAEVLG

SEQ ID NO: 207855 - protein, 21 aa, Mycobacterium bovis
VIDEYRLVYRADSLVNWCPGL

SEQ ID NO: 207856 - protein, 25 aa, Mycobacterium bovis
VIDLLLKRAASLGIQIRYETGATEL

SEQ ID NO: 207857 - protein, 21 aa, Mycobacterium bovis
VIDNIRYFAELCGVDRQAADE

SEQ ID NO: 207858 - protein, 24 aa, Mycobacterium bovis
VIDSRSAAMGVGFAALAAGRAAAA

SEQ ID NO: 207859 - protein, 21 aa, Mycobacterium bovis
VIDVLDWCAREGIAVIPYGGG

SEQ ID NO: 207860 - protein, 19 aa, Mycobacterium bovis
VIISDFLGPINWMRPLRAI

SEQ ID NO: 207861 - protein, 25 aa, Mycobacterium bovis
VILPTRRRARDLGHTTALFRAQTLQ

SEQ ID NO: 207862 - protein, 19 aa, Mycobacterium bovis
VILQCARALAEYGVEPRHL

SEQ ID NO: 207863 - protein, 24 aa, Mycobacterium bovis
VILQEIFRRFTITAAGPSKGETPL

SEQ ID NO: 207864 - protein, 18 aa, Mycobacterium bovis
VILRQAACARGVPVLMAT

SEQ ID NO: 207865 - protein, 19 aa, Mycobacterium bovis
VINAPTLALLNRPLIGNGA

SEQ ID NO: 207866 - protein, 18 aa, Mycobacterium bovis
VIPKRIRERLGLRGNDQV

SEQ ID NO: 207867 - protein, 24 aa, Mycobacterium bovis
VIPLLDIPPAPGFGNSTTGPSSGF

SEQ ID NO: 207868 - protein, 21 aa, Mycobacterium bovis
VISGLQMLLHQAFAQVEQFTG

SEQ ID NO: 207869 - protein, 27 aa, Mycobacterium bovis
VISYRGGVREACLWSAGLAGSGIRRRA

SEQ ID NO: 207870 - protein, 18 aa, Mycobacterium bovis
VIVESAVLLGQSNAHTLV

SEQ ID NO: 207871 - protein, 20 aa, Mycobacterium bovis
VIVRQMLRRVTIIDSGSTEF

SEQ ID NO: 207872 - protein, 19 aa, Mycobacterium bovis
VIYRAGLARTRRMARQLVS

SEQ ID NO: 207873 - protein, 19 aa, Mycobacterium bovis
VKAARRARQEWLAERLATL

SEQ ID NO: 207874 - protein, 20 aa, Mycobacterium bovis
VKAAVDVFKEKLIRRDISLK

SEQ ID NO: 207875 - protein, 20 aa, Mycobacterium bovis
VKAGAILVNVNFRYVEGELR

SEQ ID NO: 207876 - protein, 22 aa, Mycobacterium bovis
VKALLDVAGVMVTRFVRFEVGQ

SEQ ID NO: 207877 - protein, 24 aa, Mycobacterium bovis
VKDKPAWLDRAWRRIIEEAAAGRQ

SEQ ID NO: 207878 - protein, 21 aa, Mycobacterium bovis
VKDQGLWAAHLRPELGGQGFG

SEQ ID NO: 207879 - protein, 25 aa, Mycobacterium bovis
VKEAVLPFHRFRRADGAAIDSLLGP

SEQ ID NO: 207880 - protein, 24 aa, Mycobacterium bovis
VKEKNDWTYPKWAKQVTRVLIAIE

SEQ ID NO: 207881 - protein, 22 aa, Mycobacterium bovis
VKEVKAAMAALDIDPAFAERSV

SEQ ID NO: 207882 - protein, 18 aa, Mycobacterium bovis
VKEYARKHPHSMGEWSMA

SEQ ID NO: 207883 - protein, 23 aa, Mycobacterium bovis
VKFDGGTLPPMFVDLINAPTRRQ

SEQ ID NO: 207884 - protein, 39 aa, Mycobacterium bovis
VKFKDAELLGMPWIVVVGRGWADGVVELRDRFSGQTREL

SEQ ID NO: 207885 - protein, 21 aa, Mycobacterium bovis
VKGFFEKTFAPLGLKKIQAEV

SEQ ID NO: 207886 - protein, 23 aa, Mycobacterium bovis
VKGGRRFSFTALVIVGDGNGMVG

SEQ ID NO: 207887 - protein, 18 aa, Mycobacterium bovis
VKGVSFLADEIGRFIRAA

SEQ ID NO: 207888 - protein, 17 aa, Mycobacterium bovis
VKHPSAWRGWLTTMRSR

SEQ ID NO: 207889 - protein, 19 aa, Mycobacterium bovis
VKLIQPVAMDEGLRFAIRE

SEQ ID NO: 207890 - protein, 17 aa, Mycobacterium bovis
VKLPNRWPLTDAAGVPV

SEQ ID NO: 207891 - protein, 20 aa, Mycobacterium bovis
VKLRFFGRVRRCGMVSPTVF

SEQ ID NO: 207892 - protein, 18 aa, Mycobacterium bovis
VKPARGGSSIGVSRVSSW

SEQ ID NO: 207893 - protein, 18 aa, Mycobacterium bovis
VKPFRPFQLNSRLLALAD

SEQ ID NO: 207894 - protein, 24 aa, Mycobacterium bovis
VKPRRFTAKLSYRGRAFATVPIEV

SEQ ID NO: 207895 - protein, 18 aa, Mycobacterium bovis
VKSFYRRPLQVSDVTSGV

SEQ ID NO: 207896 - protein, 22 aa, Mycobacterium bovis
VKSRLHYAVRALRLTLQELGVT

SEQ ID NO: 207897 - protein, 17 aa, Mycobacterium bovis
VKVAKNWQRDPKQLGRL

SEQ ID NO: 207898 - protein, 19 aa, Mycobacterium bovis
VKVDDWLPLETAVLVGCGV

SEQ ID NO: 207899 - protein, 28 aa, Mycobacterium bovis
VKVGGARRCAAQSWSLDRIKSVKQAAGV

SEQ ID NO: 207900 - protein, 18 aa, Mycobacterium bovis
VKVLPWIPTPAKRILSAG

SEQ ID NO: 207901 - protein, 18 aa, Mycobacterium bovis
VKVPAGWSHTAAATTSVV

SEQ ID NO: 207902 - protein, 19 aa, Mycobacterium bovis
VKVVRLGGVGRGFSSGVSM

SEQ ID NO: 207903 - protein, 22 aa, Mycobacterium bovis
VKYGGLQWTWSQYLAESAARAA

SEQ ID NO: 207904 - protein, 18 aa, Mycobacterium bovis
VKYKLAILDEYDRADRTE

SEQ ID NO: 207905 - protein, 65 aa, Mycobacterium bovis
VLAAGADEVSARIAALFGMYGLEYQAISAQVAAYHQQFVQTLRTGAASYMLAEATNVEQNLLNLI

SEQ ID NO: 207906 - protein, 24 aa, Mycobacterium bovis
VLAATGRPLIGNGANGAPGTGANG

SEQ ID NO: 207907 - protein, 25 aa, Mycobacterium bovis
VLAAYPGHIARMFGLVYGGESRDHA

SEQ ID NO: 207908 - protein, 25 aa, Mycobacterium bovis
VLAHPCPMCYGSLYYCSPDEVVFLT

SEQ ID NO: 207909 - protein, 25 aa, Mycobacterium bovis
VLAISINGPRAWDLDLAIDFTFTEP

SEQ ID NO: 207910 - protein, 17 aa, Mycobacterium bovis
VLAPLGLVFDENSPWLN

SEQ ID NO: 207911 - protein, 23 aa, Mycobacterium bovis
VLASTGWHLMMALIARARVAIAQ

SEQ ID NO: 207912 - protein, 18 aa, Mycobacterium bovis
VLAWLHPPGIDFGPALLA

SEQ ID NO: 207913 - protein, 20 aa, Mycobacterium bovis
VLCAFGTALHPRFGPDSSAR

SEQ ID NO: 207914 - protein, 19 aa, Mycobacterium bovis
VLDELCLTIAPYVVGGLAR

SEQ ID NO: 207915 - protein, 18 aa, Mycobacterium bovis
VLDSVNWLVEHEGAHVTW

SEQ ID NO: 207916 - protein, 23 aa, Mycobacterium bovis
VLDVTHITRWAGCIGNRSTVIAV

SEQ ID NO: 207917 - protein, 20 aa, Mycobacterium bovis
VLDWITGSALVPVRERLSDE

SEQ ID NO: 207918 - protein, 25 aa, Mycobacterium bovis
VLEAFRPGTMEKLGLGPDDLRSRNP

SEQ ID NO: 207919 - protein, 18 aa, Mycobacterium bovis
VLEAMGIPHTEVDLILVN

SEQ ID NO: 207920 - protein, 30 aa, Mycobacterium bovis
VLEHVTRLRADLCPEWPQPAQPGGSYRIEI

SEQ ID NO: 207921 - protein, 21 aa, Mycobacterium bovis
VLELAWTTGLIRWEDDPQPGW

SEQ ID NO: 207922 - protein, 26 aa, Mycobacterium bovis
VLEPRLRVPDEFGLSRYLAAGLAALQ

SEQ ID NO: 207923 - protein, 24 aa, Mycobacterium bovis
VLETGNPVTMPWRDSVNAIMQAWY

SEQ ID NO: 207924 - protein, 19 aa, Mycobacterium bovis
VLFCGVVGPGPAHIRTVRL

SEQ ID NO: 207925 - protein, 26 aa, Mycobacterium bovis
VLGAGIPLFGICFGNQILGRALGLST

SEQ ID NO: 207926 - protein, 20 aa, Mycobacterium bovis
VLGCGPGRADGVCAGIAFRN

SEQ ID NO: 207927 - protein, 24 aa, Mycobacterium bovis
VLGLPRGGVPVAFEVAKSLQAPLD

SEQ ID NO: 207928 - protein, 25 aa, Mycobacterium bovis
VLGPSGVWELFWPDFPCDGLYKFRV

SEQ ID NO: 207929 - protein, 17 aa, Mycobacterium bovis
VLHEVRIMLDQYWPSVP

SEQ ID NO: 207930 - protein, 24 aa, Mycobacterium bovis
VLHLLYSRFWHKVLYDLGHVSSRE

SEQ ID NO: 207931 - protein, 19 aa, Mycobacterium bovis
VLIAGSWFPRYARNLGTPE

SEQ ID NO: 207932 - protein, 19 aa, Mycobacterium bovis
VLIALGWPNHVHHAAAQRW

SEQ ID NO: 207933 - protein, 17 aa, Mycobacterium bovis
VLIALVVAEHVHHDAAA

SEQ ID NO: 207934 - protein, 25 aa, Mycobacterium bovis
VLIETARLWLSLGHHDRHGVWHLDG

SEQ ID NO: 207935 - protein, 18 aa, Mycobacterium bovis
VLKLHAWLDRSADHDYKD

SEQ ID NO: 207936 - protein, 24 aa, Mycobacterium bovis
VLLARAPRSAGHWLAVAEAVVRGP

SEQ ID NO: 207937 - protein, 17 aa, Mycobacterium bovis
VLLAWQMNSEPLPRAHG

SEQ ID NO: 207938 - protein, 28 aa, Mycobacterium bovis
VLLDRERCILCARCTRFSDQIAGDPFID

SEQ ID NO: 207939 - protein, 27 aa, Mycobacterium bovis
VLLKVRLRQGLPLARLGAAERERAEAV

SEQ ID NO: 207940 - protein, 17 aa, Mycobacterium bovis
VLLPGLPYLGLEHRAAW

SEQ ID NO: 207941 - protein, 24 aa, Mycobacterium bovis
VLLSDPWACSRFAEHDVVVPLVVI

SEQ ID NO: 207942 - protein, 24 aa, Mycobacterium bovis
VLNARFALNAANARWGSLYDALYG

SEQ ID NO: 207943 - protein, 18 aa, Mycobacterium bovis
VLNMPRHPIRLARFGPRA

SEQ ID NO: 207944 - protein, 18 aa, Mycobacterium bovis
VLPDPVGLLRCAGGADLA

SEQ ID NO: 207945 - protein, 28 aa, Mycobacterium bovis
VLPRSDWATKICELRKPVRLEVVTAVQG

SEQ ID NO: 207946 - protein, 19 aa, Mycobacterium bovis
VLRHLAAKRIRVMEQFTVQ

SEQ ID NO: 207947 - protein, 23 aa, Mycobacterium bovis
VLRHVTVMLGGDVVRMSAGVRFC

SEQ ID NO: 207948 - protein, 17 aa, Mycobacterium bovis
VLRLVGRRRLWGRGLGA

SEQ ID NO: 207949 - protein, 17 aa, Mycobacterium bovis
VLRRLEGHFTLVFANAD

SEQ ID NO: 207950 - protein, 18 aa, Mycobacterium bovis
VLRRRRGAWVGWPGVNDD

SEQ ID NO: 207951 - protein, 18 aa, Mycobacterium bovis
VLRSMGIPCRYVSGYLHP

SEQ ID NO: 207952 - protein, 25 aa, Mycobacterium bovis
VLSEFPADRGWDLAGLYNPDPDAAG

SEQ ID NO: 207953 - protein, 20 aa, Mycobacterium bovis
VLSGSACSALVFATLAAGDV

SEQ ID NO: 207954 - protein, 17 aa, Mycobacterium bovis
VLTAMSAFFFGLVDAPN

SEQ ID NO: 207955 - protein, 17 aa, Mycobacterium bovis
VLTLYGIPHRDCGSYAS

SEQ ID NO: 207956 - protein, 20 aa, Mycobacterium bovis
VLTPLAVDPAHPFPFVSGLS

SEQ ID NO: 207957 - protein, 30 aa, Mycobacterium bovis
VLTRNPRWWGARPRLDSITYLVLDDAARLP

SEQ ID NO: 207958 - protein, 23 aa, Mycobacterium bovis
VLTRPDAASGRRGKPQPSPVARE

SEQ ID NO: 207959 - protein, 27 aa, Mycobacterium bovis
VLVLHDWGSALGFDWANQHRDRVQGIA

SEQ ID NO: 207960 - protein, 24 aa, Mycobacterium bovis
VMARLRSPLLAVVKDGSLLGVVTA

SEQ ID NO: 207961 - protein, 20 aa, Mycobacterium bovis
VMASQMLWDPIRFDETCPSS

SEQ ID NO: 207962 - protein, 18 aa, Mycobacterium bovis
VMFDRIMDLPAEIRNRYD

SEQ ID NO: 207963 - protein, 24 aa, Mycobacterium bovis
VMGLAELLAALGIPYDSEEAVRLA

SEQ ID NO: 207964 - protein, 18 aa, Mycobacterium bovis
VMLGAALLARNAVEKGLT

SEQ ID NO: 207965 - protein, 18 aa, Mycobacterium bovis
VMMVHTLLWPDEIRDPDF

SEQ ID NO: 207966 - protein, 18 aa, Mycobacterium bovis
VMNKDRLEMLGAQNDPRS

SEQ ID NO: 207967 - protein, 26 aa, Mycobacterium bovis
VMRDYRLRVSDALSKLTPWKAPPPIA

SEQ ID NO: 207968 - protein, 19 aa, Mycobacterium bovis
VMRQLPITLLHIVAPVVVG

SEQ ID NO: 207969 - protein, 17 aa, Mycobacterium bovis
VMSDWGGTPSWECALAG

SEQ ID NO: 207970 - protein, 24 aa, Mycobacterium bovis
VMSQLRTALRMQISTGYTVVEALE

SEQ ID NO: 207971 - protein, 19 aa, Mycobacterium bovis
VMSRDCWDAVGGMDLSTFG

SEQ ID NO: 207972 - protein, 19 aa, Mycobacterium bovis
VMTGFRVSRSGWYGIDPVP

SEQ ID NO: 207973 - protein, 18 aa, Mycobacterium bovis
VMYFKDFNSGAMIQNVVD

SEQ ID NO: 207974 - protein, 28 aa, Mycobacterium bovis
VNAETGTVWWPECSKEAYADGIAGAVDA

SEQ ID NO: 207975 - protein, 27 aa, Mycobacterium bovis
VNALNCGRPPRFCRRVGVRPPAPAALP

SEQ ID NO: 207976 - protein, 21 aa, Mycobacterium bovis
VNANGIYVCRAIVSHRMPEGV

SEQ ID NO: 207977 - protein, 29 aa, Mycobacterium bovis
VNAPAQALLGRPLIGNGANGADGTGAPGG

SEQ ID NO: 207978 - protein, 28 aa, Mycobacterium bovis
VNAPAQALLGRPLIGNGANGAPGTGQAG

SEQ ID NO: 207979 - protein, 29 aa, Mycobacterium bovis
VNAPTQALFGRPLIGNGADGSPGTGQAGG

SEQ ID NO: 207980 - protein, 21 aa, Mycobacterium bovis
VNARYLRICVLTQYKSHSLDR

SEQ ID NO: 207981 - protein, 24 aa, Mycobacterium bovis
VNASYRMEQGFTFELNLAGVADEH

SEQ ID NO: 207982 - protein, 24 aa, Mycobacterium bovis
VNDYYDRSGLWPYLEKLGFYLVGY

SEQ ID NO: 207983 - protein, 28 aa, Mycobacterium bovis
VNGPTQLLLGRPLIGDGANGGPGQNGGD

SEQ ID NO: 207984 - protein, 19 aa, Mycobacterium bovis
VNGSWNWSSGCDHASWTFV

SEQ ID NO: 207985 - protein, 17 aa, Mycobacterium bovis
VNGTAMRESFAERGVTL

SEQ ID NO: 207986 - protein, 26 aa, Mycobacterium bovis
VNGYRGCSHACRYCFARPTHEYLDFN

SEQ ID NO: 207987 - protein, 26 aa, Mycobacterium bovis
VNHLGHFALVTGILDWLARPARIVVV

SEQ ID NO: 207988 - protein, 18 aa, Mycobacterium bovis
VNMPVNFRPTAWSTEVIS

SEQ ID NO: 207989 - protein, 23 aa, Mycobacterium bovis
VNPSGRLPITFPVDLGQTPRSQP

SEQ ID NO: 207990 - protein, 25 aa, Mycobacterium bovis
VNPTGKFVLGGPMGDAGLTGRKIIV

SEQ ID NO: 207991 - protein, 17 aa, Mycobacterium bovis
VNQPWTIRQYAGFSTAA

SEQ ID NO: 207992 - protein, 21 aa, Mycobacterium bovis
VNRARRIERFLSQNMMAAEQF

SEQ ID NO: 207993 - protein, 23 aa, Mycobacterium bovis
VNRDIPLRLVYVIDPSQLSAAGE

SEQ ID NO: 207994 - protein, 20 aa, Mycobacterium bovis
VNRHRRLAVQVLKLPRLKAV

SEQ ID NO: 207995 - protein, 20 aa, Mycobacterium bovis
VNSARIFAGAGLGPMLAAAS

SEQ ID NO: 207996 - protein, 17 aa, Mycobacterium bovis
VNSARMYTGPGAGSLLA

SEQ ID NO: 207997 - protein, 21 aa, Mycobacterium bovis
VNSPGWRRAMAARKRIDDLID

SEQ ID NO: 207998 - protein, 17 aa, Mycobacterium bovis
VNSVSMRGVVVIGEGEK

SEQ ID NO: 207999 - protein, 17 aa, Mycobacterium bovis
VNTGAFIAGNYSNGVLW

SEQ ID NO: 208000 - protein, 17 aa, Mycobacterium bovis
VNTGAFIGGNFSNGAFW

SEQ ID NO: 208001 - protein, 35 aa, Mycobacterium bovis
VNVEDWKCWARWRLIRARAPWLTRALVAEDFEFYG

SEQ ID NO: 208002 - protein, 19 aa, Mycobacterium bovis
VNVKPKFAVDAMVATIGQE

SEQ ID NO: 208003 - protein, 23 aa, Mycobacterium bovis
VNVLCTPGVWARHRKLAHTAPAL

SEQ ID NO: 208004 - protein, 17 aa, Mycobacterium bovis
VNVMLARDTIRRRLAGE

SEQ ID NO: 208005 - protein, 23 aa, Mycobacterium bovis
VNWDVREGVFAPGVIDAMFTHQV

SEQ ID NO: 208006 - protein, 17 aa, Mycobacterium bovis
VPADHRLAFSRARSKAL

SEQ ID NO: 208007 - protein, 24 aa, Mycobacterium bovis
VPAELRPALERAFASGLPAVVNVL

SEQ ID NO: 208008 - protein, 17 aa, Mycobacterium bovis
VPAESKVAIGQSVELAF

SEQ ID NO: 208009 - protein, 17 aa, Mycobacterium bovis
VPAHILIAIDEAYVEYI

SEQ ID NO: 208010 - protein, 20 aa, Mycobacterium bovis
VPAHVAANFEGLVVRVDDTD

SEQ ID NO: 208011 - protein, 20 aa, Mycobacterium bovis
VPAITKWRKGAGVTGENRLK

SEQ ID NO: 208012 - protein, 26 aa, Mycobacterium bovis
VPALPRLGPTDALPRCRQTVHRGAVI

SEQ ID NO: 208013 - protein, 21 aa, Mycobacterium bovis
VPARLHPGSFYALPQSPQLFK

SEQ ID NO: 208014 - protein, 23 aa, Mycobacterium bovis
VPARPRRVRKPGEPLRIGVGGPV

SEQ ID NO: 208015 - protein, 18 aa, Mycobacterium bovis
VPAYMPFFDVLHVTGRQR

SEQ ID NO: 208016 - protein, 19 aa, Mycobacterium bovis
VPDFFRIPYDPHLATGLAV

SEQ ID NO: 208017 - protein, 22 aa, Mycobacterium bovis
VPDILECLASVMADAGSNREAV

SEQ ID NO: 208018 - protein, 17 aa, Mycobacterium bovis
VPDPRYGQQVAAVVQAR

SEQ ID NO: 208019 - protein, 23 aa, Mycobacterium bovis
VPDYLMQVLARFARYLRESRSID

SEQ ID NO: 208020 - protein, 25 aa, Mycobacterium bovis
VPEGDFVRWKKLRGGIGALTTHLSQ

SEQ ID NO: 208021 - protein, 24 aa, Mycobacterium bovis
VPESKRFCWNCGRPVGRSDSETKG

SEQ ID NO: 208022 - protein, 23 aa, Mycobacterium bovis
VPEVLEVRGEVFFRLDDFQALNA

SEQ ID NO: 208023 - protein, 25 aa, Mycobacterium bovis
VPFGTRWYGYFLRRLAERPANLAFF

SEQ ID NO: 208024 - protein, 28 aa, Mycobacterium bovis
VPFPKECPAPGVMQGCLESTSGLIMGID

SEQ ID NO: 208025 - protein, 17 aa, Mycobacterium bovis
VPFRLSIDDGIEAVRQR

SEQ ID NO: 208026 - protein, 18 aa, Mycobacterium bovis
VPGASYWYAHTDQWRYDG

SEQ ID NO: 208027 - protein, 17 aa, Mycobacterium bovis
VPGEAWARHGVEHPMGA

SEQ ID NO: 208028 - protein, 20 aa, Mycobacterium bovis
VPGELHAMMLDMRRTFDEMV

SEQ ID NO: 208029 - protein, 21 aa, Mycobacterium bovis
VPGGFRAGFHATLPMIDMPQY

SEQ ID NO: 208030 - protein, 19 aa, Mycobacterium bovis
VPGGHVFRPDMFRLDLDGI

SEQ ID NO: 208031 - protein, 19 aa, Mycobacterium bovis
VPGGTAFPHCSGVLVAGDE

SEQ ID NO: 208032 - protein, 22 aa, Mycobacterium bovis
VPGIYQVRGFDISNISFVEGDT

SEQ ID NO: 208033 - protein, 17 aa, Mycobacterium bovis
VPGYRLVDSTGQVVRTL

SEQ ID NO: 208034 - protein, 26 aa, Mycobacterium bovis
VPHRPVAEYFVWFKGEYDVDDTDRLL

SEQ ID NO: 208035 - protein, 17 aa, Mycobacterium bovis
VPHVSFVHGSRGVEYLR

SEQ ID NO: 208036 - protein, 18 aa, Mycobacterium bovis
VPIAGFGGAPGFGNSTTL

SEQ ID NO: 208037 - protein, 25 aa, Mycobacterium bovis
VPIKLRESPGLMILGRQGCGKTTAL

SEQ ID NO: 208038 - protein, 18 aa, Mycobacterium bovis
VPIPGFPTTVTVFGTPFM

SEQ ID NO: 208039 - protein, 24 aa, Mycobacterium bovis
VPIPRAGGLGAPRIRDVELVQMVA

SEQ ID NO: 208040 - protein, 17 aa, Mycobacterium bovis
VPIVPVVVWGAQRIWTK

SEQ ID NO: 208041 - protein, 29 aa, Mycobacterium bovis
VPIYPGYVCAIVASLLLDKPVKWMEDRSE

SEQ ID NO: 208042 - protein, 23 aa, Mycobacterium bovis
VPLTYPFALTFPSVMSLVTGFDF

SEQ ID NO: 208043 - protein, 27 aa, Mycobacterium bovis
VPLWTTRAKRWLRRRTGAEHPAVAWAT

SEQ ID NO: 208044 - protein, 19 aa, Mycobacterium bovis
VPMLLRAGLGVAMGNAHPD

SEQ ID NO: 208045 - protein, 17 aa, Mycobacterium bovis
VPNDQFLLYAFDGEPTD

SEQ ID NO: 208046 - protein, 20 aa, Mycobacterium bovis
VPNLFWCVGYTNASWTLRAD

SEQ ID NO: 208047 - protein, 18 aa, Mycobacterium bovis
VPNSGGRQGYFGPCPPAG

SEQ ID NO: 208048 - protein, 23 aa, Mycobacterium bovis
VPPGDGPWRLGLGSAGTFENLRL

SEQ ID NO: 208049 - protein, 19 aa, Mycobacterium bovis
VPPMPAPVEPQGPAVWEEI

SEQ ID NO: 208050 - protein, 18 aa, Mycobacterium bovis
VPPSWAWPKPAVAPPVLF

SEQ ID NO: 208051 - protein, 18 aa, Mycobacterium bovis
VPQGWSFAQAAAVPVVFL

SEQ ID NO: 208052 - protein, 17 aa, Mycobacterium bovis
VPRLGVLTVTIIQQTPD

SEQ ID NO: 208053 - protein, 23 aa, Mycobacterium bovis
VPRPELFTLSAQRLLTMARAVVD

SEQ ID NO: 208054 - protein, 17 aa, Mycobacterium bovis
VPRSLWFVDEVKRSPAG

SEQ ID NO: 208055 - protein, 21 aa, Mycobacterium bovis
VPSCAEGGVLGAICATIASIQ

SEQ ID NO: 208056 - protein, 21 aa, Mycobacterium bovis
VPSERTGSVARCYSLCSSPYT

SEQ ID NO: 208057 - protein, 17 aa, Mycobacterium bovis
VPSLLGLFLSLPGVSQW

SEQ ID NO: 208058 - protein, 26 aa, Mycobacterium bovis
VPSLPFRLIHIADTYTPIAPADLPGR

SEQ ID NO: 208059 - protein, 17 aa, Mycobacterium bovis
VPSLRLVGYGGSRAIAA

SEQ ID NO: 208060 - protein, 20 aa, Mycobacterium bovis
VPSPFGLFPDVDWAEVAADL

SEQ ID NO: 208061 - protein, 18 aa, Mycobacterium bovis
VPSRRLNPVRAISAERAA

SEQ ID NO: 208062 - protein, 29 aa, Mycobacterium bovis
VPSYKSCFLAMVRRFYELGVKELNGHLLY

SEQ ID NO: 208063 - protein, 19 aa, Mycobacterium bovis
VPTAFPVEFLSLGASGVGV

SEQ ID NO: 208064 - protein, 20 aa, Mycobacterium bovis
VPTPASLFAPINPIAVASAL

SEQ ID NO: 208065 - protein, 22 aa, Mycobacterium bovis
VPTSWRAARATLRLPADTAARV

SEQ ID NO: 208066 - protein, 18 aa, Mycobacterium bovis
VPVGSAPTPSGWEVTTHG

SEQ ID NO: 208067 - protein, 17 aa, Mycobacterium bovis
VPVLPGRGPQLRLYDSA

SEQ ID NO: 208068 - protein, 25 aa, Mycobacterium bovis
VPVNPSGGLACFGEAIPAQAIAQVC

SEQ ID NO: 208069 - protein, 20 aa, Mycobacterium bovis
VPVQLVRIGRLYLIGIPGEP

SEQ ID NO: 208070 - protein, 17 aa, Mycobacterium bovis
VPVSAAVWREGHEAVAA

SEQ ID NO: 208071 - protein, 20 aa, Mycobacterium bovis
VPVSGLLALTARTLRQTEFI

SEQ ID NO: 208072 - protein, 25 aa, Mycobacterium bovis
VPWEPICAPDLLLAQALLRTQQIKL

SEQ ID NO: 208073 - protein, 20 aa, Mycobacterium bovis
VPYDRVVELSSTLTMPRPNF

SEQ ID NO: 208074 - protein, 17 aa, Mycobacterium bovis
VQAAWAVLVAYFNRLRC

SEQ ID NO: 208075 - protein, 29 aa, Mycobacterium bovis
VQAIKEAGWWRLGLAEEIGGMPAPPPLAW

SEQ ID NO: 208076 - protein, 25 aa, Mycobacterium bovis
VQANRVRTWLLAVSNVFGQNAPAIA

SEQ ID NO: 208077 - protein, 23 aa, Mycobacterium bovis
VQDAANLPPDWASVPYGVPFPNN

SEQ ID NO: 208078 - protein, 19 aa, Mycobacterium bovis
VQDIGWDEQWQCDRCSVVH

SEQ ID NO: 208079 - protein, 19 aa, Mycobacterium bovis
VQDLGIEVFLVMPFTTDFM

SEQ ID NO: 208080 - protein, 19 aa, Mycobacterium bovis
VQEDWNFEFGWQATEAIVD

SEQ ID NO: 208081 - protein, 18 aa, Mycobacterium bovis
VQELFEARVPRGKAPIAD

SEQ ID NO: 208082 - protein, 23 aa, Mycobacterium bovis
VQFCRERLAAFEIPASFQEASGL

SEQ ID NO: 208083 - protein, 20 aa, Mycobacterium bovis
VQFSCKGANVAPPLTWSSPA

SEQ ID NO: 208084 - protein, 21 aa, Mycobacterium bovis
VQGEAAAGVVLLRPASPGTGV

SEQ ID NO: 208085 - protein, 18 aa, Mycobacterium bovis
VQGGRPEALGGLGGAASS

SEQ ID NO: 208086 - protein, 19 aa, Mycobacterium bovis
VQGSGWAALGWDTLGNKLL

SEQ ID NO: 208087 - protein, 17 aa, Mycobacterium bovis
VQHLSLVVPNVVAGIAA

SEQ ID NO: 208088 - protein, 22 aa, Mycobacterium bovis
VQIMRYRGYRDLTLALTGRPPG

SEQ ID NO: 208089 - protein, 27 aa, Mycobacterium bovis
VQLAVYRLAWAALRGCPTSSVRTAFYY

SEQ ID NO: 208090 - protein, 24 aa, Mycobacterium bovis
VQLKGSNLEFALGYSHPVVIEAPE

SEQ ID NO: 208091 - protein, 26 aa, Mycobacterium bovis
VQLTRKRLGTGLIEAFSTSCPNCSGR

SEQ ID NO: 208092 - protein, 21 aa, Mycobacterium bovis
VQPNLKVIVNLGYGDPAYGYS

SEQ ID NO: 208093 - protein, 22 aa, Mycobacterium bovis
VQRRWRCFSQIGVPGDDWPAYT

SEQ ID NO: 208094 - protein, 25 aa, Mycobacterium bovis
VQSGKYRRVLALAWEKQSESNAMWA

SEQ ID NO: 208095 - protein, 17 aa, Mycobacterium bovis
VQSLIRWDPVGHAEAEL

SEQ ID NO: 208096 - protein, 26 aa, Mycobacterium bovis
VQTGFARTGAMFACEHEGPDGLEPDL

SEQ ID NO: 208097 - protein, 24 aa, Mycobacterium bovis
VQTPQPYWYWALDRESIGGSVSAA

SEQ ID NO: 208098 - protein, 20 aa, Mycobacterium bovis
VQVIRCFLHQLPHHVDLPTR

SEQ ID NO: 208099 - protein, 18 aa, Mycobacterium bovis
VQVLRRLYDRVGDRLALI

SEQ ID NO: 208100 - protein, 17 aa, Mycobacterium bovis
VQVPVLLVGGWQDIFLR

SEQ ID NO: 208101 - protein, 20 aa, Mycobacterium bovis
VRAALPRPRGISVLSGTRRG

SEQ ID NO: 208102 - protein, 19 aa, Mycobacterium bovis
VRACLPRLGELAIGGTAVG

SEQ ID NO: 208103 - protein, 20 aa, Mycobacterium bovis
VRADGGWLLTGQKVWTSAAH

SEQ ID NO: 208104 - protein, 18 aa, Mycobacterium bovis
VRAIWNLPPRPRTRPPSD

SEQ ID NO: 208105 - protein, 20 aa, Mycobacterium bovis
VRALEVMLSLGAQVRDISAL

SEQ ID NO: 208106 - protein, 19 aa, Mycobacterium bovis
VRAQLGITINWRFFSLEEI

SEQ ID NO: 208107 - protein, 20 aa, Mycobacterium bovis
VRARLRQSWLERGATDAELG

SEQ ID NO: 208108 - protein, 19 aa, Mycobacterium bovis
VRARPCQKVVAVLRRSKSH

SEQ ID NO: 208109 - protein, 21 aa, Mycobacterium bovis
VRARWERRLAEVGVDRLHAEL

SEQ ID NO: 208110 - protein, 17 aa, Mycobacterium bovis
VRASVIDRGQWKDHRDG

SEQ ID NO: 208111 - protein, 31 aa, Mycobacterium bovis
VRAVVGLSLPGTVAWHAVPRWFARNKDRRQH

SEQ ID NO: 208112 - protein, 21 aa, Mycobacterium bovis
VRAWARLWERCAIDLTGNTEE

SEQ ID NO: 208113 - protein, 19 aa, Mycobacterium bovis
VRAYGDFLSYCLVAEGAVD

SEQ ID NO: 208114 - protein, 17 aa, Mycobacterium bovis
VRDCCAPGSRFAQATRA

SEQ ID NO: 208115 - protein, 23 aa, Mycobacterium bovis
VRDELPHSLAVVIDEVSPREGRD

SEQ ID NO: 208116 - protein, 18 aa, Mycobacterium bovis
VRDGDILVGKVTPKGETE

SEQ ID NO: 208117 - protein, 17 aa, Mycobacterium bovis
VRDIRFEQMLLLDDETP

SEQ ID NO: 208118 - protein, 18 aa, Mycobacterium bovis
VRDMRFEAMLLLDDQTPV

SEQ ID NO: 208119 - protein, 19 aa, Mycobacterium bovis
VREFACQRWQWHDLEVSRT

SEQ ID NO: 208120 - protein, 24 aa, Mycobacterium bovis
VREGGVGVHSIFGGAFTVEAQANG

SEQ ID NO: 208121 - protein, 26 aa, Mycobacterium bovis
VRELMPRTPFIGGLGIVFERYEPDDV

SEQ ID NO: 208122 - protein, 23 aa, Mycobacterium bovis
VREPSGAVVDLNFSMVTRPIERL

SEQ ID NO: 208123 - protein, 22 aa, Mycobacterium bovis
VRESLRRSLSFNGYSVELAHDG

SEQ ID NO: 208124 - protein, 19 aa, Mycobacterium bovis
VRFGDCLEGDLVRRDFTTN

SEQ ID NO: 208125 - protein, 17 aa, Mycobacterium bovis
VRGARYVGADGVFEVPA

SEQ ID NO: 208126 - protein, 19 aa, Mycobacterium bovis
VRGEGAAVVVLKRLDDAVR

SEQ ID NO: 208127 - protein, 24 aa, Mycobacterium bovis
VRGGALAPGTVRQWLAEHAGDGRR

SEQ ID NO: 208128 - protein, 17 aa, Mycobacterium bovis
VRGLRMGTGTSERDERD

SEQ ID NO: 208129 - protein, 19 aa, Mycobacterium bovis
VRGPWIAGSYYGGRDESKF

SEQ ID NO: 208130 - protein, 17 aa, Mycobacterium bovis
VRGWAVTNPARWALLYG

SEQ ID NO: 208131 - protein, 18 aa, Mycobacterium bovis
VRHGLADMYGFIPVDREP

SEQ ID NO: 208132 - protein, 18 aa, Mycobacterium bovis
VRHNMPFGEVGKGEYGTY

SEQ ID NO: 208133 - protein, 24 aa, Mycobacterium bovis
VRHYIIDCALRWMRDFHADGLRLD

SEQ ID NO: 208134 - protein, 20 aa, Mycobacterium bovis
VRIGGRWRSGTAYLLPDDDP

SEQ ID NO: 208135 - protein, 21 aa, Mycobacterium bovis
VRIKRGEVVVIYLAAANRDPA

SEQ ID NO: 208136 - protein, 23 aa, Mycobacterium bovis
VRIPDPIAALGNRMQGHSDRLPY

SEQ ID NO: 208137 - protein, 21 aa, Mycobacterium bovis
VRKEKYLAAKALGYELASYVS

SEQ ID NO: 208138 - protein, 25 aa, Mycobacterium bovis
VRKGTMKSQPWILAYEDHNVDAGLA

SEQ ID NO: 208139 - protein, 19 aa, Mycobacterium bovis
VRLAREGADIVALDICAPV

SEQ ID NO: 208140 - protein, 20 aa, Mycobacterium bovis
VRLGPEMNRTVVVELDTSGT

SEQ ID NO: 208141 - protein, 21 aa, Mycobacterium bovis
VRLKGGDPFVFARGYEEVLAC

SEQ ID NO: 208142 - protein, 25 aa, Mycobacterium bovis
VRLQDRVLLRFGLHQALRLGKPLQF

SEQ ID NO: 208143 - protein, 18 aa, Mycobacterium bovis
VRMAVLFHVLVGAQDAGK

SEQ ID NO: 208144 - protein, 33 aa, Mycobacterium bovis
VRMGMRVEAVWKPRERWGLGIDNIEYFRPTGEP

SEQ ID NO: 208145 - protein, 23 aa, Mycobacterium bovis
VRMLKAGELVGVYPEATISRSFE

SEQ ID NO: 208146 - protein, 18 aa, Mycobacterium bovis
VRMLTSLLMFPGRDEADE

SEQ ID NO: 208147 - protein, 24 aa, Mycobacterium bovis
VRNEWGWAEAHLDMGWQDIKVAAE

SEQ ID NO: 208148 - protein, 20 aa, Mycobacterium bovis
VRNGNRWRVIAVDTEHHRIA

SEQ ID NO: 208149 - protein, 19 aa, Mycobacterium bovis
VRNQVPFFVDYVRRYTDLP

SEQ ID NO: 208150 - protein, 30 aa, Mycobacterium bovis
VRPEARAVARLRIAVVRAIRTALQRRGFLE

SEQ ID NO: 208151 - protein, 26 aa, Mycobacterium bovis
VRPETAADEIVRWATPVTAFQRTALR

SEQ ID NO: 208152 - protein, 17 aa, Mycobacterium bovis
VRPPRGLTATGLAALLR

SEQ ID NO: 208153 - protein, 23 aa, Mycobacterium bovis
VRPWADAVWDTGIEFGTVGVGKS

SEQ ID NO: 208154 - protein, 17 aa, Mycobacterium bovis
VRPWPRSLANIFDEYTA

SEQ ID NO: 208155 - protein, 18 aa, Mycobacterium bovis
VRQFLNLDVPLFVESAFH

SEQ ID NO: 208156 - protein, 28 aa, Mycobacterium bovis
VRQLRLRDIGGIVVIDFIDMVLESNRDL

SEQ ID NO: 208157 - protein, 18 aa, Mycobacterium bovis
VRQVCARALSLPSLPCEV

SEQ ID NO: 208158 - protein, 24 aa, Mycobacterium bovis
VRRDEFSRWLSAKPDYLVTTEQSV

SEQ ID NO: 208159 - protein, 19 aa, Mycobacterium bovis
VRRHCRDGSDPVVIAVSTR

SEQ ID NO: 208160 - protein, 19 aa, Mycobacterium bovis
VRRQFYWHRFFSHQPDLNY

SEQ ID NO: 208161 - protein, 22 aa, Mycobacterium bovis
VRRRPYTVVLFDEIEKAHPDVF

SEQ ID NO: 208162 - protein, 20 aa, Mycobacterium bovis
VRRRVTWAFHDRRGRKIDPQ

SEQ ID NO: 208163 - protein, 26 aa, Mycobacterium bovis
VRRYIAKYTICPAIAHGMDHLIGSVE

SEQ ID NO: 208164 - protein, 18 aa, Mycobacterium bovis
VRRYSRHLIIPDIGVNGQ

SEQ ID NO: 208165 - protein, 24 aa, Mycobacterium bovis
VRSREVAAEFAARFANLIGARTQD

SEQ ID NO: 208166 - protein, 23 aa, Mycobacterium bovis
VRSYKLRGAYNLLVQLSDEELAA

SEQ ID NO: 208167 - protein, 29 aa, Mycobacterium bovis
VRTCDCFNIPIVMLVDVPGFLPGTDQEYN

SEQ ID NO: 208168 - protein, 17 aa, Mycobacterium bovis
VRTDELLDLWAAAYPGG

SEQ ID NO: 208169 - protein, 21 aa, Mycobacterium bovis
VRTFSGLLDRFGRGKGCDICK

SEQ ID NO: 208170 - protein, 20 aa, Mycobacterium bovis
VRTSRGWSASPVRHGLSTIR

SEQ ID NO: 208171 - protein, 25 aa, Mycobacterium bovis
VRTVEPWGVVTEKGRWYLVGHDRDR

SEQ ID NO: 208172 - protein, 17 aa, Mycobacterium bovis
VRTVGVGDLVMVSSVAG

SEQ ID NO: 208173 - protein, 18 aa, Mycobacterium bovis
VRVAHVLSVNLARVRANP

SEQ ID NO: 208174 - protein, 17 aa, Mycobacterium bovis
VRVCTICTDPWNLDHET

SEQ ID NO: 208175 - protein, 19 aa, Mycobacterium bovis
VRVIPCLDVDDGRVVKGVN

SEQ ID NO: 208176 - protein, 17 aa, Mycobacterium bovis
VRVIVAGTWGFASHAEL

SEQ ID NO: 208177 - protein, 18 aa, Mycobacterium bovis
VRVLKPGGRFVFAGEPTT

SEQ ID NO: 208178 - protein, 24 aa, Mycobacterium bovis
VRVLRPGGYFPYADLRPNNEIAAW

SEQ ID NO: 208179 - protein, 22 aa, Mycobacterium bovis
VRVPAKALWRAQTQRAVENFPI

SEQ ID NO: 208180 - protein, 27 aa, Mycobacterium bovis
VRVTLVIRGSCLLRHCDDTICERFTRI

SEQ ID NO: 208181 - protein, 17 aa, Mycobacterium bovis
VRWIETQDLLFIEEAAG

SEQ ID NO: 208182 - protein, 24 aa, Mycobacterium bovis
VRWNCKAGKCGSCSAEINGKPRLM

SEQ ID NO: 208183 - protein, 17 aa, Mycobacterium bovis
VRYGELISHERILDLRA

SEQ ID NO: 208184 - protein, 21 aa, Mycobacterium bovis
VRYPYARGVLVEMYREAKTRL

SEQ ID NO: 208185 - protein, 19 aa, Mycobacterium bovis
VSAAIAALFSAHGQDYQAL

SEQ ID NO: 208186 - protein, 21 aa, Mycobacterium bovis
VSAALAALFGAHAREYQAAAA

SEQ ID NO: 208187 - protein, 19 aa, Mycobacterium bovis
VSAAVELVHNFTLLHDDVM

SEQ ID NO: 208188 - protein, 27 aa, Mycobacterium bovis
VSADDEPKCSLCQALTAASSQIQSESR

SEQ ID NO: 208189 - protein, 21 aa, Mycobacterium bovis
VSADTGEIFWGEPGTNGQHAF

SEQ ID NO: 208190 - protein, 20 aa, Mycobacterium bovis
VSAGIAALFGARAQAYQAIS

SEQ ID NO: 208191 - protein, 18 aa, Mycobacterium bovis
VSAIDVLLGLGWLAPSHV

SEQ ID NO: 208192 - protein, 19 aa, Mycobacterium bovis
VSAILGGAMGQGFSQMMKG

SEQ ID NO: 208193 - protein, 21 aa, Mycobacterium bovis
VSAKEYRDWFATLPAELTDVV

SEQ ID NO: 208194 - protein, 19 aa, Mycobacterium bovis
VSAKGEFLGGAIAPGVQVS

SEQ ID NO: 208195 - protein, 29 aa, Mycobacterium bovis
VSALKALEGDAKWVASVEELMNAVDESIP

SEQ ID NO: 208196 - protein, 20 aa, Mycobacterium bovis
VSALRVPGRHPAVAAWADSV

SEQ ID NO: 208197 - protein, 17 aa, Mycobacterium bovis
VSARAAAIHDQFVATLA

SEQ ID NO: 208198 - protein, 18 aa, Mycobacterium bovis
VSARSDANIAVMTRDLNR

SEQ ID NO: 208199 - protein, 23 aa, Mycobacterium bovis
VSCGHVARSLWAVIVDPDTGPEA

SEQ ID NO: 208200 - protein, 28 aa, Mycobacterium bovis
VSDDGRWRIVGNIPRGMFVGGRRGSSVT

SEQ ID NO: 208201 - protein, 18 aa, Mycobacterium bovis
VSDLFDFSLYVDARIEDI

SEQ ID NO: 208202 - protein, 24 aa, Mycobacterium bovis
VSDLPRLGKSLVGYVTPAAGGDGP

SEQ ID NO: 208203 - protein, 18 aa, Mycobacterium bovis
VSDVVLFPGTGFVELAIR

SEQ ID NO: 208204 - protein, 23 aa, Mycobacterium bovis
VSEAWALLVSKLRAAKLRVPIND

SEQ ID NO: 208205 - protein, 19 aa, Mycobacterium bovis
VSEICRRLDGMPLAIELAA

SEQ ID NO: 208206 - protein, 24 aa, Mycobacterium bovis
VSEKAATFLVEYARKYRQTIAAAA

SEQ ID NO: 208207 - protein, 25 aa, Mycobacterium bovis
VSGAAGNLARLGSMISAANSAAAAQ

SEQ ID NO: 208208 - protein, 25 aa, Mycobacterium bovis
VSGHAYAGELLFLYNGVRPRNVMPV

SEQ ID NO: 208209 - protein, 22 aa, Mycobacterium bovis
VSGLRLRLPVIATALGTYDTAS

SEQ ID NO: 208210 - protein, 25 aa, Mycobacterium bovis
VSGMGLDWASVFSGYRPKRVELPTY

SEQ ID NO: 208211 - protein, 23 aa, Mycobacterium bovis
VSGVGPRLAMAALAVHDAPALRQ

SEQ ID NO: 208212 - protein, 21 aa, Mycobacterium bovis
VSIGAILAVPGIRAALREATA

SEQ ID NO: 208213 - protein, 25 aa, Mycobacterium bovis
VSILYRLYRPLIFALYCLPLNWLRR

SEQ ID NO: 208214 - protein, 25 aa, Mycobacterium bovis
VSIPLIKIPAAPGFGNSTTSPSSGF

SEQ ID NO: 208215 - protein, 20 aa, Mycobacterium bovis
VSKPRIPLVSNVTGQMAGAG

SEQ ID NO: 208216 - protein, 20 aa, Mycobacterium bovis
VSKTLGVTINDVFLACVAGA

SEQ ID NO: 208217 - protein, 20 aa, Mycobacterium bovis
VSLAELWKSVAVHPDAVIGH

SEQ ID NO: 208218 - protein, 29 aa, Mycobacterium bovis
VSLCRSVDIPARFVLGQALELPQPGAQDC

SEQ ID NO: 208219 - protein, 26 aa, Mycobacterium bovis
VSLPCAPFLHLFVAYGRLTLEGGGEL

SEQ ID NO: 208220 - protein, 20 aa, Mycobacterium bovis
VSMALRYEGWNITTAGDGSS

SEQ ID NO: 208221 - protein, 18 aa, Mycobacterium bovis
VSPMPLAFVEYDLDTGDP

SEQ ID NO: 208222 - protein, 18 aa, Mycobacterium bovis
VSPVLWKKVAPKLSAGRV

SEQ ID NO: 208223 - protein, 19 aa, Mycobacterium bovis
VSRALRLTGRRVMLVPTMG

SEQ ID NO: 208224 - protein, 17 aa, Mycobacterium bovis
VSRLFAEQWTRAAEEAA

SEQ ID NO: 208225 - protein, 18 aa, Mycobacterium bovis
VSRLPAPLRRGQIRPLGL

SEQ ID NO: 208226 - protein, 23 aa, Mycobacterium bovis
VSRLRPYATTVFAEMSALATRIG

SEQ ID NO: 208227 - protein, 35 aa, Mycobacterium bovis
VSSAQFPRPAPRPSYSALSSRQWALAGLTPLRHWR

SEQ ID NO: 208228 - protein, 25 aa, Mycobacterium bovis
VSSYTRSRFASAFGPAASLEYLPPG

SEQ ID NO: 208229 - protein, 21 aa, Mycobacterium bovis
VSTAIASIFGAYGRQCQVLSA

SEQ ID NO: 208230 - protein, 18 aa, Mycobacterium bovis
VSVCNAVEFSVHGSQHVA

SEQ ID NO: 208231 - protein, 23 aa, Mycobacterium bovis
VSVELADGLGLPVLSVASMVARP

SEQ ID NO: 208232 - protein, 25 aa, Mycobacterium bovis
VSVTMPGKFAALRFADERTARADLV

SEQ ID NO: 208233 - protein, 23 aa, Mycobacterium bovis
VTADICSRIVSLPVHDHMAPDDV

SEQ ID NO: 208234 - protein, 21 aa, Mycobacterium bovis
VTAKPKLLGPLGDLFTIMTIP

SEQ ID NO: 208235 - protein, 24 aa, Mycobacterium bovis
VTALCPGPVPTEWAEIASAERFSI

SEQ ID NO: 208236 - protein, 21 aa, Mycobacterium bovis
VTARLWPTLIEPLRTREQARR

SEQ ID NO: 208237 - protein, 18 aa, Mycobacterium bovis
VTATRARLMAPLSGQGGM

SEQ ID NO: 208238 - protein, 18 aa, Mycobacterium bovis
VTAVRSRLMAPLSGQGTM

SEQ ID NO: 208239 - protein, 17 aa, Mycobacterium bovis
VTDAHLLTLARRRGVRL

SEQ ID NO: 208240 - protein, 21 aa, Mycobacterium bovis
VTDLGAAFARLMRTEDARPVV

SEQ ID NO: 208241 - protein, 23 aa, Mycobacterium bovis
VTDMAHFFYIHFGLPTYFKNVFE

SEQ ID NO: 208242 - protein, 22 aa, Mycobacterium bovis
VTDRPSFIALRTVIGYPAPNLM

SEQ ID NO: 208243 - protein, 31 aa, Mycobacterium bovis
VTDWFGDQPFAVWPWAAPKLGGARPAVLNLD

SEQ ID NO: 208244 - protein, 25 aa, Mycobacterium bovis
VTEAITGLDLVEWQLRVGAGEKLGF

SEQ ID NO: 208245 - protein, 21 aa, Mycobacterium bovis
VTELFPLLLSVMSTGVTFVRS

SEQ ID NO: 208246 - protein, 21 aa, Mycobacterium bovis
VTELLPFGRPQLAGGPLGSVA

SEQ ID NO: 208247 - protein, 24 aa, Mycobacterium bovis
VTESFRLPPSVLTTVYYRVFGGWL

SEQ ID NO: 208248 - protein, 27 aa, Mycobacterium bovis
VTEVRLFLRRVPALAFLPNRRPAEPNQ

SEQ ID NO: 208249 - protein, 18 aa, Mycobacterium bovis
VTFGDVWALLVDGNFGSG

SEQ ID NO: 208250 - protein, 21 aa, Mycobacterium bovis
VTFPRDLTCRSEMESAVTELA

SEQ ID NO: 208251 - protein, 19 aa, Mycobacterium bovis
VTGGLFFSPTIDFLDHPPP

SEQ ID NO: 208252 - protein, 17 aa, Mycobacterium bovis
VTGGLTFAGGPWSNYVT

SEQ ID NO: 208253 - protein, 18 aa, Mycobacterium bovis
VTGIARRLPGRSVGRRIE

SEQ ID NO: 208254 - protein, 17 aa, Mycobacterium bovis
VTGLRLMTRMVQTGSSL

SEQ ID NO: 208255 - protein, 34 aa, Mycobacterium bovis
VTGNFSNGILWRGDYQGLAGFAVGYTLPLFPAVG

SEQ ID NO: 208256 - protein, 41 aa, Mycobacterium bovis
VTGTLGTFTVHGFRFPEITGDIFLIGIPFNAATLDAFSFPN

SEQ ID NO: 208257 - protein, 28 aa, Mycobacterium bovis
VTGYDILFFWVARMMMFGTFVGDDAAIT

SEQ ID NO: 208258 - protein, 19 aa, Mycobacterium bovis
VTIAKLWELFVAEDATLVE

SEQ ID NO: 208259 - protein, 24 aa, Mycobacterium bovis
VTILEEARVPFLKDAFGADITSTG

SEQ ID NO: 208260 - protein, 24 aa, Mycobacterium bovis
VTIPQLTIPAGITIGGFSLPAIHT

SEQ ID NO: 208261 - protein, 22 aa, Mycobacterium bovis
VTKSGLSIREWLIGLREAGLDT

SEQ ID NO: 208262 - protein, 25 aa, Mycobacterium bovis
VTLAARLRLPIDVIATVPMAENMPS

SEQ ID NO: 208263 - protein, 19 aa, Mycobacterium bovis
VTLANRLAGNITEYSGIHV

SEQ ID NO: 208264 - protein, 18 aa, Mycobacterium bovis
VTLCKTLGKPVNFVPVID

SEQ ID NO: 208265 - protein, 26 aa, Mycobacterium bovis
VTLGPRGRHVVLAKAFGGPTVTNDGV

SEQ ID NO: 208266 - protein, 25 aa, Mycobacterium bovis
VTLRGYRGAKNVLLVFFPLAFTGIC

SEQ ID NO: 208267 - protein, 18 aa, Mycobacterium bovis
VTLRRARASGAVLMKPST

SEQ ID NO: 208268 - protein, 24 aa, Mycobacterium bovis
VTMRNRLRLAATHAVRTSADVVRS

SEQ ID NO: 208269 - protein, 25 aa, Mycobacterium bovis
VTNCGNSWPMARLTLALSPATLPKM

SEQ ID NO: 208270 - protein, 21 aa, Mycobacterium bovis
VTPELRATIEAVWAKLAAPGM

SEQ ID NO: 208271 - protein, 24 aa, Mycobacterium bovis
VTPICCYHPPCGGGVQKMLSRKLG

SEQ ID NO: 208272 - protein, 20 aa, Mycobacterium bovis
VTPLRARIAERLDQSGPTVS

SEQ ID NO: 208273 - protein, 25 aa, Mycobacterium bovis
VTQRHLRRLWALPGTQLAVVAWPST

SEQ ID NO: 208274 - protein, 29 aa, Mycobacterium bovis
VTQRVGLPGIWYAGSHGFELTAPDGTHHQ

SEQ ID NO: 208275 - protein, 23 aa, Mycobacterium bovis
VTREIPWEMKVSGLRARLGGARL

SEQ ID NO: 208276 - protein, 20 aa, Mycobacterium bovis
VTSAGLVFQGWFHKAPYYPH

SEQ ID NO: 208277 - protein, 21 aa, Mycobacterium bovis
VTSELAGGAWQGPASAAMANA

SEQ ID NO: 208278 - protein, 18 aa, Mycobacterium bovis
VTSLLRFAGGLHIVGGRV

SEQ ID NO: 208279 - protein, 18 aa, Mycobacterium bovis
VTTLPAVISRWLSSVLPG

SEQ ID NO: 208280 - protein, 27 aa, Mycobacterium bovis
VTTTSWLKSRHSFSFGDHYDPDNTHHG

SEQ ID NO: 208281 - protein, 17 aa, Mycobacterium bovis
VTVCQWGEAAAKDLEGY

SEQ ID NO: 208282 - protein, 19 aa, Mycobacterium bovis
VTVGEVWVHDNARWAEYLR

SEQ ID NO: 208283 - protein, 25 aa, Mycobacterium bovis
VTVIDPRWVLPVSDGVRELAVQHKL

SEQ ID NO: 208284 - protein, 25 aa, Mycobacterium bovis
VVAAARGRPVVDFGARRAHGTDAAC

SEQ ID NO: 208285 - protein, 29 aa, Mycobacterium bovis
VVAADWPLLAAAYRTRGALRIVDDLLPAP

SEQ ID NO: 208286 - protein, 19 aa, Mycobacterium bovis
VVADRRLDVEFSVSAGEVL

SEQ ID NO: 208287 - protein, 17 aa, Mycobacterium bovis
VVADRWFPSLSVEPTVR

SEQ ID NO: 208288 - protein, 21 aa, Mycobacterium bovis
VVAEVRADLLASVADAVAAGV

SEQ ID NO: 208289 - protein, 27 aa, Mycobacterium bovis
VVAGVLRRLAAMRCYMRDINLGRETQP

SEQ ID NO: 208290 - protein, 24 aa, Mycobacterium bovis
VVALERLGRWCVPGPVTESIAVAP

SEQ ID NO: 208291 - protein, 19 aa, Mycobacterium bovis
VVANRCELSAIPAVTDALR

SEQ ID NO: 208292 - protein, 22 aa, Mycobacterium bovis
VVARFQPVLGLEVHVELSTATK

SEQ ID NO: 208293 - protein, 18 aa, Mycobacterium bovis
VVCEDSLGLAEEFEAAMQ

SEQ ID NO: 208294 - protein, 18 aa, Mycobacterium bovis
VVCFPDRWLDLRYVGPAS

SEQ ID NO: 208295 - protein, 24 aa, Mycobacterium bovis
VVDARTALDPSAPVIRTDLEGKSD

SEQ ID NO: 208296 - protein, 24 aa, Mycobacterium bovis
VVDDAARLTAVWIADWADDTVHLS

SEQ ID NO: 208297 - protein, 23 aa, Mycobacterium bovis
VVDGAGAPLGWIDADGRRRHRGG

SEQ ID NO: 208298 - protein, 24 aa, Mycobacterium bovis
VVDGRGRLTGLITVKDFVKTEQHP

SEQ ID NO: 208299 - protein, 17 aa, Mycobacterium bovis
VVDRSFVDNHCAGFDGY

SEQ ID NO: 208300 - protein, 21 aa, Mycobacterium bovis
VVEGVKLVDGRAFSVQYHPEA

SEQ ID NO: 208301 - protein, 18 aa, Mycobacterium bovis
VVEIEFLVTMIVVCSQGP

SEQ ID NO: 208302 - protein, 29 aa, Mycobacterium bovis
VVESWKQFGKSLIHWDEWTTNPNEALGKT

SEQ ID NO: 208303 - protein, 20 aa, Mycobacterium bovis
VVGCGPGPFTGLRAGMASAA

SEQ ID NO: 208304 - protein, 24 aa, Mycobacterium bovis
VVGFIWEVLGRIGIGRKDALVSLG

SEQ ID NO: 208305 - protein, 28 aa, Mycobacterium bovis
VVGHDWGAPVAWTFAWLHPDRCAGVVGI

SEQ ID NO: 208306 - protein, 26 aa, Mycobacterium bovis
VVGLVGEKARYMWVSTFHSTCVRILR

SEQ ID NO: 208307 - protein, 17 aa, Mycobacterium bovis
VVGRKAFARFAGYSSAM

SEQ ID NO: 208308 - protein, 18 aa, Mycobacterium bovis
VVHPRSWLLRQASSGVSA

SEQ ID NO: 208309 - protein, 17 aa, Mycobacterium bovis
VVHRWRNVGVLDMGWEK

SEQ ID NO: 208310 - protein, 25 aa, Mycobacterium bovis
VVIACGDCALNRGVFADAYGVVGAV

SEQ ID NO: 208311 - protein, 20 aa, Mycobacterium bovis
VVIDGRICRPGWVHTADGRI

SEQ ID NO: 208312 - protein, 18 aa, Mycobacterium bovis
VVIYLEYLGTTIGDLLGA

SEQ ID NO: 208313 - protein, 23 aa, Mycobacterium bovis
VVKVARIAGQYAKPRSADIDALG

SEQ ID NO: 208314 - protein, 24 aa, Mycobacterium bovis
VVLKPAPDTPWCAAALGEIIVEHT

SEQ ID NO: 208315 - protein, 18 aa, Mycobacterium bovis
VVLREILRRVELSTTTTS

SEQ ID NO: 208316 - protein, 18 aa, Mycobacterium bovis
VVLRLRGVCKRYGSITAV

SEQ ID NO: 208317 - protein, 17 aa, Mycobacterium bovis
VVLWTFPNSALAIAGER

SEQ ID NO: 208318 - protein, 19 aa, Mycobacterium bovis
VVNLHRRYRITTAQLAAAT

SEQ ID NO: 208319 - protein, 17 aa, Mycobacterium bovis
VVPRASMPKFLSTARGL

SEQ ID NO: 208320 - protein, 27 aa, Mycobacterium bovis
VVPSSKLGGLWTAVSPHLSPLSNVSSI

SEQ ID NO: 208321 - protein, 23 aa, Mycobacterium bovis
VVQRLELVRRIGLVIDYDVVELG

SEQ ID NO: 208322 - protein, 22 aa, Mycobacterium bovis
VVQRVPYFQVWNLTGQPAAVVP

SEQ ID NO: 208323 - protein, 17 aa, Mycobacterium bovis
VVRGEACADSFYAALES

SEQ ID NO: 208324 - protein, 18 aa, Mycobacterium bovis
VVRKAYRPSHEKLAWARR

SEQ ID NO: 208325 - protein, 22 aa, Mycobacterium bovis
VVRTLTVDAGAYASAEAANAGP

SEQ ID NO: 208326 - protein, 21 aa, Mycobacterium bovis
VVRTRGRLWLANRPDQVMWLE

SEQ ID NO: 208327 - protein, 17 aa, Mycobacterium bovis
VVRVRLVPGTGKFDLNG

SEQ ID NO: 208328 - protein, 18 aa, Mycobacterium bovis
VVSEFPTDRGWDVEGLYD

SEQ ID NO: 208329 - protein, 25 aa, Mycobacterium bovis
VVSELFLRAAQAYGVKRGQRMLGLS

SEQ ID NO: 208330 - protein, 19 aa, Mycobacterium bovis
VVSGGFRRIIEPLARELML

SEQ ID NO: 208331 - protein, 18 aa, Mycobacterium bovis
VVSGWRADTFVAGAPEPR

SEQ ID NO: 208332 - protein, 22 aa, Mycobacterium bovis
VVSLSSLAARRGRIHFDDLQFE

SEQ ID NO: 208333 - protein, 20 aa, Mycobacterium bovis
VVSPGDLWDLLRDGREATGS

SEQ ID NO: 208334 - protein, 19 aa, Mycobacterium bovis
VVSRLADFIRSRGHGTDDS

SEQ ID NO: 208335 - protein, 18 aa, Mycobacterium bovis
VVTDHVWHRGQQVGLVDV

SEQ ID NO: 208336 - protein, 28 aa, Mycobacterium bovis
VVTFAKPYAEWRGMFAGNGMLLPASMTA

SEQ ID NO: 208337 - protein, 21 aa, Mycobacterium bovis
VVTQSYCPLALGRLLDNPTVT

SEQ ID NO: 208338 - protein, 25 aa, Mycobacterium bovis
VVVACSAISHASRRRAQRRLPDTPV

SEQ ID NO: 208339 - protein, 18 aa, Mycobacterium bovis
VVVAFDYSCIVSLELLAR

SEQ ID NO: 208340 - protein, 25 aa, Mycobacterium bovis
VVVFKELRVLGALGVDATAYRAALD

SEQ ID NO: 208341 - protein, 25 aa, Mycobacterium bovis
VVVGLPMRCVFALTAMGFLPQSAET

SEQ ID NO: 208342 - protein, 18 aa, Mycobacterium bovis
VVVLPCGAGKTLVGAAAM

SEQ ID NO: 208343 - protein, 20 aa, Mycobacterium bovis
VVVLPDFGERYLSTPLFADV

SEQ ID NO: 208344 - protein, 25 aa, Mycobacterium bovis
VVVNCAGTGNAIRVLSRDGVFPLAA

SEQ ID NO: 208345 - protein, 26 aa, Mycobacterium bovis
VVVVGHSFGGAVAMHLAAARPDQVAA

SEQ ID NO: 208346 - protein, 23 aa, Mycobacterium bovis
VVYYHGGGWSLGGLDTHDPVARA

SEQ ID NO: 208347 - protein, 24 aa, Mycobacterium bovis
VWAGEIDPSLRLRPSRGTHLVFDA

SEQ ID NO: 208348 - protein, 21 aa, Mycobacterium bovis
VWAKEFFAEFARDGGEIRNGS

SEQ ID NO: 208349 - protein, 25 aa, Mycobacterium bovis
VWCSDIRAGAGLVLAGLVADGDTEV

SEQ ID NO: 208350 - protein, 20 aa, Mycobacterium bovis
VWDRVCSALTPGNVVLADQG

SEQ ID NO: 208351 - protein, 18 aa, Mycobacterium bovis
VWFQRGPLDAAIRASIAI

SEQ ID NO: 208352 - protein, 23 aa, Mycobacterium bovis
VWGGWRTECWEDRFEEQLIRCNG

SEQ ID NO: 208353 - protein, 24 aa, Mycobacterium bovis
VWHRRVPDRYPEVIVQAVSADDIV

SEQ ID NO: 208354 - protein, 25 aa, Mycobacterium bovis
VWLEAGKQGFLGMAVPEEYGGGGNA

SEQ ID NO: 208355 - protein, 18 aa, Mycobacterium bovis
VWLPTLLAGRVFTHRLGA

SEQ ID NO: 208356 - protein, 20 aa, Mycobacterium bovis
VWLSNLLAWLTRRASATDVS

SEQ ID NO: 208357 - protein, 18 aa, Mycobacterium bovis
VWRTDGYCHCMFTALDTL

SEQ ID NO: 208358 - protein, 25 aa, Mycobacterium bovis
VWRTFGQERLDAMASVATVPVINAL

SEQ ID NO: 208359 - protein, 17 aa, Mycobacterium bovis
VWTLRLYLTGKRLWHDP

SEQ ID NO: 208360 - protein, 25 aa, Mycobacterium bovis
VWVARLAVDFRQRFKKDVVIDMLCY

SEQ ID NO: 208361 - protein, 26 aa, Mycobacterium bovis
VWVRTDEQWRWLAHTLTVELLKELLP

SEQ ID NO: 208362 - protein, 18 aa, Mycobacterium bovis
VYCYGVLYHLSRPAEALA

SEQ ID NO: 208363 - protein, 23 aa, Mycobacterium bovis
VYECAVPVIAAVNGFCVGGGIGL

SEQ ID NO: 208364 - protein, 25 aa, Mycobacterium bovis
VYEPPSRVLFTWDIGPTWRPETDLA

SEQ ID NO: 208365 - protein, 24 aa, Mycobacterium bovis
VYFALLARRRMDLYGATVEDFAQV

SEQ ID NO: 208366 - protein, 21 aa, Mycobacterium bovis
VYFVERLVDCLAFELKMDPAE

SEQ ID NO: 208367 - protein, 29 aa, Mycobacterium bovis
VYGIGGSWFRYAGGGKWNWQRDFFDFGHV

SEQ ID NO: 208368 - protein, 27 aa, Mycobacterium bovis
VYGNTRLGLFPFRRGLTFYYLDLALMS

SEQ ID NO: 208369 - protein, 19 aa, Mycobacterium bovis
VYLDKRLKPSLRQRVIAAW

SEQ ID NO: 208370 - protein, 25 aa, Mycobacterium bovis
VYLLSRAPGALGLHAALTGAPFSGA

SEQ ID NO: 208371 - protein, 18 aa, Mycobacterium bovis
VYLRDLVLALRWVHDNIA

SEQ ID NO: 208372 - protein, 21 aa, Mycobacterium bovis
VYLTRPSLFHFTRTGEEFSWR

SEQ ID NO: 208373 - protein, 17 aa, Mycobacterium bovis
VYPRAAFEQLARRASKA

SEQ ID NO: 208374 - protein, 24 aa, Mycobacterium bovis
VYRCDLGYGAKPWLIVSNNARNRH

SEQ ID NO: 208375 - protein, 21 aa, Mycobacterium bovis
VYRLGRGRYGPGYIPRSTEYR

SEQ ID NO: 208376 - protein, 19 aa, Mycobacterium bovis
VYRLRASRAGKVLDQREAI

SEQ ID NO: 208377 - protein, 21 aa, Mycobacterium bovis
VYRLTVEGVLPMPQSTHYPLA

SEQ ID NO: 208378 - protein, 24 aa, Mycobacterium bovis
VYRRPHTRRWAGPAFLLNQMLVWG

SEQ ID NO: 208379 - protein, 26 aa, Mycobacterium bovis
VYSDGRYSYQLSIYVIRVEQGTAVAV

SEQ ID NO: 208380 - protein, 24 aa, Mycobacterium bovis
VYSRGDVGTGWVLHAEGALRAGSA

SEQ ID NO: 208381 - protein, 19 aa, Mycobacterium bovis
VYYPDCADVGIGAAVEIRG

SEQ ID NO: 208382 - protein, 24 aa, Mycobacterium bovis
WAAALRLAALSLRGGGDATQLLRG

SEQ ID NO: 208383 - protein, 23 aa, Mycobacterium bovis
WAAEACGEYAPDLDIVGAVLGSP

SEQ ID NO: 208384 - protein, 19 aa, Mycobacterium bovis
WAAGAQRGQPIYLMGPGGA

SEQ ID NO: 208385 - protein, 24 aa, Mycobacterium bovis
WAAKRAALKLVHRVPRSAGRELAY

SEQ ID NO: 208386 - protein, 17 aa, Mycobacterium bovis
WAALPFDERAAVFLRAA

SEQ ID NO: 208387 - protein, 17 aa, Mycobacterium bovis
WAALTASIGDRVQIVGD

SEQ ID NO: 208388 - protein, 17 aa, Mycobacterium bovis
WAAMPTVRTPAGGGDAH

SEQ ID NO: 208389 - protein, 20 aa, Mycobacterium bovis
WAAPSTRPVSALSPAGLTTL

SEQ ID NO: 208390 - protein, 18 aa, Mycobacterium bovis
WAARRDRPGVWLIRDPAQ

SEQ ID NO: 208391 - protein, 18 aa, Mycobacterium bovis
WAATRWVAEHGRQVGADL

SEQ ID NO: 208392 - protein, 19 aa, Mycobacterium bovis
WAAWQRSGLQRRWLAASEH

SEQ ID NO: 208393 - protein, 25 aa, Mycobacterium bovis
WADKYRGRFDVGWDALREETFARQK

SEQ ID NO: 208394 - protein, 20 aa, Mycobacterium bovis
WADLRRRVAALAGALSGRGV

SEQ ID NO: 208395 - protein, 24 aa, Mycobacterium bovis
WADNLRHTVRFSAAVRSALDDGYR

SEQ ID NO: 208396 - protein, 19 aa, Mycobacterium bovis
WAEVRPGPDAQLYRDYHDN

SEQ ID NO: 208397 - protein, 21 aa, Mycobacterium bovis
WAGRLRRLLVEQASVILRRTI

SEQ ID NO: 208398 - protein, 17 aa, Mycobacterium bovis
WAGRQMVGVGLARLDPA

SEQ ID NO: 208399 - protein, 19 aa, Mycobacterium bovis
WAGTCKPGDGLGIAGDEVL

SEQ ID NO: 208400 - protein, 24 aa, Mycobacterium bovis
WAKQRGHRGLAYVLVAEDGTLGGP

SEQ ID NO: 208401 - protein, 19 aa, Mycobacterium bovis
WAKTWEFQALLKARPVVGD

SEQ ID NO: 208402 - protein, 17 aa, Mycobacterium bovis
WAKVTGRVAPVFDLGIG

SEQ ID NO: 208403 - protein, 25 aa, Mycobacterium bovis
WANGVRRIATEAGITVIAGMFTPTG

SEQ ID NO: 208404 - protein, 21 aa, Mycobacterium bovis
WAPLCAPCDLFTPTYEASSRK

SEQ ID NO: 208405 - protein, 20 aa, Mycobacterium bovis
WAPLMWTSLVVTAWMGEHGG

SEQ ID NO: 208406 - protein, 20 aa, Mycobacterium bovis
WAQDVAAMFGYHSAASAVAT

SEQ ID NO: 208407 - protein, 17 aa, Mycobacterium bovis
WARRLHIGRSELLRDAL

SEQ ID NO: 208408 - protein, 19 aa, Mycobacterium bovis
WARSELDYIPGTTSVHSSG

SEQ ID NO: 208409 - protein, 25 aa, Mycobacterium bovis
WASANWRLRRGRIVLLEGDSPAGLR

SEQ ID NO: 208410 - protein, 18 aa, Mycobacterium bovis
WASSGHVGFKGSRKSTPF

SEQ ID NO: 208411 - protein, 18 aa, Mycobacterium bovis
WATPVTAFQRTALRDYEL

SEQ ID NO: 208412 - protein, 20 aa, Mycobacterium bovis
WCAHSGWKVDAAKGVPDWAA

SEQ ID NO: 208413 - protein, 19 aa, Mycobacterium bovis
WCTADIGWVTGHTYGVYGP

SEQ ID NO: 208414 - protein, 20 aa, Mycobacterium bovis
WDDPESWTLATYQRHDRYRG

SEQ ID NO: 208415 - protein, 25 aa, Mycobacterium bovis
WDDTPEGFGRIAATTARQVMLQRFR

SEQ ID NO: 208416 - protein, 17 aa, Mycobacterium bovis
WDGLAMELASAAASFGS

SEQ ID NO: 208417 - protein, 18 aa, Mycobacterium bovis
WDIWKASLQGVLATRPDF

SEQ ID NO: 208418 - protein, 17 aa, Mycobacterium bovis
WDLAVKIGGHLKDPVDS

SEQ ID NO: 208419 - protein, 25 aa, Mycobacterium bovis
WDLGDAHGTVMLRMPLHPVAIELLR

SEQ ID NO: 208420 - protein, 21 aa, Mycobacterium bovis
WDLLQRSRISAVSVDASTLQA

SEQ ID NO: 208421 - protein, 20 aa, Mycobacterium bovis
WDLRNGVIVRKARAHGLATP

SEQ ID NO: 208422 - protein, 17 aa, Mycobacterium bovis
WDLTRGVATDTPESLTN

SEQ ID NO: 208423 - protein, 19 aa, Mycobacterium bovis
WDMVRPRPSSRPAAASLPD

SEQ ID NO: 208424 - protein, 19 aa, Mycobacterium bovis
WDPAELGPVVSDLLAKSRP

SEQ ID NO: 208425 - protein, 22 aa, Mycobacterium bovis
WDPARWPLPVLPSSRSGPAPQS

SEQ ID NO: 208426 - protein, 27 aa, Mycobacterium bovis
WDPFPEFLGGLRFAGAQVVPIRVYRWK

SEQ ID NO: 208427 - protein, 17 aa, Mycobacterium bovis
WDPNSTYVRKPPYFEGM

SEQ ID NO: 208428 - protein, 22 aa, Mycobacterium bovis
WDQRAPIGWNMKDATPVAKTVC

SEQ ID NO: 208429 - protein, 20 aa, Mycobacterium bovis
WDQRLCAVPDADMFKAIRDG

SEQ ID NO: 208430 - protein, 19 aa, Mycobacterium bovis
WDQRLCLVPNGDLFRAIRH

SEQ ID NO: 208431 - protein, 20 aa, Mycobacterium bovis
WDRRPSWFRAVARMATGVKD

SEQ ID NO: 208432 - protein, 25 aa, Mycobacterium bovis
WDVLARFGNMLSVSLIFVLETMVQQ

SEQ ID NO: 208433 - protein, 22 aa, Mycobacterium bovis
WDVRCAPAAFRFMSQARHIGKV

SEQ ID NO: 208434 - protein, 24 aa, Mycobacterium bovis
WDVRHAREAYRFLSQARHVGKVVL

SEQ ID NO: 208435 - protein, 18 aa, Mycobacterium bovis
WDYRARARAARALHGEPV

SEQ ID NO: 208436 - protein, 24 aa, Mycobacterium bovis
WEAGHVRDVLAFYAASPERLSGRQ

SEQ ID NO: 208437 - protein, 18 aa, Mycobacterium bovis
WEALVCGGVTALPVPERL

SEQ ID NO: 208438 - protein, 20 aa, Mycobacterium bovis
WEFLDRLTSIALPRIRDFRG

SEQ ID NO: 208439 - protein, 18 aa, Mycobacterium bovis
WEFNQPWSVEEIEIGDPR

SEQ ID NO: 208440 - protein, 18 aa, Mycobacterium bovis
WEGFTDAYRDLAFPGGIR

SEQ ID NO: 208441 - protein, 19 aa, Mycobacterium bovis
WEKMPEQFLAALDREFGIT

SEQ ID NO: 208442 - protein, 21 aa, Mycobacterium bovis
WEKTIPNWFFEPDIAADIVGN

SEQ ID NO: 208443 - protein, 17 aa, Mycobacterium bovis
WELAVGDDPLSEEEIAA

SEQ ID NO: 208444 - protein, 19 aa, Mycobacterium bovis
WELEDLSFAILHPKKYEEI

SEQ ID NO: 208445 - protein, 19 aa, Mycobacterium bovis
WELGEGWAKHVTVEVALGT

SEQ ID NO: 208446 - protein, 19 aa, Mycobacterium bovis
WELLEDAFVVPETLRGQPI

SEQ ID NO: 208447 - protein, 17 aa, Mycobacterium bovis
WELYLAYSEAGFRSGYL

SEQ ID NO: 208448 - protein, 34 aa, Mycobacterium bovis
WEPGETRFALVLSRLFWDAAIFHRACEAVMPGGV

SEQ ID NO: 208449 - protein, 21 aa, Mycobacterium bovis
WERVVEAFAPAHVVEFFATTD

SEQ ID NO: 208450 - protein, 24 aa, Mycobacterium bovis
WESELDPDLLWLADHVIDDLVVLP

SEQ ID NO: 208451 - protein, 27 aa, Mycobacterium bovis
WESLQETLYWLAQPGIRESIAEADADI

SEQ ID NO: 208452 - protein, 21 aa, Mycobacterium bovis
WETTCLISPAGSVEWLCVPRP

SEQ ID NO: 208453 - protein, 26 aa, Mycobacterium bovis
WEVQGRGELALAVLVEQMRREGFELT

SEQ ID NO: 208454 - protein, 20 aa, Mycobacterium bovis
WFASNCAGEAFVVLAKPEGA

SEQ ID NO: 208455 - protein, 20 aa, Mycobacterium bovis
WFDEHGISFTRHYTGSLACV

SEQ ID NO: 208456 - protein, 19 aa, Mycobacterium bovis
WFDIEPCYVYHPLNAYSEC

SEQ ID NO: 208457 - protein, 20 aa, Mycobacterium bovis
WFDPGKFWSGDSLPLAPGYR

SEQ ID NO: 208458 - protein, 18 aa, Mycobacterium bovis
WFEVQSIRGHLVDGAVAH

SEQ ID NO: 208459 - protein, 17 aa, Mycobacterium bovis
WFFEPDIAADIVGNLLF

SEQ ID NO: 208460 - protein, 17 aa, Mycobacterium bovis
WFPSLKIYNRNGQLYTA

SEQ ID NO: 208461 - protein, 18 aa, Mycobacterium bovis
WFSYVCPGAGHAPHHVFK

SEQ ID NO: 208462 - protein, 17 aa, Mycobacterium bovis
WFVDGLIGATLGFGGEE

SEQ ID NO: 208463 - protein, 25 aa, Mycobacterium bovis
WGAWSDIGQLGWWSASPARASALEE

SEQ ID NO: 208464 - protein, 30 aa, Mycobacterium bovis
WGAYLTGMWLYRLSLAKVKWHSLTGRPLTG

SEQ ID NO: 208465 - protein, 23 aa, Mycobacterium bovis
WGGATYDVALRFLKEDPWERLAT

SEQ ID NO: 208466 - protein, 19 aa, Mycobacterium bovis
WGGPISMAVAVERADRVRG

SEQ ID NO: 208467 - protein, 18 aa, Mycobacterium bovis
WGHDRVAQVITFGTIKTK

SEQ ID NO: 208468 - protein, 19 aa, Mycobacterium bovis
WGIAAAMTRGDISVAGVDP

SEQ ID NO: 208469 - protein, 21 aa, Mycobacterium bovis
WGLDPYLTPGFTELSSQAGFD

SEQ ID NO: 208470 - protein, 17 aa, Mycobacterium bovis
WGPAYATETHYLRVYLA

SEQ ID NO: 208471 - protein, 17 aa, Mycobacterium bovis
WGPPNFCAAAARMQDVR

SEQ ID NO: 208472 - protein, 17 aa, Mycobacterium bovis
WGPRAPFEVLLGKPRAG

SEQ ID NO: 208473 - protein, 17 aa, Mycobacterium bovis
WGRRHVVMGANQVDRYG

SEQ ID NO: 208474 - protein, 38 aa, Mycobacterium bovis
WGVDNAINPSVLWTLTPRIVSLDVEYFGVMWPNNAAVG

SEQ ID NO: 208475 - protein, 24 aa, Mycobacterium bovis
WHAELGDKLLDVWTGTNHRGVQLN

SEQ ID NO: 208476 - protein, 24 aa, Mycobacterium bovis
WHERETYDFFGIIFDGHPALTRIE

SEQ ID NO: 208477 - protein, 18 aa, Mycobacterium bovis
WHGQRLRALAALPELIAA

SEQ ID NO: 208478 - protein, 17 aa, Mycobacterium bovis
WHGRPWAHHVPVMRETI

SEQ ID NO: 208479 - protein, 18 aa, Mycobacterium bovis
WIAAERGFIDAVIDPHET

SEQ ID NO: 208480 - protein, 17 aa, Mycobacterium bovis
WIGEASFVLPADLPLGY

SEQ ID NO: 208481 - protein, 20 aa, Mycobacterium bovis
WIHLPCLPSVAALDHNLGVP

SEQ ID NO: 208482 - protein, 18 aa, Mycobacterium bovis
WIHPDHRKKGYGTAALRK

SEQ ID NO: 208483 - protein, 21 aa, Mycobacterium bovis
WILNGAKCWITNGGKSTWYTV

SEQ ID NO: 208484 - protein, 18 aa, Mycobacterium bovis
WILRRILRRLGYAAYGWG

SEQ ID NO: 208485 - protein, 20 aa, Mycobacterium bovis
WIPAGCWHQHKFHGHTQFHG

SEQ ID NO: 208486 - protein, 17 aa, Mycobacterium bovis
WIQRAAMDRRTTMKRVA

SEQ ID NO: 208487 - protein, 17 aa, Mycobacterium bovis
WIREFPSLGAAAYPVQR

SEQ ID NO: 208488 - protein, 21 aa, Mycobacterium bovis
WIVFEEEYFRAGAPGRASANG

SEQ ID NO: 208489 - protein, 25 aa, Mycobacterium bovis
WKAGPALACGNAFVLKPSERDPSVP

SEQ ID NO: 208490 - protein, 19 aa, Mycobacterium bovis
WKAPPPIAHSTVLVAPVSP

SEQ ID NO: 208491 - protein, 20 aa, Mycobacterium bovis
WKIDEIRPAFIHVNPVTIPP

SEQ ID NO: 208492 - protein, 19 aa, Mycobacterium bovis
WKKVAPKLSAGRVQSVATR

SEQ ID NO: 208493 - protein, 18 aa, Mycobacterium bovis
WKLVRTFDDPATWTEPGV

SEQ ID NO: 208494 - protein, 17 aa, Mycobacterium bovis
WKNTGQILADEGHHVVA

SEQ ID NO: 208495 - protein, 22 aa, Mycobacterium bovis
WKVCGTGVVTCRFTHVYPDGPA

SEQ ID NO: 208496 - protein, 17 aa, Mycobacterium bovis
WKVKRIRNTPRVTLATC

SEQ ID NO: 208497 - protein, 20 aa, Mycobacterium bovis
WKYLMALFSSKIDEHADPKV

SEQ ID NO: 208498 - protein, 18 aa, Mycobacterium bovis
WLAALRGSARLVIGTRSA

SEQ ID NO: 208499 - protein, 20 aa, Mycobacterium bovis
WLADTWRDRFEQMLQRAEAR

SEQ ID NO: 208500 - protein, 26 aa, Mycobacterium bovis
WLCVPRPDSPSVFGAILDRSAGHFRL

SEQ ID NO: 208501 - protein, 24 aa, Mycobacterium bovis
WLDDRKWAYVRLEGRAFGDVPLNL

SEQ ID NO: 208502 - protein, 29 aa, Mycobacterium bovis
WLDPFTEFRFPRIGTAVFDGIEIELRGAI

SEQ ID NO: 208503 - protein, 18 aa, Mycobacterium bovis
WLDPMIALSFAAAASSRV

SEQ ID NO: 208504 - protein, 23 aa, Mycobacterium bovis
WLDPQMTSPYAWYQYFVNTADAD

SEQ ID NO: 208505 - protein, 22 aa, Mycobacterium bovis
WLEMPIQAGVGITRMDLLERGR

SEQ ID NO: 208506 - protein, 21 aa, Mycobacterium bovis
WLGDGNFLLLGYQRCRVADGM

SEQ ID NO: 208507 - protein, 18 aa, Mycobacterium bovis
WLGDHRIHNVAALPGAAY

SEQ ID NO: 208508 - protein, 20 aa, Mycobacterium bovis
WLGRDRFVLSAGHSSLTLYI

SEQ ID NO: 208509 - protein, 18 aa, Mycobacterium bovis
WLGTVVQAYLRRTLADCA

SEQ ID NO: 208510 - protein, 17 aa, Mycobacterium bovis
WLHRAAVDLVAVHADQA

SEQ ID NO: 208511 - protein, 26 aa, Mycobacterium bovis
WLHRRFGDIVQLVFALVPFRFRKHPR

SEQ ID NO: 208512 - protein, 24 aa, Mycobacterium bovis
WLNSYYDDMAWLALALERADRVAG

SEQ ID NO: 208513 - protein, 19 aa, Mycobacterium bovis
WLPAFAILEHVGRRSGKPY

SEQ ID NO: 208514 - protein, 20 aa, Mycobacterium bovis
WLPCFHDMGMVGFLTIPMFF

SEQ ID NO: 208515 - protein, 20 aa, Mycobacterium bovis
WLPETMAYTAVRWKNVLRQA

SEQ ID NO: 208516 - protein, 17 aa, Mycobacterium bovis
WLPFLPTSDPPAHTRMR

SEQ ID NO: 208517 - protein, 25 aa, Mycobacterium bovis
WLPFYHDMGLMLGIILPMINQDTAV

SEQ ID NO: 208518 - protein, 19 aa, Mycobacterium bovis
WLPGTALVIADLVWADGSE

SEQ ID NO: 208519 - protein, 29 aa, Mycobacterium bovis
WLPMKRTALALHHLVCTRFRSDALQIIAF

SEQ ID NO: 208520 - protein, 17 aa, Mycobacterium bovis
WLQEEWLHHCGDAAAFL

SEQ ID NO: 208521 - protein, 20 aa, Mycobacterium bovis
WLRNSTRGALAMDPRRMAMM

SEQ ID NO: 208522 - protein, 23 aa, Mycobacterium bovis
WLSSPYSHWAFQHVEDFMPTTVI

SEQ ID NO: 208523 - protein, 23 aa, Mycobacterium bovis
WLTATRARNALVLVRGKPTDQLP

SEQ ID NO: 208524 - protein, 22 aa, Mycobacterium bovis
WLTCTAESSALAAAQAMASAAA

SEQ ID NO: 208525 - protein, 17 aa, Mycobacterium bovis
WLVCVHGTEMGRAPLDL

SEQ ID NO: 208526 - protein, 17 aa, Mycobacterium bovis
WLVDRGAGRVVLGGRSD

SEQ ID NO: 208527 - protein, 19 aa, Mycobacterium bovis
WLVHRFKAQAVHYVTPTDD

SEQ ID NO: 208528 - protein, 19 aa, Mycobacterium bovis
WLVRQLAALLPELARYPST

SEQ ID NO: 208529 - protein, 26 aa, Mycobacterium bovis
WMCDRAVDLLLLETCVSYSGEDEPFL

SEQ ID NO: 208530 - protein, 17 aa, Mycobacterium bovis
WMGPSSITMAAAVAPYV

SEQ ID NO: 208531 - protein, 24 aa, Mycobacterium bovis
WMLQSRLKALRIFDRKPIPKWGSN

SEQ ID NO: 208532 - protein, 20 aa, Mycobacterium bovis
WMRELFPFDRVVHLANENPQ

SEQ ID NO: 208533 - protein, 24 aa, Mycobacterium bovis
WMVTAAKFEVEWPADPQRAGLVRS

SEQ ID NO: 208534 - protein, 17 aa, Mycobacterium bovis
WMWFVFPQLRGLGSSPL

SEQ ID NO: 208535 - protein, 23 aa, Mycobacterium bovis
WNCDKGRWAFTYATQPDVITTPL

SEQ ID NO: 208536 - protein, 19 aa, Mycobacterium bovis
WNFEFGWQATEAIVDTGRG

SEQ ID NO: 208537 - protein, 19 aa, Mycobacterium bovis
WNFTVPFVCGATNLGEALR

SEQ ID NO: 208538 - protein, 17 aa, Mycobacterium bovis
WNHPVVDPHTVEPDHHG

SEQ ID NO: 208539 - protein, 18 aa, Mycobacterium bovis
WNIGIGITGNGQIGFGKP

SEQ ID NO: 208540 - protein, 24 aa, Mycobacterium bovis
WNLGGLKAALAIAGREAAADLARM

SEQ ID NO: 208541 - protein, 26 aa, Mycobacterium bovis
WNLLGWPSINVPAGFTSDGLPIGVQL

SEQ ID NO: 208542 - protein, 19 aa, Mycobacterium bovis
WNPEFLREGFAVHDTLNPD

SEQ ID NO: 208543 - protein, 24 aa, Mycobacterium bovis
WNRIDYRPLDGFVYAITPFNFTSI

SEQ ID NO: 208544 - protein, 32 aa, Mycobacterium bovis
WNWSSGCDHASWTFVGGPVIKDGRPVDFGSFL

SEQ ID NO: 208545 - protein, 18 aa, Mycobacterium bovis
WPAPDHLRLVTLPWSRDL

SEQ ID NO: 208546 - protein, 20 aa, Mycobacterium bovis
WPARQLVDDRWVWLPTLLAG

SEQ ID NO: 208547 - protein, 24 aa, Mycobacterium bovis
WPATPARLPFTLGAGAHLQADIAL

SEQ ID NO: 208548 - protein, 19 aa, Mycobacterium bovis
WPAVCSGLRSEARNGRMLP

SEQ ID NO: 208549 - protein, 17 aa, Mycobacterium bovis
WPCPDRCDRASSWFHNH

SEQ ID NO: 208550 - protein, 19 aa, Mycobacterium bovis
WPDALRRGGFDAAEPAAWI

SEQ ID NO: 208551 - protein, 17 aa, Mycobacterium bovis
WPDPADWLAAVRASPLL

SEQ ID NO: 208552 - protein, 24 aa, Mycobacterium bovis
WPDREYRPDLDILIAGCGTNQAAI

SEQ ID NO: 208553 - protein, 20 aa, Mycobacterium bovis
WPDRQLPGEGVTRGAIQVPP

SEQ ID NO: 208554 - protein, 25 aa, Mycobacterium bovis
WPGEERLLRLGLQSLRLWREGSFLD

SEQ ID NO: 208555 - protein, 21 aa, Mycobacterium bovis
WPHPPEALAPRYVDALGGIDR

SEQ ID NO: 208556 - protein, 25 aa, Mycobacterium bovis
WPLTDAAGVPVVFLTAYCALRVLAQ

SEQ ID NO: 208557 - protein, 31 aa, Mycobacterium bovis
WPNGIAAKGEMRWQFHHVIDVAPTILEAAGL

SEQ ID NO: 208558 - protein, 23 aa, Mycobacterium bovis
WPNLDYPGLHALSTVPQCVPNAA

SEQ ID NO: 208559 - protein, 17 aa, Mycobacterium bovis
WPPAGAVPVEVADGYQQ

SEQ ID NO: 208560 - protein, 17 aa, Mycobacterium bovis
WPPEAQLYVALDDDGER

SEQ ID NO: 208561 - protein, 19 aa, Mycobacterium bovis
WPPPCNIRIVGRSAAAAPR

SEQ ID NO: 208562 - protein, 18 aa, Mycobacterium bovis
WPQPQVLCTMRLARRVLS

SEQ ID NO: 208563 - protein, 21 aa, Mycobacterium bovis
WPRELTEAFANMGTEIFETMF

SEQ ID NO: 208564 - protein, 26 aa, Mycobacterium bovis
WPRHILDVKTAIAWARANVDKFGGDR

SEQ ID NO: 208565 - protein, 20 aa, Mycobacterium bovis
WPRHRRLSIGADDGRSAVLA

SEQ ID NO: 208566 - protein, 21 aa, Mycobacterium bovis
WPSYVRVSAGLPRTMTFKVIK

SEQ ID NO: 208567 - protein, 20 aa, Mycobacterium bovis
WPTDDAFRRRVFELVDIAFA

SEQ ID NO: 208568 - protein, 20 aa, Mycobacterium bovis
WPTIELPGFVAGNGHWALTK

SEQ ID NO: 208569 - protein, 26 aa, Mycobacterium bovis
WPVAGRMMGRLGWYVESMLSPRLHRR

SEQ ID NO: 208570 - protein, 17 aa, Mycobacterium bovis
WPVALVIATGHILANNH

SEQ ID NO: 208571 - protein, 18 aa, Mycobacterium bovis
WPVLVAAIAEWAKRGGRR

SEQ ID NO: 208572 - protein, 23 aa, Mycobacterium bovis
WQAARCVANWDGARVDKGLRRWR

SEQ ID NO: 208573 - protein, 24 aa, Mycobacterium bovis
WQAGDPEAAFAHFGRRFDDLSTEI

SEQ ID NO: 208574 - protein, 20 aa, Mycobacterium bovis
WQAIEASGRFCVNVLTEKQK

SEQ ID NO: 208575 - protein, 19 aa, Mycobacterium bovis
WQALVNWSGTDPVAGELVA

SEQ ID NO: 208576 - protein, 22 aa, Mycobacterium bovis
WQATSPLPGWDVKAVVSHIIGT

SEQ ID NO: 208577 - protein, 17 aa, Mycobacterium bovis
WQECSQVGMPRAVVITK

SEQ ID NO: 208578 - protein, 24 aa, Mycobacterium bovis
WQENWARLGTFNVPNPVGSLAPPD

SEQ ID NO: 208579 - protein, 19 aa, Mycobacterium bovis
WQGASAMALNAKMDDWLDA

SEQ ID NO: 208580 - protein, 21 aa, Mycobacterium bovis
WQGDTGITYQGWQTQWNQALE

SEQ ID NO: 208581 - protein, 17 aa, Mycobacterium bovis
WQHGVFIGATLGSEQTA

SEQ ID NO: 208582 - protein, 18 aa, Mycobacterium bovis
WQLGMTRHFLAGDAQPRY

SEQ ID NO: 208583 - protein, 28 aa, Mycobacterium bovis
WQPEGVSLAELFRRSGLDVRAADDDTIF

SEQ ID NO: 208584 - protein, 20 aa, Mycobacterium bovis
WQPPTPRRLGPFRASEETWR

SEQ ID NO: 208585 - protein, 17 aa, Mycobacterium bovis
WQRLRTDVGAVFDTEVY

SEQ ID NO: 208586 - protein, 25 aa, Mycobacterium bovis
WQRQGRAGSHVSIRWDVPGDTTPGQ

SEQ ID NO: 208587 - protein, 23 aa, Mycobacterium bovis
WQSDHQGQWGAHYAITVPQIPLL

SEQ ID NO: 208588 - protein, 26 aa, Mycobacterium bovis
WQTAHVMKARRGALEGDPSGSQAADN

SEQ ID NO: 208589 - protein, 17 aa, Mycobacterium bovis
WQTGFPRRSKSCWSAVM

SEQ ID NO: 208590 - protein, 17 aa, Mycobacterium bovis
WQVTRTAVRFIGRLPRK

SEQ ID NO: 208591 - protein, 21 aa, Mycobacterium bovis
WRAACRSNPALAKGLSTHEGA

SEQ ID NO: 208592 - protein, 19 aa, Mycobacterium bovis
WRAAGELRKGDRVAQPRRF

SEQ ID NO: 208593 - protein, 18 aa, Mycobacterium bovis
WRAAMWSKPAGHGINAPD

SEQ ID NO: 208594 - protein, 17 aa, Mycobacterium bovis
WRADTFVAGAPEPRHDE

SEQ ID NO: 208595 - protein, 31 aa, Mycobacterium bovis
WRAEEVTVIVAPMFHAWGFSQLVLASSLACT

SEQ ID NO: 208596 - protein, 20 aa, Mycobacterium bovis
WRAPSKLAYIDAGLIDLIRV

SEQ ID NO: 208597 - protein, 22 aa, Mycobacterium bovis
WRDHIRHGAAIAAALRERLDPA

SEQ ID NO: 208598 - protein, 18 aa, Mycobacterium bovis
WRDIHLDSSFAVDLGEPI

SEQ ID NO: 208599 - protein, 20 aa, Mycobacterium bovis
WREWSLRCAALATHPAALDT

SEQ ID NO: 208600 - protein, 21 aa, Mycobacterium bovis
WRFENRCELLAFRHDLDPNDA

SEQ ID NO: 208601 - protein, 20 aa, Mycobacterium bovis
WRFGLDRILTGVAMSEDSQA

SEQ ID NO: 208602 - protein, 17 aa, Mycobacterium bovis
WRGPVLDDLRDFQFVEP

SEQ ID NO: 208603 - protein, 19 aa, Mycobacterium bovis
WRHGAAVSVGLVFAAELAR

SEQ ID NO: 208604 - protein, 17 aa, Mycobacterium bovis
WRHTACPVNELSKSAAY

SEQ ID NO: 208605 - protein, 17 aa, Mycobacterium bovis
WRLPGDDVTALRGTAEN

SEQ ID NO: 208606 - protein, 20 aa, Mycobacterium bovis
WRMPMGPVVNLTRWMEAAGC

SEQ ID NO: 208607 - protein, 18 aa, Mycobacterium bovis
WRNIRRLIDAGARVALST

SEQ ID NO: 208608 - protein, 18 aa, Mycobacterium bovis
WRNLASGYQVKTYRDDAD

SEQ ID NO: 208609 - protein, 28 aa, Mycobacterium bovis
WRPFGLPPHRWRLAPWYWRGLQVTLEPG

SEQ ID NO: 208610 - protein, 17 aa, Mycobacterium bovis
WRPQAVLNHAGELARMC

SEQ ID NO: 208611 - protein, 25 aa, Mycobacterium bovis
WRQADKYDVPRICFVNKMDKIGADF

SEQ ID NO: 208612 - protein, 26 aa, Mycobacterium bovis
WRQLEARLNLLRVHASFLFEEVAINS

SEQ ID NO: 208613 - protein, 19 aa, Mycobacterium bovis
WRRESELFADVAVPDDVDV

SEQ ID NO: 208614 - protein, 25 aa, Mycobacterium bovis
WRRGTLPPGRLGVRRAKEIRNRARD

SEQ ID NO: 208615 - protein, 17 aa, Mycobacterium bovis
WRRLLGPLVAHSETVVE

SEQ ID NO: 208616 - protein, 19 aa, Mycobacterium bovis
WRRRKPYSWLRQVLPDPQY

SEQ ID NO: 208617 - protein, 18 aa, Mycobacterium bovis
WRSALATALAAPANSTSI

SEQ ID NO: 208618 - protein, 19 aa, Mycobacterium bovis
WRSFELYPPQVRVAGAIPI

SEQ ID NO: 208619 - protein, 18 aa, Mycobacterium bovis
WRTIGRVLDGPARVLVDG

SEQ ID NO: 208620 - protein, 17 aa, Mycobacterium bovis
WRVVEAVDEPSAITTLA

SEQ ID NO: 208621 - protein, 20 aa, Mycobacterium bovis
WRWIAEDHTVALFLDKDRVL

SEQ ID NO: 208622 - protein, 20 aa, Mycobacterium bovis
WSAAPNFAFELAVRKTTDAD

SEQ ID NO: 208623 - protein, 18 aa, Mycobacterium bovis
WSAAVSRLAAAEAAVADC

SEQ ID NO: 208624 - protein, 18 aa, Mycobacterium bovis
WSALCGIVEAGGSLEKFR

SEQ ID NO: 208625 - protein, 20 aa, Mycobacterium bovis
WSANPFPFLRQIIANQQVYW

SEQ ID NO: 208626 - protein, 18 aa, Mycobacterium bovis
WSDLRRAAMAAGLQEIAG

SEQ ID NO: 208627 - protein, 22 aa, Mycobacterium bovis
WSDPCKGIPALDAHLVDEVAER

SEQ ID NO: 208628 - protein, 27 aa, Mycobacterium bovis
WSDVDVSEWPGIDWPATQSMAEQVLAE

SEQ ID NO: 208629 - protein, 26 aa, Mycobacterium bovis
WSEACDRGGPGLLLRAKHAVFDRLVY

SEQ ID NO: 208630 - protein, 25 aa, Mycobacterium bovis
WSFAQAAAVPVVFLTAWYGLADLAE

SEQ ID NO: 208631 - protein, 17 aa, Mycobacterium bovis
WSGAGVVASHMTATEIT

SEQ ID NO: 208632 - protein, 18 aa, Mycobacterium bovis
WSKVHLFWGDERYVPEDD

SEQ ID NO: 208633 - protein, 21 aa, Mycobacterium bovis
WSLAGLRVGYALGSPDVLARL

SEQ ID NO: 208634 - protein, 20 aa, Mycobacterium bovis
WSLMAQGVYAPAIPRRKSQN

SEQ ID NO: 208635 - protein, 22 aa, Mycobacterium bovis
WSMPLIRPNGRMLAIKGERAHD

SEQ ID NO: 208636 - protein, 19 aa, Mycobacterium bovis
WSNRIERGLVHITGVTRLE

SEQ ID NO: 208637 - protein, 17 aa, Mycobacterium bovis
WSPVSLGDYCAGSNHVL

SEQ ID NO: 208638 - protein, 26 aa, Mycobacterium bovis
WSVDGRPRRAAVSSFGISGTNAHLIL

SEQ ID NO: 208639 - protein, 19 aa, Mycobacterium bovis
WSYAEAAAISAVFTTAYYA

SEQ ID NO: 208640 - protein, 24 aa, Mycobacterium bovis
WTATLKRHCVRVIPWEITGRHFRF

SEQ ID NO: 208641 - protein, 20 aa, Mycobacterium bovis
WTERWPDLVASFTAATRAEE

SEQ ID NO: 208642 - protein, 27 aa, Mycobacterium bovis
WTFLGPRPAGWWVRRRLHEVAVHRADV

SEQ ID NO: 208643 - protein, 20 aa, Mycobacterium bovis
WTGCRDFDELIVYCRRGAGT

SEQ ID NO: 208644 - protein, 17 aa, Mycobacterium bovis
WTIHPRSALAAPVLPVF

SEQ ID NO: 208645 - protein, 17 aa, Mycobacterium bovis
WTIVSGLEIDEFSRGRI

SEQ ID NO: 208646 - protein, 19 aa, Mycobacterium bovis
WTKRKGRIYSDDRIGVALD

SEQ ID NO: 208647 - protein, 22 aa, Mycobacterium bovis
WTKRLRAVDFTLGYEVRSVNAE

SEQ ID NO: 208648 - protein, 18 aa, Mycobacterium bovis
WTLADGRDLLFFSLPGHV

SEQ ID NO: 208649 - protein, 19 aa, Mycobacterium bovis
WTLDTAVAYAKVREQFGKP

SEQ ID NO: 208650 - protein, 30 aa, Mycobacterium bovis
WTLLKWLDQPCSFYDWRRSAADGPRLHPDD

SEQ ID NO: 208651 - protein, 19 aa, Mycobacterium bovis
WTNPDCRRAGTVHLGGTFA

SEQ ID NO: 208652 - protein, 24 aa, Mycobacterium bovis
WTRVPYEVLERISTRITNEVAEVN

SEQ ID NO: 208653 - protein, 28 aa, Mycobacterium bovis
WTSAAHKARWGVCLARTDPDAPKHKGIT

SEQ ID NO: 208654 - protein, 24 aa, Mycobacterium bovis
WTSGAADPRCKILIVMGRTNPDAA

SEQ ID NO: 208655 - protein, 23 aa, Mycobacterium bovis
WTSSGAIGPTWYSVGRIYNAGDL

SEQ ID NO: 208656 - protein, 17 aa, Mycobacterium bovis
WTVSKLYYVHGFLRERM

SEQ ID NO: 208657 - protein, 24 aa, Mycobacterium bovis
WVARVGTVVMSWRLRTRHRLPVHD

SEQ ID NO: 208658 - protein, 24 aa, Mycobacterium bovis
WVDNLRHTVRFAAAVQAALEDGYR

SEQ ID NO: 208659 - protein, 17 aa, Mycobacterium bovis
WVDNMVNELAARPPDDP

SEQ ID NO: 208660 - protein, 17 aa, Mycobacterium bovis
WVEFAANNDGTLPHFPL

SEQ ID NO: 208661 - protein, 18 aa, Mycobacterium bovis
WVEMFGADALRFTLARGA

SEQ ID NO: 208662 - protein, 18 aa, Mycobacterium bovis
WVEYEPYGTVLIIGAWNY

SEQ ID NO: 208663 - protein, 23 aa, Mycobacterium bovis
WVGGSPPAALSWVEPILQATTTL

SEQ ID NO: 208664 - protein, 19 aa, Mycobacterium bovis
WVGPRRFSGSSGQLAREWV

SEQ ID NO: 208665 - protein, 18 aa, Mycobacterium bovis
WVGYLERDVFPGGCFFAA

SEQ ID NO: 208666 - protein, 18 aa, Mycobacterium bovis
WVKLVGDWIDRQIGDLAP

SEQ ID NO: 208667 - protein, 18 aa, Mycobacterium bovis
WVLGPSMTYTCAVFPNAE

SEQ ID NO: 208668 - protein, 19 aa, Mycobacterium bovis
WVLTKGKLPTSLWIEIVTT

SEQ ID NO: 208669 - protein, 31 aa, Mycobacterium bovis
WVMTGWQRLHFRFGFPAPLLEPLAVERLYLD

SEQ ID NO: 208670 - protein, 17 aa, Mycobacterium bovis
WVNLVALAVNEENASGG

SEQ ID NO: 208671 - protein, 24 aa, Mycobacterium bovis
WVNMLRCTLAAFGAGVGGADTVLV

SEQ ID NO: 208672 - protein, 24 aa, Mycobacterium bovis
WVPAHFPKDAWALGRFDGTPLYEH

SEQ ID NO: 208673 - protein, 18 aa, Mycobacterium bovis
WVPEDIFQTALGRAAEPV

SEQ ID NO: 208674 - protein, 24 aa, Mycobacterium bovis
WVPLGEVPEVWAAVTSVFRDYGYR

SEQ ID NO: 208675 - protein, 22 aa, Mycobacterium bovis
WVTGPGGERWEVYTVLADSETF

SEQ ID NO: 208676 - protein, 23 aa, Mycobacterium bovis
WVVGRLQLWHGYRLGLIEITPSS

SEQ ID NO: 208677 - protein, 20 aa, Mycobacterium bovis
WVVRVVLSLMYWPAENDEAE

SEQ ID NO: 208678 - protein, 18 aa, Mycobacterium bovis
WWAAPTILEHGTPEQIER

SEQ ID NO: 208679 - protein, 17 aa, Mycobacterium bovis
WWLTFSSAAALLGTPGQ

SEQ ID NO: 208680 - protein, 17 aa, Mycobacterium bovis
WWLVRLLGSITPTERTT

SEQ ID NO: 208681 - protein, 20 aa, Mycobacterium bovis
WWPECSKEAYADGIAGAVDA

SEQ ID NO: 208682 - protein, 20 aa, Mycobacterium bovis
WWQVHRRAMIVAEELWIYAS

SEQ ID NO: 208683 - protein, 17 aa, Mycobacterium bovis
WYAARTLLRTEFGITRM

SEQ ID NO: 208684 - protein, 20 aa, Mycobacterium bovis
WYDHVFFISVWWGWQDHFRE

SEQ ID NO: 208685 - protein, 18 aa, Mycobacterium bovis
WYDTRRIPAATAEALERT

SEQ ID NO: 208686 - protein, 19 aa, Mycobacterium bovis
WYEGPTWLQRVLRALPAAG

SEQ ID NO: 208687 - protein, 17 aa, Mycobacterium bovis
WYGLDGVEHTGGPLVDF

SEQ ID NO: 208688 - protein, 20 aa, Mycobacterium bovis
WYGQRFPKPLARTREYIDIV

SEQ ID NO: 208689 - protein, 20 aa, Mycobacterium bovis
WYIREVDPTTLLLTGLTRDG

SEQ ID NO: 208690 - protein, 28 aa, Mycobacterium bovis
WYPGEPLPRWQIALYWRTDGRPLWTNDA

SEQ ID NO: 208691 - protein, 18 aa, Mycobacterium bovis
WYSDFLDFVGRERIFASL

SEQ ID NO: 208692 - protein, 18 aa, Mycobacterium bovis
WYYARTFEGKQYGVHCRC

SEQ ID NO: 208693 - protein, 21 aa, Mycobacterium bovis
YAAAGRYVLDRAIFDALRRID

SEQ ID NO: 208694 - protein, 20 aa, Mycobacterium bovis
YAACLPERFADVMRVTADVL

SEQ ID NO: 208695 - protein, 33 aa, Mycobacterium bovis
YAAKAFLCSEVARWISEEGLCLDVCTGGELAVA

SEQ ID NO: 208696 - protein, 25 aa, Mycobacterium bovis
YAALEFWSALHGFVLLEMTGVMDDI

SEQ ID NO: 208697 - protein, 19 aa, Mycobacterium bovis
YAALMAGADLVLPDRHLDA

SEQ ID NO: 208698 - protein, 19 aa, Mycobacterium bovis
YAAVGFEYGYTVGNPDAVV

SEQ ID NO: 208699 - protein, 20 aa, Mycobacterium bovis
YADAAAVCGCPVGTIRSRVA

SEQ ID NO: 208700 - protein, 18 aa, Mycobacterium bovis
YADALIWTPAHLAVDVAV

SEQ ID NO: 208701 - protein, 18 aa, Mycobacterium bovis
YADLRPNNEIAAWEADLA

SEQ ID NO: 208702 - protein, 24 aa, Mycobacterium bovis
YADPLGALRRSGALDARLQDTAPE

SEQ ID NO: 208703 - protein, 17 aa, Mycobacterium bovis
YADVRVHTVMNKDRLEM

SEQ ID NO: 208704 - protein, 19 aa, Mycobacterium bovis
YAEAFCRAVGGSWADVLDG

SEQ ID NO: 208705 - protein, 17 aa, Mycobacterium bovis
YAFDDTVAWLAVACSKT

SEQ ID NO: 208706 - protein, 18 aa, Mycobacterium bovis
YAGADRVLGRLVKVTPTS

SEQ ID NO: 208707 - protein, 17 aa, Mycobacterium bovis
YAHVTGRVGVCMATSGP

SEQ ID NO: 208708 - protein, 24 aa, Mycobacterium bovis
YAIERPHMYRLMFGSTSAHGINVP

SEQ ID NO: 208709 - protein, 29 aa, Mycobacterium bovis
YAKALRRYRFRAGIAKVDFVLSDEIPWSD

SEQ ID NO: 208710 - protein, 17 aa, Mycobacterium bovis
YALAGRHVHVVTINDYL

SEQ ID NO: 208711 - protein, 18 aa, Mycobacterium bovis
YALATGIIDETGFPEAVA

SEQ ID NO: 208712 - protein, 27 aa, Mycobacterium bovis
YALRSVNMFAPWIRRIFIATDSTPPPW

SEQ ID NO: 208713 - protein, 18 aa, Mycobacterium bovis
YALTEWQRILDVNLTGVF

SEQ ID NO: 208714 - protein, 25 aa, Mycobacterium bovis
YAMWERRLGVRIAQATHEIHAAGAS

SEQ ID NO: 208715 - protein, 18 aa, Mycobacterium bovis
YAPLPWLPDNIYREVVSR

SEQ ID NO: 208716 - protein, 30 aa, Mycobacterium bovis
YAQCLRGMAARNRLDIVAALQNFRTAFEVG

SEQ ID NO: 208717 - protein, 20 aa, Mycobacterium bovis
YARPRFDDDYGRYDGRDYDD

SEQ ID NO: 208718 - protein, 18 aa, Mycobacterium bovis
YARSRFTIAARAAGLPSA

SEQ ID NO: 208719 - protein, 23 aa, Mycobacterium bovis
YARTRHNLGFVVADLLAARLGAK

SEQ ID NO: 208720 - protein, 25 aa, Mycobacterium bovis
YASREARAAYRWMRANQPVFRDRNG

SEQ ID NO: 208721 - protein, 17 aa, Mycobacterium bovis
YATGAARDIVKRARALG

SEQ ID NO: 208722 - protein, 20 aa, Mycobacterium bovis
YAVIDGEIWLETKAKSQKAV

SEQ ID NO: 208723 - protein, 18 aa, Mycobacterium bovis
YAVNNSFGFGGHNVALAF

SEQ ID NO: 208724 - protein, 22 aa, Mycobacterium bovis
YAWSRMRMMRSGKHITYHSVRR

SEQ ID NO: 208725 - protein, 28 aa, Mycobacterium bovis
YCALACAELLYRAGLPRALYAIVPGPGS

SEQ ID NO: 208726 - protein, 23 aa, Mycobacterium bovis
YDALCFPGLAAEWGGRRPFVGAL

SEQ ID NO: 208727 - protein, 24 aa, Mycobacterium bovis
YDAPVAEYWPEFGANGKSEVTVSD

SEQ ID NO: 208728 - protein, 30 aa, Mycobacterium bovis
YDAYTNPGTLMWWIARSLELLQDFQEFAKL

SEQ ID NO: 208729 - protein, 19 aa, Mycobacterium bovis
YDDFCRRQHTFSSTLTVES

SEQ ID NO: 208730 - protein, 27 aa, Mycobacterium bovis
YDDIPANVMPIDWYLHVRHAVGGEIAM

SEQ ID NO: 208731 - protein, 19 aa, Mycobacterium bovis
YDDRLLYLDRYWREEEQVC

SEQ ID NO: 208732 - protein, 21 aa, Mycobacterium bovis
YDEAWMLNTVFDYHNENAKEE

SEQ ID NO: 208733 - protein, 19 aa, Mycobacterium bovis
YDFFNMWRVRPAGLRVIGA

SEQ ID NO: 208734 - protein, 19 aa, Mycobacterium bovis
YDGAVAWLVGEEGRGVPTI

SEQ ID NO: 208735 - protein, 17 aa, Mycobacterium bovis
YDIPGACEHLRQFTEAL

SEQ ID NO: 208736 - protein, 17 aa, Mycobacterium bovis
YDISDDFFALFLDPTWV

SEQ ID NO: 208737 - protein, 21 aa, Mycobacterium bovis
YDIYRGVVTYVRVVDGKISPR

SEQ ID NO: 208738 - protein, 21 aa, Mycobacterium bovis
YDLSAGFPLLTTKKVHFKSVA

SEQ ID NO: 208739 - protein, 27 aa, Mycobacterium bovis
YDLSHPWGHGAPAWPYFEDVQIERLHG

SEQ ID NO: 208740 - protein, 20 aa, Mycobacterium bovis
YDPDKGFGFLSQEGGEDVYV

SEQ ID NO: 208741 - protein, 20 aa, Mycobacterium bovis
YDPIWPRHGIRIIPGPSSLW

SEQ ID NO: 208742 - protein, 17 aa, Mycobacterium bovis
YDRAIGYEAAYAGTSFA

SEQ ID NO: 208743 - protein, 17 aa, Mycobacterium bovis
YDRPAFYAADVVTHGQI

SEQ ID NO: 208744 - protein, 22 aa, Mycobacterium bovis
YDRRWLHEQGIALTMSDLRFLK

SEQ ID NO: 208745 - protein, 18 aa, Mycobacterium bovis
YDRRYGLDDTHLRAIAQL

SEQ ID NO: 208746 - protein, 28 aa, Mycobacterium bovis
YDSLVCGRRRLGAIGAEIENAVAHQRAL

SEQ ID NO: 208747 - protein, 19 aa, Mycobacterium bovis
YDTGLSLSAVCALEPYWEA

SEQ ID NO: 208748 - protein, 24 aa, Mycobacterium bovis
YDVKRAETGIIYIDEVDKIARKSE

SEQ ID NO: 208749 - protein, 19 aa, Mycobacterium bovis
YDVVDGRPHLRLENRVLPA

SEQ ID NO: 208750 - protein, 19 aa, Mycobacterium bovis
YDYSARFGDYQVIVIANPL

SEQ ID NO: 208751 - protein, 17 aa, Mycobacterium bovis
YEEIDWDTAIVEIAEGF

SEQ ID NO: 208752 - protein, 17 aa, Mycobacterium bovis
YEEPAFDIFALVPPPVG

SEQ ID NO: 208753 - protein, 18 aa, Mycobacterium bovis
YEGLTANEALYDWNYQRQ

SEQ ID NO: 208754 - protein, 27 aa, Mycobacterium bovis
YEKACKRGEVTIGKMFVVDTGQLDGPK

SEQ ID NO: 208755 - protein, 19 aa, Mycobacterium bovis
YELEEARPWARIHAPNIAE

SEQ ID NO: 208756 - protein, 19 aa, Mycobacterium bovis
YELLGRGDTLGVFQLDGGP

SEQ ID NO: 208757 - protein, 25 aa, Mycobacterium bovis
YELVDARLSAAGFAWYEVSNWCRPG

SEQ ID NO: 208758 - protein, 17 aa, Mycobacterium bovis
YEPEPGKPAPAAVSAGM

SEQ ID NO: 208759 - protein, 32 aa, Mycobacterium bovis
YEPETSVALGFGFRCGFLGLLHMEITRERLER

SEQ ID NO: 208760 - protein, 21 aa, Mycobacterium bovis
YEPWTMLGNLAFGLPSRLRLG

SEQ ID NO: 208761 - protein, 20 aa, Mycobacterium bovis
YERATAQRFADWLVRVVEAF

SEQ ID NO: 208762 - protein, 19 aa, Mycobacterium bovis
YERHIACTRLPDLRESMRR

SEQ ID NO: 208763 - protein, 19 aa, Mycobacterium bovis
YERLGIPTIATVPWTTDRL

SEQ ID NO: 208764 - protein, 30 aa, Mycobacterium bovis
YERPANLFVAGFIGSPAMNFFPARLTAIGL

SEQ ID NO: 208765 - protein, 23 aa, Mycobacterium bovis
YERWKETAFQYGWLLATADSDRY

SEQ ID NO: 208766 - protein, 18 aa, Mycobacterium bovis
YEVHFACDPRFNKLLGPL

SEQ ID NO: 208767 - protein, 27 aa, Mycobacterium bovis
YEVKGCIAHGGLGWIYLALDRNVNGRP

SEQ ID NO: 208768 - protein, 23 aa, Mycobacterium bovis
YEVLQRVPSFDVVFVGHRRGEVR

SEQ ID NO: 208769 - protein, 23 aa, Mycobacterium bovis
YEVTALNFMPGWLDMLLEVGGGR

SEQ ID NO: 208770 - protein, 24 aa, Mycobacterium bovis
YEWPEDRQSLSWTLESSSLLKSLE

SEQ ID NO: 208771 - protein, 18 aa, Mycobacterium bovis
YFAELCGVDRQAADEVIE

SEQ ID NO: 208772 - protein, 17 aa, Mycobacterium bovis
YFASIGISLDSRLRVLA

SEQ ID NO: 208773 - protein, 25 aa, Mycobacterium bovis
YFGDLRTGMMGVWIGAIQNMYPELG

SEQ ID NO: 208774 - protein, 19 aa, Mycobacterium bovis
YFGDRRKAFLEDLAVVTGG

SEQ ID NO: 208775 - protein, 18 aa, Mycobacterium bovis
YFLDMGWEDIMLAVEYDG

SEQ ID NO: 208776 - protein, 24 aa, Mycobacterium bovis
YFLGCRMDSMFPLGPSLATRASTS

SEQ ID NO: 208777 - protein, 20 aa, Mycobacterium bovis
YFLSRLDEWENVIAGRIAEA

SEQ ID NO: 208778 - protein, 24 aa, Mycobacterium bovis
YFRTKRWPDVLAQFPEATQWRHPE

SEQ ID NO: 208779 - protein, 24 aa, Mycobacterium bovis
YFTKLRIPGARVIPTIYFLRHSTD

SEQ ID NO: 208780 - protein, 18 aa, Mycobacterium bovis
YGAAGFAVLERTIAELRA

SEQ ID NO: 208781 - protein, 23 aa, Mycobacterium bovis
YGAALRFAPPLVITAQEIDCAVR

SEQ ID NO: 208782 - protein, 23 aa, Mycobacterium bovis
YGACPECSGLGIRKEVDPELVVP

SEQ ID NO: 208783 - protein, 22 aa, Mycobacterium bovis
YGAECATWRNFFLTGAAELRDG

SEQ ID NO: 208784 - protein, 18 aa, Mycobacterium bovis
YGAVWQREDVGVITTMID

SEQ ID NO: 208785 - protein, 21 aa, Mycobacterium bovis
YGDCSKLAAITGWQQEICLTQ

SEQ ID NO: 208786 - protein, 17 aa, Mycobacterium bovis
YGDLFPHAVKWRGTTYL

SEQ ID NO: 208787 - protein, 24 aa, Mycobacterium bovis
YGDTKLGLFPFRRNLSFYAVDLGL

SEQ ID NO: 208788 - protein, 18 aa, Mycobacterium bovis
YGDYRYAVNNSFGFGGHN

SEQ ID NO: 208789 - protein, 24 aa, Mycobacterium bovis
YGEMWAQDTMAMFGYASSSATASR

SEQ ID NO: 208790 - protein, 17 aa, Mycobacterium bovis
YGGVEFYSAIAAGSPER

SEQ ID NO: 208791 - protein, 21 aa, Mycobacterium bovis
YGKKLSWADLIVFAGNCALES

SEQ ID NO: 208792 - protein, 18 aa, Mycobacterium bovis
YGLAAADGVMRWLEEHRR

SEQ ID NO: 208793 - protein, 17 aa, Mycobacterium bovis
YGLAEATLYVASRNSGD

SEQ ID NO: 208794 - protein, 24 aa, Mycobacterium bovis
YGLAWRTKRLIVFDVDSTLVQGEV

SEQ ID NO: 208795 - protein, 17 aa, Mycobacterium bovis
YGLDGRLRGAPHMAANL

SEQ ID NO: 208796 - protein, 21 aa, Mycobacterium bovis
YGLDPERIWTTVYFDDDEAVR

SEQ ID NO: 208797 - protein, 19 aa, Mycobacterium bovis
YGLTYPGVGFVVWRGPEHL

SEQ ID NO: 208798 - protein, 17 aa, Mycobacterium bovis
YGMPRIAVYSATKHAVK

SEQ ID NO: 208799 - protein, 17 aa, Mycobacterium bovis
YGPAFQGLVAIWRRGSE

SEQ ID NO: 208800 - protein, 17 aa, Mycobacterium bovis
YGPWECDGVRRAGVSSF

SEQ ID NO: 208801 - protein, 19 aa, Mycobacterium bovis
YGQHVALDFVGRIRGQKKF

SEQ ID NO: 208802 - protein, 18 aa, Mycobacterium bovis
YGQVKFSNLKARAAVGAL

SEQ ID NO: 208803 - protein, 23 aa, Mycobacterium bovis
YGSASILPITWAYIRMMGAEGLR

SEQ ID NO: 208804 - protein, 29 aa, Mycobacterium bovis
YGSVLSGLAALHWRGPAAESMAVTAAPYI

SEQ ID NO: 208805 - protein, 17 aa, Mycobacterium bovis
YGTGAFITGSMNNGLLW

SEQ ID NO: 208806 - protein, 17 aa, Mycobacterium bovis
YGVCSLDAIGGQTIGDT

SEQ ID NO: 208807 - protein, 25 aa, Mycobacterium bovis
YGVHLMCSAGGWIHGQRQSLLQNVT

SEQ ID NO: 208808 - protein, 18 aa, Mycobacterium bovis
YGVHPVLLDACFQSVAAH

SEQ ID NO: 208809 - protein, 24 aa, Mycobacterium bovis
YGVPFPNNACRVVADSGDDCPDWV

SEQ ID NO: 208810 - protein, 24 aa, Mycobacterium bovis
YGVVADPFGHHWSLGQPVREVNMD

SEQ ID NO: 208811 - protein, 17 aa, Mycobacterium bovis
YGYDYVTGCVSVPIGGD

SEQ ID NO: 208812 - protein, 17 aa, Mycobacterium bovis
YGYRFGTAGSRLDDLAA

SEQ ID NO: 208813 - protein, 18 aa, Mycobacterium bovis
YHALRASNRIAIERGTHF

SEQ ID NO: 208814 - protein, 18 aa, Mycobacterium bovis
YHALTWGPLMREIVYAAT

SEQ ID NO: 208815 - protein, 24 aa, Mycobacterium bovis
YHDHPRFQVPHVVASAPKVVIQEW

SEQ ID NO: 208816 - protein, 23 aa, Mycobacterium bovis
YHDVLRLPVDLVVTEKFAADSPP

SEQ ID NO: 208817 - protein, 18 aa, Mycobacterium bovis
YHEFWSCTVSILDSKVID

SEQ ID NO: 208818 - protein, 26 aa, Mycobacterium bovis
YHELEAMPDLVARVIAATGPVAELAH

SEQ ID NO: 208819 - protein, 26 aa, Mycobacterium bovis
YHGVVFAELGPPAFALKARVQLLRDY

SEQ ID NO: 208820 - protein, 18 aa, Mycobacterium bovis
YHRRAGLTAERFVADPFN

SEQ ID NO: 208821 - protein, 25 aa, Mycobacterium bovis
YHSVRRWPRRGLRSLLTITIGDLVE

SEQ ID NO: 208822 - protein, 23 aa, Mycobacterium bovis
YHYYASKSLILFDIYRQAAEGTL

SEQ ID NO: 208823 - protein, 17 aa, Mycobacterium bovis
YIAALLWFGEFSGCGIK

SEQ ID NO: 208824 - protein, 17 aa, Mycobacterium bovis
YIEFNSLVDRGYWDDDE

SEQ ID NO: 208825 - protein, 19 aa, Mycobacterium bovis
YIGEICRYLLNQPAKPTDR

SEQ ID NO: 208826 - protein, 17 aa, Mycobacterium bovis
YIGSKPSPFAWIPFGGG

SEQ ID NO: 208827 - protein, 17 aa, Mycobacterium bovis
YILGAGMHPWGKWGNDF

SEQ ID NO: 208828 - protein, 17 aa, Mycobacterium bovis
YILRRLKTDPAIIDDLP

SEQ ID NO: 208829 - protein, 17 aa, Mycobacterium bovis
YISYLRKKIDSDREPMI

SEQ ID NO: 208830 - protein, 18 aa, Mycobacterium bovis
YITARFLPDKAIDLVDEA

SEQ ID NO: 208831 - protein, 24 aa, Mycobacterium bovis
YITKSGHDYTWFVLNAKIIEKEFA

SEQ ID NO: 208832 - protein, 20 aa, Mycobacterium bovis
YKIRGVAAVTFYGRGRLVSA

SEQ ID NO: 208833 - protein, 20 aa, Mycobacterium bovis
YKLWHPRAHLSARWKDGDQD

SEQ ID NO: 208834 - protein, 22 aa, Mycobacterium bovis
YKMVFGHRGINIPVVDHATGRV

SEQ ID NO: 208835 - protein, 26 aa, Mycobacterium bovis
YKPPAARCPLCPGPTGLSSEVPAPDY

SEQ ID NO: 208836 - protein, 26 aa, Mycobacterium bovis
YKSYRGMGSLGAMRGRGGATSYSKDR

SEQ ID NO: 208837 - protein, 23 aa, Mycobacterium bovis
YKVGLGSVRYLLAVGDLLIGWRL

SEQ ID NO: 208838 - protein, 28 aa, Mycobacterium bovis
YLALLDALRWLGLDWDEGPEVGGPYGPY

SEQ ID NO: 208839 - protein, 18 aa, Mycobacterium bovis
YLCALPEPARAVVDYLAI

SEQ ID NO: 208840 - protein, 19 aa, Mycobacterium bovis
YLDAASLSPFVTWGTNPGQ

SEQ ID NO: 208841 - protein, 24 aa, Mycobacterium bovis
YLEKTRGAIDFNRPGIPIIASLPS

SEQ ID NO: 208842 - protein, 19 aa, Mycobacterium bovis
YLGAIGMAAVEAHERELVA

SEQ ID NO: 208843 - protein, 20 aa, Mycobacterium bovis
YLGEKICAAVVFAGAPITLA

SEQ ID NO: 208844 - protein, 24 aa, Mycobacterium bovis
YLHGAYPGARCFLVNNGDITEDLP

SEQ ID NO: 208845 - protein, 19 aa, Mycobacterium bovis
YLLAVGDLLIGWRLLVLAG

SEQ ID NO: 208846 - protein, 18 aa, Mycobacterium bovis
YLLEETYELLDAVRSGSV

SEQ ID NO: 208847 - protein, 17 aa, Mycobacterium bovis
YLLEPVSVWAPECSEDL

SEQ ID NO: 208848 - protein, 17 aa, Mycobacterium bovis
YLLGLALAQARGTKYPD

SEQ ID NO: 208849 - protein, 25 aa, Mycobacterium bovis
YLLGSRSALGWIIDRYRVTTDKASG

SEQ ID NO: 208850 - protein, 17 aa, Mycobacterium bovis
YLMRALPRVARAVSSNP

SEQ ID NO: 208851 - protein, 23 aa, Mycobacterium bovis
YLMVSLRSLPLVMLIGRPEAQIP

SEQ ID NO: 208852 - protein, 17 aa, Mycobacterium bovis
YLPGCWLDSGPFGCLGS

SEQ ID NO: 208853 - protein, 25 aa, Mycobacterium bovis
YLPHAPWPWGVIDQAARVLLPASTT

SEQ ID NO: 208854 - protein, 20 aa, Mycobacterium bovis
YLQRWRRRRALWVGVTLGGA

SEQ ID NO: 208855 - protein, 17 aa, Mycobacterium bovis
YLRCLRVLTAGRGYPMV

SEQ ID NO: 208856 - protein, 24 aa, Mycobacterium bovis
YLRMDDFPARLVVVPGEHDRLLEA

SEQ ID NO: 208857 - protein, 25 aa, Mycobacterium bovis
YLRPDELHLGFNFRLARTEFDAAEI

SEQ ID NO: 208858 - protein, 17 aa, Mycobacterium bovis
YLSEASMALLYPDSDNA

SEQ ID NO: 208859 - protein, 18 aa, Mycobacterium bovis
YLTDMAHKYGIDRHIEFN

SEQ ID NO: 208860 - protein, 24 aa, Mycobacterium bovis
YLTQCCYTMRTIFDVKPDSDVFWC

SEQ ID NO: 208861 - protein, 18 aa, Mycobacterium bovis
YMIGSSFGSIIGSLVARE

SEQ ID NO: 208862 - protein, 25 aa, Mycobacterium bovis
YMIRVKEMWESMKIVEQCLDKLRPG

SEQ ID NO: 208863 - protein, 17 aa, Mycobacterium bovis
YMSKIFNDAWMSSYGFL

SEQ ID NO: 208864 - protein, 20 aa, Mycobacterium bovis
YNAVCSVYGHLHIPRTTWYD

SEQ ID NO: 208865 - protein, 22 aa, Mycobacterium bovis
YNKLFEERIIFLGVQVDDASAN

SEQ ID NO: 208866 - protein, 17 aa, Mycobacterium bovis
YNLQWKPVGGFPVTFGW

SEQ ID NO: 208867 - protein, 18 aa, Mycobacterium bovis
YNPGHLMVVPYRRVSELE

SEQ ID NO: 208868 - protein, 27 aa, Mycobacterium bovis
YNPLRFLRAAMKWCRKAQELGTLDEDA

SEQ ID NO: 208869 - protein, 21 aa, Mycobacterium bovis
YNRGWFPQVFSIIDGQKVGVT

SEQ ID NO: 208870 - protein, 18 aa, Mycobacterium bovis
YNRKALDPAQVVDALLEQ

SEQ ID NO: 208871 - protein, 17 aa, Mycobacterium bovis
YNTFGFFAPHHQYASTR

SEQ ID NO: 208872 - protein, 19 aa, Mycobacterium bovis
YPALTLAQLRARLHTLDVP

SEQ ID NO: 208873 - protein, 26 aa, Mycobacterium bovis
YPARVKCALLGWMAFKDALAQASEAF

SEQ ID NO: 208874 - protein, 21 aa, Mycobacterium bovis
YPDAPKLPAVVGYEVAGTVEA

SEQ ID NO: 208875 - protein, 24 aa, Mycobacterium bovis
YPDLVPRLRFGDIVRVGSADEHLQ

SEQ ID NO: 208876 - protein, 18 aa, Mycobacterium bovis
YPDVRVHRSLVCDKPARW

SEQ ID NO: 208877 - protein, 23 aa, Mycobacterium bovis
YPERPGPVAARYHGRHQLNRYPD

SEQ ID NO: 208878 - protein, 24 aa, Mycobacterium bovis
YPGCKRIVLGHSMGGGIVFAYGVE

SEQ ID NO: 208879 - protein, 19 aa, Mycobacterium bovis
YPGDIKSVLLTAEQIQARI

SEQ ID NO: 208880 - protein, 17 aa, Mycobacterium bovis
YPGGVVMAGDRRSTQGN

SEQ ID NO: 208881 - protein, 20 aa, Mycobacterium bovis
YPGRRYYGGCEFVDGVEQLA

SEQ ID NO: 208882 - protein, 19 aa, Mycobacterium bovis
YPGSNVALCVGMCGQLIYV

SEQ ID NO: 208883 - protein, 22 aa, Mycobacterium bovis
YPIETLDGITLFGRPTMTTPFI

SEQ ID NO: 208884 - protein, 23 aa, Mycobacterium bovis
YPKVVLVTGACRFLGGYLTARLA

SEQ ID NO: 208885 - protein, 17 aa, Mycobacterium bovis
YPMVYDMPARAKDAFGA

SEQ ID NO: 208886 - protein, 20 aa, Mycobacterium bovis
YPNQRLRLETSTERLTTRVI

SEQ ID NO: 208887 - protein, 21 aa, Mycobacterium bovis
YPPEAIDWLLPAAARRVLDLG

SEQ ID NO: 208888 - protein, 19 aa, Mycobacterium bovis
YPPGARCLVHESMAEGLAA

SEQ ID NO: 208889 - protein, 21 aa, Mycobacterium bovis
YPRQLDFARFRAIADEVDAVL

SEQ ID NO: 208890 - protein, 17 aa, Mycobacterium bovis
YPSLSVALGEEITPQTT

SEQ ID NO: 208891 - protein, 22 aa, Mycobacterium bovis
YPSTLGYKGFPKSCCTSLNEVI

SEQ ID NO: 208892 - protein, 24 aa, Mycobacterium bovis
YPTASALAECLGQLLGGQHESSDD

SEQ ID NO: 208893 - protein, 20 aa, Mycobacterium bovis
YPVDLRFVLAPPVAPTEATN

SEQ ID NO: 208894 - protein, 23 aa, Mycobacterium bovis
YPVEVWGWDEAYLAVAPGTPDDP

SEQ ID NO: 208895 - protein, 23 aa, Mycobacterium bovis
YPVKRGDTVLVHAGAGGVGLILT

SEQ ID NO: 208896 - protein, 20 aa, Mycobacterium bovis
YPYLPSHPQYDLAKRQMSGG

SEQ ID NO: 208897 - protein, 27 aa, Mycobacterium bovis
YQAAMFDGRFVGFADFLIRDGHRYRVA

SEQ ID NO: 208898 - protein, 18 aa, Mycobacterium bovis
YQDYQSWTDRTIPIVVCE

SEQ ID NO: 208899 - protein, 29 aa, Mycobacterium bovis
YQHPTRLHWYVPRSIRWIDRLKGVSPEFV

SEQ ID NO: 208900 - protein, 17 aa, Mycobacterium bovis
YQIYRLDAVPNTAKLPY

SEQ ID NO: 208901 - protein, 20 aa, Mycobacterium bovis
YQMYRLLAVAKYEERYVIPT

SEQ ID NO: 208902 - protein, 17 aa, Mycobacterium bovis
YQPGRRCASWVKDKHWN

SEQ ID NO: 208903 - protein, 18 aa, Mycobacterium bovis
YQPKVWAACRARGQDPDK

SEQ ID NO: 208904 - protein, 25 aa, Mycobacterium bovis
YQPLWEPKIPLGRLGRPEELAGLYL

SEQ ID NO: 208905 - protein, 19 aa, Mycobacterium bovis
YQSAGHRVLAFFVSACSAP

SEQ ID NO: 208906 - protein, 24 aa, Mycobacterium bovis
YRAFNERSGMRFGQVQTRLTENAD

SEQ ID NO: 208907 - protein, 18 aa, Mycobacterium bovis
YRAGMAMGTTLQVPPQMW

SEQ ID NO: 208908 - protein, 17 aa, Mycobacterium bovis
YRALGGIDGRYPKIKQW

SEQ ID NO: 208909 - protein, 18 aa, Mycobacterium bovis
YRDYIGWLAGRDQTASRA

SEQ ID NO: 208910 - protein, 17 aa, Mycobacterium bovis
YRFLLRRNRRLYGVAYT

SEQ ID NO: 208911 - protein, 20 aa, Mycobacterium bovis
YRFNFGVAYDRSLLFGYALD

SEQ ID NO: 208912 - protein, 23 aa, Mycobacterium bovis
YRFRRLELARFLAALHATVLDNP

SEQ ID NO: 208913 - protein, 21 aa, Mycobacterium bovis
YRGRDRLLVLGLARGGVPVGW

SEQ ID NO: 208914 - protein, 17 aa, Mycobacterium bovis
YRITPLALWNARAAGHD

SEQ ID NO: 208915 - protein, 20 aa, Mycobacterium bovis
YRLDGVKSLIPAAADAELFI

SEQ ID NO: 208916 - protein, 20 aa, Mycobacterium bovis
YRLIPKHSIGMALDDCHDGY

SEQ ID NO: 208917 - protein, 17 aa, Mycobacterium bovis
YRMDSGATIAVRITVDR

SEQ ID NO: 208918 - protein, 18 aa, Mycobacterium bovis
YRMTGSLHDAEDLVQETL

SEQ ID NO: 208919 - protein, 20 aa, Mycobacterium bovis
YRNNWKRLGFTDDEVSRPGS

SEQ ID NO: 208920 - protein, 23 aa, Mycobacterium bovis
YRPEHNVTVGLVFRARTSESELL

SEQ ID NO: 208921 - protein, 17 aa, Mycobacterium bovis
YRPHRSAVLTASLTSPR

SEQ ID NO: 208922 - protein, 25 aa, Mycobacterium bovis
YRPSHEKLAWARRVLAASRSERGAF

SEQ ID NO: 208923 - protein, 18 aa, Mycobacterium bovis
YRPTPSANSIAWLLWHSA

SEQ ID NO: 208924 - protein, 24 aa, Mycobacterium bovis
YRPWAGEIRARHTGSLVSDRAGAI

SEQ ID NO: 208925 - protein, 22 aa, Mycobacterium bovis
YRQLDYWARTSLVVPSIRSAAG

SEQ ID NO: 208926 - protein, 17 aa, Mycobacterium bovis
YRRCRRALRQIGVLERP

SEQ ID NO: 208927 - protein, 27 aa, Mycobacterium bovis
YRRFLERRLRETFGFDGSPIRVNVRVR

SEQ ID NO: 208928 - protein, 18 aa, Mycobacterium bovis
YRRLDLWLDDYLGTHNDT

SEQ ID NO: 208929 - protein, 17 aa, Mycobacterium bovis
YRRLPVGIVANGVLTRT

SEQ ID NO: 208930 - protein, 17 aa, Mycobacterium bovis
YRSGARHVPRLQRRTLP

SEQ ID NO: 208931 - protein, 19 aa, Mycobacterium bovis
YRTLLEFFFQIHDPTTKDR

SEQ ID NO: 208932 - protein, 18 aa, Mycobacterium bovis
YRVFTELTPHPLLTHAVD

SEQ ID NO: 208933 - protein, 21 aa, Mycobacterium bovis
YRYFPEPDLEPVAPSRELVER

SEQ ID NO: 208934 - protein, 17 aa, Mycobacterium bovis
YSCKGCRYLIDAQYSAT

SEQ ID NO: 208935 - protein, 23 aa, Mycobacterium bovis
YSDSPSVEAFSRMFERDKNELRD

SEQ ID NO: 208936 - protein, 24 aa, Mycobacterium bovis
YSEYPRFHKLMAEMSGMVFDAALI

SEQ ID NO: 208937 - protein, 23 aa, Mycobacterium bovis
YSGLLEHLASWGIVAAAPDSERG

SEQ ID NO: 208938 - protein, 18 aa, Mycobacterium bovis
YSGVPVRVCRTGYTGEHG

SEQ ID NO: 208939 - protein, 26 aa, Mycobacterium bovis
YSLARWRKADAALGRPVVSNQVHFSL

SEQ ID NO: 208940 - protein, 27 aa, Mycobacterium bovis
YSLDVPRITILDAHFTGAFGPVVVPPI

SEQ ID NO: 208941 - protein, 27 aa, Mycobacterium bovis
YSLDVPRITIVDAHLDGGFGPVVLPPI

SEQ ID NO: 208942 - protein, 26 aa, Mycobacterium bovis
YSPAELACALGLFPPTAEQAAVIAAP

SEQ ID NO: 208943 - protein, 24 aa, Mycobacterium bovis
YSPRLDRLAAEGILFTRAHATAPL

SEQ ID NO: 208944 - protein, 21 aa, Mycobacterium bovis
YSPRVEGVHLRFGPVARGGLR

SEQ ID NO: 208945 - protein, 17 aa, Mycobacterium bovis
YSRDAKFTPAREALDNP

SEQ ID NO: 208946 - protein, 19 aa, Mycobacterium bovis
YSRVRVDGVVHPLTDPPKL

SEQ ID NO: 208947 - protein, 18 aa, Mycobacterium bovis
YSTIKILSGMQFARNYIT

SEQ ID NO: 208948 - protein, 20 aa, Mycobacterium bovis
YSTILPKCRAVVHHGGAGTT

SEQ ID NO: 208949 - protein, 19 aa, Mycobacterium bovis
YSVAMARFVETFARVLGDP

SEQ ID NO: 208950 - protein, 22 aa, Mycobacterium bovis
YSVRSRQSWGIGDLTDLANLAL

SEQ ID NO: 208951 - protein, 18 aa, Mycobacterium bovis
YSYLVSLLPSRIVADLGA

SEQ ID NO: 208952 - protein, 24 aa, Mycobacterium bovis
YTAELAARLERTWQENWARLGTFN

SEQ ID NO: 208953 - protein, 19 aa, Mycobacterium bovis
YTAKPGAFRRPNGQAFSSH

SEQ ID NO: 208954 - protein, 28 aa, Mycobacterium bovis
YTATEIANAAAMRVVLGAVNAPTQTLLG

SEQ ID NO: 208955 - protein, 27 aa, Mycobacterium bovis
YTEEMPVAVPWSLPAARSAHAGNDAPV

SEQ ID NO: 208956 - protein, 23 aa, Mycobacterium bovis
YTGELAGGFAFVPGHETVGTIAA

SEQ ID NO: 208957 - protein, 23 aa, Mycobacterium bovis
YTIKRLPGKLVRFMKTDTGQRKV

SEQ ID NO: 208958 - protein, 19 aa, Mycobacterium bovis
YTIPISALTRGGRVDRLVQ

SEQ ID NO: 208959 - protein, 28 aa, Mycobacterium bovis
YTKGYKFSTYATWWIRQAITRAMADQAR

SEQ ID NO: 208960 - protein, 20 aa, Mycobacterium bovis
YTLRFKDLRTGEQYPDEIAG

SEQ ID NO: 208961 - protein, 22 aa, Mycobacterium bovis
YTLRLPLDVLVVASANPEDYTN

SEQ ID NO: 208962 - protein, 28 aa, Mycobacterium bovis
YTLTGPIVIGSFFLPAFNIPGIDVPAIN

SEQ ID NO: 208963 - protein, 20 aa, Mycobacterium bovis
YTNFEELCDIFARYDVTFSL

SEQ ID NO: 208964 - protein, 17 aa, Mycobacterium bovis
YTPLAWWGSSTQRVRLG

SEQ ID NO: 208965 - protein, 19 aa, Mycobacterium bovis
YTQSRWWSERGWQHRQRAG

SEQ ID NO: 208966 - protein, 24 aa, Mycobacterium bovis
YTRTLDILERFYGLVLTDCGTGLL

SEQ ID NO: 208967 - protein, 25 aa, Mycobacterium bovis
YTSADIRALYAFKRYAWWPYTLVMR

SEQ ID NO: 208968 - protein, 17 aa, Mycobacterium bovis
YTSEWKIRNLVKKYSDF

SEQ ID NO: 208969 - protein, 23 aa, Mycobacterium bovis
YVAAHTPYLAWLVQASANSAAMA

SEQ ID NO: 208970 - protein, 18 aa, Mycobacterium bovis
YVDHGWPTTDPDDHAVSE

SEQ ID NO: 208971 - protein, 17 aa, Mycobacterium bovis
YVEGCLPAGELITTADG

SEQ ID NO: 208972 - protein, 26 aa, Mycobacterium bovis
YVEILPTPFLPAGVFDLWGLEADDSR

SEQ ID NO: 208973 - protein, 17 aa, Mycobacterium bovis
YVHGFLRERMQMLQDEF

SEQ ID NO: 208974 - protein, 20 aa, Mycobacterium bovis
YVHNRLLTLLLFDIGSFAGL

SEQ ID NO: 208975 - protein, 25 aa, Mycobacterium bovis
YVINPRMVRGLDYYTKTAFEFVHDG

SEQ ID NO: 208976 - protein, 17 aa, Mycobacterium bovis
YVPCEVCQGARYNRETL

SEQ ID NO: 208977 - protein, 21 aa, Mycobacterium bovis
YVQRMGKLLGGQLWESAGSPE

SEQ ID NO: 208978 - protein, 18 aa, Mycobacterium bovis
YVRDRTGDPNAWQTGLTP

SEQ ID NO: 208979 - protein, 20 aa, Mycobacterium bovis
YVVAELDYLVATRVGVDAEL

SEQ ID NO: 208980 - protein, 18 aa, Mycobacterium bovis
YVVALPMRVRFRGITTRE

SEQ ID NO: 208981 - protein, 20 aa, Mycobacterium bovis
YWDDDECRWHVFTADGREYV

SEQ ID NO: 208982 - protein, 20 aa, Mycobacterium bovis
YWDKISVDLKPIYTAASAAE

SEQ ID NO: 208983 - protein, 23 aa, Mycobacterium bovis
YWDRVLFDAGLSVITWPAKYGGR

SEQ ID NO: 208984 - protein, 19 aa, Mycobacterium bovis
YWELPAMMLQFLRTGSGAT

SEQ ID NO: 208985 - protein, 17 aa, Mycobacterium bovis
YWGIIKADIGIRDGRIV

SEQ ID NO: 208986 - protein, 18 aa, Mycobacterium bovis
YWLQEFHIDGLRVDAVAS

SEQ ID NO: 208987 - protein, 24 aa, Mycobacterium bovis
YWVEHVRKPVRFFDGVGLAESLGA

SEQ ID NO: 208988 - protein, 24 aa, Mycobacterium bovis
YWVGNHCKRVFVEAVDVVSGIGYD

SEQ ID NO: 208989 - protein, 25 aa, Mycobacterium bovis
YYEKGLRDVIRYHVSMTSSVNFPDQ

SEQ ID NO: 208990 - protein, 26 aa, Mycobacterium bovis
YYHAELEWWTSPFVLAHGVPPDTLAS

SEQ ID NO: 208991 - protein, 17 aa, Mycobacterium bovis
YYLMGFDIASFTPIFVM

SEQ ID NO: 208992 - protein, 17 aa, Mycobacterium bovis
YYLSFLLDRANRTYLAM

SEQ ID NO: 208993 - protein, 20 aa, Mycobacterium bovis
YYRPELDGLPEMGLVGRQLW

SEQ ID NO: 208994 - protein, 21 aa, Mycobacterium bovis
YYTICELLHRHGFAGATVLLG

SEQ ID NO: 208995 - protein, 19 aa, Mycobacterium bovis
YYTKTAFEFVHDGLGAQSG

SEQ ID NO: 208996 - protein, 17 aa, Mycobacterium bovis
AAAAPYAGWLAAAATQA

SEQ ID NO: 208997 - protein, 20 aa, Mycobacterium bovis
AAAGDGIRSAYQGVQAGSTG

SEQ ID NO: 208998 - protein, 19 aa, Mycobacterium bovis
AAALWLVAPCTELYHDSRA

SEQ ID NO: 208999 - protein, 23 aa, Mycobacterium bovis
AAAPPRFDGLRALFINATLKRSP

SEQ ID NO: 209000 - protein, 18 aa, Mycobacterium bovis
AADCALFVIAANEGVDEP

SEQ ID NO: 209001 - protein, 28 aa, Mycobacterium bovis
AAGAGYADMTAIFLGSSGTPGEDGGNGG

SEQ ID NO: 209002 - protein, 27 aa, Mycobacterium bovis
AAGDARPPFWQNLAELGWLGLHIDERH

SEQ ID NO: 209003 - protein, 27 aa, Mycobacterium bovis
AAGKPLLGICGGFQMLGRVIRDPYGIE

SEQ ID NO: 209004 - protein, 17 aa, Mycobacterium bovis
AAGPAWFDIAGVRMAPA

SEQ ID NO: 209005 - protein, 19 aa, Mycobacterium bovis
AAHPGRPDVLTAWMDAAVI

SEQ ID NO: 209006 - protein, 24 aa, Mycobacterium bovis
AAHRRAHGLPAISLGWGLWDQASA

SEQ ID NO: 209007 - protein, 22 aa, Mycobacterium bovis
AAKLLRRKRFDIVGPPHHVEVE

SEQ ID NO: 209008 - protein, 21 aa, Mycobacterium bovis
AAKVWICKPVIPKPRGWSNVS

SEQ ID NO: 209009 - protein, 17 aa, Mycobacterium bovis
AALLKLPVANWPALGGM

SEQ ID NO: 209010 - protein, 18 aa, Mycobacterium bovis
AALMCYEAHIAGLGDNVA

SEQ ID NO: 209011 - protein, 23 aa, Mycobacterium bovis
AANARLALYSGGDYLLRRLTAEP

SEQ ID NO: 209012 - protein, 28 aa, Mycobacterium bovis
AARAPRVSAVIKVDWRPGVTDAMTQKVA

SEQ ID NO: 209013 - protein, 17 aa, Mycobacterium bovis
AARFVRTCDCFNIPIVM

SEQ ID NO: 209014 - protein, 21 aa, Mycobacterium bovis
AARTRYFDAFFRDATSAGIRQ

SEQ ID NO: 209015 - protein, 18 aa, Mycobacterium bovis
AATVHPMLVAANRNAFVQ

SEQ ID NO: 209016 - protein, 21 aa, Mycobacterium bovis
AAVAVEFARLYAVELEHYEKL

SEQ ID NO: 209017 - protein, 26 aa, Mycobacterium bovis
AAVGRRRLRGTINVVLPVPGDVRGLA

SEQ ID NO: 209018 - protein, 28 aa, Mycobacterium bovis
AAVSPLLDPINEFFLANTGRPLIGNGAN

SEQ ID NO: 209019 - protein, 26 aa, Mycobacterium bovis
AAVSWAERRRMFELPRSSWGDYDRSL

SEQ ID NO: 209020 - protein, 19 aa, Mycobacterium bovis
AAYEKAYHAEPFIYLMPEG

SEQ ID NO: 209021 - protein, 23 aa, Mycobacterium bovis
ADARRLAPGGAIVVGGAAGSSAL

SEQ ID NO: 209022 - protein, 18 aa, Mycobacterium bovis
ADDATGYQARWAEAVNAL

SEQ ID NO: 209023 - protein, 25 aa, Mycobacterium bovis
ADDRYAFSFSGLKTAVARYVESHAA

SEQ ID NO: 209024 - protein, 24 aa, Mycobacterium bovis
ADFKRPAPHWWFDDATLYGPDGLA

SEQ ID NO: 209025 - protein, 21 aa, Mycobacterium bovis
ADFVGELWAGLRAADCALFVI

SEQ ID NO: 209026 - protein, 21 aa, Mycobacterium bovis
ADGMFPPMHIDAEYNADGSLR

SEQ ID NO: 209027 - protein, 22 aa, Mycobacterium bovis
ADHHPRELLVVGIATFDQKRPA

SEQ ID NO: 209028 - protein, 18 aa, Mycobacterium bovis
ADLRAIRAHQDCMEARTD

SEQ ID NO: 209029 - protein, 26 aa, Mycobacterium bovis
ADPALALELGTYLGYSALRIARAAPE

SEQ ID NO: 209030 - protein, 25 aa, Mycobacterium bovis
ADPERTAELATRFGVESSIARLQKA

SEQ ID NO: 209031 - protein, 21 aa, Mycobacterium bovis
ADRYRRLHVIIGDANLAETST

SEQ ID NO: 209032 - protein, 21 aa, Mycobacterium bovis
ADSVAVCRGVRAVARARLVER

SEQ ID NO: 209033 - protein, 22 aa, Mycobacterium bovis
ADVTWLDCLGIPTVQAVRPASL

SEQ ID NO: 209034 - protein, 26 aa, Mycobacterium bovis
ADVVIPKLERLVAMHPYRESLWKQLM

SEQ ID NO: 209035 - protein, 24 aa, Mycobacterium bovis
AEAAAAAPLEGLLNIVNTPTQLLL

SEQ ID NO: 209036 - protein, 18 aa, Mycobacterium bovis
AEALLRWEHPTLGTLLPG

SEQ ID NO: 209037 - protein, 18 aa, Mycobacterium bovis
AEAQRIVVLSGDQLDALC

SEQ ID NO: 209038 - protein, 24 aa, Mycobacterium bovis
AEFDRAGADIVLLDLMLPGMSGTD

SEQ ID NO: 209039 - protein, 21 aa, Mycobacterium bovis
AEFGCKEALFTLGDRPEARWR

SEQ ID NO: 209040 - protein, 27 aa, Mycobacterium bovis
AEFGLVLGWRCSWCPSGTRGNGKLSMR

SEQ ID NO: 209041 - protein, 19 aa, Mycobacterium bovis
AEGLVSLAASVQPLRAAAG

SEQ ID NO: 209042 - protein, 18 aa, Mycobacterium bovis
AELGRMYVHHGVVVVEQK

SEQ ID NO: 209043 - protein, 18 aa, Mycobacterium bovis
AEMIRACRPITVPLTQAQ

SEQ ID NO: 209044 - protein, 20 aa, Mycobacterium bovis
AEMWAQDAMAMYGYAGSSAT

SEQ ID NO: 209045 - protein, 20 aa, Mycobacterium bovis
AENRAELMILTATNLLGQNT

SEQ ID NO: 209046 - protein, 26 aa, Mycobacterium bovis
AEPSGWAYWVAESLLGPGTQLADLKL

SEQ ID NO: 209047 - protein, 17 aa, Mycobacterium bovis
AERKDLFTKLLAAETGQ

SEQ ID NO: 209048 - protein, 26 aa, Mycobacterium bovis
AERYGLRHRIRFGATVVSARFDDGRW

SEQ ID NO: 209049 - protein, 18 aa, Mycobacterium bovis
AESFSEVHPLPGRDLMPV

SEQ ID NO: 209050 - protein, 28 aa, Mycobacterium bovis
AETLLVVLCGVGFYIGFVGSYQRMATIT

SEQ ID NO: 209051 - protein, 27 aa, Mycobacterium bovis
AEVELAWEILDPALEHWAAHGTPDAYE

SEQ ID NO: 209052 - protein, 24 aa, Mycobacterium bovis
AFDAGDFRWAATLLDHAVFADSEH

SEQ ID NO: 209053 - protein, 18 aa, Mycobacterium bovis
AFEAARAATVHPMLVAAN

SEQ ID NO: 209054 - protein, 17 aa, Mycobacterium bovis
AGARWASRVTGRGAGAM

SEQ ID NO: 209055 - protein, 22 aa, Mycobacterium bovis
AGAVSFRFGDRTQINGVARDDA

SEQ ID NO: 209056 - protein, 38 aa, Mycobacterium bovis
AGDWHLPAPLTLFGHCMGAIVAFEFARLAERNGVPVRA

SEQ ID NO: 209057 - protein, 21 aa, Mycobacterium bovis
AGELLRLARVLGIAATRDRAR

SEQ ID NO: 209058 - protein, 35 aa, Mycobacterium bovis
AGGAAGMLFGAAGVGGPGGFAAAFGATGGAGGAGG

SEQ ID NO: 209059 - protein, 24 aa, Mycobacterium bovis
AGGDGIGGVGGGKGGNGADGEVGG

SEQ ID NO: 209060 - protein, 20 aa, Mycobacterium bovis
AGGEILRLLLGHPAYADGRL

SEQ ID NO: 209061 - protein, 18 aa, Mycobacterium bovis
AGGLYAHGGTGGPGGNGG

SEQ ID NO: 209062 - protein, 20 aa, Mycobacterium bovis
AGGTGIEFGSVGGAGGAGGN

SEQ ID NO: 209063 - protein, 28 aa, Mycobacterium bovis
AGHSFVIFLREGFPINILNPVQAVPEVC

SEQ ID NO: 209064 - protein, 25 aa, Mycobacterium bovis
AGIKLCKKRHRLPGLDFVRGDAENL

SEQ ID NO: 209065 - protein, 19 aa, Mycobacterium bovis
AGLFSIPNPFAVTYYLIKG

SEQ ID NO: 209066 - protein, 23 aa, Mycobacterium bovis
AGLLPVPARKAGRLILVDDQPAD

SEQ ID NO: 209067 - protein, 24 aa, Mycobacterium bovis
AGPRVRTAVLTKLYPTRSHTGAAQ

SEQ ID NO: 209068 - protein, 24 aa, Mycobacterium bovis
AGQLGRPIGFRGLAGGCPVSPLGY

SEQ ID NO: 209069 - protein, 25 aa, Mycobacterium bovis
AGRTERFWVGLSVYRPGGTAEPAPT

SEQ ID NO: 209070 - protein, 35 aa, Mycobacterium bovis
AGSAPMLAASVAWDRLAAELAVAASSFGSVTSGLA

SEQ ID NO: 209071 - protein, 21 aa, Mycobacterium bovis
AGVTYWRKAAQLKRNEANDLR

SEQ ID NO: 209072 - protein, 17 aa, Mycobacterium bovis
AGVWAFGALVDPLEPQA

SEQ ID NO: 209073 - protein, 23 aa, Mycobacterium bovis
AHEGSLRFGDKVVLGRDNVINTY

SEQ ID NO: 209074 - protein, 21 aa, Mycobacterium bovis
AHTFPATRFLGAGAAMSLLPE

SEQ ID NO: 209075 - protein, 19 aa, Mycobacterium bovis
AHWARRTGDPLARRVAAQT

SEQ ID NO: 209076 - protein, 19 aa, Mycobacterium bovis
AIACGRADVVIPKLERLVA

SEQ ID NO: 209077 - protein, 20 aa, Mycobacterium bovis
AIGKAAPVGLFVETFGTETE

SEQ ID NO: 209078 - protein, 28 aa, Mycobacterium bovis
AIPKLRQGSYFPGWLLQRRKRAERALTS

SEQ ID NO: 209079 - protein, 24 aa, Mycobacterium bovis
AIRALRESRDWSLADLAAATGVST

SEQ ID NO: 209080 - protein, 24 aa, Mycobacterium bovis
AIRPDGQGLVAFVGVTHGDDLDKA

SEQ ID NO: 209081 - protein, 29 aa, Mycobacterium bovis
AIVIGCGPIGLAVICMLKSRGVHTVIASD

SEQ ID NO: 209082 - protein, 20 aa, Mycobacterium bovis
AKAVAGAFEAARAAMVDPVV

SEQ ID NO: 209083 - protein, 24 aa, Mycobacterium bovis
AKAVAGAFEAARAAMVDPVVVAAN

SEQ ID NO: 209084 - protein, 18 aa, Mycobacterium bovis
ALAADWRVSGDNVKFGAT

SEQ ID NO: 209085 - protein, 19 aa, Mycobacterium bovis
ALDRGEFFLVYQPIIRLAD

SEQ ID NO: 209086 - protein, 21 aa, Mycobacterium bovis
ALDRMKAIVAQAVLDHVTDEE

SEQ ID NO: 209087 - protein, 24 aa, Mycobacterium bovis
ALGHPFGGSGARLMTTVLHHMPDK

SEQ ID NO: 209088 - protein, 19 aa, Mycobacterium bovis
ALHGAWGVRVHDVRASVDA

SEQ ID NO: 209089 - protein, 18 aa, Mycobacterium bovis
ALPRWRGAAGRLEVWYAT

SEQ ID NO: 209090 - protein, 32 aa, Mycobacterium bovis
ALSGFERFPAWMWRNTVVRDFVEWLRTRNQRY

SEQ ID NO: 209091 - protein, 18 aa, Mycobacterium bovis
ALTAPAPHHTRPTRFVWL

SEQ ID NO: 209092 - protein, 24 aa, Mycobacterium bovis
ALVCKFASRNARRFTLTVGLMLPR

SEQ ID NO: 209093 - protein, 24 aa, Mycobacterium bovis
AMAAAVAPYLGWLAAAAAQAQRSA

SEQ ID NO: 209094 - protein, 26 aa, Mycobacterium bovis
AMAARLKGYRLICVMPENTSVERRQL

SEQ ID NO: 209095 - protein, 18 aa, Mycobacterium bovis
AMEKFDYTKGFKFSTYAT

SEQ ID NO: 209096 - protein, 24 aa, Mycobacterium bovis
AMNLAVVLRATWAVARVLTDRGLA

SEQ ID NO: 209097 - protein, 25 aa, Mycobacterium bovis
AMNLAVVLRATWAVARVLTDRGLAG

SEQ ID NO: 209098 - protein, 21 aa, Mycobacterium bovis
AMPAALRAAQMLAAEWDVAAD

SEQ ID NO: 209099 - protein, 17 aa, Mycobacterium bovis
ANAQWGNNVAILAGDYL

SEQ ID NO: 209100 - protein, 17 aa, Mycobacterium bovis
ANGFILDGYPRSVEQAK

SEQ ID NO: 209101 - protein, 26 aa, Mycobacterium bovis
ANGGAGGAGGWLFGNGGAGGVGGAGG

SEQ ID NO: 209102 - protein, 24 aa, Mycobacterium bovis
APGARLAWREDATWAPHGGESRVD

SEQ ID NO: 209103 - protein, 17 aa, Mycobacterium bovis
APGHMLGGLPLGQLTNS

SEQ ID NO: 209104 - protein, 23 aa, Mycobacterium bovis
APIPGRLFAGPGLSQPSDVLPAD

SEQ ID NO: 209105 - protein, 17 aa, Mycobacterium bovis
APLGYRPARSTAVMSTM

SEQ ID NO: 209106 - protein, 20 aa, Mycobacterium bovis
APLPAWTHARLFIDDDGQEQ

SEQ ID NO: 209107 - protein, 19 aa, Mycobacterium bovis
APMGRAIPYHIGRHSHPKA

SEQ ID NO: 209108 - protein, 19 aa, Mycobacterium bovis
APPDKIWTLIADVRNTGRF

SEQ ID NO: 209109 - protein, 21 aa, Mycobacterium bovis
APRKLLARFFVWLTVGLYDPP

SEQ ID NO: 209110 - protein, 17 aa, Mycobacterium bovis
APVGLFVETFGTETEDP

SEQ ID NO: 209111 - protein, 19 aa, Mycobacterium bovis
APYAGWLAAAATQAEQAAT

SEQ ID NO: 209112 - protein, 27 aa, Mycobacterium bovis
AQCVKAEMLAASSWRVAVNAGADSTGR

SEQ ID NO: 209113 - protein, 17 aa, Mycobacterium bovis
AQLAANVARWPSMTKAR

SEQ ID NO: 209114 - protein, 26 aa, Mycobacterium bovis
AQLRSRSWWSGFDVVLLVDDWHIQPP

SEQ ID NO: 209115 - protein, 25 aa, Mycobacterium bovis
AQMGRDGWLALGWPKEYGGQGRSAM

SEQ ID NO: 209116 - protein, 18 aa, Mycobacterium bovis
AQTLPPGRGLLVGADGDV

SEQ ID NO: 209117 - protein, 17 aa, Mycobacterium bovis
AQWGNNVAILAGDYLLA

SEQ ID NO: 209118 - protein, 19 aa, Mycobacterium bovis
ARALSLPSLPCEVAVNEPE

SEQ ID NO: 209119 - protein, 19 aa, Mycobacterium bovis
ARARLVERLGALKPATMRA

SEQ ID NO: 209120 - protein, 20 aa, Mycobacterium bovis
AREPHSWDLCVGHAGRITAP

SEQ ID NO: 209121 - protein, 21 aa, Mycobacterium bovis
AREVAEVVAPVLGWTAADIDR

SEQ ID NO: 209122 - protein, 20 aa, Mycobacterium bovis
ARFDGWFVVAVLTTGVYCRP

SEQ ID NO: 209123 - protein, 17 aa, Mycobacterium bovis
ARGGIKTNWVISMPPGQ

SEQ ID NO: 209124 - protein, 24 aa, Mycobacterium bovis
ARLGPARTAGICAISPALFTSFTG

SEQ ID NO: 209125 - protein, 24 aa, Mycobacterium bovis
ARLRGRGGVIMCSFRAFQEMFGSN

SEQ ID NO: 209126 - protein, 20 aa, Mycobacterium bovis
ARLTEVGLWDAVKDRLSDSP

SEQ ID NO: 209127 - protein, 20 aa, Mycobacterium bovis
ARPEFKAMFLDDLLNGSRKQ

SEQ ID NO: 209128 - protein, 17 aa, Mycobacterium bovis
ARPPTFVLFTTGFLEAG

SEQ ID NO: 209129 - protein, 17 aa, Mycobacterium bovis
ARPVARRLFAVRAVVGL

SEQ ID NO: 209130 - protein, 22 aa, Mycobacterium bovis
ARQVPDNGGMYFVPAFSGLFAP

SEQ ID NO: 209131 - protein, 21 aa, Mycobacterium bovis
ARRITGWVAALGTGVCASDAI

SEQ ID NO: 209132 - protein, 18 aa, Mycobacterium bovis
ARSGTPVQVLGFREHASW

SEQ ID NO: 209133 - protein, 19 aa, Mycobacterium bovis
ARSLLQCAALHDLVDVVLS

SEQ ID NO: 209134 - protein, 17 aa, Mycobacterium bovis
ARTSLMIHDIGAIVEWI

SEQ ID NO: 209135 - protein, 30 aa, Mycobacterium bovis
ARVDCGLAGTVLRFVPPLAALGSVPVTFDG

SEQ ID NO: 209136 - protein, 24 aa, Mycobacterium bovis
ARVPQRFVPDLTKYQYWNGDSNSW

SEQ ID NO: 209137 - protein, 18 aa, Mycobacterium bovis
ARYLFVFLDHHGMLSVFG

SEQ ID NO: 209138 - protein, 22 aa, Mycobacterium bovis
ASELRRLRRCIAAAAGADHPLL

SEQ ID NO: 209139 - protein, 26 aa, Mycobacterium bovis
ASMYRAAAGLHRLCDSLSGAQVRDVA

SEQ ID NO: 209140 - protein, 21 aa, Mycobacterium bovis
ASTICDPGFLVLVEGVLGETG

SEQ ID NO: 209141 - protein, 17 aa, Mycobacterium bovis
ASVWDIAQRYNKGGPTV

SEQ ID NO: 209142 - protein, 18 aa, Mycobacterium bovis
ATAARYGHREALVDMVAR

SEQ ID NO: 209143 - protein, 18 aa, Mycobacterium bovis
ATASRLVARLGPEAVRII

SEQ ID NO: 209144 - protein, 25 aa, Mycobacterium bovis
ATEFDYLEMWAQDVAAMVGYHAGAK

SEQ ID NO: 209145 - protein, 25 aa, Mycobacterium bovis
ATFPIAAHYFAVFPLAKHMESAGRR

SEQ ID NO: 209146 - protein, 20 aa, Mycobacterium bovis
ATLPAAAWQRCRTHYAANHG

SEQ ID NO: 209147 - protein, 21 aa, Mycobacterium bovis
ATNLAEIGSAISTANGAAALP

SEQ ID NO: 209148 - protein, 21 aa, Mycobacterium bovis
ATPQPLQWDCFLFGIIQSDDH

SEQ ID NO: 209149 - protein, 17 aa, Mycobacterium bovis
AVGLGMPGVGLPVSAAK

SEQ ID NO: 209150 - protein, 24 aa, Mycobacterium bovis
AVGSELKAADSLAEYVLELARKLI

SEQ ID NO: 209151 - protein, 26 aa, Mycobacterium bovis
AVIYFLRKVIWFLPDFTVEGYHDRLR

SEQ ID NO: 209152 - protein, 26 aa, Mycobacterium bovis
AVLAAARRLRIIPGIASRTRTGGSAT

SEQ ID NO: 209153 - protein, 24 aa, Mycobacterium bovis
AVLGRLPMRAWLIGLRPMEGSPEG

SEQ ID NO: 209154 - protein, 17 aa, Mycobacterium bovis
AVLRRCGRCGRKASWYD

SEQ ID NO: 209155 - protein, 25 aa, Mycobacterium bovis
AVPYRANMWALRALGVRRVFGPCAV

SEQ ID NO: 209156 - protein, 24 aa, Mycobacterium bovis
AVRAWRSADDFPCTEHMAYKIAQV

SEQ ID NO: 209157 - protein, 26 aa, Mycobacterium bovis
AVRPRSCAALPRILRDNGYVTGAFGK

SEQ ID NO: 209158 - protein, 25 aa, Mycobacterium bovis
AVRSYELPTRVLLISAHDEPAIVYQ

SEQ ID NO: 209159 - protein, 25 aa, Mycobacterium bovis
AVRVIRTLRRLGIRSVAVYSDPDVD

SEQ ID NO: 209160 - protein, 17 aa, Mycobacterium bovis
AVSYGNEAPKFFNSKGE

SEQ ID NO: 209161 - protein, 20 aa, Mycobacterium bovis
AVTGQFLWQNVFGVWPVSGE

SEQ ID NO: 209162 - protein, 23 aa, Mycobacterium bovis
AVTSFRVGRHRAEVVAVADGITY

SEQ ID NO: 209163 - protein, 22 aa, Mycobacterium bovis
AVVGGALAYLVVKTLINATQLL

SEQ ID NO: 209164 - protein, 18 aa, Mycobacterium bovis
AVWSDGTPITWRDIASQI

SEQ ID NO: 209165 - protein, 21 aa, Mycobacterium bovis
AWSEGRDLWWHHVVGSASPAH

SEQ ID NO: 209166 - protein, 18 aa, Mycobacterium bovis
AWVHGWVQGVGFRWWTRC

SEQ ID NO: 209167 - protein, 18 aa, Mycobacterium bovis
AYLPRLPVDVVKLGGKFI

SEQ ID NO: 209168 - protein, 22 aa, Mycobacterium bovis
CAALPVLDTRAADTILGYDERG

SEQ ID NO: 209169 - protein, 18 aa, Mycobacterium bovis
CADLPICRSACRPGNATL

SEQ ID NO: 209170 - protein, 17 aa, Mycobacterium bovis
CAERLPGAVLAIGNAPT

SEQ ID NO: 209171 - protein, 22 aa, Mycobacterium bovis
CALLGLDCVIYMGGIDTARQAL

SEQ ID NO: 209172 - protein, 30 aa, Mycobacterium bovis; identical to SEQ ID NO: 160297

SEQ ID NO: 209173 - protein, 17 aa, Mycobacterium bovis
CGQRLAFENSACLSCGS

SEQ ID NO: 209174 - protein, 21 aa, Mycobacterium bovis
CIECPDGTVGEIWVHGDNVAN

SEQ ID NO: 209175 - protein, 20 aa, Mycobacterium bovis
CIGGRMSVVVAGRLPDRVAA

SEQ ID NO: 209176 - protein, 25 aa, Mycobacterium bovis
CLTLKGFTYSQMRLPGGDTVDVYNL

SEQ ID NO: 209177 - protein, 24 aa, Mycobacterium bovis
CPICRKEQLTLVSWVFGEHLGAVS

SEQ ID NO: 209178 - protein, 19 aa, Mycobacterium bovis
CQLLRLGGRWLSVVCCRNG

SEQ ID NO: 209179 - protein, 28 aa, Mycobacterium bovis
CRYCMPEAEYAWLPRADLLSVDEISLIV

SEQ ID NO: 209180 - protein, 17 aa, Mycobacterium bovis
CTPTRPKEFIALLDELL

SEQ ID NO: 209181 - protein, 19 aa, Mycobacterium bovis
CTTSCPVFWHEGSYFGPAA

SEQ ID NO: 209182 - protein, 21 aa, Mycobacterium bovis
CYSGLELRDDRLVLSPQWPEA

SEQ ID NO: 209183 - protein, 22 aa, Mycobacterium bovis
DAFAGAPIRVGAFLAEDHALRL

SEQ ID NO: 209184 - protein, 17 aa, Mycobacterium bovis
DAHILVLCGPIWLGDNS

SEQ ID NO: 209185 - protein, 21 aa, Mycobacterium bovis
DALRPLTAVVRSARMSAVTAI

SEQ ID NO: 209186 - protein, 17 aa, Mycobacterium bovis
DALVAHLPADRWADPTP

SEQ ID NO: 209187 - protein, 19 aa, Mycobacterium bovis
DAPLIGWGGNGGPGGFAAF

SEQ ID NO: 209188 - protein, 26 aa, Mycobacterium bovis
DASGVRLAIVASSWHGKICDALLDGA

SEQ ID NO: 209189 - protein, 23 aa, Mycobacterium bovis
DASLRLLPRGGRFIEMGKTEFGT

SEQ ID NO: 209190 - protein, 18 aa, Mycobacterium bovis
DAYIDYRALGGIDGRYPK

SEQ ID NO: 209191 - protein, 19 aa, Mycobacterium bovis
DAYYEHGVQVWDCAAGALI

SEQ ID NO: 209192 - protein, 18 aa, Mycobacterium bovis
DDERAAGYAGWRKAVQRT

SEQ ID NO: 209193 - protein, 22 aa, Mycobacterium bovis
DDLKLCSSMTLFARATDANQDF

SEQ ID NO: 209194 - protein, 20 aa, Mycobacterium bovis
DDLLNALIDFLAAVRNGLVP

SEQ ID NO: 209195 - protein, 22 aa, Mycobacterium bovis
DDLRAIATLTHRGVEGAIVGKA

SEQ ID NO: 209196 - protein, 18 aa, Mycobacterium bovis
DDVHGWLDLVLDGPLASE

SEQ ID NO: 209197 - protein, 23 aa, Mycobacterium bovis
DDWPGMFLLAAASFTDFIGPESA

SEQ ID NO: 209198 - protein, 22 aa, Mycobacterium bovis
DEAKTLCRACPRRWLCARDAVE

SEQ ID NO: 209199 - protein, 22 aa, Mycobacterium bovis
DEFITGVLFYTGARALPFGDRL

SEQ ID NO: 209200 - protein, 20 aa, Mycobacterium bovis
DEIFGDLKPRVAALDAAGRT

SEQ ID NO: 209201 - protein, 20 aa, Mycobacterium bovis
DEIGSGLAVFHPKGGIVRRE

SEQ ID NO: 209202 - protein, 19 aa, Mycobacterium bovis
DEIRWDIRPSPHLGTLEVR

SEQ ID NO: 209203 - protein, 17 aa, Mycobacterium bovis
DEMAARVAAEFEDGQYV

SEQ ID NO: 209204 - protein, 23 aa, Mycobacterium bovis
DESVPGRWALTREGGHSRRRIVH

SEQ ID NO: 209205 - protein, 21 aa, Mycobacterium bovis
DEVYGIMLMHGWAVQHVECER

SEQ ID NO: 209206 - protein, 20 aa, Mycobacterium bovis
DFDAGYWRAGGRIKIGSKRS

SEQ ID NO: 209207 - protein, 19 aa, Mycobacterium bovis
DFPASAVRFFASARSQGRK

SEQ ID NO: 209208 - protein, 17 aa, Mycobacterium bovis
DFRLYELIWQRTVASQM

SEQ ID NO: 209209 - protein, 20 aa, Mycobacterium bovis
DGGAGGAAFLVGSGGNGGSG

SEQ ID NO: 209210 - protein, 23 aa, Mycobacterium bovis
DGGDGGAGGIFFGTGGTGGAGGV

SEQ ID NO: 209211 - protein, 25 aa, Mycobacterium bovis
DGIPEVWPFAPAKHRAMLANLHPEE

SEQ ID NO: 209212 - protein, 24 aa, Mycobacterium bovis
DGVLRLLPVTTFDVRRAPAALRYL

SEQ ID NO: 209213 - protein, 22 aa, Mycobacterium bovis
DGYFSRPGLARVAAGKVSPSAE

SEQ ID NO: 209214 - protein, 24 aa, Mycobacterium bovis
DHAHFKIPGWRDALTRTGVVEGTR

SEQ ID NO: 209215 - protein, 22 aa, Mycobacterium bovis
DHGKAPVRRACYAADRTGHMIL

SEQ ID NO: 209216 - protein, 18 aa, Mycobacterium bovis
DHLIGHFVDQARRSGASW

SEQ ID NO: 209217 - protein, 21 aa, Mycobacterium bovis
DHPDEACGVLAGPEGSDRPER

SEQ ID NO: 209218 - protein, 22 aa, Mycobacterium bovis
DHRAACIRTELVTGRSAADIYR

SEQ ID NO: 209219 - protein, 21 aa, Mycobacterium bovis
DIKAPLLAALGAADLALATVN

SEQ ID NO: 209220 - protein, 17 aa, Mycobacterium bovis
DIRETFRRMAMNDVETA

SEQ ID NO: 209221 - protein, 23 aa, Mycobacterium bovis
DKLPRYIAGVLARLQEVWLRRQI

SEQ ID NO: 209222 - protein, 18 aa, Mycobacterium bovis
DKLSVGLGRLAAEDPTLR

SEQ ID NO: 209223 - protein, 17 aa, Mycobacterium bovis
DKPWFSYVCPGAGHAPH

SEQ ID NO: 209224 - protein, 27 aa, Mycobacterium bovis
DKRLPRIAGPCGMVIFGVTGDLARKKV

SEQ ID NO: 209225 - protein, 20 aa, Mycobacterium bovis
DKRTEMRAPLSASGDAVPAE

SEQ ID NO: 209226 - protein, 23 aa, Mycobacterium bovis
DKSRPLWEMYLVEGLEKNRIALY

SEQ ID NO: 209227 - protein, 21 aa, Mycobacterium bovis
DKVTALQLVWADRRGRWPWAA

SEQ ID NO: 209228 - protein, 24 aa, Mycobacterium bovis
DLARIDVWDGYYCFAAELTSATLE

SEQ ID NO: 209229 - protein, 27 aa, Mycobacterium bovis
DLASGWIPPHIRLPAHITLLEPAPRRR

SEQ ID NO: 209230 - protein, 24 aa, Mycobacterium bovis
DLDKPKLVFFFDEAHLLFTDASKA

SEQ ID NO: 209231 - protein, 20 aa, Mycobacterium bovis
DLLLVPSIVEPSNFLENISR

SEQ ID NO: 209232 - protein, 19 aa, Mycobacterium bovis
DLLRFVLETGTPKSDRTGT

SEQ ID NO: 209233 - protein, 19 aa, Mycobacterium bovis
DLMTAAATNLAEIGSAIST

SEQ ID NO: 209234 - protein, 19 aa, Mycobacterium bovis
DMTEHGWATDEWPALYRRV

SEQ ID NO: 209235 - protein, 24 aa, Mycobacterium bovis
DPAEWKVFLNLLRTRFETDKDKWT

SEQ ID NO: 209236 - protein, 25 aa, Mycobacterium bovis
DPATVRYLREFRFRGDIDGYAEGEL

SEQ ID NO: 209237 - protein, 27 aa, Mycobacterium bovis
DPDTCIECPQGSVGEIWVQGGNVASGY

SEQ ID NO: 209238 - protein, 18 aa, Mycobacterium bovis
DPLEPGGRLPIDREPRAI

SEQ ID NO: 209239 - protein, 20 aa, Mycobacterium bovis
DPMVREWLTVLLRRDLGLLV

SEQ ID NO: 209240 - protein, 17 aa, Mycobacterium bovis
DQLACYRPTPSANSIAW

SEQ ID NO: 209241 - protein, 21 aa, Mycobacterium bovis
DRGAGHLGFAGTARREAVADA

SEQ ID NO: 209242 - protein, 24 aa, Mycobacterium bovis
DRLWIPVRRSWRLNERHYGALQGL

SEQ ID NO: 209243 - protein, 19 aa, Mycobacterium bovis
DRNGALRMVRGVKNRFGAA

SEQ ID NO: 209244 - protein, 17 aa, Mycobacterium bovis
DRSTLQTSLLLTVMIDE

SEQ ID NO: 209245 - protein, 18 aa, Mycobacterium bovis
DRVAIHWEGEPVGDRRTL

SEQ ID NO: 209246 - protein, 19 aa, Mycobacterium bovis
DSGEGRWTAIAAIDEGVPA

SEQ ID NO: 209247 - protein, 19 aa, Mycobacterium bovis
DSHLLLLWGAANRDPAQFE

SEQ ID NO: 209248 - protein, 23 aa, Mycobacterium bovis
DSILRVLAMHRFAKAPMLVGGQM

SEQ ID NO: 209249 - protein, 20 aa, Mycobacterium bovis
DSLRIFPATHYVAGPERMAH

SEQ ID NO: 209250 - protein, 18 aa, Mycobacterium bovis
DSPELLWKALLRGDDLIT

SEQ ID NO: 209251 - protein, 19 aa, Mycobacterium bovis
DSPEVIAYLEAENDYTERT

SEQ ID NO: 209252 - protein, 24 aa, Mycobacterium bovis
DTQLPNWWGPILAPALAGVGALRG

SEQ ID NO: 209253 - protein, 25 aa, Mycobacterium bovis
DVMGGMPCIRGLRIPVATVVAMVAD

SEQ ID NO: 209254 - protein, 25 aa, Mycobacterium bovis
DVQRYEVVDLLSLLADKSLVVTEDS

SEQ ID NO: 209255 - protein, 23 aa, Mycobacterium bovis
DWDDELLSLFSIPRAMLPEIASS

SEQ ID NO: 209256 - protein, 33 aa, Mycobacterium bovis
DWVKLAVTRARISGMPVLFWLDPYRPHENELIK

SEQ ID NO: 209257 - protein, 25 aa, Mycobacterium bovis
EAAAFVRGRRAEVFGISRAGDGDGA

SEQ ID NO: 209258 - protein, 22 aa, Mycobacterium bovis
EAANAGPNMLAAVNAPAQALLG

SEQ ID NO: 209259 - protein, 19 aa, Mycobacterium bovis
EAFASLATALSRVLGLTFD

SEQ ID NO: 209260 - protein, 18 aa, Mycobacterium bovis
EAGLPRRGTPDAIVVVRD

SEQ ID NO: 209261 - protein, 17 aa, Mycobacterium bovis
EAIRIATAAKREYEASV

SEQ ID NO: 209262 - protein, 19 aa, Mycobacterium bovis
EALFTLGDRPEARWRQARE

SEQ ID NO: 209263 - protein, 34 aa, Mycobacterium bovis
EARAQHPWPPRVATLPHWPLIYAGALEGLDHLEL

SEQ ID NO: 209264 - protein, 18 aa, Mycobacterium bovis
EAVNLFRANVIDVSPESL

SEQ ID NO: 209265 - protein, 21 aa, Mycobacterium bovis
EDGEKRIPLDVAEGDTVIYSK

SEQ ID NO: 209266 - protein, 30 aa, Mycobacterium bovis
EDVRARIGVLSQVPWLWAKFIGHAQAIAPA

SEQ ID NO: 209267 - protein, 26 aa, Mycobacterium bovis
EEKKLFCRMAEVFAGFLSYTDAQIGR

SEQ ID NO: 209268 - protein, 18 aa, Mycobacterium bovis
EELTRSWRVQWPELPDAM

SEQ ID NO: 209269 - protein, 18 aa, Mycobacterium bovis
EEVRNCFADMAKVAIALG

SEQ ID NO: 209270 - protein, 23 aa, Mycobacterium bovis
EEYLRELTIWSGRYGSVAGVPAR

SEQ ID NO: 209271 - protein, 36 aa, Mycobacterium bovis
EFTFPMEFVSFKGGWQLSRQTAEMLLAMGNSPDSTP

SEQ ID NO: 209272 - protein, 17 aa, Mycobacterium bovis
EGAALGAAFLGRLAAGL

SEQ ID NO: 209273 - protein, 20 aa, Mycobacterium bovis
EGGTVGPVRFDACDPDGNRM

SEQ ID NO: 209274 - protein, 20 aa, Mycobacterium bovis
EGIAWRFRTGSPWRDLPAEF

SEQ ID NO: 209275 - protein, 22 aa, Mycobacterium bovis
EGLPYFSIGMGNNFIQSAKTLG

SEQ ID NO: 209276 - protein, 20 aa, Mycobacterium bovis
EGVSALLIRVGESGVAPDRL

SEQ ID NO: 209277 - protein, 20 aa, Mycobacterium bovis
EGVTLRFGSKVPGTAMEVRD

SEQ ID NO: 209278 - protein, 17 aa, Mycobacterium bovis
EIACGRADSVISELEEL

SEQ ID NO: 209279 - protein, 24 aa, Mycobacterium bovis
EIADRAGVSKPVLYQHFSSKLELY

SEQ ID NO: 209280 - protein, 19 aa, Mycobacterium bovis
EKGFGMDFGALPPEINSGR

SEQ ID NO: 209281 - protein, 33 aa, Mycobacterium bovis
EKLGALPGWQLLDMRLSRAFQCTNFDQSIDFMN

SEQ ID NO: 209282 - protein, 18 aa, Mycobacterium bovis
EKLRTKWVPERAKMLREL

SEQ ID NO: 209283 - protein, 17 aa, Mycobacterium bovis
EKNFKWIARSADGWITT

SEQ ID NO: 209284 - protein, 17 aa, Mycobacterium bovis
ELFTAEAIWEMPPYTGW

SEQ ID NO: 209285 - protein, 18 aa, Mycobacterium bovis
ELNRLFTAWVETVYHRSV

SEQ ID NO: 209286 - protein, 18 aa, Mycobacterium bovis
ELTGLALQRIYLDRVAKL

SEQ ID NO: 209287 - protein, 17 aa, Mycobacterium bovis
ELVWAPAAFRYVMMVLR

SEQ ID NO: 209288 - protein, 26 aa, Mycobacterium bovis
ENSACLSCGSALGFSLGRMALLVIAD

SEQ ID NO: 209289 - protein, 25 aa, Mycobacterium bovis
EPLTPELCALSWMVYSLPGAPVLEH

SEQ ID NO: 209290 - protein, 17 aa, Mycobacterium bovis
EPPMFEMDTTGLASGNC

SEQ ID NO: 209291 - protein, 25 aa, Mycobacterium bovis
EPPTLLWPIGVPFSDGLNTLSEFKV

SEQ ID NO: 209292 - protein, 23 aa, Mycobacterium bovis
EQNAWWWDVLKFGRSSAYAEFFD

SEQ ID NO: 209293 - protein, 19 aa, Mycobacterium bovis
EQRLATIAHQCEVKSDQSE

SEQ ID NO: 209294 - protein, 25 aa, Mycobacterium bovis
ERFRRGRDRIPLTGRIAVIVDDGIA

SEQ ID NO: 209295 - protein, 27 aa, Mycobacterium bovis
ERLCRRLADQAVRQWGFMQGLKQKLGP

SEQ ID NO: 209296 - protein, 20 aa, Mycobacterium bovis
ERLRLSGTRIELEELLQLPV

SEQ ID NO: 209297 - protein, 24 aa, Mycobacterium bovis
ERPGRGAVVGVDWRTPLTDAAARV

SEQ ID NO: 209298 - protein, 21 aa, Mycobacterium bovis
ERSSHTWFVLRELLGHQNVNI

SEQ ID NO: 209299 - protein, 17 aa, Mycobacterium bovis
ERVRAVGSGHSFTDIAC

SEQ ID NO: 209300 - protein, 21 aa, Mycobacterium bovis
ERYRTKMIWWDRRTLANHAEP

SEQ ID NO: 209301 - protein, 25 aa, Mycobacterium bovis
ESKASEVVEPWSLRLSHPELLYHPT

SEQ ID NO: 209302 - protein, 20 aa, Mycobacterium bovis
ESPVALPVPAYMPFFDVLHV

SEQ ID NO: 209303 - protein, 21 aa, Mycobacterium bovis
ESTFAKLGVRDEIVRALGEEG

SEQ ID NO: 209304 - protein, 20 aa, Mycobacterium bovis
ESWMGPASMAMVAAAQPYLA

SEQ ID NO: 209305 - protein, 25 aa, Mycobacterium bovis
ETLVRAASDLANIGSTLGAANAAAL

SEQ ID NO: 209306 - protein, 17 aa, Mycobacterium bovis
ETMKLPRTILMYPMTLA

SEQ ID NO: 209307 - protein, 20 aa, Mycobacterium bovis
EVCRTCSWNHLVKSYVLGAA

SEQ ID NO: 209308 - protein, 18 aa, Mycobacterium bovis
EVDRLAAELADRLHTSKT

SEQ ID NO: 209309 - protein, 22 aa, Mycobacterium bovis
EVEINIACSLGMLTAEQVDQLA

SEQ ID NO: 209310 - protein, 20 aa, Mycobacterium bovis
EVIGDRFGVCGYCIGGRMSV

SEQ ID NO: 209311 - protein, 19 aa, Mycobacterium bovis
EVLNRIACGQSIPAIAAEL

SEQ ID NO: 209312 - protein, 24 aa, Mycobacterium bovis
EVNSLRMYLGAGSGPMLAAAAAWD

SEQ ID NO: 209313 - protein, 34 aa, Mycobacterium bovis; identical to SEQ ID NO: 96427

SEQ ID NO: 209314 - protein, 22 aa, Mycobacterium bovis
EVSALTAAQFAAHAQMYQTVSA

SEQ ID NO: 209315 - protein, 29 aa, Mycobacterium bovis
EYPSAVAKARFVRVSPRKARRVIDLVRGR

SEQ ID NO: 209316 - protein, 22 aa, Mycobacterium bovis
FACALRPTKLIDYEEMFRGAMQ

SEQ ID NO: 209317 - protein, 24 aa, Mycobacterium bovis
FADDRIADVLGRLRGGYQVEGREV

SEQ ID NO: 209318 - protein, 17 aa, Mycobacterium bovis
FAGKINRLAIMVRGNLA

SEQ ID NO: 209319 - protein, 21 aa, Mycobacterium bovis
FALPVCRRPGAKTVTALGGGY

SEQ ID NO: 209320 - protein, 18 aa, Mycobacterium bovis
FASAWAHGGGTARLRGRG

SEQ ID NO: 209321 - protein, 25 aa, Mycobacterium bovis
FASLPRRCVRLEGAEDLLATMAGER

SEQ ID NO: 209322 - protein, 25 aa, Mycobacterium bovis
FDCSDPAKLAGWWAEQFDGTTRELL

SEQ ID NO: 209323 - protein, 20 aa, Mycobacterium bovis
FDFVREIIEQGAIPDDVTIQ

SEQ ID NO: 209324 - protein, 26 aa, Mycobacterium bovis
FDGAIPRRWRSPAPLWGDTSFHSVAP

SEQ ID NO: 209325 - protein, 22 aa, Mycobacterium bovis
FECYRIRRAPGHSASFRITGAA

SEQ ID NO: 209326 - protein, 17 aa, Mycobacterium bovis
FEDGGWVWFDITTDTAV

SEQ ID NO: 209327 - protein, 18 aa, Mycobacterium bovis
FEQSRHWSRTYAPGHELK

SEQ ID NO: 209328 - protein, 18 aa, Mycobacterium bovis
FFLDRGCKVLCTEPRGEN

SEQ ID NO: 209329 - protein, 18 aa, Mycobacterium bovis
FFRISPREATAMDPQQRV

SEQ ID NO: 209330 - protein, 18 aa, Mycobacterium bovis
FGDRTQINGVARDDAVAA

SEQ ID NO: 209331 - protein, 18 aa, Mycobacterium bovis
FGGEVERGLSMVDGVLLL

SEQ ID NO: 209332 - protein, 22 aa, Mycobacterium bovis
FGRLQRHVAMIVVAQFAATLTD

SEQ ID NO: 209333 - protein, 25 aa, Mycobacterium bovis
FGRRVAVVACEFDFLGGSIGVAAAE

SEQ ID NO: 209334 - protein, 23 aa, Mycobacterium bovis
FGSGGVGGLGFDAGGAGGAGGKA

SEQ ID NO: 209335 - protein, 18 aa, Mycobacterium bovis
FHERVALHFGAAYGSSVL

SEQ ID NO: 209336 - protein, 26 aa, Mycobacterium bovis
FHLRNRLVVAAMHWDGPKAQVIGLVR

SEQ ID NO: 209337 - protein, 25 aa, Mycobacterium bovis
FIIGRIKDLLIVYGRNHSPDDIEAT

SEQ ID NO: 209338 - protein, 20 aa, Mycobacterium bovis
FIQFHPTMLFAGRAGGRRPL

SEQ ID NO: 209339 - protein, 18 aa, Mycobacterium bovis
FLCACGPAYLPERDQRMG

SEQ ID NO: 209340 - protein, 17 aa, Mycobacterium bovis
FLISACGILTVPKLPDI

SEQ ID NO: 209341 - protein, 17 aa, Mycobacterium bovis
FLKRVRKVVDDEFPGRV

SEQ ID NO: 209342 - protein, 25 aa, Mycobacterium bovis
FNAFPASYWRRWTTCKSVVLRVQVT

SEQ ID NO: 209343 - protein, 29 aa, Mycobacterium bovis
FNIWGRPDLRRWLPLDVYRPLKSTLVTLD

SEQ ID NO: 209344 - protein, 17 aa, Mycobacterium bovis
FPEDIWVPERDPGTTRL

SEQ ID NO: 209345 - protein, 27 aa, Mycobacterium bovis
FPEFPLPLGDPSVRCGGDLLSMMLMDE

SEQ ID NO: 209346 - protein, 17 aa, Mycobacterium bovis
FPKQIWRQIWSNNPQER

SEQ ID NO: 209347 - protein, 18 aa, Mycobacterium bovis
FQIRHHLRRVAMPAPGGR

SEQ ID NO: 209348 - protein, 23 aa, Mycobacterium bovis
FQTLTGRPLIGNGANGTPGTGAD

SEQ ID NO: 209349 - protein, 17 aa, Mycobacterium bovis
FRLSPPVLSGAMGPFMH

SEQ ID NO: 209350 - protein, 20 aa, Mycobacterium bovis
FRLVAAEALKLTAADAALVA

SEQ ID NO: 209351 - protein, 17 aa, Mycobacterium bovis
FRRRRHPAVAGAWSPGV

SEQ ID NO: 209352 - protein, 35 aa, Mycobacterium bovis
FRTADRYIVISAYVPKHWQKLCYLIGRPDLVEDQR

SEQ ID NO: 209353 - protein, 23 aa, Mycobacterium bovis
FSDFPDRPDNLLAVANAAIGAAI

SEQ ID NO: 209354 - protein, 18 aa, Mycobacterium bovis
FSDGLNTLSEFKVQRLDR

SEQ ID NO: 209355 - protein, 21 aa, Mycobacterium bovis
FSDHRLILEGIAWRFRTGSPW

SEQ ID NO: 209356 - protein, 17 aa, Mycobacterium bovis
FSKQLINSIKWARDETG

SEQ ID NO: 209357 - protein, 17 aa, Mycobacterium bovis
FSPGKGLGVIPREGYFQ

SEQ ID NO: 209358 - protein, 19 aa, Mycobacterium bovis
FSYQFSFEQSRHWSRTYAP

SEQ ID NO: 209359 - protein, 25 aa, Mycobacterium bovis
FTAAARAGLGWGMFPEKLAASPLAD

SEQ ID NO: 209360 - protein, 20 aa, Mycobacterium bovis
FTAPHFASAWAHGGGTARLR

SEQ ID NO: 209361 - protein, 17 aa, Mycobacterium bovis
FTPPFDLDGRWIGEASF

SEQ ID NO: 209362 - protein, 18 aa, Mycobacterium bovis
FTSMYRRIVGSAGPITDD

SEQ ID NO: 209363 - protein, 17 aa, Mycobacterium bovis
FVAAFDVDAKKVGFDLS

SEQ ID NO: 209364 - protein, 24 aa, Mycobacterium bovis
FVAEAIAVLGARVAGSSLAGFATY

SEQ ID NO: 209365 - protein, 23 aa, Mycobacterium bovis
FVIGASNRFAHAAALAIAEAPAR

SEQ ID NO: 209366 - protein, 24 aa, Mycobacterium bovis
FVIGASNRFAHAAALAIAEAPARA

SEQ ID NO: 209367 - protein, 18 aa, Mycobacterium bovis
FVLETGTPKSDRTGTGTR

SEQ ID NO: 209368 - protein, 25 aa, Mycobacterium bovis
FVPAFSGLFAPYWRSDARGAIVGLS

SEQ ID NO: 209369 - protein, 23 aa, Mycobacterium bovis
FVPRPETEAILGWATAQSLPARP

SEQ ID NO: 209370 - protein, 18 aa, Mycobacterium bovis
FVTDGKMFIIGRIKDLLI

SEQ ID NO: 209371 - protein, 30 aa, Mycobacterium bovis
GAAGGNGGNGGWLFGAGGTGGIGGTGAPGA

SEQ ID NO: 209372 - protein, 19 aa, Mycobacterium bovis
GAFEAARAAMVDPVVVAAN

SEQ ID NO: 209373 - protein, 19 aa, Mycobacterium bovis
GAGGAGMRAAVEAGPRVRT

SEQ ID NO: 209374 - protein, 26 aa, Mycobacterium bovis
GAGGDGGNAGMFFGSGGAGGAGGFGR

SEQ ID NO: 209375 - protein, 27 aa, Mycobacterium bovis
GAGGDVSADFGGVGFGGQGGNGGAGGL

SEQ ID NO: 209376 - protein, 20 aa, Mycobacterium bovis
GAGGNAMLFGAGGAGGAGGG

SEQ ID NO: 209377 - protein, 21 aa, Mycobacterium bovis
GAGGRGGDAGLFLGAAGTGGQ

SEQ ID NO: 209378 - protein, 29 aa, Mycobacterium bovis
GAGGTGGNAAWLLGGGGTGGAGGIGGGNG

SEQ ID NO: 209379 - protein, 18 aa, Mycobacterium bovis
GAGGYPQMLLRVGWAPIN

SEQ ID NO: 209380 - protein, 22 aa, Mycobacterium bovis
GAGQITGLRSGFGSAGGAGGAG

SEQ ID NO: 209381 - protein, 19 aa, Mycobacterium bovis
GAIETCARKLFVHPNTVRY

SEQ ID NO: 209382 - protein, 19 aa, Mycobacterium bovis
GAIRRRLAAELGLTPDRVD

SEQ ID NO: 209383 - protein, 17 aa, Mycobacterium bovis
GALMPFTPPSGAPPDLL

SEQ ID NO: 209384 - protein, 21 aa, Mycobacterium bovis
GANYKRLPLGVFTEASESLTN

SEQ ID NO: 209385 - protein, 17 aa, Mycobacterium bovis
GATGNCWAVHTNCPVPG

SEQ ID NO: 209386 - protein, 20 aa, Mycobacterium bovis
GCAEAMKGQGARVSVTEIDP

SEQ ID NO: 209387 - protein, 30 aa, Mycobacterium bovis
GCGARLSVVVAESWRASALAEMIQEAGLVP

SEQ ID NO: 209388 - protein, 17 aa, Mycobacterium bovis
GCRVHPLGEMRYLPVAS

SEQ ID NO: 209389 - protein, 17 aa, Mycobacterium bovis
GDALWAATFLRRRGAAA

SEQ ID NO: 209390 - protein, 20 aa, Mycobacterium bovis
GDDALKRKASSVMLESFLFY

SEQ ID NO: 209391 - protein, 32 aa, Mycobacterium bovis
GDGGDGGDGGWGRPGGQGGFGSTSGAHGKAGF

SEQ ID NO: 209392 - protein, 31 aa, Mycobacterium bovis
GDGGTGGRGGLLMGAGAGGHGGTGGAGGAGV

SEQ ID NO: 209393 - protein, 19 aa, Mycobacterium bovis
GDGNGSFADAGDGGPGGNG

SEQ ID NO: 209394 - protein, 21 aa, Mycobacterium bovis
GDLPGWLALHGYQNSRKRAVA

SEQ ID NO: 209395 - protein, 24 aa, Mycobacterium bovis
GDLWAAPSGWRGGGHMAPVRTAMR

SEQ ID NO: 209396 - protein, 20 aa, Mycobacterium bovis
GDMRVSLFLSDAAQADAQSG

SEQ ID NO: 209397 - protein, 18 aa, Mycobacterium bovis
GDVWRFVDTAGLRRKVGQ

SEQ ID NO: 209398 - protein, 22 aa, Mycobacterium bovis
GEDLSWLWDVRFEHFETTRVVA

SEQ ID NO: 209399 - protein, 18 aa, Mycobacterium bovis
GEGAVGRWWARQPELTAA

SEQ ID NO: 209400 - protein, 18 aa, Mycobacterium bovis
GEHIRVFPLSNWTEFDIW

SEQ ID NO: 209401 - protein, 23 aa, Mycobacterium bovis
GEIEWAKASLIGPEEYVTAVAAA

SEQ ID NO: 209402 - protein, 22 aa, Mycobacterium bovis
GEKRLARMLARPVSAPVLSGDT

SEQ ID NO: 209403 - protein, 19 aa, Mycobacterium bovis
GEMWAQDAAAMFGYAAATA

SEQ ID NO: 209404 - protein, 21 aa, Mycobacterium bovis
GEMWAQDAAAMFGYAAATATA

SEQ ID NO: 209405 - protein, 20 aa, Mycobacterium bovis
GEMWAQDAAAMFGYAATAAT

SEQ ID NO: 209406 - protein, 27 aa, Mycobacterium bovis
GEPTRAAICRFATWWVVLERHGNLVRL

SEQ ID NO: 209407 - protein, 18 aa, Mycobacterium bovis
GERLDAKALVAFTQSGDT

SEQ ID NO: 209408 - protein, 17 aa, Mycobacterium bovis
GESMSRQAGGRAGDSGG

SEQ ID NO: 209409 - protein, 27 aa, Mycobacterium bovis
GESPYWYVYEHNLWPSREDALSISAVV

SEQ ID NO: 209410 - protein, 17 aa, Mycobacterium bovis
GETASIFVPSVPNLLQL

SEQ ID NO: 209411 - protein, 17 aa, Mycobacterium bovis
GEVAGYVVEYNRRTHVR

SEQ ID NO: 209412 - protein, 19 aa, Mycobacterium bovis
GEVVRRCYTDVLAAARPAT

SEQ ID NO: 209413 - protein, 25 aa, Mycobacterium bovis
GFDSADLSLPWGQDALIAAVASANA

SEQ ID NO: 209414 - protein, 17 aa, Mycobacterium bovis
GFGSLRPLLEVAAAHGR

SEQ ID NO: 209415 - protein, 22 aa, Mycobacterium bovis
GFPNCNGRIPADTALLPEVLAE

SEQ ID NO: 209416 - protein, 19 aa, Mycobacterium bovis
GFQLLRPVKGEERYFVVTH

SEQ ID NO: 209417 - protein, 17 aa, Mycobacterium bovis
GFSFFDGNGGDGGTGGT

SEQ ID NO: 209418 - protein, 17 aa, Mycobacterium bovis
GGAAVQAKAVAGAFEAA

SEQ ID NO: 209419 - protein, 24 aa, Mycobacterium bovis
GGADALRYPARYLFVFLDHHGMLS

SEQ ID NO: 209420 - protein, 26 aa, Mycobacterium bovis
GGAGGDGGGALGVLGGMGGDGGDGGE

SEQ ID NO: 209421 - protein, 17 aa, Mycobacterium bovis
GGAGSVACQEFITQLGR

SEQ ID NO: 209422 - protein, 17 aa, Mycobacterium bovis
GGAVIIAGFPFLDLGNV

SEQ ID NO: 209423 - protein, 19 aa, Mycobacterium bovis
GGDGGRGAGGLTSGGVGSS

SEQ ID NO: 209424 - protein, 27 aa, Mycobacterium bovis
GGDGVFEGIAVLGLGFGGAAGAGGAAT

SEQ ID NO: 209425 - protein, 22 aa, Mycobacterium bovis
GGEITARFLISACGILTVPKLP

SEQ ID NO: 209426 - protein, 18 aa, Mycobacterium bovis
GGELARIGVAADIGAAPA

SEQ ID NO: 209427 - protein, 23 aa, Mycobacterium bovis
GGEMWRVDFAWPDMRLAAEYESI

SEQ ID NO: 209428 - protein, 21 aa, Mycobacterium bovis
GGFERRGRWNVPKKLTTFTLW

SEQ ID NO: 209429 - protein, 26 aa, Mycobacterium bovis
GGGGLSSPVILGIGIGGAGGDGGGAL

SEQ ID NO: 209430 - protein, 18 aa, Mycobacterium bovis
GGGGRYDGLMHQLGGQDL

SEQ ID NO: 209431 - protein, 17 aa, Mycobacterium bovis
GGIDEYLQLAARVSAPA

SEQ ID NO: 209432 - protein, 26 aa, Mycobacterium bovis
GGLGGQLLGRDGFNAPASTPLHTLQQ

SEQ ID NO: 209433 - protein, 23 aa, Mycobacterium bovis
GGLGSAFGPGGTGGMGGAGGTST

SEQ ID NO: 209434 - protein, 17 aa, Mycobacterium bovis
GGLQLLIIISAGRTIAN

SEQ ID NO: 209435 - protein, 19 aa, Mycobacterium bovis
GGMPMMLMPMSISGAGAGM

SEQ ID NO: 209436 - protein, 20 aa, Mycobacterium bovis
GGNAGTVFGSGGAGGNGGVG

SEQ ID NO: 209437 - protein, 23 aa, Mycobacterium bovis
GGNGGAGGMLLGDGGAGGQGGPA

SEQ ID NO: 209438 - protein, 18 aa, Mycobacterium bovis
GGPPEGWQDSFVSSYATM

SEQ ID NO: 209439 - protein, 18 aa, Mycobacterium bovis
GGTGDLLFGNGGAGGQGG

SEQ ID NO: 209440 - protein, 18 aa, Mycobacterium bovis
GGVGGNGVDGFDINETTG

SEQ ID NO: 209441 - protein, 19 aa, Mycobacterium bovis
GGVGQGFAGGIGGAGGTPG

SEQ ID NO: 209442 - protein, 19 aa, Mycobacterium bovis
GHLDWYADGMFPPMHIDAE

SEQ ID NO: 209443 - protein, 19 aa, Mycobacterium bovis
GHMLGGLPLGQLTNSGGGF

SEQ ID NO: 209444 - protein, 18 aa, Mycobacterium bovis
GHPLPGESLPGAIRRRLA

SEQ ID NO: 209445 - protein, 21 aa, Mycobacterium bovis
GHTPGSIALALGGPVTGGVTQ

SEQ ID NO: 209446 - protein, 20 aa, Mycobacterium bovis
GIPLLRLAAQTALLESEALA

SEQ ID NO: 209447 - protein, 26 aa, Mycobacterium bovis
GIRIDLRKTYLFAFLDDHSRLVPGYR

SEQ ID NO: 209448 - protein, 18 aa, Mycobacterium bovis
GITGLDFDNGTVFLNKPV

SEQ ID NO: 209449 - protein, 22 aa, Mycobacterium bovis
GKRVHNAIIRRMQRMSFEELRE

SEQ ID NO: 209450 - protein, 18 aa, Mycobacterium bovis
GKTLAAAKAEALKCAKGF

SEQ ID NO: 209451 - protein, 25 aa, Mycobacterium bovis
GLARNGYDLTRWLATKGMELTWRSG

SEQ ID NO: 209452 - protein, 20 aa, Mycobacterium bovis
GLAVRPGYVLSDGFRVPGLP

SEQ ID NO: 209453 - protein, 18 aa, Mycobacterium bovis
GLCRGMDSSMFFHPDGER

SEQ ID NO: 209454 - protein, 24 aa, Mycobacterium bovis
GLGCELRHAHRLVYSEGLDLSGDP

SEQ ID NO: 209455 - protein, 18 aa, Mycobacterium bovis
GLGWRQCQTPTPPFALVL

SEQ ID NO: 209456 - protein, 29 aa, Mycobacterium bovis
GLLNRLSAFKVPHRFAVVDRLPRTPNGKL

SEQ ID NO: 209457 - protein, 22 aa, Mycobacterium bovis
GLLPPTFSLVGFARRDWSTQDF

SEQ ID NO: 209458 - protein, 24 aa, Mycobacterium bovis
GLLSRRLRIPAALAGVGAGLAIAD

SEQ ID NO: 209459 - protein, 18 aa, Mycobacterium bovis
GLMGRRIAGVLASAGLDV

SEQ ID NO: 209460 - protein, 21 aa, Mycobacterium bovis
GLPKPDWQVLLAVSAELAGER

SEQ ID NO: 209461 - protein, 17 aa, Mycobacterium bovis
GLYAVVVDREMSALLDG

SEQ ID NO: 209462 - protein, 18 aa, Mycobacterium bovis
GLYPGRKFGGGALSVYID

SEQ ID NO: 209463 - protein, 24 aa, Mycobacterium bovis
GMALAFRAGAPLKDMEFVQYHPTG

SEQ ID NO: 209464 - protein, 23 aa, Mycobacterium bovis
GMLTGPVTILAWSFVRDDQPLAD

SEQ ID NO: 209465 - protein, 20 aa, Mycobacterium bovis
GMSRLSGYLTPQARATFEAV

SEQ ID NO: 209466 - protein, 19 aa, Mycobacterium bovis
GNAGSFFGAAGTGGAGAST

SEQ ID NO: 209467 - protein, 33 aa, Mycobacterium bovis
GNGADAAAVVGFGANGDPGFAGGKGGNGGIGGA

SEQ ID NO: 209468 - protein, 26 aa, Mycobacterium bovis
GNGERTGNVCLVTLGLNLFSRGVDPQ

SEQ ID NO: 209469 - protein, 18 aa, Mycobacterium bovis
GNIGFGLTGNNQVGIGGL

SEQ ID NO: 209470 - protein, 26 aa, Mycobacterium bovis
GNMIKPMLARGELRLVGATTLDEYRK

SEQ ID NO: 209471 - protein, 31 aa, Mycobacterium bovis
GNRLRLALDSDLCAAVTGMPGPLAHPGLVCD

SEQ ID NO: 209472 - protein, 21 aa, Mycobacterium bovis
GPARTGSVLAELGVDPNRPMA

SEQ ID NO: 209473 - protein, 17 aa, Mycobacterium bovis
GPASGFGGNGGHAGTTG

SEQ ID NO: 209474 - protein, 17 aa, Mycobacterium bovis
GPDRVALLSLLRSTPLT

SEQ ID NO: 209475 - protein, 20 aa, Mycobacterium bovis
GPGIPRHHRAAGGLQSVAKA

SEQ ID NO: 209476 - protein, 25 aa, Mycobacterium bovis
GPGPMLAAASAWTGLAGDLGSAAAS

SEQ ID NO: 209477 - protein, 18 aa, Mycobacterium bovis
GPSIGWRTSTRLPRDHYV

SEQ ID NO: 209478 - protein, 20 aa, Mycobacterium bovis
GPTTELLAAGADEVSAAIAS

SEQ ID NO: 209479 - protein, 21 aa, Mycobacterium bovis
GQAGGPGGLLYGNGGNGAAGG

SEQ ID NO: 209480 - protein, 23 aa, Mycobacterium bovis
GQGGHGGNAILFGQGGAGGPGGT

SEQ ID NO: 209481 - protein, 17 aa, Mycobacterium bovis
GQGGLGLAGINGGSGGQ

SEQ ID NO: 209482 - protein, 19 aa, Mycobacterium bovis
GQGGLLRGIPLARAGRRTG

SEQ ID NO: 209483 - protein, 23 aa, Mycobacterium bovis
GQPAADALHAWLVDGRRALVTAE

SEQ ID NO: 209484 - protein, 25 aa, Mycobacterium bovis
GQPGRWGRTAVCARLSSADQKVDLD

SEQ ID NO: 209485 - protein, 19 aa, Mycobacterium bovis
GRGAGGLTSGGVGSSGESG

SEQ ID NO: 209486 - protein, 24 aa, Mycobacterium bovis
GRGVTVGRPLGLLLTRRSENATVT

SEQ ID NO: 209487 - protein, 17 aa, Mycobacterium bovis
GRIAVIGGYAHLGVPAG

SEQ ID NO: 209488 - protein, 18 aa, Mycobacterium bovis
GRKFGGGALSVYIDDRQV

SEQ ID NO: 209489 - protein, 17 aa, Mycobacterium bovis
GRLAVVVDFAMEADAQY

SEQ ID NO: 209490 - protein, 18 aa, Mycobacterium bovis
GRQRRAGQRRQRRQRWQW

SEQ ID NO: 209491 - protein, 23 aa, Mycobacterium bovis
GRSAACWARRLVFVNGHGGNVGA

SEQ ID NO: 209492 - protein, 20 aa, Mycobacterium bovis
GRSLRACIDLAALGENTIAI

SEQ ID NO: 209493 - protein, 24 aa, Mycobacterium bovis
GRTLGLAGHAAFERRTLATVAKLL

SEQ ID NO: 209494 - protein, 19 aa, Mycobacterium bovis
GRVGPHLEIKVVDPATGEA

SEQ ID NO: 209495 - protein, 22 aa, Mycobacterium bovis
GRYADAWIPIVVVRPSDYSRAL

SEQ ID NO: 209496 - protein, 19 aa, Mycobacterium bovis
GSAYLARVPQRFVPDLTKY

SEQ ID NO: 209497 - protein, 18 aa, Mycobacterium bovis
GSGGFGLDTGGAGGRGGD

SEQ ID NO: 209498 - protein, 17 aa, Mycobacterium bovis
GSGGLGSAFGPGGTGGM

SEQ ID NO: 209499 - protein, 23 aa, Mycobacterium bovis
GSGNGPLAAFVHALADVGFDVAV

SEQ ID NO: 209500 - protein, 17 aa, Mycobacterium bovis
GSGQAWQGAAAAAMVVA

SEQ ID NO: 209501 - protein, 17 aa, Mycobacterium bovis
GSHAADIYAKFAADHAD

SEQ ID NO: 209502 - protein, 24 aa, Mycobacterium bovis
GSLYHAGVKLDWMVATTLLTGRRT

SEQ ID NO: 209503 - protein, 19 aa, Mycobacterium bovis
GSPGLELYSPAQLGLDHGH

SEQ ID NO: 209504 - protein, 20 aa, Mycobacterium bovis
GSPRPTLGVEWEFALVDSQT

SEQ ID NO: 209505 - protein, 19 aa, Mycobacterium bovis
GSVMKRAVERYDVNVVGLT

SEQ ID NO: 209506 - protein, 19 aa, Mycobacterium bovis
GSWSFVWRDVLLRLANDFR

SEQ ID NO: 209507 - protein, 59 aa, Mycobacterium bovis
GTALTRASSTWADSPRAWPIRAPSRLQVWRTRATTARECSIRVIISRVSSTGAPPKKVG

SEQ ID NO: 209508 - protein, 24 aa, Mycobacterium bovis
GTASSPFGIAIAIGGAGAQGGAGT

SEQ ID NO: 209509 - protein, 19 aa, Mycobacterium bovis
GTCRETPDGLVITATPLRP

SEQ ID NO: 209510 - protein, 26 aa, Mycobacterium bovis
GTGADGGAGGWLFGNGGNGGSGATGT

SEQ ID NO: 209511 - protein, 24 aa, Mycobacterium bovis
GTGANGGDGGWLIGNGGAGGSGAA

SEQ ID NO: 209512 - protein, 26 aa, Mycobacterium bovis
GTGQAGGNGGWLWGNGGNSGSGAPGQ

SEQ ID NO: 209513 - protein, 17 aa, Mycobacterium bovis
GVAACPEMALILEEDDA

SEQ ID NO: 209514 - protein, 19 aa, Mycobacterium bovis
GVAAVAPVCRLLRRLLGPT

SEQ ID NO: 209515 - protein, 19 aa, Mycobacterium bovis
GVAITLTWSQLYRRTLNVA

SEQ ID NO: 209516 - protein, 17 aa, Mycobacterium bovis
GVEKWRDGQFVAFEGSY

SEQ ID NO: 209517 - protein, 24 aa, Mycobacterium bovis
GVGGAGGLLFGYGGAGGAGGYSNI

SEQ ID NO: 209518 - protein, 25 aa, Mycobacterium bovis
GVGGNGGRGGWLLGNGGAGGVGGVG

SEQ ID NO: 209519 - protein, 27 aa, Mycobacterium bovis
GVGRRRCSRGGQWSGGRQRRAGQRRQR

SEQ ID NO: 209520 - protein, 26 aa, Mycobacterium bovis
GVRLAFVCAVDMPYLTVELIEDLARR

SEQ ID NO: 209521 - protein, 18 aa, Mycobacterium bovis
GVWPDMTEHGWATDEWPA

SEQ ID NO: 209522 - protein, 19 aa, Mycobacterium bovis
GWAGIKVGVDYEGDHHRTD

SEQ ID NO: 209523 - protein, 24 aa, Mycobacterium bovis
GWAGSLKRHGEWIVPTRLALVRRL

SEQ ID NO: 209524 - protein, 21 aa, Mycobacterium bovis
GYVMPHWPRPWGRAAGAVEQL

SEQ ID NO: 209525 - protein, 20 aa, Mycobacterium bovis
HAARRCATRLLDLHVVDGRL

SEQ ID NO: 209526 - protein, 17 aa, Mycobacterium bovis
HADCAKVGITSIRRDLP

SEQ ID NO: 209527 - protein, 25 aa, Mycobacterium bovis
HAGPGGYCGYLLYNLTTSGFRPATF

SEQ ID NO: 209528 - protein, 18 aa, Mycobacterium bovis
HDAYCLRIAITETMSDLP

SEQ ID NO: 209529 - protein, 23 aa, Mycobacterium bovis
HDDWRWVIDVDLWGSIHTVEAFL

SEQ ID NO: 209530 - protein, 22 aa, Mycobacterium bovis
HDLSSLRLLGSVGEPINPEAWR

SEQ ID NO: 209531 - protein, 27 aa, Mycobacterium bovis
HDNVFAIAAGLRWSAAVPPLHKGDAVT

SEQ ID NO: 209532 - protein, 25 aa, Mycobacterium bovis
HEDDWLAPGGFNFDAWRFENRCELL

SEQ ID NO: 209533 - protein, 20 aa, Mycobacterium bovis
HERSAFRLSPPVLSGAMGPF

SEQ ID NO: 209534 - protein, 17 aa, Mycobacterium bovis
HGGDGGNAVGLIGNGGA

SEQ ID NO: 209535 - protein, 26 aa, Mycobacterium bovis
HGLSLPRRLQIEFSQVIQKIAEGTAG

SEQ ID NO: 209536 - protein, 21 aa, Mycobacterium bovis
HGLTGPAIRIRCKSLLNTLHE

SEQ ID NO: 209537 - protein, 20 aa, Mycobacterium bovis
HGNAKRWGWIHADLGDGDVL

SEQ ID NO: 209538 - protein, 19 aa, Mycobacterium bovis
HGRTARWIEIAAEWGTRDY

SEQ ID NO: 209539 - protein, 20 aa, Mycobacterium bovis
HHGMLSVFGSPTWRTVTGGS

SEQ ID NO: 209540 - protein, 26 aa, Mycobacterium bovis
HHRAATRARLWPRSMTTLSTHDTKRG

SEQ ID NO: 209541 - protein, 18 aa, Mycobacterium bovis
HHRNEVTEIIPLDGFLDG

SEQ ID NO: 209542 - protein, 18 aa, Mycobacterium bovis
HKPEESKRTFGARIVTPS

SEQ ID NO: 209543 - protein, 24 aa, Mycobacterium bovis
HLADEAFRLLGHVDVVFSNAGIVV

SEQ ID NO: 209544 - protein, 21 aa, Mycobacterium bovis
HLKATLKHLACLEYSTVAIQN

SEQ ID NO: 209545 - protein, 18 aa, Mycobacterium bovis
HLRGHTPGSIALALGGPV

SEQ ID NO: 209546 - protein, 18 aa, Mycobacterium bovis
HLTEYGVRVLGGLSALNS

SEQ ID NO: 209547 - protein, 28 aa, Mycobacterium bovis
HNKTLRADACFVIGFGILRHIRCAGIDE

SEQ ID NO: 209548 - protein, 19 aa, Mycobacterium bovis
HPLIARAHLLLRFDRGNWI

SEQ ID NO: 209549 - protein, 21 aa, Mycobacterium bovis
HPRGPAVWYQRGRSGAPPVGG

SEQ ID NO: 209550 - protein, 17 aa, Mycobacterium bovis
HRAALNFGDCMTYATAQ

SEQ ID NO: 209551 - protein, 24 aa, Mycobacterium bovis
HRDLRLLAADMVFDLPVIGEAARK

SEQ ID NO: 209552 - protein, 17 aa, Mycobacterium bovis
HRSAVLTASLTSPRGKR

SEQ ID NO: 209553 - protein, 21 aa, Mycobacterium bovis
HRSPLGRLPLRIGRSKSNDMV

SEQ ID NO: 209554 - protein, 20 aa, Mycobacterium bovis
HRVGCPPIACLDEHQQDSRG

SEQ ID NO: 209555 - protein, 18 aa, Mycobacterium bovis
HRVGFGSVCEFPGPYPGY

SEQ ID NO: 209556 - protein, 25 aa, Mycobacterium bovis
HSARWDHTVPLLGRRIAVIGTGSTG

SEQ ID NO: 209557 - protein, 20 aa, Mycobacterium bovis
HSRIPMWVEETLRYDTSSQI

SEQ ID NO: 209558 - protein, 25 aa, Mycobacterium bovis
HTGPAMSAFNAWVLLKGLETLAIRV

SEQ ID NO: 209559 - protein, 29 aa, Mycobacterium bovis
HTRRLRFGLAAPLPRAGTQMRAFAQAVEA

SEQ ID NO: 209560 - protein, 17 aa, Mycobacterium bovis
HVAYWWSAEPQRLSMAA

SEQ ID NO: 209561 - protein, 20 aa, Mycobacterium bovis
HYTYKLDWLAALRDTAEGWL

SEQ ID NO: 209562 - protein, 17 aa, Mycobacterium bovis
IAAELYVAPSTVKTHVQ

SEQ ID NO: 209563 - protein, 17 aa, Mycobacterium bovis
IAEVKRASPSAGALATI

SEQ ID NO: 209564 - protein, 21 aa, Mycobacterium bovis
IAIDRLPAAIITRLTQTNDPL

SEQ ID NO: 209565 - protein, 27 aa, Mycobacterium bovis
IAMLACARLGIMHSVVFGGFTAAALQA

SEQ ID NO: 209566 - protein, 17 aa, Mycobacterium bovis
IAPVGPSAVSIELADGL

SEQ ID NO: 209567 - protein, 20 aa, Mycobacterium bovis
ICARRGPTLQWVRSAVTAQD

SEQ ID NO: 209568 - protein, 19 aa, Mycobacterium bovis
IDARKGVVVVGADRVGPTI

SEQ ID NO: 209569 - protein, 21 aa, Mycobacterium bovis
IDKVFVVACGTAYHSGLLAKY

SEQ ID NO: 209570 - protein, 20 aa, Mycobacterium bovis
IDKWLPLSWSLNMVNRSMGH

SEQ ID NO: 209571 - protein, 19 aa, Mycobacterium bovis
IDLRQDWPKALQKAGFDPS

SEQ ID NO: 209572 - protein, 20 aa, Mycobacterium bovis
IDYLRSRLTGIAGEGNKEID

SEQ ID NO: 209573 - protein, 17 aa, Mycobacterium bovis
IDYRALGGIDGRYPKIK

SEQ ID NO: 209574 - protein, 17 aa, Mycobacterium bovis
IEEAMRLAAEMGEQDPG

SEQ ID NO: 209575 - protein, 19 aa, Mycobacterium bovis
IERGIPLTMEMAKFIRFIV

SEQ ID NO: 209576 - protein, 19 aa, Mycobacterium bovis
IEVIEFCLGIPHLLKGEYT

SEQ ID NO: 209577 - protein, 17 aa, Mycobacterium bovis
IGGFAVNVGNGVGGLGG

SEQ ID NO: 209578 - protein, 17 aa, Mycobacterium bovis
IGLLGAVQTGAWQGPSA

SEQ ID NO: 209579 - protein, 17 aa, Mycobacterium bovis
IGMGNNFIQSAKTLGLI

SEQ ID NO: 209580 - protein, 24 aa, Mycobacterium bovis
IGVPRPYWRSKPISVVELRLDPPD

SEQ ID NO: 209581 - protein, 19 aa, Mycobacterium bovis
IHAALRINGFTVMLNDDVP

SEQ ID NO: 209582 - protein, 19 aa, Mycobacterium bovis
IHGVQFCQHHCPVSHVAEE

SEQ ID NO: 209583 - protein, 30 aa, Mycobacterium bovis
IHLDVPLYWQCWKLDSPIIARITDTVRAAA

SEQ ID NO: 209584 - protein, 26 aa, Mycobacterium bovis
IHNTQPWRWRVCPTSLELFSRPDMQL

SEQ ID NO: 209585 - protein, 19 aa, Mycobacterium bovis
IIRCLKRARRTGATRIEVT

SEQ ID NO: 209586 - protein, 20 aa, Mycobacterium bovis
ILCACCTTSCPVFWHEGSYF

SEQ ID NO: 209587 - protein, 18 aa, Mycobacterium bovis
ILDRGEKLMGFGHRVYRA

SEQ ID NO: 209588 - protein, 17 aa, Mycobacterium bovis
ILRALRINLTVRGYQVI

SEQ ID NO: 209589 - protein, 17 aa, Mycobacterium bovis
ILRRVELSTTTTSGERP

SEQ ID NO: 209590 - protein, 27 aa, Mycobacterium bovis
IQAAYWPRYGLGMGETYESVTVETKDQ

SEQ ID NO: 209591 - protein, 20 aa, Mycobacterium bovis
IQGLLTEAARTWADRLIGAA

SEQ ID NO: 209592 - protein, 21 aa, Mycobacterium bovis
IQKRLQVILDRQIMRKLAGHG

SEQ ID NO: 209593 - protein, 19 aa, Mycobacterium bovis
IQVLTQCRPELIERTFQAC

SEQ ID NO: 209594 - protein, 25 aa, Mycobacterium bovis
IRDFARASFSYGLNAKWPVYLSTKN

SEQ ID NO: 209595 - protein, 23 aa, Mycobacterium bovis
IRHRWNWTDVRRWLTDPTGRWHP

SEQ ID NO: 209596 - protein, 18 aa, Mycobacterium bovis
IRLRFGLDDGQPRTLDQI

SEQ ID NO: 209597 - protein, 19 aa, Mycobacterium bovis
IRRILRTQLGWAPDERTLQ

SEQ ID NO: 209598 - protein, 24 aa, Mycobacterium bovis
IRTGRANPGMFSRITIDYYGAATL

SEQ ID NO: 209599 - protein, 18 aa, Mycobacterium bovis
ISEQGITAAEEFLSDPEV

SEQ ID NO: 209600 - protein, 19 aa, Mycobacterium bovis
ISGGLMRLGSAVAPLLQVG

SEQ ID NO: 209601 - protein, 17 aa, Mycobacterium bovis
ISKPVGLGFSKGGGEND

SEQ ID NO: 209602 - protein, 20 aa, Mycobacterium bovis
ITALWEEWPPSGARASIHSY

SEQ ID NO: 209603 - protein, 18 aa, Mycobacterium bovis
ITSGEMYLGPGAGPMLAA

SEQ ID NO: 209604 - protein, 22 aa, Mycobacterium bovis
IVDEPFLAPARIDLTALRAHAV

SEQ ID NO: 209605 - protein, 18 aa, Mycobacterium bovis
IVPPPLIAANRARLTSLV

SEQ ID NO: 209606 - protein, 19 aa, Mycobacterium bovis
KALADFLFDDERAMVRIDM

SEQ ID NO: 209607 - protein, 18 aa, Mycobacterium bovis
KASSVMLESFLFYSGFYL

SEQ ID NO: 209608 - protein, 28 aa, Mycobacterium bovis
KATMRISARWPLSRTRCATATSTPARIR

SEQ ID NO: 209609 - protein, 21 aa, Mycobacterium bovis
KDKRVLRLVNWQRIRHRWNWT

SEQ ID NO: 209610 - protein, 25 aa, Mycobacterium bovis
KDRMIGIDATHAWASVWTPQQPGRF

SEQ ID NO: 209611 - protein, 25 aa, Mycobacterium bovis
KDRMPTPYLPVGLKLNALEGTGEVQ

SEQ ID NO: 209612 - protein, 20 aa, Mycobacterium bovis
KDTAAPLWTFPRVAWERELL

SEQ ID NO: 209613 - protein, 20 aa, Mycobacterium bovis
KEGNRFAGVFWSELSSGGVV

SEQ ID NO: 209614 - protein, 22 aa, Mycobacterium bovis
KGTGAYAGPRYGFKPTVMPKQV

SEQ ID NO: 209615 - protein, 24 aa, Mycobacterium bovis
KGTLFRRFGSRAGLMMVLLDEDER

SEQ ID NO: 209616 - protein, 19 aa, Mycobacterium bovis
KINAAFALGGGRLLTQTVE

SEQ ID NO: 209617 - protein, 22 aa, Mycobacterium bovis
KKLGPVRPYGFLLICPVRSLDK

SEQ ID NO: 209618 - protein, 40 aa, Mycobacterium bovis; identical to SEQ ID NO: 99181

SEQ ID NO: 209619 - protein, 22 aa, Mycobacterium bovis
KLRDRPRLGVSVLAEGHDAACM

SEQ ID NO: 209620 - protein, 27 aa, Mycobacterium bovis
KLSEERKVNALKFIAFVTNPTNTAYFS

SEQ ID NO: 209621 - protein, 20 aa, Mycobacterium bovis
KNVRCLLIYNQQWIGSTTTV

SEQ ID NO: 209622 - protein, 18 aa, Mycobacterium bovis
KPGLRRLAPLAFVRFRID

SEQ ID NO: 209623 - protein, 21 aa, Mycobacterium bovis
KPKVALIAAHYQIDFSEHYLA

SEQ ID NO: 209624 - protein, 17 aa, Mycobacterium bovis
KPVGLGFSKGGGENDYE

SEQ ID NO: 209625 - protein, 20 aa, Mycobacterium bovis
KPVRLCLDFDAGYWRAGGRI

SEQ ID NO: 209626 - protein, 19 aa, Mycobacterium bovis
KQILDVVGSWTMSNSAQRD

SEQ ID NO: 209627 - protein, 18 aa, Mycobacterium bovis
KQLRARSSVPVIMVTARD

SEQ ID NO: 209628 - protein, 28 aa, Mycobacterium bovis
KRLPRLIRMQRFWISLYFPLTMRSLCNA

SEQ ID NO: 209629 - protein, 20 aa, Mycobacterium bovis
KTLTCVLPAYLNALAGNGVH

SEQ ID NO: 209630 - protein, 17 aa, Mycobacterium bovis
KVEAPGGEAARQITSVL

SEQ ID NO: 209631 - protein, 20 aa, Mycobacterium bovis
KVGLRRGKIIVVRPEHDHGL

SEQ ID NO: 209632 - protein, 18 aa, Mycobacterium bovis
KVPTPLLDFIAPKVAGLS

SEQ ID NO: 209633 - protein, 26 aa, Mycobacterium bovis
KVSARPSDSVAIALRVGVPIYVEEAV

SEQ ID NO: 209634 - protein, 22 aa, Mycobacterium bovis
LAAAAGELRSLGATLKASNAAA

SEQ ID NO: 209635 - protein, 18 aa, Mycobacterium bovis
LAAIQARAAATAFEAALA

SEQ ID NO: 209636 - protein, 17 aa, Mycobacterium bovis
LAEELTRSWRVQWPELP

SEQ ID NO: 209637 - protein, 17 aa, Mycobacterium bovis
LAELGWLGLHIDERHGG

SEQ ID NO: 209638 - protein, 18 aa, Mycobacterium bovis
LAGQSWQGAAAAMAAAAA

SEQ ID NO: 209639 - protein, 21 aa, Mycobacterium bovis
LAHGTTIRFTHELRMTLRELG

SEQ ID NO: 209640 - protein, 17 aa, Mycobacterium bovis
LALTGKRKPYIYTSTIA

SEQ ID NO: 209641 - protein, 26 aa, Mycobacterium bovis
LALTRFHIFSHSWGGMLAQQYVLDKA

SEQ ID NO: 209642 - protein, 22 aa, Mycobacterium bovis
LANTGRPLIGNGANGAPGTGAN

SEQ ID NO: 209643 - protein, 17 aa, Mycobacterium bovis
LARPRTDFHTEILRMQK

SEQ ID NO: 209644 - protein, 18 aa, Mycobacterium bovis
LASRLIDVTGWLATQPDT

SEQ ID NO: 209645 - protein, 18 aa, Mycobacterium bovis
LATDSWLSAASFQETTRV

SEQ ID NO: 209646 - protein, 17 aa, Mycobacterium bovis
LATEPDAHYVLVSTRDP

SEQ ID NO: 209647 - protein, 32 aa, Mycobacterium bovis
LAVAHALALQFGWRLFAPMLRSATGIDELTGD

SEQ ID NO: 209648 - protein, 17 aa, Mycobacterium bovis
LCLLAGAIQARRVLEIG

SEQ ID NO: 209649 - protein, 18 aa, Mycobacterium bovis
LCSPTRASLLTGRNATTA

SEQ ID NO: 209650 - protein, 22 aa, Mycobacterium bovis
LCSVSNRPAIYVATYFGDPGAA

SEQ ID NO: 209651 - protein, 17 aa, Mycobacterium bovis
LDAPICLTWELTYACNL

SEQ ID NO: 209652 - protein, 25 aa, Mycobacterium bovis
LDGYPRLHLKLSVIGVAAGVAGLLS

SEQ ID NO: 209653 - protein, 23 aa, Mycobacterium bovis
LDILRTEIWPLLADRSPITKLER

SEQ ID NO: 209654 - protein, 20 aa, Mycobacterium bovis
LDKIFYRSGQGVTLQAVSYG

SEQ ID NO: 209655 - protein, 17 aa, Mycobacterium bovis
LDKMGWRSSDTAELCYT

SEQ ID NO: 209656 - protein, 17 aa, Mycobacterium bovis
LDLGDDCVFDYEAQLLA

SEQ ID NO: 209657 - protein, 17 aa, Mycobacterium bovis
LDRARAGGEVVITERGI

SEQ ID NO: 209658 - protein, 19 aa, Mycobacterium bovis
LDVRWRLDEPDGHAAYLQG

SEQ ID NO: 209659 - protein, 17 aa, Mycobacterium bovis
LEAGVLVLGSFPSGRRA

SEQ ID NO: 209660 - protein, 17 aa, Mycobacterium bovis
LENPQWCARVIGEHGDQ

SEQ ID NO: 209661 - protein, 18 aa, Mycobacterium bovis
LEPLEVTSRWIAGENPET

SEQ ID NO: 209662 - protein, 19 aa, Mycobacterium bovis
LEPPRFCAQCGRRMVVQVR

SEQ ID NO: 209663 - protein, 17 aa, Mycobacterium bovis
LEQLEFGLVREALYERE

SEQ ID NO: 209664 - protein, 17 aa, Mycobacterium bovis
LEYALAHDERFGIWGGL

SEQ ID NO: 209665 - protein, 19 aa, Mycobacterium bovis
LFAGWRSDPAFVLNLSPFD

SEQ ID NO: 209666 - protein, 18 aa, Mycobacterium bovis
LFASEVAMEIALNAVRIH

SEQ ID NO: 209667 - protein, 23 aa, Mycobacterium bovis
LFRESYRAFLDRHVAPYHDEWEK

SEQ ID NO: 209668 - protein, 27 aa, Mycobacterium bovis
LFRNKIPIVAAIGSPVRPEGNAEQLNA

SEQ ID NO: 209669 - protein, 18 aa, Mycobacterium bovis
LGASLLIRAARPVASPAL

SEQ ID NO: 209670 - protein, 21 aa, Mycobacterium bovis
LGEPHAISAMHGRGVADLLDG

SEQ ID NO: 209671 - protein, 23 aa, Mycobacterium bovis
LGPCPQHRYSFINVRRVASGSNT

SEQ ID NO: 209672 - protein, 19 aa, Mycobacterium bovis
LGPLISALLNPGARNAAPL

SEQ ID NO: 209673 - protein, 18 aa, Mycobacterium bovis
LGQWPFTSGPGFGHTRNP

SEQ ID NO: 209674 - protein, 17 aa, Mycobacterium bovis
LGSEVLAAKAIPERAMR

SEQ ID NO: 209675 - protein, 23 aa, Mycobacterium bovis
LGVRPPVEADWLLLVELAADHDQ

SEQ ID NO: 209676 - protein, 18 aa, Mycobacterium bovis
LHGARYSGWQGLLDAQRA

SEQ ID NO: 209677 - protein, 23 aa, Mycobacterium bovis
LHHPRIPPIAGLDDFRGTVFHSA

SEQ ID NO: 209678 - protein, 25 aa, Mycobacterium bovis
LHRAFKMLAEDGIDLQTCGLVAVGH

SEQ ID NO: 209679 - protein, 24 aa, Mycobacterium bovis
LHRLLRRYRLELSRPDYQPRWDYS

SEQ ID NO: 209680 - protein, 17 aa, Mycobacterium bovis
LIAFGRERMRFVHAHHQ

SEQ ID NO: 209681 - protein, 23 aa, Mycobacterium bovis
LIALRRCPAETAFDELHNAAQRH

SEQ ID NO: 209682 - protein, 18 aa, Mycobacterium bovis
LIERDAWLRCMHTAVASI

SEQ ID NO: 209683 - protein, 19 aa, Mycobacterium bovis
LISELKQQYTIVIVTHNMQ

SEQ ID NO: 209684 - protein, 24 aa, Mycobacterium bovis
LITVLKGAVLFVTDLARAIPVPTQ

SEQ ID NO: 209685 - protein, 17 aa, Mycobacterium bovis
LKESVQAHGIYNQNLQA

SEQ ID NO: 209686 - protein, 17 aa, Mycobacterium bovis
LKPPRSGLPVIEVLDTE

SEQ ID NO: 209687 - protein, 18 aa, Mycobacterium bovis
LKQQYTIVIVTHNMQQAA

SEQ ID NO: 209688 - protein, 17 aa, Mycobacterium bovis
LLAAELWERGRIVRSLG

SEQ ID NO: 209689 - protein, 19 aa, Mycobacterium bovis
LLAFTAFPKQIWRQIWSNN

SEQ ID NO: 209690 - protein, 21 aa, Mycobacterium bovis
LLARIGDAFLALPNGFTAHPR

SEQ ID NO: 209691 - protein, 24 aa, Mycobacterium bovis
LLARRMGKTRVIAETGAGQHGVAT

SEQ ID NO: 209692 - protein, 17 aa, Mycobacterium bovis
LLASSGFAARLAGRSAD

SEQ ID NO: 209693 - protein, 17 aa, Mycobacterium bovis
LLATRFSEFAVHVVEVC

SEQ ID NO: 209694 - protein, 21 aa, Mycobacterium bovis
LLEALPQFRFDADACELLAQF

SEQ ID NO: 209695 - protein, 25 aa, Mycobacterium bovis
LLGLVERLPWLSAVPAYFVGLGVRP

SEQ ID NO: 209696 - protein, 17 aa, Mycobacterium bovis
LLGRPLIGDGAHGTAPG

SEQ ID NO: 209697 - protein, 18 aa, Mycobacterium bovis
LLHRADAAVLPSHYEPFG

SEQ ID NO: 209698 - protein, 26 aa, Mycobacterium bovis
LLLILRRPRAGLSYEALLETVEQRLP

SEQ ID NO: 209699 - protein, 25 aa, Mycobacterium bovis
LLSMRTGQGYAEFAVSSFGTDAVIG

SEQ ID NO: 209700 - protein, 17 aa, Mycobacterium bovis
LLTALGVKFTEHGNVAR

SEQ ID NO: 209701 - protein, 17 aa, Mycobacterium bovis
LLVPPSDRPWRLAMSTA

SEQ ID NO: 209702 - protein, 17 aa, Mycobacterium bovis
LLVSARSLLQCAALHDL

SEQ ID NO: 209703 - protein, 27 aa, Mycobacterium bovis
LMAATPKPSWPWVRTLLHSIYDQPDAE

SEQ ID NO: 209704 - protein, 19 aa, Mycobacterium bovis
LMAELPAGGVMVVAASEEE

SEQ ID NO: 209705 - protein, 17 aa, Mycobacterium bovis
LMIACNLGAEPTCVPVS

SEQ ID NO: 209706 - protein, 20 aa, Mycobacterium bovis
LMRRGELVIVFPGGAREVNK

SEQ ID NO: 209707 - protein, 24 aa, Mycobacterium bovis
LMSRAGYPTACFVSINRHKSVANY

SEQ ID NO: 209708 - protein, 27 aa, Mycobacterium bovis
LMTLDVDRDCFARIAPGLPSSVIRIAE

SEQ ID NO: 209709 - protein, 23 aa, Mycobacterium bovis
LMVEAVAPYVAWMRATAIQAEQA

SEQ ID NO: 209710 - protein, 25 aa, Mycobacterium bovis
LNAQAAAFHHSFVQTLNAAGGAYSS

SEQ ID NO: 209711 - protein, 17 aa, Mycobacterium bovis
LNRLRALTHDDFRNAWF

SEQ ID NO: 209712 - protein, 18 aa, Mycobacterium bovis
LPAWAESSTSHYVQTKDP

SEQ ID NO: 209713 - protein, 21 aa, Mycobacterium bovis
LPGMVKRGAGAVLNIASIAGF

SEQ ID NO: 209714 - protein, 18 aa, Mycobacterium bovis
LPSRVWRAVREARDVLDD

SEQ ID NO: 209715 - protein, 24 aa, Mycobacterium bovis
LPSTTMGGFAIPAGPGYFNSSATP

SEQ ID NO: 209716 - protein, 25 aa, Mycobacterium bovis
LPVDQLRYPVFSWQRITLQEMTHMR

SEQ ID NO: 209717 - protein, 17 aa, Mycobacterium bovis
LPVPARRVGRVILVDEP

SEQ ID NO: 209718 - protein, 21 aa, Mycobacterium bovis
LPVRVGRDVPGFIGNRLQHAL

SEQ ID NO: 209719 - protein, 23 aa, Mycobacterium bovis
LPVSYRPGLLCVRQKRFTHMGEY

SEQ ID NO: 209720 - protein, 17 aa, Mycobacterium bovis
LQAGRIAVPLSVPQGGV

SEQ ID NO: 209721 - protein, 19 aa, Mycobacterium bovis
LQHALWREAIALVAEGVCD

SEQ ID NO: 209722 - protein, 24 aa, Mycobacterium bovis
LQHASMLFLPVRILTSPITTLASM

SEQ ID NO: 209723 - protein, 18 aa, Mycobacterium bovis
LQRCYSGLELRDDRLVLS

SEQ ID NO: 209724 - protein, 20 aa, Mycobacterium bovis
LQSFLPPPFDAIPNPIEDLD

SEQ ID NO: 209725 - protein, 21 aa, Mycobacterium bovis
LRAAAQHWATWAMQKQELARN

SEQ ID NO: 209726 - protein, 32 aa, Mycobacterium bovis
LRAEARAHFGFPDDARVLLVFGGSQGAVSLNR

SEQ ID NO: 209727 - protein, 19 aa, Mycobacterium bovis
LRAELTVACDGRWSIARHE

SEQ ID NO: 209728 - protein, 22 aa, Mycobacterium bovis
LRAHVPDAGGMIIASDRTTARA

SEQ ID NO: 209729 - protein, 25 aa, Mycobacterium bovis
LRERYPQWDRFAAVRDRLDPDRVFL

SEQ ID NO: 209730 - protein, 17 aa, Mycobacterium bovis
LRFPKKQGMRIDFILGS

SEQ ID NO: 209731 - protein, 18 aa, Mycobacterium bovis
LRILLGLVKADGGSVRLL

SEQ ID NO: 209732 - protein, 24 aa, Mycobacterium bovis
LRLNRARPTPWRVPDVDSLPELVA

SEQ ID NO: 209733 - protein, 24 aa, Mycobacterium bovis
LRLSHPELLYHPTQSWVVDDNFDL

SEQ ID NO: 209734 - protein, 20 aa, Mycobacterium bovis
LRPHYIKTLRIWGDTLQSNK

SEQ ID NO: 209735 - protein, 24 aa, Mycobacterium bovis
LRPSDLARAIAFVAETPRGCVVVN

SEQ ID NO: 209736 - protein, 19 aa, Mycobacterium bovis
LRRAEEFERAAGRVRGQRW

SEQ ID NO: 209737 - protein, 17 aa, Mycobacterium bovis
LRRCGRCGRKASWYDRG

SEQ ID NO: 209738 - protein, 17 aa, Mycobacterium bovis
LRRDEWLHRRFGDIVQL

SEQ ID NO: 209739 - protein, 21 aa, Mycobacterium bovis
LRRLAPLAFVRFRIDGKDWPA

SEQ ID NO: 209740 - protein, 19 aa, Mycobacterium bovis
LRRSGRISGAKAWLGTALA

SEQ ID NO: 209741 - protein, 18 aa, Mycobacterium bovis
LRSLGATLKASNAAAAVP

SEQ ID NO: 209742 - protein, 25 aa, Mycobacterium bovis
LRVWSRATIGLAYASALIIADRHDE

SEQ ID NO: 209743 - protein, 23 aa, Mycobacterium bovis
LSDQEIMAFLFLMVIAGNETTTK

SEQ ID NO: 209744 - protein, 17 aa, Mycobacterium bovis
LSKLVRHHLLLPITATR

SEQ ID NO: 209745 - protein, 20 aa, Mycobacterium bovis
LSPDGRCKAFAAAADGTGFS

SEQ ID NO: 209746 - protein, 18 aa, Mycobacterium bovis
LSRRLAHWTRLYPEVRVD

SEQ ID NO: 209747 - protein, 28 aa, Mycobacterium bovis
LSTQAAAFHSRFVQALTTAAASYASVEA

SEQ ID NO: 209748 - protein, 21 aa, Mycobacterium bovis
LSVEVNGGIGPIVVPDITIPG

SEQ ID NO: 209749 - protein, 33 aa, Mycobacterium bovis
LTAAATPGWLEWFINWYLPISQLFYNTVGLPYF

SEQ ID NO: 209750 - protein, 19 aa, Mycobacterium bovis
LTDEARMAPDLRGRISMAS

SEQ ID NO: 209751 - protein, 19 aa, Mycobacterium bovis
LTEAFLWEEHRRVTKTATV

SEQ ID NO: 209752 - protein, 17 aa, Mycobacterium bovis
LTGGVAWEGLNNLGAAT

SEQ ID NO: 209753 - protein, 19 aa, Mycobacterium bovis
LTIRLLGRTEIRRLAKELD

SEQ ID NO: 209754 - protein, 19 aa, Mycobacterium bovis
LTIVEGFALLSVPSSFVQN

SEQ ID NO: 209755 - protein, 19 aa, Mycobacterium bovis
LTQELRFATTMTGGVSLAI

SEQ ID NO: 209756 - protein, 18 aa, Mycobacterium bovis
LTSVFRATRAALRYFRDA

SEQ ID NO: 209757 - protein, 17 aa, Mycobacterium bovis
LTTVCYQFGNAKPVYAL

SEQ ID NO: 209758 - protein, 17 aa, Mycobacterium bovis
LTVACDGRWSIARHEAG

SEQ ID NO: 209759 - protein, 21 aa, Mycobacterium bovis
LTVAEWSHLLAGHGLVVEHVV

SEQ ID NO: 209760 - protein, 23 aa, Mycobacterium bovis
LTVPEKPRGIVVLAHGSGSSRHS

SEQ ID NO: 209761 - protein, 24 aa, Mycobacterium bovis
LTWLLSRWACVFGTPACQGTVAGR

SEQ ID NO: 209762 - protein, 18 aa, Mycobacterium bovis
LVAALQRRGHLAAVGLDR

SEQ ID NO: 209763 - protein, 18 aa, Mycobacterium bovis
LVASFAIDELLDYRSRRP

SEQ ID NO: 209764 - protein, 18 aa, Mycobacterium bovis
LVGGSWQGRSSVAMAAAA

SEQ ID NO: 209765 - protein, 25 aa, Mycobacterium bovis
LVGLQRLSPRWDDGRDGPHVRLWAK

SEQ ID NO: 209766 - protein, 20 aa, Mycobacterium bovis
LVHHPCVGDLGWIADAPKAP

SEQ ID NO: 209767 - protein, 18 aa, Mycobacterium bovis
LVRYWRLLRFKLANPHII

SEQ ID NO: 209768 - protein, 24 aa, Mycobacterium bovis
LVVRRTGIEMAWSEGRDLWWHHVV

SEQ ID NO: 209769 - protein, 17 aa, Mycobacterium bovis
LVYPAMKALTLDIASMV

SEQ ID NO: 209770 - protein, 24 aa, Mycobacterium bovis
LWAATFLRRRGAAADAVLLNPDRT

SEQ ID NO: 209771 - protein, 21 aa, Mycobacterium bovis
LWAGLRAADCALFVIAANEGV

SEQ ID NO: 209772 - protein, 18 aa, Mycobacterium bovis
LWAGVAVSDLEFIQFHPT

SEQ ID NO: 209773 - protein, 18 aa, Mycobacterium bovis
LYEKFFRIGFKKQAEALG

SEQ ID NO: 209774 - protein, 19 aa, Mycobacterium bovis
LYHLSRPAEALAWMCDRAV

SEQ ID NO: 209775 - protein, 19 aa, Mycobacterium bovis
LYISYLRKKIDNGREPMIH

SEQ ID NO: 209776 - protein, 19 aa, Mycobacterium bovis
MAAAASPYVGWLSTVASQA

SEQ ID NO: 209777 - protein, 17 aa, Mycobacterium bovis
MAGAPGFEADDVLGTLA

SEQ ID NO: 209778 - protein, 17 aa, Mycobacterium bovis
MAGCDDVYYCVVDTRAW

SEQ ID NO: 209779 - protein, 18 aa, Mycobacterium bovis
MCRRCPVIEACRSHALEV

SEQ ID NO: 209780 - protein, 22 aa, Mycobacterium bovis
MIEMLRGGPDYLMFLYKTKGPV

SEQ ID NO: 209781 - protein, 18 aa, Mycobacterium bovis
MKTDHGLSLPRRLQIEFS

SEQ ID NO: 209782 - protein, 30 aa, Mycobacterium bovis
MLESFLFYSGFYLPMYWSSRGKLTNTADLI

SEQ ID NO: 209783 - protein, 18 aa, Mycobacterium bovis
MLGGLPVGQMGARAGGGL

SEQ ID NO: 209784 - protein, 19 aa, Mycobacterium bovis
MLPTGEVVRRCYTDVLAAA

SEQ ID NO: 209785 - protein, 28 aa, Mycobacterium bovis
MLVSSWQMPGGIYAPMMHPWSTGKDVYF

SEQ ID NO: 209786 - protein, 20 aa, Mycobacterium bovis
MMPLQEVVRIAADEAGVPPP

SEQ ID NO: 209787 - protein, 17 aa, Mycobacterium bovis
MPGRPRPGYLPRVIDGA

SEQ ID NO: 209788 - protein, 19 aa, Mycobacterium bovis
MPRKPGGDLARLPSRVWRA

SEQ ID NO: 209789 - protein, 17 aa, Mycobacterium bovis
MPVNSFAGTRGWGYDGV

SEQ ID NO: 209790 - protein, 17 aa, Mycobacterium bovis
MRAPLSASGDAVPAELL

SEQ ID NO: 209791 - protein, 27 aa, Mycobacterium bovis
MRDELRSLLRFVLDLLADYGLTDFYLE

SEQ ID NO: 209792 - protein, 27 aa, Mycobacterium bovis
MRRTNACDRRRFGLSLTIHEDACRIIS

SEQ ID NO: 209793 - protein, 17 aa, Mycobacterium bovis
MRTTLGVRHWQLEGRIG

SEQ ID NO: 209794 - protein, 22 aa, Mycobacterium bovis
MRVPLEGGGRLVVELTPDEAAA

SEQ ID NO: 209795 - protein, 24 aa, Mycobacterium bovis
MTGVAASYARWLTTAAAQAEQAAG

SEQ ID NO: 209796 - protein, 18 aa, Mycobacterium bovis
MTSAGGLLEQAAAVEEAS

SEQ ID NO: 209797 - protein, 19 aa, Mycobacterium bovis
MVDDCVRRVARWMPQPDGM

SEQ ID NO: 209798 - protein, 19 aa, Mycobacterium bovis
MVELFPGIVERIDTQLPNW

SEQ ID NO: 209799 - protein, 25 aa, Mycobacterium bovis
MVFQRPNPFPAMSIRNNVVAGLKLQ

SEQ ID NO: 209800 - protein, 17 aa, Mycobacterium bovis
MVKRLKKVADYVGTLSD

SEQ ID NO: 209801 - protein, 21 aa, Mycobacterium bovis
MWKKSMTVRELWVSVTDPDAL

SEQ ID NO: 209802 - protein, 19 aa, Mycobacterium bovis
MYVGLLLILRRPRAGLSYE

SEQ ID NO: 209803 - protein, 27 aa, Mycobacterium bovis
NAPAQTLLGRPLIGNGADGSTPGQAGG

SEQ ID NO: 209804 - protein, 19 aa, Mycobacterium bovis
NASLKRTRITIAVNADSMA

SEQ ID NO: 209805 - protein, 25 aa, Mycobacterium bovis
NELPFNVAGIFTGYIGPIPLSTFVL

SEQ ID NO: 209806 - protein, 26 aa, Mycobacterium bovis
NELREMLPHNAVEYFVSYYDYYQPEA

SEQ ID NO: 209807 - protein, 23 aa, Mycobacterium bovis
NFGAMLRAECARLNRAGLTTCSE

SEQ ID NO: 209808 - protein, 19 aa, Mycobacterium bovis
NFGDCLSYALAIDRREPLL

SEQ ID NO: 209809 - protein, 21 aa, Mycobacterium bovis
NGAAGGAGWSPDSDLKGFDGF

SEQ ID NO: 209810 - protein, 22 aa, Mycobacterium bovis
NGGDALGLVGVGGNGGNAGTGF

SEQ ID NO: 209811 - protein, 27 aa, Mycobacterium bovis
NGGLGGAGRDGGAPGGDGGDGGTGGSG

SEQ ID NO: 209812 - protein, 19 aa, Mycobacterium bovis
NGGTGGNGLLFGAGGTGGA

SEQ ID NO: 209813 - protein, 19 aa, Mycobacterium bovis
NGVARVIAYRWLRVGRLPV

SEQ ID NO: 209814 - protein, 25 aa, Mycobacterium bovis
NGVDGFDINETTGRDGGDGGDGGYG

SEQ ID NO: 209815 - protein, 21 aa, Mycobacterium bovis
NHYPIGWAMAFNTPYKLFKRY

SEQ ID NO: 209816 - protein, 23 aa, Mycobacterium bovis
NLAQDRIRTWSDWFDNNTRSARY

SEQ ID NO: 209817 - protein, 18 aa, Mycobacterium bovis
NNIGFGLTGDNLVGIGAL

SEQ ID NO: 209818 - protein, 22 aa, Mycobacterium bovis
NPIARLVWRLCKIDGKPSRYRS

SEQ ID NO: 209819 - protein, 25 aa, Mycobacterium bovis
NPVEAFQFYFELLLFDYPTHIVQIV

SEQ ID NO: 209820 - protein, 18 aa, Mycobacterium bovis
NPYLPPYYHPGLNAPEIR

SEQ ID NO: 209821 - protein, 19 aa, Mycobacterium bovis
NPYLQRKAQIIVDYYRGDD

SEQ ID NO: 209822 - protein, 18 aa, Mycobacterium bovis
NQFGRDFDDRLAVAIHFA

SEQ ID NO: 209823 - protein, 25 aa, Mycobacterium bovis
NQIGCSLRLFVYDCAADRAMTARRR

SEQ ID NO: 209824 - protein, 17 aa, Mycobacterium bovis
NQVLPEEVRNCFADMAK

SEQ ID NO: 209825 - protein, 23 aa, Mycobacterium bovis
NRFPDPKDRCHLATIGVQPLVPD

SEQ ID NO: 209826 - protein, 21 aa, Mycobacterium bovis
NRQEIKQALLALQRVSERDTD

SEQ ID NO: 209827 - protein, 19 aa, Mycobacterium bovis
NTIGLRLATLGPLENADYI

SEQ ID NO: 209828 - protein, 26 aa, Mycobacterium bovis
NTPVVWRGPMLHRALQQFLADVYWGD

SEQ ID NO: 209829 - protein, 18 aa, Mycobacterium bovis
NTRMPSCRAHLLKEGLRH

SEQ ID NO: 209830 - protein, 25 aa, Mycobacterium bovis
NVPRLVPGWTKPIVIGRHAFGDQYR

SEQ ID NO: 209831 - protein, 26 aa, Mycobacterium bovis
NYDDFFKRCFNIMPADGRMTVQSSVS

SEQ ID NO: 209832 - protein, 19 aa, Mycobacterium bovis
PAGIPLEPGIYEWRVEVEG

SEQ ID NO: 209833 - protein, 17 aa, Mycobacterium bovis
PAGRFLLREVRSGRDHS

SEQ ID NO: 209834 - protein, 20 aa, Mycobacterium bovis
PAHRAGAAYAELALLRGDPS

SEQ ID NO: 209835 - protein, 18 aa, Mycobacterium bovis
PAPMANSLPGQWTAHVTL

SEQ ID NO: 209836 - protein, 24 aa, Mycobacterium bovis
PASYDASLRVSWRQLQPTDPRTLP

SEQ ID NO: 209837 - protein, 22 aa, Mycobacterium bovis
PDQARAALIVLMQRYLVGDLAA

SEQ ID NO: 209838 - protein, 22 aa, Mycobacterium bovis
PDRVIDRAPLWCAVDLRDGNQA

SEQ ID NO: 209839 - protein, 17 aa, Mycobacterium bovis
PDSLHWDCFSFGVIQRA

SEQ ID NO: 209840 - protein, 17 aa, Mycobacterium bovis
PDTPGGAGEPGGAGGAG

SEQ ID NO: 209841 - protein, 20 aa, Mycobacterium bovis
PDTWVLWNLTGGPRGGGVHV

SEQ ID NO: 209842 - protein, 19 aa, Mycobacterium bovis
PDYSITGWVILTLIQHGTP

SEQ ID NO: 209843 - protein, 21 aa, Mycobacterium bovis
PEINSGRMFFGAGSGPMLAAA

SEQ ID NO: 209844 - protein, 25 aa, Mycobacterium bovis
PEINSGRMFFGAGSGPMLAAAAAWD

SEQ ID NO: 209845 - protein, 20 aa, Mycobacterium bovis
PEITTPPFAIDPIGLSGFTL

SEQ ID NO: 209846 - protein, 21 aa, Mycobacterium bovis
PEPDLPRWRRAVEVATQRWVA

SEQ ID NO: 209847 - protein, 19 aa, Mycobacterium bovis
PEPHPVLPTTPWQHTQHWI

SEQ ID NO: 209848 - protein, 18 aa, Mycobacterium bovis
PEPISYTALDRGDLQRAM

SEQ ID NO: 209849 - protein, 20 aa, Mycobacterium bovis
PERAGLLTALGVKFTEHGNV

SEQ ID NO: 209850 - protein, 22 aa, Mycobacterium bovis
PETIAYGLIPRAHRGIVAVNEL

SEQ ID NO: 209851 - protein, 20 aa, Mycobacterium bovis
PETPVAVVAFASWPQQRTLR

SEQ ID NO: 209852 - protein, 30 aa, Mycobacterium bovis
PFDQLSELWKAISPHLSPLSNIVSMLNNHV

SEQ ID NO: 209853 - protein, 18 aa, Mycobacterium bovis
PFEPFAVAVVELADEGLI

SEQ ID NO: 209854 - protein, 19 aa, Mycobacterium bovis
PGANGIAGNGGDGGDGAAG

SEQ ID NO: 209855 - protein, 19 aa, Mycobacterium bovis
PGEQVCAPSAIVRPTSEAE

SEQ ID NO: 209856 - protein, 19 aa, Mycobacterium bovis
PGMHALRASTIVAALQYMV

SEQ ID NO: 209857 - protein, 26 aa, Mycobacterium bovis
PGPWKESLRLLAHEVMPRLNARLATK

SEQ ID NO: 209858 - protein, 24 aa, Mycobacterium bovis
PGVNELFALLAYGEVAAFYRLTDE

SEQ ID NO: 209859 - protein, 20 aa, Mycobacterium bovis
PHALKGRFSGVAMAAVDDDE

SEQ ID NO: 209860 - protein, 17 aa, Mycobacterium bovis
PHARIKASHFIQEDSGT

SEQ ID NO: 209861 - protein, 19 aa, Mycobacterium bovis
PHGSRPGIDLVVAAEAGMT

SEQ ID NO: 209862 - protein, 19 aa, Mycobacterium bovis
PHIVGAALFEALAETTTWD

SEQ ID NO: 209863 - protein, 26 aa, Mycobacterium bovis
PHLDIPRAPVTLNYLFGSQPGGPLKI

SEQ ID NO: 209864 - protein, 25 aa, Mycobacterium bovis
PHPTSRRELLAALTKRGRDVVRQVT

SEQ ID NO: 209865 - protein, 18 aa, Mycobacterium bovis
PILDDAAAWFIGRTASRS

SEQ ID NO: 209866 - protein, 27 aa, Mycobacterium bovis
PKFDVPLPTAVRWAMRIPGGKAVHRLL

SEQ ID NO: 209867 - protein, 17 aa, Mycobacterium bovis
PKIAALIRHIEDLHARH

SEQ ID NO: 209868 - protein, 17 aa, Mycobacterium bovis
PKIKQWLSQVLGNFPVY

SEQ ID NO: 209869 - protein, 17 aa, Mycobacterium bovis
PLDAPRPMPPEVADHVA

SEQ ID NO: 209870 - protein, 17 aa, Mycobacterium bovis
PLDSVYFAGYAMWNYLT

SEQ ID NO: 209871 - protein, 19 aa, Mycobacterium bovis
PLGEMRYLPVASRPFVQRH

SEQ ID NO: 209872 - protein, 17 aa, Mycobacterium bovis
PLHVAVYRRVIAEFNGG

SEQ ID NO: 209873 - protein, 17 aa, Mycobacterium bovis
PLIFARRRLIAAGTTRG

SEQ ID NO: 209874 - protein, 24 aa, Mycobacterium bovis
PLMRGYLRLGARACGEPAHDPDFG

SEQ ID NO: 209875 - protein, 24 aa, Mycobacterium bovis
PLPGPRLPHDMAFTENYVILNDFP

SEQ ID NO: 209876 - protein, 18 aa, Mycobacterium bovis
PLRPWKKEQLGGGYQVST

SEQ ID NO: 209877 - protein, 18 aa, Mycobacterium bovis
PLRRGLVWRRRASELRTE

SEQ ID NO: 209878 - protein, 25 aa, Mycobacterium bovis
PLTPGRMTTKWGGFVPDVAGFDAEF

SEQ ID NO: 209879 - protein, 25 aa, Mycobacterium bovis
PMADLTRRALLRWGAGAGAGAAGVW

SEQ ID NO: 209880 - protein, 19 aa, Mycobacterium bovis
PMHIDAEYNADGSLRKPGQ

SEQ ID NO: 209881 - protein, 20 aa, Mycobacterium bovis
PMVAATMWDRYRQAVAGRIA

SEQ ID NO: 209882 - protein, 22 aa, Mycobacterium bovis
PPELETRIAILRKKAQMERLAV

SEQ ID NO: 209883 - protein, 22 aa, Mycobacterium bovis
PPGHKWARRSRVVSARELAQTP

SEQ ID NO: 209884 - protein, 23 aa, Mycobacterium bovis
PPGSLAAKWLVTRVPVAGLAEKC

SEQ ID NO: 209885 - protein, 18 aa, Mycobacterium bovis
PPGVGGIGEDFIDALRSK

SEQ ID NO: 209886 - protein, 17 aa, Mycobacterium bovis
PPIACLDEHQQDSRGTF

SEQ ID NO: 209887 - protein, 22 aa, Mycobacterium bovis
PPNSALVSWLPFYHDMGLVIGI

SEQ ID NO: 209888 - protein, 20 aa, Mycobacterium bovis
PPRGKTVWFTGLSGSGKSSV

SEQ ID NO: 209889 - protein, 25 aa, Mycobacterium bovis
PPRWLPGPRELRAWTLAAGSPEADR

SEQ ID NO: 209890 - protein, 25 aa, Mycobacterium bovis
PPVRELMGYRWLRRDEWLHRRFGDI

SEQ ID NO: 209891 - protein, 17 aa, Mycobacterium bovis
PQPAIPNMPLDLGASQS

SEQ ID NO: 209892 - protein, 18 aa, Mycobacterium bovis
PQSNHAFGAEPGVAPMSD

SEQ ID NO: 209893 - protein, 18 aa, Mycobacterium bovis
PQYQAWKHTQLIIDVVPG

SEQ ID NO: 209894 - protein, 29 aa, Mycobacterium bovis
PRAAFFGRSGLRRNIRWDPLDSVYFAGYA

SEQ ID NO: 209895 - protein, 19 aa, Mycobacterium bovis
PRKARRVIDLVRGRSVSDA

SEQ ID NO: 209896 - protein, 17 aa, Mycobacterium bovis
PRLMCMTRMSTFDEDEI

SEQ ID NO: 209897 - protein, 30 aa, Mycobacterium bovis
PRLPVDVVKLGGKFIECLDGDIQARLANEQ

SEQ ID NO: 209898 - protein, 20 aa, Mycobacterium bovis
PRLRGWGESMSRQAGGRAGD

SEQ ID NO: 209899 - protein, 22 aa, Mycobacterium bovis
PRPARPELVVLCDVSGSVAGFS

SEQ ID NO: 209900 - protein, 21 aa, Mycobacterium bovis
PRQRGIPFIFVRTDKAGNISK

SEQ ID NO: 209901 - protein, 17 aa, Mycobacterium bovis
PRSSLLVLGDGRTNYRN

SEQ ID NO: 209902 - protein, 20 aa, Mycobacterium bovis
PRTDFHTEILRMQKAINAVA

SEQ ID NO: 209903 - protein, 17 aa, Mycobacterium bovis
PRVSGRLGGPPHGQVGR

SEQ ID NO: 209904 - protein, 23 aa, Mycobacterium bovis
PRVVLAAAPPGYRLSIPDNTCDL

SEQ ID NO: 209905 - protein, 17 aa, Mycobacterium bovis
PTITVDGPLRFELIDIA

SEQ ID NO: 209906 - protein, 28 aa, Mycobacterium bovis
PTKGIFTSSFGYRWGVLHAGIDLANAIG

SEQ ID NO: 209907 - protein, 21 aa, Mycobacterium bovis
PTQIPSVAVPVTGAGGTGGNG

SEQ ID NO: 209908 - protein, 26 aa, Mycobacterium bovis
PTTGGPYAHGWVTWFPPDAPPGTERF

SEQ ID NO: 209909 - protein, 23 aa, Mycobacterium bovis
PTVAECLIVLTARHGPVARTIFE

SEQ ID NO: 209910 - protein, 17 aa, Mycobacterium bovis
PVARRLFAVRAVVGLSL

SEQ ID NO: 209911 - protein, 28 aa, Mycobacterium bovis
PVDVDGFVFPTCRWVHPIGPGNRSLPFP

SEQ ID NO: 209912 - protein, 19 aa, Mycobacterium bovis
PVLPAGRLVNFGTVHRVPA

SEQ ID NO: 209913 - protein, 25 aa, Mycobacterium bovis
PVNHLPLTLPLRYLGMSDAEVDQID

SEQ ID NO: 209914 - protein, 17 aa, Mycobacterium bovis
PYFQISAMLPKNTRPTS

SEQ ID NO: 209915 - protein, 24 aa, Mycobacterium bovis
QAEGGAAAARWICDNRDALDGNQW

SEQ ID NO: 209916 - protein, 21 aa, Mycobacterium bovis
QAQAFHAQFVQALTSGGGAYA

SEQ ID NO: 209917 - protein, 17 aa, Mycobacterium bovis
QAVGGAFVRLLDSSDEF

SEQ ID NO: 209918 - protein, 29 aa, Mycobacterium bovis
QDEVSTAIAALFGSHGQHYQAISAQVAAY

SEQ ID NO: 209919 - protein, 24 aa, Mycobacterium bovis
QDWWPNRLNLKVLHQNPAVADPMG

SEQ ID NO: 209920 - protein, 17 aa, Mycobacterium bovis
QELAVNYLAGAPDSVVT

SEQ ID NO: 209921 - protein, 25 aa, Mycobacterium bovis
QELDLVLAILRACQLFGGAHAIPGL

SEQ ID NO: 209922 - protein, 35 aa, Mycobacterium bovis; identical to SEQ ID NO: 83529

SEQ ID NO: 209923 - protein, 18 aa, Mycobacterium bovis
QFPLDWRANGPIASTGLA

SEQ ID NO: 209924 - protein, 24 aa, Mycobacterium bovis
QGEGFRACKRCRPDASPGSPEWNV

SEQ ID NO: 209925 - protein, 21 aa, Mycobacterium bovis
QHGKLAYHAVTYGWLLSGLAR

SEQ ID NO: 209926 - protein, 25 aa, Mycobacterium bovis
QHPDFLRLFYLLSMERSQDPAVAAV

SEQ ID NO: 209927 - protein, 17 aa, Mycobacterium bovis
QHSKLMRDGGLFHSNSL

SEQ ID NO: 209928 - protein, 41 aa, Mycobacterium bovis
QLAERGYGYGLAFRGLTAMWRRGDEVFAEVALPADAGVSVT

SEQ ID NO: 209929 - protein, 24 aa, Mycobacterium bovis
QLARASVMALSYVAQSARGIYQPA

SEQ ID NO: 209930 - protein, 22 aa, Mycobacterium bovis
QLDWMVCRTVATLLRSKVSARP

SEQ ID NO: 209931 - protein, 18 aa, Mycobacterium bovis
QLFGGAHAIPGLRQALGL

SEQ ID NO: 209932 - protein, 29 aa, Mycobacterium bovis
QLHCKIMWCPSVSLSIWANAWLAGKAAPD

SEQ ID NO: 209933 - protein, 20 aa, Mycobacterium bovis
QLINSIKWARDETGIIPTAG

SEQ ID NO: 209934 - protein, 30 aa, Mycobacterium bovis
QLPDGISRLRFRLRWRGFRLIVDANHTDVT

SEQ ID NO: 209935 - protein, 21 aa, Mycobacterium bovis
QPEPTRWGLPVDQLRYPVFSW

SEQ ID NO: 209936 - protein, 24 aa, Mycobacterium bovis
QPIRRYDVDAAILFSDIVVPLRAA

SEQ ID NO: 209937 - protein, 24 aa, Mycobacterium bovis
QQGFCGTCKVRVLAGQVDRRGRII

SEQ ID NO: 209938 - protein, 19 aa, Mycobacterium bovis
QQPKRPALRPTKAAATTAA

SEQ ID NO: 209939 - protein, 20 aa, Mycobacterium bovis
QQRYPPWPASYDASLRVSWR

SEQ ID NO: 209940 - protein, 19 aa, Mycobacterium bovis
QRAAGEMRSRLRALDAAAR

SEQ ID NO: 209941 - protein, 28 aa, Mycobacterium bovis
QRAKNMFALGLLSWMYGRELEHSEAFIR

SEQ ID NO: 209942 - protein, 23 aa, Mycobacterium bovis
QRDRAKMFALLWQSLRRQRQLLK

SEQ ID NO: 209943 - protein, 17 aa, Mycobacterium bovis
QRGLRPIQIWVPDVNAP

SEQ ID NO: 209944 - protein, 19 aa, Mycobacterium bovis
QRHASLLPLLHNYREPAKP

SEQ ID NO: 209945 - protein, 24 aa, Mycobacterium bovis
QRIDCGQGHCAWFVGYRDKNLDTV

SEQ ID NO: 209946 - protein, 19 aa, Mycobacterium bovis
QRPARWMHLMASDFHAFSA

SEQ ID NO: 209947 - protein, 18 aa, Mycobacterium bovis
QRPELVLDRVRAFLAAGT

SEQ ID NO: 209948 - protein, 24 aa, Mycobacterium bovis
QSRTIRLPVHLVEQVNKLARIKRE

SEQ ID NO: 209949 - protein, 25 aa, Mycobacterium bovis
QSVLTRSCKRWFGTGPAAYRNQARL

SEQ ID NO: 209950 - protein, 19 aa, Mycobacterium bovis
QTAAGLWLEACAAKQFRTS

SEQ ID NO: 209951 - protein, 23 aa, Mycobacterium bovis
QTVWKRHHRWSLDGTCDEVFAHV

SEQ ID NO: 209952 - protein, 19 aa, Mycobacterium bovis
QVRGGEGFFNRQEIKQALL

SEQ ID NO: 209953 - protein, 23 aa, Mycobacterium bovis
QWAIRLARRGAVIVVDNVIRGGG

SEQ ID NO: 209954 - protein, 22 aa, Mycobacterium bovis
RAAMPNTVWTTGCDSWYLNKDG

SEQ ID NO: 209955 - protein, 21 aa, Mycobacterium bovis
RAATHAALWAVDEAVNRDIPL

SEQ ID NO: 209956 - protein, 17 aa, Mycobacterium bovis
RADRLQYFVSCLVYMPR

SEQ ID NO: 209957 - protein, 19 aa, Mycobacterium bovis
RAGKVAALLPGRDPYHPSQ

SEQ ID NO: 209958 - protein, 17 aa, Mycobacterium bovis
RAGYMYGTVLARGLRGH

SEQ ID NO: 209959 - protein, 18 aa, Mycobacterium bovis
RAHGIAFETSWLDPFTEF

SEQ ID NO: 209960 - protein, 20 aa, Mycobacterium bovis
RAHLLLRFDRGNWIAIDNDS

SEQ ID NO: 209961 - protein, 19 aa, Mycobacterium bovis
RAIGLFRYQLIWEAADAAH

SEQ ID NO: 209962 - protein, 21 aa, Mycobacterium bovis
RAKPAVPFGGAYRLIDFVLSN

SEQ ID NO: 209963 - protein, 42 aa, Mycobacterium bovis
RALLEHVWALMGMPCGKYLVVMLELWLPLVAAAGDLDKPFAT

SEQ ID NO: 209964 - protein, 19 aa, Mycobacterium bovis
RALPDRQRHASLLPLLHNY

SEQ ID NO: 209965 - protein, 17 aa, Mycobacterium bovis
RALVTVGLFGGDAPVRD

SEQ ID NO: 209966 - protein, 17 aa, Mycobacterium bovis
RAPRIGLVSNVTGQLAG

SEQ ID NO: 209967 - protein, 18 aa, Mycobacterium bovis
RAQAIAGLRALAAGQHAP

SEQ ID NO: 209968 - protein, 17 aa, Mycobacterium bovis
RARAGWDRATGRIPADA

SEQ ID NO: 209969 - protein, 20 aa, Mycobacterium bovis
RARLLPALIDGTLTAGVGLD

SEQ ID NO: 209970 - protein, 17 aa, Mycobacterium bovis
RATDTVAGISGRVQLTH

SEQ ID NO: 209971 - protein, 18 aa, Mycobacterium bovis
RATTAGIPLLRLAAQTAL

SEQ ID NO: 209972 - protein, 17 aa, Mycobacterium bovis
RAVIVTGDFNARYSDDQ

SEQ ID NO: 209973 - protein, 19 aa, Mycobacterium bovis
RCARRRAEIFTWQRAAASM

SEQ ID NO: 209974 - protein, 22 aa, Mycobacterium bovis
RDDAVAAIVAWIADRENAVPTA

SEQ ID NO: 209975 - protein, 19 aa, Mycobacterium bovis
RDGPHVRLWAKLEDRNPTG

SEQ ID NO: 209976 - protein, 17 aa, Mycobacterium bovis
RDGVPTFLLPANPVSAL

SEQ ID NO: 209977 - protein, 28 aa, Mycobacterium bovis
RDHPDFPAAAARLGSRLSIHDQPNLGGS

SEQ ID NO: 209978 - protein, 17 aa, Mycobacterium bovis
RDMSLSFGSAVGAYERG

SEQ ID NO: 209979 - protein, 17 aa, Mycobacterium bovis
RDPRLRRALTPDYEPMC

SEQ ID NO: 209980 - protein, 23 aa, Mycobacterium bovis
RDRRQPLRFALGIMDEPRRHLQD

SEQ ID NO: 209981 - protein, 22 aa, Mycobacterium bovis
RDRTCVVPGCGATRGLHAHHIR

SEQ ID NO: 209982 - protein, 19 aa, Mycobacterium bovis
RDVDWWLTFSSAAALLGTP

SEQ ID NO: 209983 - protein, 19 aa, Mycobacterium bovis
RDVVAGLVSDIAWDTPVST

SEQ ID NO: 209984 - protein, 22 aa, Mycobacterium bovis
REAKKICMGCEVRHECLEYALA

SEQ ID NO: 209985 - protein, 17 aa, Mycobacterium bovis
REAPVYWHRPTEHTPDG

SEQ ID NO: 209986 - protein, 24 aa, Mycobacterium bovis
RECDAICQVVRVFVDDDVTHVTGR

SEQ ID NO: 209987 - protein, 17 aa, Mycobacterium bovis
RECDAVLYTRAGPEIGV

SEQ ID NO: 209988 - protein, 24 aa, Mycobacterium bovis
REDLPSAIYHRFGRVHTYAKARKT

SEQ ID NO: 209989 - protein, 25 aa, Mycobacterium bovis
REELQPRLPAVMDRLDRAIPRGVGT

SEQ ID NO: 209990 - protein, 18 aa, Mycobacterium bovis
REGIACAVLRRPDHRDTY

SEQ ID NO: 209991 - protein, 28 aa, Mycobacterium bovis
REHAEARLGYPLDRSHTAAVIWGDQAQG

SEQ ID NO: 209992 - protein, 18 aa, Mycobacterium bovis
REHIKEIQAFFKELSAAV

SEQ ID NO: 209993 - protein, 19 aa, Mycobacterium bovis
RELTAFVTYDHRLLSGCRE

SEQ ID NO: 209994 - protein, 18 aa, Mycobacterium bovis
RERVAPLIAKYRLAGDHR

SEQ ID NO: 209995 - protein, 19 aa, Mycobacterium bovis
RERYSMLAACFEPDVACEI

SEQ ID NO: 209996 - protein, 22 aa, Mycobacterium bovis
RETFRRMAMNDVETAALIVGGH

SEQ ID NO: 209997 - protein, 18 aa, Mycobacterium bovis
RGADGRVIVACFASNVDR

SEQ ID NO: 209998 - protein, 17 aa, Mycobacterium bovis
RGETVHAPAHFDVEVIG

SEQ ID NO: 209999 - protein, 17 aa, Mycobacterium bovis
RGGRFIEMGKTEFGTPR

SEQ ID NO: 210000 - protein, 18 aa, Mycobacterium bovis
RGKDRPVLVVGRDRSVLL

SEQ ID NO: 210001 - protein, 24 aa, Mycobacterium bovis
RGLDHSRLLIASVEVFGHCDLRAM

SEQ ID NO: 210002 - protein, 17 aa, Mycobacterium bovis
RGLRRILTEGGPTLLGT

SEQ ID NO: 210003 - protein, 18 aa, Mycobacterium bovis
RGPGQMLGGLPVGQMGAR

SEQ ID NO: 210004 - protein, 18 aa, Mycobacterium bovis
RGVARIGLANYFAGAFLL

SEQ ID NO: 210005 - protein, 17 aa, Mycobacterium bovis
RHGARRMVIAPWLLAPG

SEQ ID NO: 210006 - protein, 17 aa, Mycobacterium bovis
RHHRARASWNYLVTPGQ

SEQ ID NO: 210007 - protein, 18 aa, Mycobacterium bovis
RHTPEIAQGLRAVTDRDV

SEQ ID NO: 210008 - protein, 24 aa, Mycobacterium bovis
RIAGEDVARLFALVQVVADEHLAD

SEQ ID NO: 210009 - protein, 23 aa, Mycobacterium bovis
RIEEARGALIEGIIEESEDESLM

SEQ ID NO: 210010 - protein, 20 aa, Mycobacterium bovis
RIGQVGALAVVLGVGAAVTT

SEQ ID NO: 210011 - protein, 19 aa, Mycobacterium bovis
RIGWWYSIRTLSGRVRELR

SEQ ID NO: 210012 - protein, 26 aa, Mycobacterium bovis
RIIARMLAVMLRRRMQEAGMDTDGVE

SEQ ID NO: 210013 - protein, 19 aa, Mycobacterium bovis
RIPTWASRVVSGLARDRPV

SEQ ID NO: 210014 - protein, 18 aa, Mycobacterium bovis
RIRELLAAYPRMPATVIA

SEQ ID NO: 210015 - protein, 24 aa, Mycobacterium bovis
RISIPSCRPGWCGPITASTECWDV

SEQ ID NO: 210016 - protein, 19 aa, Mycobacterium bovis
RIVSLRLVTAGGEVLSLSE

SEQ ID NO: 210017 - protein, 19 aa, Mycobacterium bovis
RKAAQLKRNEANDLRNERS

SEQ ID NO: 210018 - protein, 19 aa, Mycobacterium bovis
RLADRGMRLTLRVYAYSSC

SEQ ID NO: 210019 - protein, 19 aa, Mycobacterium bovis
RLAGQWGDRVRPLVGDLTE

SEQ ID NO: 210020 - protein, 27 aa, Mycobacterium bovis
RLAQRQGIKILGPVGVAARTAATVGDA

SEQ ID NO: 210021 - protein, 25 aa, Mycobacterium bovis
RLGFARLAIQHGYPIVPFASVGAEH

SEQ ID NO: 210022 - protein, 20 aa, Mycobacterium bovis
RLGRRVTEIALVFRRAPHLP

SEQ ID NO: 210023 - protein, 17 aa, Mycobacterium bovis
RLLAEPTAWLFGPEAHG

SEQ ID NO: 210024 - protein, 19 aa, Mycobacterium bovis
RLLRQLGVEAARVRMLRSF

SEQ ID NO: 210025 - protein, 17 aa, Mycobacterium bovis
RLMRFDKHGPLDLILYH

SEQ ID NO: 210026 - protein, 23 aa, Mycobacterium bovis
RLPADLREQWSIRQVPLHILLDG

SEQ ID NO: 210027 - protein, 18 aa, Mycobacterium bovis
RLPGLDFVRGDAENLPFD

SEQ ID NO: 210028 - protein, 18 aa, Mycobacterium bovis
RLPLSASVWDIAQRYNKG

SEQ ID NO: 210029 - protein, 18 aa, Mycobacterium bovis
RLPPTLPARSSMAAATVM

SEQ ID NO: 210030 - protein, 24 aa, Mycobacterium bovis
RLSDGIDIVAGWAEKAGLDVALAR

SEQ ID NO: 210031 - protein, 22 aa, Mycobacterium bovis
RLTGNFWLPEKIPLSNDLASWQ

SEQ ID NO: 210032 - protein, 26 aa, Mycobacterium bovis
RLTSIALPRIRDFRGLSPKQFDGVGN

SEQ ID NO: 210033 - protein, 18 aa, Mycobacterium bovis
RLVDLCERLGLAKSTTRR

SEQ ID NO: 210034 - protein, 23 aa, Mycobacterium bovis
RLVKEGKPAFAVVGVDGGNTYWH

SEQ ID NO: 210035 - protein, 22 aa, Mycobacterium bovis
RMALPPCHAFFQFYVADGRLSC

SEQ ID NO: 210036 - protein, 20 aa, Mycobacterium bovis
RPAEALAWMCDRAVDLLLLE

SEQ ID NO: 210037 - protein, 22 aa, Mycobacterium bovis
RPDQLAKLAARIMDCLNPDGDY

SEQ ID NO: 210038 - protein, 17 aa, Mycobacterium bovis
RPGAELRRLTPRNTDQL

SEQ ID NO: 210039 - protein, 19 aa, Mycobacterium bovis
RPGIDLVVAAEAGMTTGMP

SEQ ID NO: 210040 - protein, 24 aa, Mycobacterium bovis
RPGRRRPRFAQPMLSIHQRPFDPA

SEQ ID NO: 210041 - protein, 18 aa, Mycobacterium bovis
RPIIFNLPATVEMTTPNV

SEQ ID NO: 210042 - protein, 19 aa, Mycobacterium bovis
RPSTTCYRKASSTPTGSPS

SEQ ID NO: 210043 - protein, 23 aa, Mycobacterium bovis
RPSWLSSSAWPWQPYLLSHHQGG

SEQ ID NO: 210044 - protein, 20 aa, Mycobacterium bovis
RPTGAFMFLGPTGVGKTELA

SEQ ID NO: 210045 - protein, 21 aa, Mycobacterium bovis
RQGEPAVSFLLISSGSAEVSH

SEQ ID NO: 210046 - protein, 23 aa, Mycobacterium bovis
RQKGLPGARARRRGLSDAALGTP

SEQ ID NO: 210047 - protein, 17 aa, Mycobacterium bovis
RQRWQWRPRIGRRRSWR

SEQ ID NO: 210048 - protein, 31 aa, Mycobacterium bovis
RQSLRPRYLCMLAEILRFHRAAARLLREETD

SEQ ID NO: 210049 - protein, 25 aa, Mycobacterium bovis
RRAAELGVTCSIFVDQIHYWGDVIV

SEQ ID NO: 210050 - protein, 32 aa, Mycobacterium bovis
RRCGMVSPTVFWPIPRVYSGLVRIDRYETSPW

SEQ ID NO: 210051 - protein, 20 aa, Mycobacterium bovis
RRDGWWQGLGPYDVVLDALG

SEQ ID NO: 210052 - protein, 20 aa, Mycobacterium bovis
RRELVKQAKHKGEEAKVSVR

SEQ ID NO: 210053 - protein, 23 aa, Mycobacterium bovis
RRLAEKLWNLRVLAGEKSASDMH

SEQ ID NO: 210054 - protein, 19 aa, Mycobacterium bovis
RRLTEVRKNGVLPYLRPDG

SEQ ID NO: 210055 - protein, 18 aa, Mycobacterium bovis
RRPIHLMGLDKTFRLFST

SEQ ID NO: 210056 - protein, 17 aa, Mycobacterium bovis
RRSDGRFALYSVSDTPE

SEQ ID NO: 210057 - protein, 24 aa, Mycobacterium bovis
RRSLPIMFPIEVRFSAPDDSFLST

SEQ ID NO: 210058 - protein, 24 aa, Mycobacterium bovis
RRSLRPVGIVEVDGFPVFDVPPDA

SEQ ID NO: 210059 - protein, 21 aa, Mycobacterium bovis
RRTGDPLARRVAAQTARFLLD

SEQ ID NO: 210060 - protein, 24 aa, Mycobacterium bovis
RRVFGCFPCGVIAVCAMVDDQPVG

SEQ ID NO: 210061 - protein, 21 aa, Mycobacterium bovis
RRVQLASLLVGEWDVIALDEP

SEQ ID NO: 210062 - protein, 18 aa, Mycobacterium bovis
RRVRVAVVFGGRSNEHAI

SEQ ID NO: 210063 - protein, 19 aa, Mycobacterium bovis
RRYLGLEVLTRARAALTST

SEQ ID NO: 210064 - protein, 20 aa, Mycobacterium bovis
RSARELAHGTTIRFTHELRM

SEQ ID NO: 210065 - protein, 20 aa, Mycobacterium bovis
RSRPVLRAVDYLRAQGYHEL

SEQ ID NO: 210066 - protein, 28 aa, Mycobacterium bovis
RTADDLLERYWRGEQRLATIAHQCEVKS

SEQ ID NO: 210067 - protein, 19 aa, Mycobacterium bovis
RTAQWVLPWPNPRYSKLAR

SEQ ID NO: 210068 - protein, 19 aa, Mycobacterium bovis
RTATDWAYAAGWMAVRALP

SEQ ID NO: 210069 - protein, 21 aa, Mycobacterium bovis
RTGHVALRVLHDGTAVTGLLV

SEQ ID NO: 210070 - protein, 23 aa, Mycobacterium bovis
RTMLREYLEAMRALWTQEEACYD

SEQ ID NO: 210071 - protein, 21 aa, Mycobacterium bovis
RTRHECTGLSSPIDALDGVST

SEQ ID NO: 210072 - protein, 22 aa, Mycobacterium bovis
RTRRPPAFPEDIWVPERDPGTT

SEQ ID NO: 210073 - protein, 19 aa, Mycobacterium bovis
RTSNDLLLVPSIVEPSNFL

SEQ ID NO: 210074 - protein, 23 aa, Mycobacterium bovis
RTVRARIAGLDYRLDVNTLHRDK

SEQ ID NO: 210075 - protein, 26 aa, Mycobacterium bovis
RVAALAAVNCFAWRPTGPLFRGMLAA

SEQ ID NO: 210076 - protein, 18 aa, Mycobacterium bovis
RVAIEFDPPLPPEYQQLA

SEQ ID NO: 210077 - protein, 19 aa, Mycobacterium bovis
RVAWERELLPGAQVVIAPT

SEQ ID NO: 210078 - protein, 28 aa, Mycobacterium bovis
RVEGGWEINGQKVWTCGAQYCARGLATV

SEQ ID NO: 210079 - protein, 18 aa, Mycobacterium bovis
RVFAELSPHPLLTHAVEQ

SEQ ID NO: 210080 - protein, 17 aa, Mycobacterium bovis
RVIAEFNGGTPFPLQLA

SEQ ID NO: 210081 - protein, 20 aa, Mycobacterium bovis
RVISDVWLSNLLAWLTRRAS

SEQ ID NO: 210082 - protein, 18 aa, Mycobacterium bovis
RVIVACFASNVDRVQQII

SEQ ID NO: 210083 - protein, 20 aa, Mycobacterium bovis
RVPTEKGYREFVDRLEDVKP

SEQ ID NO: 210084 - protein, 19 aa, Mycobacterium bovis
RVRELRPLYLPPDPASRDI

SEQ ID NO: 210085 - protein, 20 aa, Mycobacterium bovis
RVRIGTTWGARCGTVTICSA

SEQ ID NO: 210086 - protein, 21 aa, Mycobacterium bovis
RVTGRKNLHVWAGECHVHAGI

SEQ ID NO: 210087 - protein, 24 aa, Mycobacterium bovis
RVVFAGAYHGWGFHEDGAASGLRA

SEQ ID NO: 210088 - protein, 17 aa, Mycobacterium bovis
RVVFVLHEIFGLPYQQI

SEQ ID NO: 210089 - protein, 17 aa, Mycobacterium bovis
RVVLVDIGLDLAHTDVL

SEQ ID NO: 210090 - protein, 20 aa, Mycobacterium bovis
RWDKPFLAIFGYRDPILGQA

SEQ ID NO: 210091 - protein, 21 aa, Mycobacterium bovis
RWMGSGPLTGLAEIQLPDLQP

SEQ ID NO: 210092 - protein, 23 aa, Mycobacterium bovis
RWWERPYIAAGIFLYDRLGGAKS

SEQ ID NO: 210093 - protein, 20 aa, Mycobacterium bovis
RYAELIKRTQWWGRQMLIWG

SEQ ID NO: 210094 - protein, 19 aa, Mycobacterium bovis
RYIILKGRNSEHLFVAAES

SEQ ID NO: 210095 - protein, 19 aa, Mycobacterium bovis
SAAIAALFGAHAQAYQTIS

SEQ ID NO: 210096 - protein, 18 aa, Mycobacterium bovis
SAAYRYPGSMCVGFPKVL

SEQ ID NO: 210097 - protein, 18 aa, Mycobacterium bovis
SAESRTLARLGLANYFAA

SEQ ID NO: 210098 - protein, 18 aa, Mycobacterium bovis
SAGRAVIVTGDFNARYSD

SEQ ID NO: 210099 - protein, 28 aa, Mycobacterium bovis
SAIVRPLLRFFFKSWFRVEVSGVENIPR

SEQ ID NO: 210100 - protein, 23 aa, Mycobacterium bovis
SAQMSAFHAQFVQTFTAGAGAYA

SEQ ID NO: 210101 - protein, 21 aa, Mycobacterium bovis
SARGRLGLLELREFEMPPHLH

SEQ ID NO: 210102 - protein, 19 aa, Mycobacterium bovis
SARYRPWMPAAGNHENEVG

SEQ ID NO: 210103 - protein, 19 aa, Mycobacterium bovis
SAVPAYFVGLGVRPEHAPA

SEQ ID NO: 210104 - protein, 17 aa, Mycobacterium bovis
SCGAAWRLLVASVVLPI

SEQ ID NO: 210105 - protein, 17 aa, Mycobacterium bovis
SDIGGAVQRLIRRLPAG

SEQ ID NO: 210106 - protein, 22 aa, Mycobacterium bovis
SDKVVRFILGLVQRYGPGLFGA

SEQ ID NO: 210107 - protein, 18 aa, Mycobacterium bovis
SDLINVRYLSGFSGSNGA

SEQ ID NO: 210108 - protein, 19 aa, Mycobacterium bovis
SDMHAPILVISQFTLYADT

SEQ ID NO: 210109 - protein, 19 aa, Mycobacterium bovis
SDPRGGYPPETGGYPPQPG

SEQ ID NO: 210110 - protein, 18 aa, Mycobacterium bovis
SDPWRKLSANRDNRVFVV

SEQ ID NO: 210111 - protein, 18 aa, Mycobacterium bovis
SDRPRSVIWVTGRGTAET

SEQ ID NO: 210112 - protein, 24 aa, Mycobacterium bovis
SELGEWLVIHEGWRSELPDQLGEG

SEQ ID NO: 210113 - protein, 17 aa, Mycobacterium bovis
SELKRVRAAGFSDRPFS

SEQ ID NO: 210114 - protein, 17 aa, Mycobacterium bovis
SEVDIYDGLTINIGKPT

SEQ ID NO: 210115 - protein, 36 aa, Mycobacterium bovis
SGAHFCLGLTWPGWKPGWPWARCCVGSATTKSTTTT

SEQ ID NO: 210116 - protein, 25 aa, Mycobacterium bovis
SGAPPVGGLHLQFGRNASTEMVVSW

SEQ ID NO: 210117 - protein, 17 aa, Mycobacterium bovis
SGESGGSGNGRGDPGSG

SEQ ID NO: 210118 - protein, 25 aa, Mycobacterium bovis
SGGAGGAGGFGRTTGGIGGTGGNAG

SEQ ID NO: 210119 - protein, 24 aa, Mycobacterium bovis
SGGSGGAGGFGFADGGQGGPGGNA

SEQ ID NO: 210120 - protein, 18 aa, Mycobacterium bovis
SGHGNTGFFNAGSFNTGM

SEQ ID NO: 210121 - protein, 17 aa, Mycobacterium bovis
SGHRGPTGGVSRRRLLR

SEQ ID NO: 210122 - protein, 25 aa, Mycobacterium bovis
SGKQRSRLALWSRRLLGEAITQAQL

SEQ ID NO: 210123 - protein, 24 aa, Mycobacterium bovis
SGQPLDWFCLFSSAAALTGSPGQS

SEQ ID NO: 210124 - protein, 25 aa, Mycobacterium bovis
SGRFEFRAGPIFTNLLLADEINRTP

SEQ ID NO: 210125 - protein, 18 aa, Mycobacterium bovis
SGTWAVAVDRGGQLRWYG

SEQ ID NO: 210126 - protein, 25 aa, Mycobacterium bovis
SHGPAVLGAPAWKPPHPLSDSITAA

SEQ ID NO: 210127 - protein, 21 aa, Mycobacterium bovis
SHGSPFRSGPIRTLADLEDIA

SEQ ID NO: 210128 - protein, 19 aa, Mycobacterium bovis
SIGLRGADVTKTFTNIQKR

SEQ ID NO: 210129 - protein, 19 aa, Mycobacterium bovis
SKNAIPWGDFSTHLAQLQG

SEQ ID NO: 210130 - protein, 18 aa, Mycobacterium bovis
SKPSPFAWIPFGGGTRRC

SEQ ID NO: 210131 - protein, 24 aa, Mycobacterium bovis
SKTVWGVGIAPSITTASLRAVVSA

SEQ ID NO: 210132 - protein, 18 aa, Mycobacterium bovis
SLARLLAPVLPKLDTVHT

SEQ ID NO: 210133 - protein, 21 aa, Mycobacterium bovis
SLEVIDLRSLAPLDFDTIAAS

SEQ ID NO: 210134 - protein, 21 aa, Mycobacterium bovis
SLFNGAPGFGGPGGSGGASLL

SEQ ID NO: 210135 - protein, 22 aa, Mycobacterium bovis
SLHRLRGLGRRTVLPGHGPDLL

SEQ ID NO: 210136 - protein, 21 aa, Mycobacterium bovis
SLHWDCFSFGVIQRADSFTFY

SEQ ID NO: 210137 - protein, 17 aa, Mycobacterium bovis
SMDSAWRGGLPPESGFT

SEQ ID NO: 210138 - protein, 21 aa, Mycobacterium bovis
SMGALHSWCLAAERPELVSAL

SEQ ID NO: 210139 - protein, 18 aa, Mycobacterium bovis
SMKMEIPVLAEAAGTVSK

SEQ ID NO: 210140 - protein, 19 aa, Mycobacterium bovis
SMKMEIPVLAEAAGTVSKV

SEQ ID NO: 210141 - protein, 18 aa, Mycobacterium bovis
SNTIAPFLGLLGGVAAAD

SEQ ID NO: 210142 - protein, 19 aa, Mycobacterium bovis
SPAALRLLATDAIVVLVSA

SEQ ID NO: 210143 - protein, 27 aa, Mycobacterium bovis
SPARKRRMFDLLVRMGYKEIEVGFPSA

SEQ ID NO: 210144 - protein, 19 aa, Mycobacterium bovis
SPGFLGFQLLRPVKGEERY

SEQ ID NO: 210145 - protein, 19 aa, Mycobacterium bovis
SPKEMWDAFAEEYLAPVRP

SEQ ID NO: 210146 - protein, 24 aa, Mycobacterium bovis
SPSLRRPQPLFSLVNFFDAQVGPL

SEQ ID NO: 210147 - protein, 28 aa, Mycobacterium bovis
SPYVDAWLLRACAKLGVRLVHSTPGRPQ

SEQ ID NO: 210148 - protein, 24 aa, Mycobacterium bovis
SQGEGGLRIVGISAVGSIDDLSAF

SEQ ID NO: 210149 - protein, 18 aa, Mycobacterium bovis
SRAHPRAAFFGRSGLRRN

SEQ ID NO: 210150 - protein, 18 aa, Mycobacterium bovis
SRLKGKQVEFFAAALGGP

SEQ ID NO: 210151 - protein, 24 aa, Mycobacterium bovis
SRLPRWRAMAAHALCKRDDLARQK

SEQ ID NO: 210152 - protein, 19 aa, Mycobacterium bovis
SRTLARLGLANYFAAATVL

SEQ ID NO: 210153 - protein, 22 aa, Mycobacterium bovis
SRVRVWCGGTLVADHDRIWAKH

SEQ ID NO: 210154 - protein, 24 aa, Mycobacterium bovis
SRYWPADDYRAGVVQTSFDKQFVR

SEQ ID NO: 210155 - protein, 40 aa, Mycobacterium bovis
SSHAPRPRMLVFGAIDFAAALARQGSFLGYRVTVCDARAV

SEQ ID NO: 210156 - protein, 17 aa, Mycobacterium bovis
SSRRGRVLGTETAGHDR

SEQ ID NO: 210157 - protein, 23 aa, Mycobacterium bovis
STAIAALFGAHGQAYQALSAQAQ

SEQ ID NO: 210158 - protein, 25 aa, Mycobacterium bovis
STLQRPSMRGVPFTFVRVDRAGNMS

SEQ ID NO: 210159 - protein, 25 aa, Mycobacterium bovis
STPNRWQVRPGPVAARRWDIEPDLT

SEQ ID NO: 210160 - protein, 22 aa, Mycobacterium bovis
STTIGAFAIPGGPGYFNSSTAP

SEQ ID NO: 210161 - protein, 23 aa, Mycobacterium bovis
SVAPCLFTKGGAVTWHIPESTAP

SEQ ID NO: 210162 - protein, 18 aa, Mycobacterium bovis
SVRAARDYHNGILDGDAV

SEQ ID NO: 210163 - protein, 20 aa, Mycobacterium bovis
SVRSAHCAGASRFIEVGPGG

SEQ ID NO: 210164 - protein, 23 aa, Mycobacterium bovis
SVSDALDILRWAPQAASGPVAKV

SEQ ID NO: 210165 - protein, 20 aa, Mycobacterium bovis
SVSMTAQWWLDAREPKKEVV

SEQ ID NO: 210166 - protein, 17 aa, Mycobacterium bovis
SVTSGLAGQSWQGAAAA

SEQ ID NO: 210167 - protein, 19 aa, Mycobacterium bovis
SWAGTLIVVSHDRYLLERV

SEQ ID NO: 210168 - protein, 21 aa, Mycobacterium bovis
SWQAREWLPFVGIERADTDRP

SEQ ID NO: 210169 - protein, 17 aa, Mycobacterium bovis
SWSRLFTGATFPGASKA

SEQ ID NO: 210170 - protein, 18 aa, Mycobacterium bovis
SWWLGPKCGRRVGRAIDR

SEQ ID NO: 210171 - protein, 25 aa, Mycobacterium bovis
SYRELPLRLFEFGTVYRYEKSGVVH

SEQ ID NO: 210172 - protein, 21 aa, Mycobacterium bovis
TAELLRLALTGKRKPYIYTST

SEQ ID NO: 210173 - protein, 23 aa, Mycobacterium bovis
TAESSLRGANLWDEVKDRLDKPG

SEQ ID NO: 210174 - protein, 18 aa, Mycobacterium bovis
TALAYGIVVAGQLAGLPV

SEQ ID NO: 210175 - protein, 19 aa, Mycobacterium bovis
TARCRRLLDLDADPEAIVE

SEQ ID NO: 210176 - protein, 21 aa, Mycobacterium bovis
TARRRGVVINPVLETSEIPET

SEQ ID NO: 210177 - protein, 33 aa, Mycobacterium bovis
TASVWCFATASAREWWGLVWADRILQSDLAHQL

SEQ ID NO: 210178 - protein, 21 aa, Mycobacterium bovis
TAVACPRFVDFVELGVTSGRQ

SEQ ID NO: 210179 - protein, 19 aa, Mycobacterium bovis
TAVLRPHLSLVPEAPAPFE

SEQ ID NO: 210180 - protein, 24 aa, Mycobacterium bovis
TDFLRRQAPELLPASISGGAPLAG

SEQ ID NO: 210181 - protein, 22 aa, Mycobacterium bovis
TDGVEPWAYLIVGGVQLATHSW

SEQ ID NO: 210182 - protein, 21 aa, Mycobacterium bovis
TDIDAVLEFRVSEEVLLERLK

SEQ ID NO: 210183 - protein, 23 aa, Mycobacterium bovis
TDRFRLAVRELKWSASSPDIEAA

SEQ ID NO: 210184 - protein, 27 aa, Mycobacterium bovis
TDSEAMDAFGLLCRMEGIIPAIESAHA

SEQ ID NO: 210185 - protein, 20 aa, Mycobacterium bovis
TDSVHRCRLPFCDVTVGLVR

SEQ ID NO: 210186 - protein, 24 aa, Mycobacterium bovis
TDVPTGVVVPYFWSDQYDVKIQCL

SEQ ID NO: 210187 - protein, 42 aa, Mycobacterium bovis
TFGDPTGRHAFGASFLARIFPPGSHIPIPFIEYTMPQQVDSQ

SEQ ID NO: 210188 - protein, 17 aa, Mycobacterium bovis
TFGGLKPVHALADCGRV

SEQ ID NO: 210189 - protein, 21 aa, Mycobacterium bovis
TFGMDSWFPSLKIYNRNGQLY

SEQ ID NO: 210190 - protein, 18 aa, Mycobacterium bovis
TFGYKFRPWRDVKVLADG

SEQ ID NO: 210191 - protein, 18 aa, Mycobacterium bovis
TFQRCKLNWAEAGSGEHA

SEQ ID NO: 210192 - protein, 29 aa, Mycobacterium bovis
TGAVYAELAAQGWGGRWLVVGADVDPGRL

SEQ ID NO: 210193 - protein, 28 aa, Mycobacterium bovis
TGGSGGFGAPPPRSIGGGDGGDGGRGGD

SEQ ID NO: 210194 - protein, 19 aa, Mycobacterium bovis
TGGVGKTRLAIQIASASEL

SEQ ID NO: 210195 - protein, 20 aa, Mycobacterium bovis
TGHGFLDWPAGAREATTARL

SEQ ID NO: 210196 - protein, 17 aa, Mycobacterium bovis
TGLPWPDVHDAGTVSLL

SEQ ID NO: 210197 - protein, 20 aa, Mycobacterium bovis
TGSPIPVGLDPTGVAVNPVT

SEQ ID NO: 210198 - protein, 19 aa, Mycobacterium bovis
TIHGARAYAAFCEFADTTP

SEQ ID NO: 210199 - protein, 17 aa, Mycobacterium bovis
TIIDKWLPLSWSLNMVN

SEQ ID NO: 210200 - protein, 22 aa, Mycobacterium bovis
TIKSAVAFGALLSRGIGDTIRV

SEQ ID NO: 210201 - protein, 17 aa, Mycobacterium bovis
TILGLSLAHGGHLTHGM

SEQ ID NO: 210202 - protein, 19 aa, Mycobacterium bovis
TIPAGTALGAFNLPTLSIP

SEQ ID NO: 210203 - protein, 21 aa, Mycobacterium bovis
TIPQFRTLVILSNHGPINLAT

SEQ ID NO: 210204 - protein, 24 aa, Mycobacterium bovis
TKDVHIGPSDHVGWLDDRKWAYVR

SEQ ID NO: 210205 - protein, 17 aa, Mycobacterium bovis
TKHIPAFKLTRSSAAYW

SEQ ID NO: 210206 - protein, 18 aa, Mycobacterium bovis
TKTRFLVDQIRTIGIVYV

SEQ ID NO: 210207 - protein, 18 aa, Mycobacterium bovis
TLASLKWVLANRAYTPWY

SEQ ID NO: 210208 - protein, 20 aa, Mycobacterium bovis
TLTAAARWYTATEIANAAAM

SEQ ID NO: 210209 - protein, 22 aa, Mycobacterium bovis
TNKLAAPVGVRSDCLGVDAPLP

SEQ ID NO: 210210 - protein, 17 aa, Mycobacterium bovis
TPAEVLELAVALRRENP

SEQ ID NO: 210211 - protein, 26 aa, Mycobacterium bovis
TPAPLPCTPRGIVHLLRRYDISIAGA

SEQ ID NO: 210212 - protein, 23 aa, Mycobacterium bovis
TPEFAIPPIGVGGFTLPQITTQE

SEQ ID NO: 210213 - protein, 19 aa, Mycobacterium bovis
TPGATPWVTWGEFVETRML

SEQ ID NO: 210214 - protein, 18 aa, Mycobacterium bovis
TPLHLAFSSYVFDLHDQL

SEQ ID NO: 210215 - protein, 17 aa, Mycobacterium bovis
TPLRLGASLLIRAARPV

SEQ ID NO: 210216 - protein, 20 aa, Mycobacterium bovis
TPLVPMPGRFIYAGIADRLV

SEQ ID NO: 210217 - protein, 25 aa, Mycobacterium bovis
TPRYAVGCKRPGFHNTYLSTFNRDN

SEQ ID NO: 210218 - protein, 17 aa, Mycobacterium bovis
TQEYRWVLDADIKACFD

SEQ ID NO: 210219 - protein, 26 aa, Mycobacterium bovis
TQRAFLRYGKGRHRAALNFGDCMTYA

SEQ ID NO: 210220 - protein, 17 aa, Mycobacterium bovis
TQVLAAGADEVSARIAA

SEQ ID NO: 210221 - protein, 22 aa, Mycobacterium bovis
TRDSSIWIGPRVVIPSLALRAR

SEQ ID NO: 210222 - protein, 21 aa, Mycobacterium bovis
TRLWEHWGKPEIVWYPGGHTG

SEQ ID NO: 210223 - protein, 25 aa, Mycobacterium bovis
TSDQPRPLVPAMFSAVLSRLRRTHT

SEQ ID NO: 210224 - protein, 21 aa, Mycobacterium bovis
TSEAYRVMSMLAMDDPAHLRM

SEQ ID NO: 210225 - protein, 23 aa, Mycobacterium bovis
TSILQRRVVFRANRAEVQAIATD

SEQ ID NO: 210226 - protein, 17 aa, Mycobacterium bovis
TSLRGLRHTLKKLSGLR

SEQ ID NO: 210227 - protein, 17 aa, Mycobacterium bovis
TSVRMPLTLNIPAGIPL

SEQ ID NO: 210228 - protein, 22 aa, Mycobacterium bovis
TSVVATCYLLGVSTRRMERLVE

SEQ ID NO: 210229 - protein, 27 aa, Mycobacterium bovis
TTALFGHSYGSLLSGIALKDGASSLVD

SEQ ID NO: 210230 - protein, 25 aa, Mycobacterium bovis
TVCILDRPRHAQLIHDVRATGARIR

SEQ ID NO: 210231 - protein, 22 aa, Mycobacterium bovis
TVIAGALGNWLMSRGEAVAPTA

SEQ ID NO: 210232 - protein, 26 aa, Mycobacterium bovis
TVKTFKRAGGQVWLMPHNPAFDPIPG

SEQ ID NO: 210233 - protein, 17 aa, Mycobacterium bovis
TVLEFSNTVTRVHEDPR

SEQ ID NO: 210234 - protein, 26 aa, Mycobacterium bovis
TVSLRLPVRAPFAFEGVFGHLAATAV

SEQ ID NO: 210235 - protein, 19 aa, Mycobacterium bovis
TVYSGEWWHFDGPGPGPGA

SEQ ID NO: 210236 - protein, 24 aa, Mycobacterium bovis
TWLADHLRRRWARNTGGLLVVTHD

SEQ ID NO: 210237 - protein, 19 aa, Mycobacterium bovis
TWLALQPFLAPAGITRVAD

SEQ ID NO: 210238 - protein, 22 aa, Mycobacterium bovis
TYARIGERWRIGSDGLVLEVSA

SEQ ID NO: 210239 - protein, 17 aa, Mycobacterium bovis
TYFFSDPAARDFVAGVA

SEQ ID NO: 210240 - protein, 21 aa, Mycobacterium bovis
TYPTLCRLFAELGVATQESEM

SEQ ID NO: 210241 - protein, 18 aa, Mycobacterium bovis
VAAASAWNGLAAELSVAA

SEQ ID NO: 210242 - protein, 20 aa, Mycobacterium bovis
VAAEATRVGMPYVNQRWLGG

SEQ ID NO: 210243 - protein, 28 aa, Mycobacterium bovis
VAAMAGYHFDASAAVAQLAPWQQVLRNL

SEQ ID NO: 210244 - protein, 21 aa, Mycobacterium bovis
VAARRAGVPITELTETLPSGT

SEQ ID NO: 210245 - protein, 19 aa, Mycobacterium bovis
VADAGWKYLSTGAYAGSLD

SEQ ID NO: 210246 - protein, 26 aa, Mycobacterium bovis
VAEELGQPLPLFIKWDDADYGLRAAE

SEQ ID NO: 210247 - protein, 17 aa, Mycobacterium bovis
VAELLGVPVSKVAQQLR

SEQ ID NO: 210248 - protein, 26 aa, Mycobacterium bovis
VAFRGTAPAGRGFWFPPTVLTPKRGD

SEQ ID NO: 210249 - protein, 24 aa, Mycobacterium bovis
VAGSRIDPVLARSWLLVNGAHGDR

SEQ ID NO: 210250 - protein, 17 aa, Mycobacterium bovis
VALRARLYPLLGPRHDP

SEQ ID NO: 210251 - protein, 22 aa, Mycobacterium bovis
VAMGRAIVRRPRVFCMDEPLSN

SEQ ID NO: 210252 - protein, 24 aa, Mycobacterium bovis
VAQTRAAPHLARITCPALVLNAEA

SEQ ID NO: 210253 - protein, 19 aa, Mycobacterium bovis
VARAYLDSRVQTIYGGTTE

SEQ ID NO: 210254 - protein, 20 aa, Mycobacterium bovis
VARRLAREEGLLVGISSGAA

SEQ ID NO: 210255 - protein, 18 aa, Mycobacterium bovis
VASDRGAGHLGFAGTARR

SEQ ID NO: 210256 - protein, 26 aa, Mycobacterium bovis
VASVSWPNPNDWWLVRLLGSITPTER

SEQ ID NO: 210257 - protein, 27 aa, Mycobacterium bovis
VAVGQRVVLVFLPRCGQCAACATDGRT

SEQ ID NO: 210258 - protein, 22 aa, Mycobacterium bovis
VAVLLRITEVFGVDATFFASQD

SEQ ID NO: 210259 - protein, 23 aa, Mycobacterium bovis
VAVRRAGGVVIPQVFFTNSGQVV

SEQ ID NO: 210260 - protein, 24 aa, Mycobacterium bovis
VAVRRISMSFVNVAPQLVSTAAAD

SEQ ID NO: 210261 - protein, 18 aa, Mycobacterium bovis
VCGYCIGGRMSVVVAGRL

SEQ ID NO: 210262 - protein, 17 aa, Mycobacterium bovis
VCWNTSFTVGFTGLARI

SEQ ID NO: 210263 - protein, 24 aa, Mycobacterium bovis
VDRHLPAFLRFAGREFIGVQGTQL

SEQ ID NO: 210264 - protein, 23 aa, Mycobacterium bovis
VDRIVSIEAFEHFGHENYDDFFK

SEQ ID NO: 210265 - protein, 24 aa, Mycobacterium bovis
VDTHFGRLVRRWRWTTAEDPVKVE

SEQ ID NO: 210266 - protein, 18 aa, Mycobacterium bovis
VEDVFPLPRELVGEGTLF

SEQ ID NO: 210267 - protein, 21 aa, Mycobacterium bovis
VEFPHGASLCSAAAQRRAVWT

SEQ ID NO: 210268 - protein, 26 aa, Mycobacterium bovis
VEPLRPGPPPTVWSRRWRQPWAPPTS

SEQ ID NO: 210269 - protein, 19 aa, Mycobacterium bovis
VEPRMLLVHFLRDQLRLTG

SEQ ID NO: 210270 - protein, 23 aa, Mycobacterium bovis
VEPSAPLPAFWVNIARKKILHAA

SEQ ID NO: 210271 - protein, 18 aa, Mycobacterium bovis
VFGSPTWRTVTGGSANYV

SEQ ID NO: 210272 - protein, 24 aa, Mycobacterium bovis
VFQRTPIWCFPKFDVPLPTAVRWA

SEQ ID NO: 210273 - protein, 17 aa, Mycobacterium bovis
VFRAWKLHDELGLNIVM

SEQ ID NO: 210274 - protein, 17 aa, Mycobacterium bovis
VGALLALAALIHRDRTG

SEQ ID NO: 210275 - protein, 24 aa, Mycobacterium bovis
VGGDGGRGGLLAGNGGTGGAGGKA

SEQ ID NO: 210276 - protein, 26 aa, Mycobacterium bovis
VGGPGGGHGLLGLGGSHGAGGAGGSG

SEQ ID NO: 210277 - protein, 20 aa, Mycobacterium bovis
VGGTWHWNTYPGIAVDIPSF

SEQ ID NO: 210278 - protein, 20 aa, Mycobacterium bovis
VGGWDFSWLDGRATEERPSW

SEQ ID NO: 210279 - protein, 26 aa, Mycobacterium bovis
VGHAGRITAPRGWELVRHAGPLPSHP

SEQ ID NO: 210280 - protein, 24 aa, Mycobacterium bovis
VGILGQRCAPVFVMAAPGQPLPTL

SEQ ID NO: 210281 - protein, 19 aa, Mycobacterium bovis
VGLFPRPLPREAAITQVAD

SEQ ID NO: 210282 - protein, 24 aa, Mycobacterium bovis
VGMSVDCARYWLDADKPISKSDAV

SEQ ID NO: 210283 - protein, 18 aa, Mycobacterium bovis
VGRHLLEVNPCFDRLARD

SEQ ID NO: 210284 - protein, 28 aa, Mycobacterium bovis
VGRPADGPPAWLRFFGCNPRHHSLAFLP

SEQ ID NO: 210285 - protein, 18 aa, Mycobacterium bovis
VGSGHSFTDIACTDGVMI

SEQ ID NO: 210286 - protein, 18 aa, Mycobacterium bovis
VGTGVHWTLLRSRPPGCS

SEQ ID NO: 210287 - protein, 17 aa, Mycobacterium bovis
VGVLDMLAAFYNDTPDE

SEQ ID NO: 210288 - protein, 19 aa, Mycobacterium bovis
VHELVRRWSGHMVTSQGDG

SEQ ID NO: 210289 - protein, 18 aa, Mycobacterium bovis
VHPDVWELAGHVSPNPGG

SEQ ID NO: 210290 - protein, 24 aa, Mycobacterium bovis
VIAENRAELMILIATNLLGQNTPA

SEQ ID NO: 210291 - protein, 25 aa, Mycobacterium bovis
VIAENRAELMILIATNLLGQNTPAI

SEQ ID NO: 210292 - protein, 22 aa, Mycobacterium bovis
VIKMVLAMRHELLPATLHVDVP

SEQ ID NO: 210293 - protein, 18 aa, Mycobacterium bovis
VIVTGDFNARYSDDQSAL

SEQ ID NO: 210294 - protein, 22 aa, Mycobacterium bovis
VKDAPIRDWVKLAVTRARISGM

SEQ ID NO: 210295 - protein, 22 aa, Mycobacterium bovis
VKEVGCRSAIVIYRLPGALSAV

SEQ ID NO: 210296 - protein, 17 aa, Mycobacterium bovis
VKGMLTGPVTILAWSFV

SEQ ID NO: 210297 - protein, 22 aa, Mycobacterium bovis
VKWTGSRVDLVFGSNSELRALV

SEQ ID NO: 210298 - protein, 19 aa, Mycobacterium bovis
VLAKDCPSFGLGPTEPLLA

SEQ ID NO: 210299 - protein, 24 aa, Mycobacterium bovis
VLARLQEVWLRRQIAEVKSKLQRM

SEQ ID NO: 210300 - protein, 21 aa, Mycobacterium bovis
VLARPPWDPGTAIIAVSDIEA

SEQ ID NO: 210301 - protein, 18 aa, Mycobacterium bovis
VLDAGCDWQRARGQLLAL

SEQ ID NO: 210302 - protein, 20 aa, Mycobacterium bovis
VLRDIEWRIGPGERIGIVGA

SEQ ID NO: 210303 - protein, 17 aa, Mycobacterium bovis
VNLWAPLMWTSLVVTAW

SEQ ID NO: 210304 - protein, 27 aa, Mycobacterium bovis
VNSGRMYCGPGSAPMVAAASAWNGLAA

SEQ ID NO: 210305 - protein, 18 aa, Mycobacterium bovis
VNWQRIRHRWNWTDVRRW

SEQ ID NO: 210306 - protein, 22 aa, Mycobacterium bovis
VPAFDRTALVTALRADQAGQTS

SEQ ID NO: 210307 - protein, 17 aa, Mycobacterium bovis
VPARRVGRVILVDEPAG

SEQ ID NO: 210308 - protein, 26 aa, Mycobacterium bovis
VPDSPEALPLLFGHIGEGNLHLNVLR

SEQ ID NO: 210309 - protein, 19 aa, Mycobacterium bovis
VPFAARWPVEVHIYPNRLV

SEQ ID NO: 210310 - protein, 23 aa, Mycobacterium bovis
VPLPSKWRIAFGEPICTADYAST

SEQ ID NO: 210311 - protein, 17 aa, Mycobacterium bovis
VPVVKVLAPGLVLSSAS

SEQ ID NO: 210312 - protein, 18 aa, Mycobacterium bovis
VQDHVASVFRHEDLASAL

SEQ ID NO: 210313 - protein, 19 aa, Mycobacterium bovis
VQEDFAYHQFLIKKSKMPS

SEQ ID NO: 210314 - protein, 17 aa, Mycobacterium bovis
VQRDGTCVLVIAPAPAL

SEQ ID NO: 210315 - protein, 25 aa, Mycobacterium bovis
VQSLTGRPLIGDGANGIDGTGQAGG

SEQ ID NO: 210316 - protein, 24 aa, Mycobacterium bovis
VQTGMGRTGAFFAHQHDGITPDVV

SEQ ID NO: 210317 - protein, 21 aa, Mycobacterium bovis
VRDGRACLVEAHLQRLTQSAR

SEQ ID NO: 210318 - protein, 18 aa, Mycobacterium bovis
VRDVACRRDFEDVALTLV

SEQ ID NO: 210319 - protein, 17 aa, Mycobacterium bovis
VRLLNMVPYFQANPRIT

SEQ ID NO: 210320 - protein, 27 aa, Mycobacterium bovis
VRLLRACYHCRTCGRGMAPPGSGTWPP

SEQ ID NO: 210321 - protein, 22 aa, Mycobacterium bovis
VRMPLTLNIPAGIPLEPGIYEW

SEQ ID NO: 210322 - protein, 22 aa, Mycobacterium bovis
VRQALRMRPDRIVVGEVRGAEV

SEQ ID NO: 210323 - protein, 20 aa, Mycobacterium bovis
VRQWLVRWAAHPGRATRGFH

SEQ ID NO: 210324 - protein, 40 aa, Mycobacterium bovis
VRRLARLHTPLPLLAFTAWPEVRSQLAMTWGTETFIVPKM

SEQ ID NO: 210325 - protein, 20 aa, Mycobacterium bovis
VRSDGGWGVLQPVSATFNPP

SEQ ID NO: 210326 - protein, 20 aa, Mycobacterium bovis
VRSRRPGETASIFVPSVPNL

SEQ ID NO: 210327 - protein, 24 aa, Mycobacterium bovis
VRTWQGFCYTAFVTDVCTRKIVVR

SEQ ID NO: 210328 - protein, 17 aa, Mycobacterium bovis
VRVAEGMVLGQWSAVVG

SEQ ID NO: 210329 - protein, 18 aa, Mycobacterium bovis
VRVAEGMVLGQWSAVVGH

SEQ ID NO: 210330 - protein, 17 aa, Mycobacterium bovis
VSARSLLQCAALHDLVD

SEQ ID NO: 210331 - protein, 17 aa, Mycobacterium bovis
VSASRARAILSSRHIHR

SEQ ID NO: 210332 - protein, 19 aa, Mycobacterium bovis
VTADVTLTRAWCLRELGDD

SEQ ID NO: 210333 - protein, 17 aa, Mycobacterium bovis
VTCTFHGHRRLSPDEVA

SEQ ID NO: 210334 - protein, 23 aa, Mycobacterium bovis
VTLPGAAIWHMAWSDKDDAIDWQ

SEQ ID NO: 210335 - protein, 17 aa, Mycobacterium bovis
VTLTRAWCLRELGDDDA

SEQ ID NO: 210336 - protein, 25 aa, Mycobacterium bovis
VTYREVRAGHQVRWTILLDGAVRIS

SEQ ID NO: 210337 - protein, 23 aa, Mycobacterium bovis
VVCCRNGSMNLVVWAEGNGVARV

SEQ ID NO: 210338 - protein, 22 aa, Mycobacterium bovis
VVDENLLRLGVALSPSEKTRPG

SEQ ID NO: 210339 - protein, 18 aa, Mycobacterium bovis
VVGCCRSVPHVQRVLSHL

SEQ ID NO: 210340 - protein, 22 aa, Mycobacterium bovis
VVHLHGRVGGLVRVGTADAAGC

SEQ ID NO: 210341 - protein, 21 aa, Mycobacterium bovis
VVRYCRARVGTVERSGLSADD

SEQ ID NO: 210342 - protein, 18 aa, Mycobacterium bovis
VVSKPAALVHGMFVALPA

SEQ ID NO: 210343 - protein, 19 aa, Mycobacterium bovis
VVTPLRLALERDTRAVDPL

SEQ ID NO: 210344 - protein, 17 aa, Mycobacterium bovis
VWFGERWITSALDLFQE

SEQ ID NO: 210345 - protein, 17 aa, Mycobacterium bovis
VWLAEELTRSWRVQWPE

SEQ ID NO: 210346 - protein, 20 aa, Mycobacterium bovis
VWRDVLLRLANDFRCVAIDA

SEQ ID NO: 210347 - protein, 17 aa, Mycobacterium bovis
VWSRRWRQPWAPPTSVA

SEQ ID NO: 210348 - protein, 25 aa, Mycobacterium bovis
VYCRPSCPVRPPFARNVRFLPTAAA

SEQ ID NO: 210349 - protein, 21 aa, Mycobacterium bovis
VYYRVFGGWLRQRRNIRDMTK

SEQ ID NO: 210350 - protein, 22 aa, Mycobacterium bovis
WAVRWKPALNALAITFADRMPA

SEQ ID NO: 210351 - protein, 19 aa, Mycobacterium bovis
WCRDRETFGRPLISRQSVQ

SEQ ID NO: 210352 - protein, 17 aa, Mycobacterium bovis
WDGPKAQVIGLVRSHLK

SEQ ID NO: 210353 - protein, 20 aa, Mycobacterium bovis
WDIEPDLTNAVAFLSAAVVS

SEQ ID NO: 210354 - protein, 17 aa, Mycobacterium bovis
WDNSLWCSWGDRETGYT

SEQ ID NO: 210355 - protein, 19 aa, Mycobacterium bovis
WDQGIEMARHIDITADLGA

SEQ ID NO: 210356 - protein, 18 aa, Mycobacterium bovis
WEALGRWDKPFLAIFGYR

SEQ ID NO: 210357 - protein, 21 aa, Mycobacterium bovis
WEQVADWDFVCEQLAAAEPWW

SEQ ID NO: 210358 - protein, 18 aa, Mycobacterium bovis
WGSSYGPIGEACRRARRR

SEQ ID NO: 210359 - protein, 19 aa, Mycobacterium bovis
WIRGWRAGGFDALVPNPRQ

SEQ ID NO: 210360 - protein, 20 aa, Mycobacterium bovis
WLSGQLGRPLSLIAETDRND

SEQ ID NO: 210361 - protein, 21 aa, Mycobacterium bovis
WLTVLLRRDLGLLVTIGVPGG

SEQ ID NO: 210362 - protein, 17 aa, Mycobacterium bovis
WNAAIMVHRAQRPGVGV

SEQ ID NO: 210363 - protein, 23 aa, Mycobacterium bovis
WNEGVKGAWVLARYDDGRPSQVR

SEQ ID NO: 210364 - protein, 29 aa, Mycobacterium bovis
WPADYGHYGPLFIRMAWHAAGTYRIHDGR

SEQ ID NO: 210365 - protein, 20 aa, Mycobacterium bovis
WPATLDRVLAIGGPDASYVP

SEQ ID NO: 210366 - protein, 31 aa, Mycobacterium bovis
WPFDQLSELWKAISPHLSPLSNIVSMLNNHV

SEQ ID NO: 210367 - protein, 17 aa, Mycobacterium bovis
WPPNAAMATRRLHPMGA

SEQ ID NO: 210368 - protein, 21 aa, Mycobacterium bovis
WPTSRGFERFYGFLGGETDQW

SEQ ID NO: 210369 - protein, 22 aa, Mycobacterium bovis
WQQVLRNLGIDIGKNGQINLGF

SEQ ID NO: 210370 - protein, 17 aa, Mycobacterium bovis
WQVLLAVSAELAGERSR

SEQ ID NO: 210371 - protein, 17 aa, Mycobacterium bovis
WRIPDVNALPPIKHTFA

SEQ ID NO: 210372 - protein, 17 aa, Mycobacterium bovis
WRPWRSYATQHLWTTLE

SEQ ID NO: 210373 - protein, 17 aa, Mycobacterium bovis
WRRAVEVATQRWVASTA

SEQ ID NO: 210374 - protein, 19 aa, Mycobacterium bovis
WRSDPAFVLNLSPFDRGSV

SEQ ID NO: 210375 - protein, 22 aa, Mycobacterium bovis
WRTDFLNDMGLVIADSIKPFAV

SEQ ID NO: 210376 - protein, 19 aa, Mycobacterium bovis
WRTSTRLPRDHYVRLDGND

SEQ ID NO: 210377 - protein, 20 aa, Mycobacterium bovis
WSLAGRSVFEHRAVVVGGDR

SEQ ID NO: 210378 - protein, 17 aa, Mycobacterium bovis
WTCMIPRQVAEELGQPL

SEQ ID NO: 210379 - protein, 17 aa, Mycobacterium bovis
WTGAGGVKGFFEKTFAP

SEQ ID NO: 210380 - protein, 17 aa, Mycobacterium bovis
WTTCKSVVLRVQVTGAG

SEQ ID NO: 210381 - protein, 17 aa, Mycobacterium bovis
WVLANRAYTPWYLVRYW

SEQ ID NO: 210382 - protein, 22 aa, Mycobacterium bovis
YAAGLAVGFWAAPSDLRANWRE

SEQ ID NO: 210383 - protein, 19 aa, Mycobacterium bovis
YADGRLRIGALTAATSAGS

SEQ ID NO: 210384 - protein, 22 aa, Mycobacterium bovis
YAFDKRRFWLSAEGSGADVSGL

SEQ ID NO: 210385 - protein, 22 aa, Mycobacterium bovis
YAGAFPAWLAPVQVVGIPVADE

SEQ ID NO: 210386 - protein, 24 aa, Mycobacterium bovis
YAGALGARGLFACRQSLRPRYLCM

SEQ ID NO: 210387 - protein, 18 aa, Mycobacterium bovis
YATGPLVFGAGTSDGSHL

SEQ ID NO: 210388 - protein, 18 aa, Mycobacterium bovis
YDAPFAFVDLDAMWGNAD

SEQ ID NO: 210389 - protein, 17 aa, Mycobacterium bovis
YDISIAGAHVVVIGRGV

SEQ ID NO: 210390 - protein, 26 aa, Mycobacterium bovis
YEPMCKRLVMSGGFYRAIQRDDVELV

SEQ ID NO: 210391 - protein, 22 aa, Mycobacterium bovis
YFYRPFRDLVIRAAERADAPLR

SEQ ID NO: 210392 - protein, 17 aa, Mycobacterium bovis
YGGWARHGGGAFSGKDP

SEQ ID NO: 210393 - protein, 21 aa, Mycobacterium bovis
YGNEAPKFFNSKGEPLSDHSP

SEQ ID NO: 210394 - protein, 19 aa, Mycobacterium bovis
YHQSLPLAAMLYARGSGLR

SEQ ID NO: 210395 - protein, 19 aa, Mycobacterium bovis
YKFRPWRDVKVLADGASSR

SEQ ID NO: 210396 - protein, 17 aa, Mycobacterium bovis
YLGRWRVDQWFSTGQIS

SEQ ID NO: 210397 - protein, 22 aa, Mycobacterium bovis
YLLRRLTAEPATPAELRDAVRS

SEQ ID NO: 210398 - protein, 19 aa, Mycobacterium bovis
YLVAEILRIISGGRLIWDP

SEQ ID NO: 210399 - protein, 20 aa, Mycobacterium bovis
YMKYLRGCEHYFTDEMLDCS

SEQ ID NO: 210400 - protein, 40 aa, Mycobacterium bovis; identical to SEQ ID NO: 160739

SEQ ID NO: 210401 - protein, 19 aa, Mycobacterium bovis
YPGSMCVGFPKVLAAFRPH

SEQ ID NO: 210402 - protein, 21 aa, Mycobacterium bovis
YPNFFTVFGPYGYVGSSYFAL

SEQ ID NO: 210403 - protein, 20 aa, Mycobacterium bovis
YPQMLLRVGWAPINADPLPP

SEQ ID NO: 210404 - protein, 41 aa, Mycobacterium bovis
YQAAAAQVAAFHSRFVQALTAGAGAYAFAEAANASPLQSAM

SEQ ID NO: 210405 - protein, 19 aa, Mycobacterium bovis
YQEVITMHECRSAKQLATV

SEQ ID NO: 210406 - protein, 21 aa, Mycobacterium bovis
YQPWLDRLLAMSWDDSEHRKI

SEQ ID NO: 210407 - protein, 28 aa, Mycobacterium bovis
YRIGREIGCKLVSFGSGAHFCLGLTWPG

SEQ ID NO: 210408 - protein, 23 aa, Mycobacterium bovis
YRLDSGEQLKVWRAMEDADEVPV

SEQ ID NO: 210409 - protein, 17 aa, Mycobacterium bovis
YRLHPVVLDAALQSVGA

SEQ ID NO: 210410 - protein, 28 aa, Mycobacterium bovis
YRLVGWRHGLCGYRRFFSITSLAGLRQE

SEQ ID NO: 210411 - protein, 17 aa, Mycobacterium bovis
YRNEERNFWAVSRHHDV

SEQ ID NO: 210412 - protein, 25 aa, Mycobacterium bovis
YRRTLRLPWGNGIVSLTPAPDHVRC

SEQ ID NO: 210413 - protein, 21 aa, Mycobacterium bovis
YRWVLDADIKACFDRIDHADL

SEQ ID NO: 210414 - protein, 17 aa, Mycobacterium bovis
YTALEAIMRPGATELDI

SEQ ID NO: 210415 - protein, 31 aa, Mycobacterium bovis
YTDAAQPIWWVVRAIEFSKDFETFVQELFVN

SEQ ID NO: 210416 - protein, 27 aa, Mycobacterium bovis
YTKGFKFSTYATWWIRQAITRGMADQS

SEQ ID NO: 210417 - protein, 25 aa, Mycobacterium bovis
YVAAHAPYLAWLMRASETSAEAAAR

SEQ ID NO: 210418 - protein, 25 aa, Mycobacterium bovis
YVVEKRFNLSWSIEGTRSRTGKMLP

SEQ ID NO: 210419 - protein, 17 aa, Mycobacterium bovis
YWPAPAVANYALSGEAV

SEQ ID NO: 210420 - protein, 18 aa, Mycobacterium bovis
YYIGYKCQRGLADLTDAE

SEQ ID NO: 210421 - protein, 22 aa, Mycobacterium bovis
AAAAPYAGWLAAAAARAAGASA

SEQ ID NO: 210422 - protein, 22 aa, Mycobacterium bovis
AAAAPYAGWLAAAAARAAGASV

SEQ ID NO: 210423 - protein, 22 aa, Mycobacterium bovis
AAAAPYAGWLAAAATQAEQAAT

SEQ ID NO: 210424 - protein, 17 aa, Mycobacterium bovis
AAAASPYVGWLSTVASQ

SEQ ID NO: 210425 - protein, 24 aa, Mycobacterium bovis
AAAFVRGRRAEVFGISRAGDGDGA

SEQ ID NO: 210426 - protein, 21 aa, Mycobacterium bovis
AAAPYAGWLAAAAARAAGASA

SEQ ID NO: 210427 - protein, 17 aa, Mycobacterium bovis
AAAQHWATWAMQKQELA

SEQ ID NO: 210428 - protein, 19 aa, Mycobacterium bovis
AAEATRVGMPYVNQRWLGG

SEQ ID NO: 210429 - protein, 17 aa, Mycobacterium bovis
AAELLRYHTVEQVTVVV

SEQ ID NO: 210430 - protein, 18 aa, Mycobacterium bovis
AAGDGMRSAYQGVQAGST

SEQ ID NO: 210431 - protein, 29 aa, Mycobacterium bovis
AAGGNGGNGGWLFGAGGTGGIGGTGAPGA

SEQ ID NO: 210432 - protein, 29 aa, Mycobacterium bovis
AAGHSFVIFLREGFPINILNPVQAVPEVC

SEQ ID NO: 210433 - protein, 17 aa, Mycobacterium bovis
AAIARRALGDNVIAISV

SEQ ID NO: 210434 - protein, 23 aa, Mycobacterium bovis
AAIEIKSAATLRGRDTRSISRLR

SEQ ID NO: 210435 - protein, 19 aa, Mycobacterium bovis
AAIPRLRRALVAPCTTTIR

SEQ ID NO: 210436 - protein, 24 aa, Mycobacterium bovis
AALRIVLGHELFHYAARADTALDA

SEQ ID NO: 210437 - protein, 27 aa, Mycobacterium bovis
AAMAGYHFDASAAVAQLAPWQQVLRNL

SEQ ID NO: 210438 - protein, 18 aa, Mycobacterium bovis
AAPAERPEPAGPAERPAP

SEQ ID NO: 210439 - protein, 26 aa, Mycobacterium bovis
AARQKAERGHPNWSKAFGYLPGPNGP

SEQ ID NO: 210440 - protein, 20 aa, Mycobacterium bovis
AARTRYFDAFFRDATSAGIR

SEQ ID NO: 210441 - protein, 19 aa, Mycobacterium bovis
AATAARYGHREALVDMVAR

SEQ ID NO: 210442 - protein, 26 aa, Mycobacterium bovis
AATDMPGRFVVAAAMVRHLLTDPMLP

SEQ ID NO: 210443 - protein, 22 aa, Mycobacterium bovis
AATNLAEIGSAISTANGAAALP

SEQ ID NO: 210444 - protein, 22 aa, Mycobacterium bovis
AAVAVEFARLYAVELEHYEKLE

SEQ ID NO: 210445 - protein, 18 aa, Mycobacterium bovis
AAYEKAYHAEPFIYLMPE

SEQ ID NO: 210446 - protein, 19 aa, Mycobacterium bovis
ADALHAWLVDGRRALVTAE

SEQ ID NO: 210447 - protein, 24 aa, Mycobacterium bovis
ADDRYAFSFSGLKTAVARYVESHA

SEQ ID NO: 210448 - protein, 18 aa, Mycobacterium bovis
ADGLLRPGATILEPTSGN

SEQ ID NO: 210449 - protein, 23 aa, Mycobacterium bovis
ADHHPRELLVVGIATFDQKRPAV

SEQ ID NO: 210450 - protein, 20 aa, Mycobacterium bovis
ADLRAIRAHQDCMEARTDAK

SEQ ID NO: 210451 - protein, 27 aa, Mycobacterium bovis
ADPALALELGTYLGYGALRIARAAPEA

SEQ ID NO: 210452 - protein, 23 aa, Mycobacterium bovis
ADPELKSTGFARDLADYIQEQGW

SEQ ID NO: 210453 - protein, 26 aa, Mycobacterium bovis
ADPERTAELATRFGVESSIARLQKAL

SEQ ID NO: 210454 - protein, 26 aa, Mycobacterium bovis
ADQRADWACDFWDCAAAEVAAALTIS

SEQ ID NO: 210455 - protein, 23 aa, Mycobacterium bovis
ADRDWLAFHASYPGNDPLRDARP

SEQ ID NO: 210456 - protein, 25 aa, Mycobacterium bovis
ADRVGPTILRHWSHPATVLVAQPVC

SEQ ID NO: 210457 - protein, 21 aa, Mycobacterium bovis
ADSILSWAVAGWSDYQRIGLS

SEQ ID NO: 210458 - protein, 23 aa, Mycobacterium bovis
AEAAAAAPLEGLLNIVNTPTQLL

SEQ ID NO: 210459 - protein, 30 aa, Mycobacterium bovis
AEARAHFGFPDDARVLLVFGGSQGAVSLNR

SEQ ID NO: 210460 - protein, 23 aa, Mycobacterium bovis
AEFDRAGADIVLLDLMLPGMSGT

SEQ ID NO: 210461 - protein, 25 aa, Mycobacterium bovis
AEFGCKEALFTLGDRPEARWRQARE

SEQ ID NO: 210462 - protein, 22 aa, Mycobacterium bovis
AEGGAAAARWICDNRDALDGNQ

SEQ ID NO: 210463 - protein, 18 aa, Mycobacterium bovis
AEGRDAGWCPCTCPGGDP

SEQ ID NO: 210464 - protein, 18 aa, Mycobacterium bovis
AEIACGRADSVISELEEL

SEQ ID NO: 210465 - protein, 22 aa, Mycobacterium bovis
AEIGRRPVVVLSRDAAIPRLRR

SEQ ID NO: 210466 - protein, 24 aa, Mycobacterium bovis
AELAAQGWGGRWLVVGADVDPGRL

SEQ ID NO: 210467 - protein, 21 aa, Mycobacterium bovis
AELGLRVCDWVDGDDPYGLVS

SEQ ID NO: 210468 - protein, 19 aa, Mycobacterium bovis
AELGRMYVHHGVVVVEQKI

SEQ ID NO: 210469 - protein, 21 aa, Mycobacterium bovis
AELNRLFTAWVETVYHRSVHS

SEQ ID NO: 210470 - protein, 17 aa, Mycobacterium bovis
AEPRYGEGVYALRNMDE

SEQ ID NO: 210471 - protein, 18 aa, Mycobacterium bovis
AEQRLAVAPGDDGDGLNP

SEQ ID NO: 210472 - protein, 29 aa, Mycobacterium bovis
AETLLVVLCGVGFYIGFVGSYQRMATITD

SEQ ID NO: 210473 - protein, 28 aa, Mycobacterium bovis
AEVELAWEILDPALEHWAAHGTPDAYEA

SEQ ID NO: 210474 - protein, 18 aa, Mycobacterium bovis
AFDNGPWPSTPPHERAAV

SEQ ID NO: 210475 - protein, 17 aa, Mycobacterium bovis
AFLAWQAARCVANWDGA

SEQ ID NO: 210476 - protein, 26 aa, Mycobacterium bovis
AFTAWPEVRSQLAMTWGTETFIVPKM

SEQ ID NO: 210477 - protein, 19 aa, Mycobacterium bovis
AFVQLVLSNLFGQNAPAIA

SEQ ID NO: 210478 - protein, 18 aa, Mycobacterium bovis
AGAIAFSSVLSYPVVAEQ

SEQ ID NO: 210479 - protein, 25 aa, Mycobacterium bovis
AGDARPPFWQNLAELGWLGLHIDER

SEQ ID NO: 210480 - protein, 25 aa, Mycobacterium bovis
AGEACARAIAWYLAMARRSQGNESA

SEQ ID NO: 210481 - protein, 23 aa, Mycobacterium bovis
AGELLRLARVLGIAATRDRARDL

SEQ ID NO: 210482 - protein, 22 aa, Mycobacterium bovis
AGGAGGFGRTTGGIGGTGGNAG

SEQ ID NO: 210483 - protein, 25 aa, Mycobacterium bovis
AGGAGGKAGLLFGSGGAGGSGGAAG

SEQ ID NO: 210484 - protein, 25 aa, Mycobacterium bovis
AGGAGGKAGLLFGSGGAGGSGGAGG

SEQ ID NO: 210485 - protein, 26 aa, Mycobacterium bovis
AGGAGGNGGWLWGNGGNGGVGGTSVA

SEQ ID NO: 210486 - protein, 20 aa, Mycobacterium bovis
AGGDECGPAILAGRSGPEQA

SEQ ID NO: 210487 - protein, 24 aa, Mycobacterium bovis
AGGDGGAGGILFGAGGAGGAGGAV

SEQ ID NO: 210488 - protein, 23 aa, Mycobacterium bovis
AGGDGIGGVGGGKGGNGADGEVG

SEQ ID NO: 210489 - protein, 25 aa, Mycobacterium bovis
AGGDVSADFGGVGFGGQGGNGGAGG

SEQ ID NO: 210490 - protein, 17 aa, Mycobacterium bovis
AGGKAGLIGNGGNGGAG

SEQ ID NO: 210491 - protein, 17 aa, Mycobacterium bovis
AGGLYAHGGTGGPGGNG

SEQ ID NO: 210492 - protein, 24 aa, Mycobacterium bovis
AGGNGGAGGMLLGDGGAGGQGGPA

SEQ ID NO: 210493 - protein, 20 aa, Mycobacterium bovis
AGGNGGDALGLVGVGGNGGN

SEQ ID NO: 210494 - protein, 20 aa, Mycobacterium bovis
AGGRGGDAGLFLGAAGTGGQ

SEQ ID NO: 210495 - protein, 20 aa, Mycobacterium bovis
AGGTGIEFGSVGGAGGNAAG

SEQ ID NO: 210496 - protein, 20 aa, Mycobacterium bovis
AGGVGGLFGAGGAGGSGGGG

SEQ ID NO: 210497 - protein, 28 aa, Mycobacterium bovis
AGIKLCKKRHRLPGLDFVRGDAENLPFD

SEQ ID NO: 210498 - protein, 18 aa, Mycobacterium bovis
AGIPLEPGIYEWRVEVEG

SEQ ID NO: 210499 - protein, 26 aa, Mycobacterium bovis
AGKPLLGICGGFQMLGRVIRDPYGIE

SEQ ID NO: 210500 - protein, 18 aa, Mycobacterium bovis
AGKVAALLPGRDPYHPSQ

SEQ ID NO: 210501 - protein, 17 aa, Mycobacterium bovis
AGLAARGGSAPTPAAAA

SEQ ID NO: 210502 - protein, 19 aa, Mycobacterium bovis
AGLAVGFWAAPSDLRANWR

SEQ ID NO: 210503 - protein, 21 aa, Mycobacterium bovis
AGLAVRPGYVLSDGFRVPGLP

SEQ ID NO: 210504 - protein, 19 aa, Mycobacterium bovis
AGLMGRRIAGVLASAGLDV

SEQ ID NO: 210505 - protein, 28 aa, Mycobacterium bovis
AGNGGLGGDGFTYLADFDGEPGGDGGDG

SEQ ID NO: 210506 - protein, 29 aa, Mycobacterium bovis
AGNGGLGGDGFTYLADFDGEPGGDGGDGG

SEQ ID NO: 210507 - protein, 33 aa, Mycobacterium bovis
AGNGGLGGDGFTYLADLTESLAATEVTAATAGG

SEQ ID NO: 210508 - protein, 26 aa, Mycobacterium bovis
AGQPGRWGRTAVCARLSSADQKVDLD

SEQ ID NO: 210509 - protein, 25 aa, Mycobacterium bovis
AGSAPMLAASVAWDGLAAELAVAAS

SEQ ID NO: 210510 - protein, 21 aa, Mycobacterium bovis
AGSIGPMSVPPSWATPSSTPV

SEQ ID NO: 210511 - protein, 18 aa, Mycobacterium bovis
AGSWPMAGTPAWRQLDDA

SEQ ID NO: 210512 - protein, 17 aa, Mycobacterium bovis
AGTGLALNGGNGGIGGN

SEQ ID NO: 210513 - protein, 27 aa, Mycobacterium bovis
AGVDQRWAFGIGCAAGPGLDPRRNQSP

SEQ ID NO: 210514 - protein, 25 aa, Mycobacterium bovis
AGVTYWRKAAQLKRNEANDLRNERS

SEQ ID NO: 210515 - protein, 17 aa, Mycobacterium bovis
AGYLLPYLVPGLSVLDV

SEQ ID NO: 210516 - protein, 19 aa, Mycobacterium bovis
AHCALWRALIGLDSMERIS

SEQ ID NO: 210517 - protein, 24 aa, Mycobacterium bovis
AHEGSLRFGDKVVLGRDNVINTYL

SEQ ID NO: 210518 - protein, 18 aa, Mycobacterium bovis
AHLGRPDVLTAWMDAAVI

SEQ ID NO: 210519 - protein, 19 aa, Mycobacterium bovis
AHLLLRFDRGNWIAIDNDS

SEQ ID NO: 210520 - protein, 22 aa, Mycobacterium bovis
AHTFPATRFLGAGAAMSLLPEL

SEQ ID NO: 210521 - protein, 26 aa, Mycobacterium bovis
AHWARRTGDPLARRVAAQTARFLLDE

SEQ ID NO: 210522 - protein, 25 aa, Mycobacterium bovis
AIAAAMSVVRAFFNVVPFAVRARQS

SEQ ID NO: 210523 - protein, 19 aa, Mycobacterium bovis
AIGKAAPVGLFVETFGTET

SEQ ID NO: 210524 - protein, 18 aa, Mycobacterium bovis
AIMRSVAAFGGHGVLIPQ

SEQ ID NO: 210525 - protein, 28 aa, Mycobacterium bovis
AIPKLRQGSYFPDWLLQRRKRAERALTS

SEQ ID NO: 210526 - protein, 24 aa, Mycobacterium bovis
AKGTGAYAGPRYGFKPTVMPKQVV

SEQ ID NO: 210527 - protein, 26 aa, Mycobacterium bovis
AKLSSAPMTTMWGAPLHRRWRGSRLR

SEQ ID NO: 210528 - protein, 23 aa, Mycobacterium bovis
AKMWKKSMTVRELWVSVTDPDAL

SEQ ID NO: 210529 - protein, 27 aa, Mycobacterium bovis
ALALTRFHIFSHSWGGMLAQQYVLDKA

SEQ ID NO: 210530 - protein, 24 aa, Mycobacterium bovis
ALARPRTDFHTEILRMQKAINAVA

SEQ ID NO: 210531 - protein, 18 aa, Mycobacterium bovis
ALASLPSGGFVPAGTTIS

SEQ ID NO: 210532 - protein, 17 aa, Mycobacterium bovis
ALAYGIVVAGQLAGLPV

SEQ ID NO: 210533 - protein, 18 aa, Mycobacterium bovis
ALDTAAWCGLAPASATFD

SEQ ID NO: 210534 - protein, 19 aa, Mycobacterium bovis
ALEPLEVTSRWIAGENPET

SEQ ID NO: 210535 - protein, 17 aa, Mycobacterium bovis
ALERLRSQQSFEEVSAR

SEQ ID NO: 210536 - protein, 17 aa, Mycobacterium bovis
ALGNWLMSRGEAVAPTA

SEQ ID NO: 210537 - protein, 19 aa, Mycobacterium bovis
ALHGARYSGWQGLLDAQRA

SEQ ID NO: 210538 - protein, 20 aa, Mycobacterium bovis
ALHGAWGVRVHDVRASVDAI

SEQ ID NO: 210539 - protein, 17 aa, Mycobacterium bovis
ALIGTKCRGDRAPEGLR

SEQ ID NO: 210540 - protein, 17 aa, Mycobacterium bovis
ALNTGLGNIGSWNLGGG

SEQ ID NO: 210541 - protein, 24 aa, Mycobacterium bovis
ALPVPEWIEGDIFRIYFSGRDGQN

SEQ ID NO: 210542 - protein, 19 aa, Mycobacterium bovis
ALQAGRIAVPLSVPQGGVT

SEQ ID NO: 210543 - protein, 34 aa, Mycobacterium bovis
ALTAAATPGWLEWFINWYLPISQLFYNTVGLPYF

SEQ ID NO: 210544 - protein, 17 aa, Mycobacterium bovis
ALTAPAPHHTRPTRFVW

SEQ ID NO: 210545 - protein, 20 aa, Mycobacterium bovis
ALVCECAFCTFPDKNAAAQQ

SEQ ID NO: 210546 - protein, 25 aa, Mycobacterium bovis
ALVCKFASRNARRFTLTVGLMLPRR

SEQ ID NO: 210547 - protein, 25 aa, Mycobacterium bovis
ALWAATFLRRRGAAADAVLLNPDRT

SEQ ID NO: 210548 - protein, 19 aa, Mycobacterium bovis
AMGVRVATSFSARLFNLLI

SEQ ID NO: 210549 - protein, 17 aa, Mycobacterium bovis
AMPAALRAAQMLAAEWD

SEQ ID NO: 210550 - protein, 25 aa, Mycobacterium bovis
AMTGAAASYARWLTTAAAQAEQAAG

SEQ ID NO: 210551 - protein, 19 aa, Mycobacterium bovis
ANAQWGNNVAILAGDYLLA

SEQ ID NO: 210552 - protein, 17 aa, Mycobacterium bovis
APAPPWAKMPIGEPPPA

SEQ ID NO: 210553 - protein, 20 aa, Mycobacterium bovis
APDHVRCLLVLDDFRDLMTA

SEQ ID NO: 210554 - protein, 23 aa, Mycobacterium bovis
APGARLAWREDATWAPHGGESRV

SEQ ID NO: 210555 - protein, 21 aa, Mycobacterium bovis
APGHMLGGLPLGQLTNSGGGF

SEQ ID NO: 210556 - protein, 30 aa, Mycobacterium bovis
APHSPMAGTGWLPGWRLTFGGEDIGWEGAL

SEQ ID NO: 210557 - protein, 18 aa, Mycobacterium bovis
APLDAPRPMPPEVADHVA

SEQ ID NO: 210558 - protein, 18 aa, Mycobacterium bovis
APLGYRPARSTAVMSTMS

SEQ ID NO: 210559 - protein, 19 aa, Mycobacterium bovis
APLHRRWRGSRLRDPRQAK

SEQ ID NO: 210560 - protein, 17 aa, Mycobacterium bovis
APMANSLPGQWTAHVTL

SEQ ID NO: 210561 - protein, 17 aa, Mycobacterium bovis
APRRRHATVTDLLGTTT

SEQ ID NO: 210562 - protein, 32 aa, Mycobacterium bovis
APVAGSEHLVAWMKAVVYGAAERWTDVIDQVK

SEQ ID NO: 210563 - protein, 24 aa, Mycobacterium bovis
AQAFPHVYCELDFTTPLELAVATI

SEQ ID NO: 210564 - protein, 31 aa, Mycobacterium bovis
AQDEVSTAIAALFGSHGQHYQAISAQVAAYQ

SEQ ID NO: 210565 - protein, 38 aa, Mycobacterium bovis
AQLPEWFRPGDFFPVPCCFPSCRSITYLLTDGEHVVPI

SEQ ID NO: 210566 - protein, 22 aa, Mycobacterium bovis
AQMSAFHAQFVQTFTAGAGAYA

SEQ ID NO: 210567 - protein, 22 aa, Mycobacterium bovis
AQPEPTRWGLPVDQLRYPVFSW

SEQ ID NO: 210568 - protein, 19 aa, Mycobacterium bovis
AQTLPPGRGLLVGADGDVE

SEQ ID NO: 210569 - protein, 24 aa, Mycobacterium bovis
ARDRRQPLRFALGIMDEPRRHLQD

SEQ ID NO: 210570 - protein, 25 aa, Mycobacterium bovis
ARFNKPGTFPLRFQTEVRDGCPSDC

SEQ ID NO: 210571 - protein, 18 aa, Mycobacterium bovis
ARGLRRILTEGGPTLLGT

SEQ ID NO: 210572 - protein, 20 aa, Mycobacterium bovis
ARGVARIGLANYFAGAFLLP

SEQ ID NO: 210573 - protein, 20 aa, Mycobacterium bovis
ARLLRQLGVEAARVRMLRSF

SEQ ID NO: 210574 - protein, 17 aa, Mycobacterium bovis
ARLNRLFDTVYPPGRGP

SEQ ID NO: 210575 - protein, 25 aa, Mycobacterium bovis
ARMHLLRLASEFGLTPAAEQRLAVA

SEQ ID NO: 210576 - protein, 17 aa, Mycobacterium bovis
ARMLRGHLERMVTSDST

SEQ ID NO: 210577 - protein, 19 aa, Mycobacterium bovis
ARPVARRLFAVRAVVGLSL

SEQ ID NO: 210578 - protein, 20 aa, Mycobacterium bovis
ARRITGWVAALGTGVCASDA

SEQ ID NO: 210579 - protein, 18 aa, Mycobacterium bovis
ARRRGVVINPVLETSEIP

SEQ ID NO: 210580 - protein, 23 aa, Mycobacterium bovis
ARVALGALLRRIRNYEVDDDNVV

SEQ ID NO: 210581 - protein, 29 aa, Mycobacterium bovis
ARVDCGLAGTVLRFVPPLAALGSVPVTFD

SEQ ID NO: 210582 - protein, 21 aa, Mycobacterium bovis
ARYSNRFSVPTARSDAPLSVT

SEQ ID NO: 210583 - protein, 22 aa, Mycobacterium bovis
ASGGRHSVRFAYDSAIVSLIKS

SEQ ID NO: 210584 - protein, 25 aa, Mycobacterium bovis
ASGVRLAIVASSWHGKICDALLDGA

SEQ ID NO: 210585 - protein, 22 aa, Mycobacterium bovis
ASIWNRRRVLLLNSTYEPLTAL

SEQ ID NO: 210586 - protein, 24 aa, Mycobacterium bovis
ASVGGWDFSWLDGRATEERPSWGY

SEQ ID NO: 210587 - protein, 17 aa, Mycobacterium bovis
ASVGSLSVPQAWAAANQ

SEQ ID NO: 210588 - protein, 22 aa, Mycobacterium bovis
ATAAFDLARIGSQVSAASAVAA

SEQ ID NO: 210589 - protein, 20 aa, Mycobacterium bovis
ATAIMWAREQFGLELIWGIE

SEQ ID NO: 210590 - protein, 20 aa, Mycobacterium bovis
ATARCRRLLDLDADPEAIVE

SEQ ID NO: 210591 - protein, 24 aa, Mycobacterium bovis
ATDRFRLAVRELKWSASSPDIEAA

SEQ ID NO: 210592 - protein, 25 aa, Mycobacterium bovis
ATDRFRLAVRELKWSASSPDIEAAV

SEQ ID NO: 210593 - protein, 24 aa, Mycobacterium bovis
ATEFDYLEMWAQDVAAMVGYHAGA

SEQ ID NO: 210594 - protein, 17 aa, Mycobacterium bovis
ATFEAVLAKLAAPGATN

SEQ ID NO: 210595 - protein, 17 aa, Mycobacterium bovis
ATGPLVFGAGTSDGSHL

SEQ ID NO: 210596 - protein, 21 aa, Mycobacterium bovis
ATLPAAAWQRCRTHYAANHGR

SEQ ID NO: 210597 - protein, 18 aa, Mycobacterium bovis
ATLSLVKFACAWTYIALD

SEQ ID NO: 210598 - protein, 18 aa, Mycobacterium bovis
ATLSVPFSAFPKPQNYPG

SEQ ID NO: 210599 - protein, 20 aa, Mycobacterium bovis
ATPGDGWASLASSIGGQVLL

SEQ ID NO: 210600 - protein, 20 aa, Mycobacterium bovis
ATRVQVLWSLADREMSVNEL

SEQ ID NO: 210601 - protein, 17 aa, Mycobacterium bovis
ATVHPMLVAANRNAFVQ

SEQ ID NO: 210602 - protein, 17 aa, Mycobacterium bovis
AVADFMADHVFNRLDIP

SEQ ID NO: 210603 - protein, 22 aa, Mycobacterium bovis
AVADWLYWQYVTGLLDRALAAA

SEQ ID NO: 210604 - protein, 30 aa, Mycobacterium bovis
AVAHALALQFGWRLFAPMLRSATGIDELTG

SEQ ID NO: 210605 - protein, 18 aa, Mycobacterium bovis
AVDIRYASADAKFSVREV

SEQ ID NO: 210606 - protein, 19 aa, Mycobacterium bovis
AVEDVFPLPRELVGEGTLF

SEQ ID NO: 210607 - protein, 26 aa, Mycobacterium bovis
AVGQRVVLVFLPRCGQCAACATDGRT

SEQ ID NO: 210608 - protein, 18 aa, Mycobacterium bovis
AVGSELKAADSLAEYVLE

SEQ ID NO: 210609 - protein, 25 aa, Mycobacterium bovis
AVIYFLRKVIWFLPDFTVEGYHDRL

SEQ ID NO: 210610 - protein, 24 aa, Mycobacterium bovis
AVLGRLPMRAWLIGLRPMEGSPER

SEQ ID NO: 210611 - protein, 19 aa, Mycobacterium bovis
AVLRRCGRCGRKASWYDRG

SEQ ID NO: 210612 - protein, 26 aa, Mycobacterium bovis
AVPYRANMWALRALGVRRVFGPCAVG

SEQ ID NO: 210613 - protein, 17 aa, Mycobacterium bovis
AVRRAGAVVVDRHSDTD

SEQ ID NO: 210614 - protein, 24 aa, Mycobacterium bovis
AVTSFRVGRHRAEVVAVADGITYV

SEQ ID NO: 210615 - protein, 19 aa, Mycobacterium bovis
AVWSDGTPITWRDIASQIH

SEQ ID NO: 210616 - protein, 19 aa, Mycobacterium bovis
AWVGPGETVAPPVVTEATA

SEQ ID NO: 210617 - protein, 33 aa, Mycobacterium bovis
AYLPRLPVDVVKLGGKFIECLDGDIQARLANEQ

SEQ ID NO: 210618 - protein, 26 aa, Mycobacterium bovis
AYRRTLRLPWGNGIVSLTPAPDHVRC

SEQ ID NO: 210619 - protein, 20 aa, Mycobacterium bovis
CAALPVLDTRAADTILGYDE

SEQ ID NO: 210620 - protein, 18 aa, Mycobacterium bovis
CAERLPGAVLAIGNAPTA

SEQ ID NO: 210621 - protein, 21 aa, Mycobacterium bovis
CALLGLDCVIYMGGIDTARQA

SEQ ID NO: 210622 - protein, 17 aa, Mycobacterium bovis
CAPVFVMAAPGQPLPTL

SEQ ID NO: 210623 - protein, 19 aa, Mycobacterium bovis
CARHAPTDPVHWGAVRRAR

SEQ ID NO: 210624 - protein, 17 aa, Mycobacterium bovis
CDYRALRVADLFDSQGI

SEQ ID NO: 210625 - protein, 20 aa, Mycobacterium bovis
CGADRVVLVLLDRAGSSAVV

SEQ ID NO: 210626 - protein, 19 aa, Mycobacterium bovis
CGHPLPGESLPGAIRRRLA

SEQ ID NO: 210627 - protein, 20 aa, Mycobacterium bovis
CGKCGNHLAGSYRTDGQVVY

SEQ ID NO: 210628 - protein, 24 aa, Mycobacterium bovis
CGRRGVSSPGRHPCSVVATVHDDT

SEQ ID NO: 210629 - protein, 23 aa, Mycobacterium bovis
CIGGVFRECRPENVIAIDAVPSF

SEQ ID NO: 210630 - protein, 19 aa, Mycobacterium bovis
CKNIIALACGMAVGIGLGE

SEQ ID NO: 210631 - protein, 18 aa, Mycobacterium bovis
CPVIEACRSHALEVGEPY

SEQ ID NO: 210632 - protein, 24 aa, Mycobacterium bovis
CRLPADLREQWSIRQVPLHILLDG

SEQ ID NO: 210633 - protein, 17 aa, Mycobacterium bovis
CRPELIERTFQACSGAH

SEQ ID NO: 210634 - protein, 18 aa, Mycobacterium bovis
CRPELIERTFQACSGAHR

SEQ ID NO: 210635 - protein, 22 aa, Mycobacterium bovis
CSHGSPFRSGPIRTLADLEDIA

SEQ ID NO: 210636 - protein, 21 aa, Mycobacterium bovis
CSVSNRPAIYVATYFGDPGAA

SEQ ID NO: 210637 - protein, 21 aa, Mycobacterium bovis
CTGLLPLASVAAMQGRIAMYH

SEQ ID NO: 210638 - protein, 20 aa, Mycobacterium bovis
DAAIPRLRRALVAPCTTTIR

SEQ ID NO: 210639 - protein, 27 aa, Mycobacterium bovis
DAAVSWAERRRMFELPRSSWGDYDRSL

SEQ ID NO: 210640 - protein, 22 aa, Mycobacterium bovis
DADRYRRLHVIIGDANLAETST

SEQ ID NO: 210641 - protein, 24 aa, Mycobacterium bovis
DAEGCAYLLVSVALRRLWFHGTKA

SEQ ID NO: 210642 - protein, 21 aa, Mycobacterium bovis
DAIVGKAQWSPLVDEATFWAA

SEQ ID NO: 210643 - protein, 19 aa, Mycobacterium bovis
DAPAGRAGSQGVGGDGGAG

SEQ ID NO: 210644 - protein, 21 aa, Mycobacterium bovis
DAPLPAWTHARLFIDDDGQEQ

SEQ ID NO: 210645 - protein, 17 aa, Mycobacterium bovis
DAPRYAELIKRTQWWGR

SEQ ID NO: 210646 - protein, 17 aa, Mycobacterium bovis
DASALGCLGYVARASGL

SEQ ID NO: 210647 - protein, 25 aa, Mycobacterium bovis
DASLRLLPRGGRFIEMGKTEFGTPR

SEQ ID NO: 210648 - protein, 21 aa, Mycobacterium bovis
DATRVQVLWSLADREMSVNEL

SEQ ID NO: 210649 - protein, 20 aa, Mycobacterium bovis
DAYIDYRALGGIDGRYPKIK

SEQ ID NO: 210650 - protein, 20 aa, Mycobacterium bovis
DAYYEHGVQVWDCAAGALIA

SEQ ID NO: 210651 - protein, 25 aa, Mycobacterium bovis
DDPDGYRLSVDYAVRITSRGLYVHS

SEQ ID NO: 210652 - protein, 20 aa, Mycobacterium bovis
DDTLPMLTGIRVEILGETVV

SEQ ID NO: 210653 - protein, 17 aa, Mycobacterium bovis
DDVHGWLDLVLDGPLAS

SEQ ID NO: 210654 - protein, 23 aa, Mycobacterium bovis
DEAKTLCRACPRRWLCARDAVES

SEQ ID NO: 210655 - protein, 27 aa, Mycobacterium bovis
DEEKKLFCRMAEVFAGFLSYTDAQIGR

SEQ ID NO: 210656 - protein, 19 aa, Mycobacterium bovis
DEIFGDLKPRVAALDAAGR

SEQ ID NO: 210657 - protein, 20 aa, Mycobacterium bovis
DEIRWDIRPSPHLGTLEVRI

SEQ ID NO: 210658 - protein, 17 aa, Mycobacterium bovis
DELYVGPTINRTARLRD

SEQ ID NO: 210659 - protein, 22 aa, Mycobacterium bovis
DEPCSSLDPISTMAIEDLISEL

SEQ ID NO: 210660 - protein, 22 aa, Mycobacterium bovis
DEVSAAIAALFSAHGQAYQAAS

SEQ ID NO: 210661 - protein, 22 aa, Mycobacterium bovis
DEVYGIMLMHGWAVQHVECERR

SEQ ID NO: 210662 - protein, 17 aa, Mycobacterium bovis
DFRPFHIDWDLAAAEKG

SEQ ID NO: 210663 - protein, 18 aa, Mycobacterium bovis
DFVGELWPGCGPPIAHCS

SEQ ID NO: 210664 - protein, 25 aa, Mycobacterium bovis
DGEFQEMFAPGAFRRSIAERGHKLK

SEQ ID NO: 210665 - protein, 24 aa, Mycobacterium bovis
DGGNGGEVGVGGKGGAGGVSANPA

SEQ ID NO: 210666 - protein, 20 aa, Mycobacterium bovis
DGYFSRPGLARVAAGKVSPS

SEQ ID NO: 210667 - protein, 23 aa, Mycobacterium bovis
DHGKAPVRRACYAADRTGHMILQ

SEQ ID NO: 210668 - protein, 30 aa, Mycobacterium bovis
DHLDGTLSFRWSCRMGICGSSGMTINGDPK

SEQ ID NO: 210669 - protein, 23 aa, Mycobacterium bovis
DHSRIPMWVEETLRYDTSSQILA

SEQ ID NO: 210670 - protein, 22 aa, Mycobacterium bovis
DIDERALAIGLRVMVNIIEQAA

SEQ ID NO: 210671 - protein, 17 aa, Mycobacterium bovis
DIFVEFSRWRGLSPDGR

SEQ ID NO: 210672 - protein, 22 aa, Mycobacterium bovis
DIGKLRYHKIVLMADADVDGQH

SEQ ID NO: 210673 - protein, 24 aa, Mycobacterium bovis
DIRETFRRMAMNDVETAALIVGGH

SEQ ID NO: 210674 - protein, 23 aa, Mycobacterium bovis
DKLPRYIAGVLARLQEVWLGRQI

SEQ ID NO: 210675 - protein, 22 aa, Mycobacterium bovis
DKRTEMRAPLSASGDAVPAELL

SEQ ID NO: 210676 - protein, 20 aa, Mycobacterium bovis
DKRVLRLVNWQRIRHRWNWT

SEQ ID NO: 210677 - protein, 29 aa, Mycobacterium bovis
DLASGWIPPHIRLPAHITLLEPAPRRRHA

SEQ ID NO: 210678 - protein, 24 aa, Mycobacterium bovis
DLASRACVVINHIMPGEPNVAVKD

SEQ ID NO: 210679 - protein, 23 aa, Mycobacterium bovis
DLDKPKLVFFFDEAHLLFTDASK

SEQ ID NO: 210680 - protein, 20 aa, Mycobacterium bovis
DLMTAAATNLAEIGSAISTA

SEQ ID NO: 210681 - protein, 17 aa, Mycobacterium bovis
DLPLPLRWGEYRAGGLA

SEQ ID NO: 210682 - protein, 19 aa, Mycobacterium bovis
DLPRMSAAIAEPTSHDPDS

SEQ ID NO: 210683 - protein, 18 aa, Mycobacterium bovis
DMHAPILVISQFTLYADT

SEQ ID NO: 210684 - protein, 22 aa, Mycobacterium bovis
DNLKLCSSMTLFARATDANQDF

SEQ ID NO: 210685 - protein, 24 aa, Mycobacterium bovis
DPAEWKIFLNLLRTRFETDKDKWT

SEQ ID NO: 210686 - protein, 20 aa, Mycobacterium bovis
DPAHAGLVVHAWRHRTAELT

SEQ ID NO: 210687 - protein, 19 aa, Mycobacterium bovis
DPLDSVYFAGYAMWNYLTT

SEQ ID NO: 210688 - protein, 17 aa, Mycobacterium bovis
DPLEPGGRLPIDREPRA

SEQ ID NO: 210689 - protein, 26 aa, Mycobacterium bovis
DPLTPGRMTTKWGGFVPDVAGFDAEF

SEQ ID NO: 210690 - protein, 17 aa, Mycobacterium bovis
DPNRPTGAFMFLGPTGV

SEQ ID NO: 210691 - protein, 22 aa, Mycobacterium bovis
DPRKWAAICDAARHWALRVETC

SEQ ID NO: 210692 - protein, 25 aa, Mycobacterium bovis
DPTASRAVSWWSVHEHVAPVLDAAG

SEQ ID NO: 210693 - protein, 21 aa, Mycobacterium bovis
DQARAALIVLMQRYLVGDLAA

SEQ ID NO: 210694 - protein, 18 aa, Mycobacterium bovis
DQLACYRPTPSANSIAWL

SEQ ID NO: 210695 - protein, 22 aa, Mycobacterium bovis
DRAKPAVPFGGAYRLIDFVLSN

SEQ ID NO: 210696 - protein, 18 aa, Mycobacterium bovis
DRDRLVVIIAGYSSDIDR

SEQ ID NO: 210697 - protein, 23 aa, Mycobacterium bovis
DRGFYAGAVGWCDGRGDGHWVVS

SEQ ID NO: 210698 - protein, 26 aa, Mycobacterium bovis
DRHLLARPEFKAMFLDDLLNGSRKQL

SEQ ID NO: 210699 - protein, 20 aa, Mycobacterium bovis
DRIVGAVGALRCHAGDRACR

SEQ ID NO: 210700 - protein, 20 aa, Mycobacterium bovis
DRKVAFKRSYRDVDVLLVDD

SEQ ID NO: 210701 - protein, 25 aa, Mycobacterium bovis
DRLSDQEIMAFLFLMVIAGNETTTK

SEQ ID NO: 210702 - protein, 24 aa, Mycobacterium bovis
DRMIGIDATHAWASVWTPQQPGRF

SEQ ID NO: 210703 - protein, 19 aa, Mycobacterium bovis
DRVIDRAPLWCAVDLRDGN

SEQ ID NO: 210704 - protein, 20 aa, Mycobacterium bovis
DSHLLLLWGAANRDPAQFEA

SEQ ID NO: 210705 - protein, 19 aa, Mycobacterium bovis
DSPELLWKALLRGDDLITE

SEQ ID NO: 210706 - protein, 19 aa, Mycobacterium bovis
DSSHHLGIDIGRVDHMQDG

SEQ ID NO: 210707 - protein, 21 aa, Mycobacterium bovis
DSVRSAHCAGASRFIEVGPGG

SEQ ID NO: 210708 - protein, 22 aa, Mycobacterium bovis
DTDTRIATAVARTVTARLHAED

SEQ ID NO: 210709 - protein, 17 aa, Mycobacterium bovis
DTGIAHVRDVVMPALQG

SEQ ID NO: 210710 - protein, 23 aa, Mycobacterium bovis
DTHARLAGVGAIMLDGKATRDEI

SEQ ID NO: 210711 - protein, 27 aa, Mycobacterium bovis
DTLTSRPGGGGWGWGVEPPGAAVAEVI

SEQ ID NO: 210712 - protein, 18 aa, Mycobacterium bovis
DVEGFPYKEIAEIMDTPI

SEQ ID NO: 210713 - protein, 25 aa, Mycobacterium bovis
DVQRYEVVDLLSLLADKSLVVTDDS

SEQ ID NO: 210714 - protein, 21 aa, Mycobacterium bovis
DYPARVVAVGVDRECRAAEIA

SEQ ID NO: 210715 - protein, 23 aa, Mycobacterium bovis
EAANAGPNMLAAVNAPAQALLGR

SEQ ID NO: 210716 - protein, 19 aa, Mycobacterium bovis
EAGVDCFVAGSAVYGADDP

SEQ ID NO: 210717 - protein, 17 aa, Mycobacterium bovis
EALGRWDKPFLAIFGYR

SEQ ID NO: 210718 - protein, 17 aa, Mycobacterium bovis
EAVNLFRANVIDVSPES

SEQ ID NO: 210719 - protein, 18 aa, Mycobacterium bovis
ECVLRRFPILGFQHPLSG

SEQ ID NO: 210720 - protein, 19 aa, Mycobacterium bovis
EDGEKRIPLDVAEGDTVIY

SEQ ID NO: 210721 - protein, 18 aa, Mycobacterium bovis
EEAIRIATAAKREYEASV

SEQ ID NO: 210722 - protein, 19 aa, Mycobacterium bovis
EFFRISPREATAMDPQQRV

SEQ ID NO: 210723 - protein, 22 aa, Mycobacterium bovis
EGLPYFSIGMGNNFIQAAKTLG

SEQ ID NO: 210724 - protein, 18 aa, Mycobacterium bovis
EGLYAVVVDREMSALLDG

SEQ ID NO: 210725 - protein, 21 aa, Mycobacterium bovis
EGVTLRFGSKVPGTAMEVRDV

SEQ ID NO: 210726 - protein, 24 aa, Mycobacterium bovis
EHHSDWLTARLVDLDSGDIETLVQ

SEQ ID NO: 210727 - protein, 17 aa, Mycobacterium bovis
EHIRVFPLSNWTEFDIW

SEQ ID NO: 210728 - protein, 22 aa, Mycobacterium bovis
EIDKVFVVACGTAYHSGLLAKY

SEQ ID NO: 210729 - protein, 18 aa, Mycobacterium bovis
EIESAPTFQAYEVPLTRE

SEQ ID NO: 210730 - protein, 21 aa, Mycobacterium bovis
EINSLRMFTGAGSAPMLAASV

SEQ ID NO: 210731 - protein, 23 aa, Mycobacterium bovis
EINSLRMFTGAGSAPMLAASVAW

SEQ ID NO: 210732 - protein, 19 aa, Mycobacterium bovis
EITTPPFAIDPIGLSGFTL

SEQ ID NO: 210733 - protein, 25 aa, Mycobacterium bovis
ELELYKRLPGDLSILTPSPASDTDT

SEQ ID NO: 210734 - protein, 18 aa, Mycobacterium bovis
ELIARIRAVLRRGGDDDS

SEQ ID NO: 210735 - protein, 17 aa, Mycobacterium bovis
ELIECGGGRRWASAEAR

SEQ ID NO: 210736 - protein, 17 aa, Mycobacterium bovis
ELLDSWRNYQWHQLARA

SEQ ID NO: 210737 - protein, 19 aa, Mycobacterium bovis
ELLPADWPGAGLRAAYHDF

SEQ ID NO: 210738 - protein, 17 aa, Mycobacterium bovis
ELMKLRAATELEVDLYH

SEQ ID NO: 210739 - protein, 17 aa, Mycobacterium bovis
ELTGLALQRIYLDRVAK

SEQ ID NO: 210740 - protein, 20 aa, Mycobacterium bovis
EMCRRCPVIEACRSHALEVG

SEQ ID NO: 210741 - protein, 17 aa, Mycobacterium bovis
EPAPALLWIHAGGYVMG

SEQ ID NO: 210742 - protein, 20 aa, Mycobacterium bovis
EPLPEEPWRSAVEATGSADV

SEQ ID NO: 210743 - protein, 19 aa, Mycobacterium bovis
EPLRPWKKEQLGGGYQVST

SEQ ID NO: 210744 - protein, 20 aa, Mycobacterium bovis
EPPTRPAPQHSRRARRGHRY

SEQ ID NO: 210745 - protein, 21 aa, Mycobacterium bovis
EPRRFGVGAAEFHHRAATRAR

SEQ ID NO: 210746 - protein, 22 aa, Mycobacterium bovis
EPSAPLPAFWVNIARKKILHAA

SEQ ID NO: 210747 - protein, 24 aa, Mycobacterium bovis
EPSGWAYWVAESLLGPGTQLADLK

SEQ ID NO: 210748 - protein, 20 aa, Mycobacterium bovis
EQALRFGADLRMEDVESVSL

SEQ ID NO: 210749 - protein, 18 aa, Mycobacterium bovis
ERFRRGRDRIPLTGRIAV

SEQ ID NO: 210750 - protein, 18 aa, Mycobacterium bovis
ERKWDVWGSVARAVTGGH

SEQ ID NO: 210751 - protein, 21 aa, Mycobacterium bovis
ERLRLSGTRIELEELLQLPVD

SEQ ID NO: 210752 - protein, 17 aa, Mycobacterium bovis
ERLTECVARAADSGIAI

SEQ ID NO: 210753 - protein, 24 aa, Mycobacterium bovis
ERPGRGGVVGVDWRTPLTDAAARV

SEQ ID NO: 210754 - protein, 18 aa, Mycobacterium bovis
ERVVFVLHEIFGLPYQQI

SEQ ID NO: 210755 - protein, 18 aa, Mycobacterium bovis
ESELKRVRAAGFSDRPFS

SEQ ID NO: 210756 - protein, 24 aa, Mycobacterium bovis
ESKASEVVEPWSLRLSHPELLYHP

SEQ ID NO: 210757 - protein, 23 aa, Mycobacterium bovis
ESLHRLRGLGRRTVLPGHGPDLL

SEQ ID NO: 210758 - protein, 19 aa, Mycobacterium bovis
ESPGTLVMQVCGGPGDSGA

SEQ ID NO: 210759 - protein, 21 aa, Mycobacterium bovis
ESPVALPVPAYMPFFDVLHVT

SEQ ID NO: 210760 - protein, 23 aa, Mycobacterium bovis
ESTAGSLQGQWRGAAGTAAQAAV

SEQ ID NO: 210761 - protein, 18 aa, Mycobacterium bovis
ETLPERWSADAGPEQMAI

SEQ ID NO: 210762 - protein, 24 aa, Mycobacterium bovis
ETLVRAASDLANIGSTLGAANAAA

SEQ ID NO: 210763 - protein, 19 aa, Mycobacterium bovis
ETPVAVVAFASWPQQRTLR

SEQ ID NO: 210764 - protein, 18 aa, Mycobacterium bovis
EVEINIACSLGMLTAEQV

SEQ ID NO: 210765 - protein, 25 aa, Mycobacterium bovis
EVIGDRFGVCGYCMGGRMSVVVAGR

SEQ ID NO: 210766 - protein, 26 aa, Mycobacterium bovis
EVPGAMARLGVWSGDGLQLDLHQPTF

SEQ ID NO: 210767 - protein, 23 aa, Mycobacterium bovis
EVSALTAAQFAAHAQMYQTVSAQ

SEQ ID NO: 210768 - protein, 18 aa, Mycobacterium bovis
FAAGADRIEGCLFGNGER

SEQ ID NO: 210769 - protein, 19 aa, Mycobacterium bovis
FAAGALAAGCEYEIDEAAP

SEQ ID NO: 210770 - protein, 17 aa, Mycobacterium bovis
FAAGVLRAEAVHEPGYY

SEQ ID NO: 210771 - protein, 23 aa, Mycobacterium bovis
FADDRIADVLGRLRGGYQVEGRE

SEQ ID NO: 210772 - protein, 18 aa, Mycobacterium bovis
FAGAGGQGGLGGQGGNGG

SEQ ID NO: 210773 - protein, 18 aa, Mycobacterium bovis
FAGKINRLAIMVRGNLAA

SEQ ID NO: 210774 - protein, 17 aa, Mycobacterium bovis
FASEVAMEIALNAVRIH

SEQ ID NO: 210775 - protein, 17 aa, Mycobacterium bovis
FCAYNSVGYREQVREQL

SEQ ID NO: 210776 - protein, 23 aa, Mycobacterium bovis
FDAGDFRWAATLLDHAVFADSEH

SEQ ID NO: 210777 - protein, 18 aa, Mycobacterium bovis
FDDIADWVEGARCAGMRA

SEQ ID NO: 210778 - protein, 19 aa, Mycobacterium bovis
FDFVREIIEQGAIPDDVTI

SEQ ID NO: 210779 - protein, 25 aa, Mycobacterium bovis
FDGAIPRRWRSPAPLWGDTSFHSVA

SEQ ID NO: 210780 - protein, 17 aa, Mycobacterium bovis
FDLPQLVVHPYTLTGPI

SEQ ID NO: 210781 - protein, 17 aa, Mycobacterium bovis
FEAARAATVHPMLVAAN

SEQ ID NO: 210782 - protein, 35 aa, Mycobacterium bovis
FEARAQHPWPPRVATLPHWPLIYAGALEGLDHLEL

SEQ ID NO: 210783 - protein, 23 aa, Mycobacterium bovis
FEHLPRGSFGRILSVLNAAADHH

SEQ ID NO: 210784 - protein, 41 aa, Mycobacterium bovis
FGDPTGRHAFGASFLARIFPPGSHIPIPFIEYTMPQQVDSQ

SEQ ID NO: 210785 - protein, 18 aa, Mycobacterium bovis
FGGEVERGLSMVDGLLLL

SEQ ID NO: 210786 - protein, 17 aa, Mycobacterium bovis
FGPYLSSASNPWGDGIN

SEQ ID NO: 210787 - protein, 24 aa, Mycobacterium bovis
FGRRVAVVACEFDFLGGSIGVAAA

SEQ ID NO: 210788 - protein, 19 aa, Mycobacterium bovis
FGVTCTFHGHRRLSPDEVA

SEQ ID NO: 210789 - protein, 17 aa, Mycobacterium bovis
FGYKFRPWRDVKVLADG

SEQ ID NO: 210790 - protein, 29 aa, Mycobacterium bovis
FHAELMPLTWATRTLSWWSVTPRTTISPG

SEQ ID NO: 210791 - protein, 17 aa, Mycobacterium bovis
FHAKAVVIATGGSGRMY

SEQ ID NO: 210792 - protein, 18 aa, Mycobacterium bovis
FLCLLAGAIQARRVLEIG

SEQ ID NO: 210793 - protein, 17 aa, Mycobacterium bovis
FLDPLIFARRRLIAAGT

SEQ ID NO: 210794 - protein, 17 aa, Mycobacterium bovis
FLDRGCKVLCTEPRGEN

SEQ ID NO: 210795 - protein, 19 aa, Mycobacterium bovis
FLEKEQRIIAALRAAADSP

SEQ ID NO: 210796 - protein, 20 aa, Mycobacterium bovis
FLEKEQRIIAALRAAADSPD

SEQ ID NO: 210797 - protein, 18 aa, Mycobacterium bovis
FLKRVRKVVDDEFPGRVL

SEQ ID NO: 210798 - protein, 17 aa, Mycobacterium bovis
FLNKPVISWAGDNGIYF

SEQ ID NO: 210799 - protein, 18 aa, Mycobacterium bovis
FLVYPAMKALTLDIASMV

SEQ ID NO: 210800 - protein, 18 aa, Mycobacterium bovis
FNAEKGFGFIAPEDGSAD

SEQ ID NO: 210801 - protein, 28 aa, Mycobacterium bovis
FNIWGRPDLRRWLPLDVYRPLKSTLVTL

SEQ ID NO: 210802 - protein, 17 aa, Mycobacterium bovis
FPAPQLSSSDGRGPVLV

SEQ ID NO: 210803 - protein, 21 aa, Mycobacterium bovis
FPHVYCELDFTTPLELAVATI

SEQ ID NO: 210804 - protein, 17 aa, Mycobacterium bovis
FPITPLFPLAGPVGLVP

SEQ ID NO: 210805 - protein, 17 aa, Mycobacterium bovis
FPLPRELVGEGTLFLLK

SEQ ID NO: 210806 - protein, 24 aa, Mycobacterium bovis
FQGCPAEGLVSLAASVQPLRAAAG

SEQ ID NO: 210807 - protein, 25 aa, Mycobacterium bovis
FQHVRAAMLSHGWIDGPPPGQYFHG

SEQ ID NO: 210808 - protein, 19 aa, Mycobacterium bovis
FQIRHHLRRVAMPAPGGRR

SEQ ID NO: 210809 - protein, 18 aa, Mycobacterium bovis
FQLLRPVKGEERYFVVTH

SEQ ID NO: 210810 - protein, 21 aa, Mycobacterium bovis
FRLVAAEALKLTAADAALVAV

SEQ ID NO: 210811 - protein, 20 aa, Mycobacterium bovis
FSDFPDRPDNLLAVANAAIG

SEQ ID NO: 210812 - protein, 27 aa, Mycobacterium bovis
FSIEPGIYFPGRWGARIEDIVIVTEDG

SEQ ID NO: 210813 - protein, 25 aa, Mycobacterium bovis
FSMDGCCKFAAISAHVYCPHQITKT

SEQ ID NO: 210814 - protein, 18 aa, Mycobacterium bovis
FSPGKGLGVIPREGYFQI

SEQ ID NO: 210815 - protein, 17 aa, Mycobacterium bovis
FSTGLFNPGHGNTGFLN

SEQ ID NO: 210816 - protein, 26 aa, Mycobacterium bovis
FSVLPPEINSALMFAGAGPGPMLAAA

SEQ ID NO: 210817 - protein, 22 aa, Mycobacterium bovis
FTAGHCRGGGAVTSRDYKVIGH

SEQ ID NO: 210818 - protein, 19 aa, Mycobacterium bovis
FTSMYRRIVGSAGPITDDP

SEQ ID NO: 210819 - protein, 17 aa, Mycobacterium bovis
FTTVWNAVVSELNGDPK

SEQ ID NO: 210820 - protein, 23 aa, Mycobacterium bovis
FVAEAIAVLGARVAGSSLAGFAT

SEQ ID NO: 210821 - protein, 17 aa, Mycobacterium bovis
FVLETGTPKSDRTGTGT

SEQ ID NO: 210822 - protein, 18 aa, Mycobacterium bovis
FVLPAAVLEKMRFIHTVV

SEQ ID NO: 210823 - protein, 24 aa, Mycobacterium bovis
FVPAFSGLFAPYWRSDARGAIVGL

SEQ ID NO: 210824 - protein, 23 aa, Mycobacterium bovis
FVPRPETEAILAWATAQSLPARP

SEQ ID NO: 210825 - protein, 20 aa, Mycobacterium bovis
GAAGGAGWSPDSDLKGFDGF

SEQ ID NO: 210826 - protein, 25 aa, Mycobacterium bovis
GADFKRPAPHWWFDDATLYGPDGLA

SEQ ID NO: 210827 - protein, 24 aa, Mycobacterium bovis
GADPELKSTGFARDLADYIQEQGW

SEQ ID NO: 210828 - protein, 31 aa, Mycobacterium bovis
GADRLGCGCGRADCAAGKRPAAPPVVIHLIA

SEQ ID NO: 210829 - protein, 27 aa, Mycobacterium bovis
GADRVGPTILRHWSHPATVLVAQPVCG

SEQ ID NO: 210830 - protein, 28 aa, Mycobacterium bovis
GADRVGPTILRHWSHPATVLVAQPVCGQ

SEQ ID NO: 210831 - protein, 19 aa, Mycobacterium bovis
GAEALLRWEHPTLGTLLPG

SEQ ID NO: 210832 - protein, 17 aa, Mycobacterium bovis
GAEYWLAPSGFTRAPQN

SEQ ID NO: 210833 - protein, 30 aa, Mycobacterium bovis
GAGADADQPGATGGTGFAGGAGGAGGAGGS

SEQ ID NO: 210834 - protein, 26 aa, Mycobacterium bovis
GAGANGLNSGAMLPGGGTVGNPGTGG

SEQ ID NO: 210835 - protein, 36 aa, Mycobacterium bovis
GAGGAAGMLFGAAGVGGPGGFAAAFGATGGAGGAGG

SEQ ID NO: 210836 - protein, 30 aa, Mycobacterium bovis
GAGGAGGSGFFGGKGGFGGDGGQGGPNGGG

SEQ ID NO: 210837 - protein, 21 aa, Mycobacterium bovis
GAGGAGISFSNGSNGGTGGTG

SEQ ID NO: 210838 - protein, 27 aa, Mycobacterium bovis
GAGGKGAIPAMKGATGADGTAPTSGGD

SEQ ID NO: 210839 - protein, 21 aa, Mycobacterium bovis
GAGGPAGLIGVGGAGGAGGDS

SEQ ID NO: 210840 - protein, 20 aa, Mycobacterium bovis
GAGGSGRTDLGGAGGAGGKA

SEQ ID NO: 210841 - protein, 28 aa, Mycobacterium bovis
GAGGTGGNAAWLLGGGGTGGAGGIGGGN

SEQ ID NO: 210842 - protein, 22 aa, Mycobacterium bovis
GAGQITGLRSGFGGAGGAGGAS

SEQ ID NO: 210843 - protein, 18 aa, Mycobacterium bovis
GALNSGIGNMGFGNSGNN

SEQ ID NO: 210844 - protein, 18 aa, Mycobacterium bovis
GANGIAGNGGDGGDGAAG

SEQ ID NO: 210845 - protein, 23 aa, Mycobacterium bovis
GANYKRLPLGVFTEASESLTNDF

SEQ ID NO: 210846 - protein, 21 aa, Mycobacterium bovis
GAPMGRAIPYHIGRHSHPKAK

SEQ ID NO: 210847 - protein, 17 aa, Mycobacterium bovis
GAREHALLLALGKDPQV

SEQ ID NO: 210848 - protein, 18 aa, Mycobacterium bovis
GATGNCWAVHTNCPVPGP

SEQ ID NO: 210849 - protein, 18 aa, Mycobacterium bovis
GAVYAELAAQGWGGRWLV

SEQ ID NO: 210850 - protein, 19 aa, Mycobacterium bovis
GCAEAMKGQGARVSVTEID

SEQ ID NO: 210851 - protein, 28 aa, Mycobacterium bovis
GCGARLSVVVAESWRASALAEMIQEAGL

SEQ ID NO: 210852 - protein, 18 aa, Mycobacterium bovis
GCGHAGYLASARERAVNL

SEQ ID NO: 210853 - protein, 21 aa, Mycobacterium bovis
GDAASFVGEIGKILADSVEQL

SEQ ID NO: 210854 - protein, 20 aa, Mycobacterium bovis
GDALGLVGVGGNGGNAGTGF

SEQ ID NO: 210855 - protein, 19 aa, Mycobacterium bovis
GDAPAGRAGSQGVGGDGGA

SEQ ID NO: 210856 - protein, 20 aa, Mycobacterium bovis
GDAPAGRAGSQGVGGDGGAG

SEQ ID NO: 210857 - protein, 20 aa, Mycobacterium bovis
GDAPLIGWGGNGGPGGFAAF

SEQ ID NO: 210858 - protein, 23 aa, Mycobacterium bovis
GDAWLNRHLSAYANWAKTNNSLL

SEQ ID NO: 210859 - protein, 25 aa, Mycobacterium bovis
GDEFITGVLFYTGARALPFGDRLMA

SEQ ID NO: 210860 - protein, 19 aa, Mycobacterium bovis
GDERHMLWFELMKPMTSTA

SEQ ID NO: 210861 - protein, 30 aa, Mycobacterium bovis
GDGGTGGRGGLLMGAGAGGHGGTGGAGGAG

SEQ ID NO: 210862 - protein, 22 aa, Mycobacterium bovis
GDKVTALQLVWADRRGRWPWAA

SEQ ID NO: 210863 - protein, 17 aa, Mycobacterium bovis
GDLAKLRASVVNTQALA

SEQ ID NO: 210864 - protein, 17 aa, Mycobacterium bovis
GDSGGPVYLAPDGGPAQ

SEQ ID NO: 210865 - protein, 17 aa, Mycobacterium bovis
GDSGLRVAVEALYDAAD

SEQ ID NO: 210866 - protein, 25 aa, Mycobacterium bovis
GDTDRVTLFRAWYSRRNFGQLSGSV

SEQ ID NO: 210867 - protein, 17 aa, Mycobacterium bovis
GDVWRFVDTAGLRRKVG

SEQ ID NO: 210868 - protein, 23 aa, Mycobacterium bovis
GEDLSWLWDVRFEHFETTRVVAA

SEQ ID NO: 210869 - protein, 19 aa, Mycobacterium bovis
GEESYVLLVRVASARALED

SEQ ID NO: 210870 - protein, 21 aa, Mycobacterium bovis
GEGVSALLIRVGESGVAPDRL

SEQ ID NO: 210871 - protein, 22 aa, Mycobacterium bovis
GEIEWAKASLIGPEEYVTAVAA

SEQ ID NO: 210872 - protein, 17 aa, Mycobacterium bovis
GELARIGVAADIGAAPA

SEQ ID NO: 210873 - protein, 22 aa, Mycobacterium bovis
GELEAFLRISVEHADAAGGDEC

SEQ ID NO: 210874 - protein, 19 aa, Mycobacterium bovis
GELREIFSAVQIIADTERM

SEQ ID NO: 210875 - protein, 20 aa, Mycobacterium bovis
GEPHAISAMHGRGVADLLDG

SEQ ID NO: 210876 - protein, 22 aa, Mycobacterium bovis
GEPRRFGVGAAEFHHRAATRAR

SEQ ID NO: 210877 - protein, 17 aa, Mycobacterium bovis
GERLDAKALVAFTQSGD

SEQ ID NO: 210878 - protein, 17 aa, Mycobacterium bovis
GESLPGAIRRRLAAELG

SEQ ID NO: 210879 - protein, 19 aa, Mycobacterium bovis
GFAAGADRIEGCLFGNGER

SEQ ID NO: 210880 - protein, 24 aa, Mycobacterium bovis
GFDSADLSLPWGQDALIAAVASAN

SEQ ID NO: 210881 - protein, 18 aa, Mycobacterium bovis
GFGSLRPLLEVAAAHGRG

SEQ ID NO: 210882 - protein, 35 aa, Mycobacterium bovis
GGAGGLFAGGGIGGAGGFGGFRGGEGGAGGAGGLF

SEQ ID NO: 210883 - protein, 24 aa, Mycobacterium bovis
GGAGGPGGAAFGLGNGGNGGNGGT

SEQ ID NO: 210884 - protein, 20 aa, Mycobacterium bovis
GGAIEACARKLFVHPNTVRY

SEQ ID NO: 210885 - protein, 26 aa, Mycobacterium bovis
GGDGVFEGIAVLGLGFGGAAGAGGAA

SEQ ID NO: 210886 - protein, 25 aa, Mycobacterium bovis
GGEMWRVDFAWPDMRLAAEYESIEW

SEQ ID NO: 210887 - protein, 22 aa, Mycobacterium bovis
GGGAGLRAAIAIAETNPHLDVA

SEQ ID NO: 210888 - protein, 33 aa, Mycobacterium bovis
GGGGGRRAAPVLARGPMVWRPATTGRSAAATAA

SEQ ID NO: 210889 - protein, 26 aa, Mycobacterium bovis
GGGGLSSPVILGIGIGGAGGNGGDAL

SEQ ID NO: 210890 - protein, 17 aa, Mycobacterium bovis
GGGGRYDGLMHQLGGQD

SEQ ID NO: 210891 - protein, 19 aa, Mycobacterium bovis
GGGLSGVLRVPPRPYVMPH

SEQ ID NO: 210892 - protein, 19 aa, Mycobacterium bovis
GGKGGNGADGEVGGAGGAG

SEQ ID NO: 210893 - protein, 24 aa, Mycobacterium bovis
GGLFASGGSGGFGGFASTGTGGAG

SEQ ID NO: 210894 - protein, 24 aa, Mycobacterium bovis
GGLGDPRVGGSGGDGGTGGSGGAA

SEQ ID NO: 210895 - protein, 25 aa, Mycobacterium bovis
GGLGGQLLGRDGFNAPASTPLHTLQ

SEQ ID NO: 210896 - protein, 19 aa, Mycobacterium bovis
GGLSHSISVASLVDRWRAV

SEQ ID NO: 210897 - protein, 22 aa, Mycobacterium bovis
GGMPMMLMPMSISGAGAGMPGG

SEQ ID NO: 210898 - protein, 17 aa, Mycobacterium bovis
GGNAGLFGHGGAGGTGG

SEQ ID NO: 210899 - protein, 28 aa, Mycobacterium bovis
GGNAGVAGVSFGNAVGGDGGNGGNGGHG

SEQ ID NO: 210900 - protein, 22 aa, Mycobacterium bovis
GGNAPDGGFGGNGGKGGQGGIG

SEQ ID NO: 210901 - protein, 34 aa, Mycobacterium bovis
GGNGADAAAVVGFGANGDPGFAGGKGGNGGIGGA

SEQ ID NO: 210902 - protein, 24 aa, Mycobacterium bovis
GGNGGSAGWLSGNGGTGGGGGTAG

SEQ ID NO: 210903 - protein, 25 aa, Mycobacterium bovis
GGPGEAAATLASRGLTAQTPRQNPM

SEQ ID NO: 210904 - protein, 22 aa, Mycobacterium bovis
GGSGGANFNGGTGGTGGTGGTG

SEQ ID NO: 210905 - protein, 25 aa, Mycobacterium bovis
GGTGGKGGMGGIAGDGGPGGDGGNA

SEQ ID NO: 210906 - protein, 20 aa, Mycobacterium bovis
GGTGVVLGGKGGDGGNGDHG

SEQ ID NO: 210907 - protein, 32 aa, Mycobacterium bovis
GGVGGFGGQGGIGGEGRTGGNGGSGGDGGGGI

SEQ ID NO: 210908 - protein, 17 aa, Mycobacterium bovis
GGVGGNGVDGFDINETT

SEQ ID NO: 210909 - protein, 24 aa, Mycobacterium bovis
GHAGRITAPRGWELVRHAGPLPSH

SEQ ID NO: 210910 - protein, 17 aa, Mycobacterium bovis
GHGGLFGAGGTGGAGGS

SEQ ID NO: 210911 - protein, 21 aa, Mycobacterium bovis
GHGNAKRWGWIHADLGDGDVL

SEQ ID NO: 210912 - protein, 17 aa, Mycobacterium bovis
GHTEWLPPPHLDHGQPW

SEQ ID NO: 210913 - protein, 22 aa, Mycobacterium bovis
GHTPGSIALALGGPVTGGVTQL

SEQ ID NO: 210914 - protein, 23 aa, Mycobacterium bovis
GHVFRRAFSWLPAQFASQSDAPV

SEQ ID NO: 210915 - protein, 18 aa, Mycobacterium bovis
GIERPDYSITGWVILTLI

SEQ ID NO: 210916 - protein, 19 aa, Mycobacterium bovis
GITGLDFDNGTGFLNKPVI

SEQ ID NO: 210917 - protein, 17 aa, Mycobacterium bovis
GKGGNGADGEVGGAGGA

SEQ ID NO: 210918 - protein, 18 aa, Mycobacterium bovis
GKGGNGADGEVGGAGGAG

SEQ ID NO: 210919 - protein, 18 aa, Mycobacterium bovis
GKGLSRLVRQNCDEVVSI

SEQ ID NO: 210920 - protein, 17 aa, Mycobacterium bovis
GKLPVRVGRDVPGFIGN

SEQ ID NO: 210921 - protein, 17 aa, Mycobacterium bovis
GKMTGRSRLEVVDPSAA

SEQ ID NO: 210922 - protein, 26 aa, Mycobacterium bovis
GKQSLTKLAAAWGGSGSEAYQGVQQK

SEQ ID NO: 210923 - protein, 24 aa, Mycobacterium bovis
GKTARRIAALVVQRAIFLNDRNTA

SEQ ID NO: 210924 - protein, 19 aa, Mycobacterium bovis
GKTLAAAKAEALKCAKGFR

SEQ ID NO: 210925 - protein, 17 aa, Mycobacterium bovis
GLAGVASVGGQPSQATQ

SEQ ID NO: 210926 - protein, 17 aa, Mycobacterium bovis
GLFANGGAGGFGANGGT

SEQ ID NO: 210927 - protein, 25 aa, Mycobacterium bovis
GLGCELRHAHRLVYSEGLDLSGDPN

SEQ ID NO: 210928 - protein, 24 aa, Mycobacterium bovis
GLGGQGNHTGGHGGAGGSAGLLAL

SEQ ID NO: 210929 - protein, 22 aa, Mycobacterium bovis
GLGSAFGPGGTGGMGGAGGTST

SEQ ID NO: 210930 - protein, 28 aa, Mycobacterium bovis
GLGWRQCQRPTPPFALVLFLDIDWDETN

SEQ ID NO: 210931 - protein, 28 aa, Mycobacterium bovis
GLLNRLSAFKVPHRFAVVDRLPRTPNGK

SEQ ID NO: 210932 - protein, 23 aa, Mycobacterium bovis
GLLPPTFSLVGFARRDWSTQDFG

SEQ ID NO: 210933 - protein, 22 aa, Mycobacterium bovis
GLLPVPARKAGRLILVDDQPAD

SEQ ID NO: 210934 - protein, 20 aa, Mycobacterium bovis
GLPKPDWQVLLAVSAELAGE

SEQ ID NO: 210935 - protein, 26 aa, Mycobacterium bovis
GLPVDQLRYPVFSWQRITLQEMTHMR

SEQ ID NO: 210936 - protein, 19 aa, Mycobacterium bovis
GLPYFPITPLFPLAGPVGL

SEQ ID NO: 210937 - protein, 26 aa, Mycobacterium bovis
GLRVWSRATIGLAYASALIIADRHDE

SEQ ID NO: 210938 - protein, 25 aa, Mycobacterium bovis
GLSLPRRLQIEFSQVIQKIAEGTAG

SEQ ID NO: 210939 - protein, 17 aa, Mycobacterium bovis
GLYPGRKFGGGALSVYI

SEQ ID NO: 210940 - protein, 25 aa, Mycobacterium bovis
GMALAFRAGAPLKDMEFVQYHPTGL

SEQ ID NO: 210941 - protein, 22 aa, Mycobacterium bovis
GMLTGPVTILAWSFVRDDQPLA

SEQ ID NO: 210942 - protein, 26 aa, Mycobacterium bovis
GMVFQRPNPFPAMSIRNNVVAGLKLQ

SEQ ID NO: 210943 - protein, 20 aa, Mycobacterium bovis
GMYELEFPAPQLSSSDGRGP

SEQ ID NO: 210944 - protein, 27 aa, Mycobacterium bovis
GNGGAGMINGGLGGFGGAGGGGAVDVA

SEQ ID NO: 210945 - protein, 27 aa, Mycobacterium bovis
GNGGGALNQAGFFGTGGKGGNGGNGGA

SEQ ID NO: 210946 - protein, 30 aa, Mycobacterium bovis
GNGGIGGKGGDAFATFAKAGNGGAGGNGGA

SEQ ID NO: 210947 - protein, 17 aa, Mycobacterium bovis
GNGGSWLAAGDGGAGGH

SEQ ID NO: 210948 - protein, 22 aa, Mycobacterium bovis
GNGGTGGLLFGNGGAGGQGGLG

SEQ ID NO: 210949 - protein, 18 aa, Mycobacterium bovis
GNGLLTLPTSVNVVTSSS

SEQ ID NO: 210950 - protein, 17 aa, Mycobacterium bovis
GNIGFGLTGNNQVGIGG

SEQ ID NO: 210951 - protein, 17 aa, Mycobacterium bovis
GNIGSWNLGGGNVGLLN

SEQ ID NO: 210952 - protein, 27 aa, Mycobacterium bovis
GNMIKPMLARGELRLVGATTLDEYRKH

SEQ ID NO: 210953 - protein, 19 aa, Mycobacterium bovis
GNYLPRFGPYLSSASNPWG

SEQ ID NO: 210954 - protein, 25 aa, Mycobacterium bovis
GPAMLPGFNSGFANIGSFNAGIANS

SEQ ID NO: 210955 - protein, 22 aa, Mycobacterium bovis
GPARTGSVLAELGVDPNRPMAV

SEQ ID NO: 210956 - protein, 17 aa, Mycobacterium bovis
GPCRGHGAAGRRTAPGA

SEQ ID NO: 210957 - protein, 23 aa, Mycobacterium bovis
GPGAIRRLCCGADVVADTAVSAA

SEQ ID NO: 210958 - protein, 18 aa, Mycobacterium bovis
GPGIPRHHRAAGGLQSVA

SEQ ID NO: 210959 - protein, 24 aa, Mycobacterium bovis
GPGPMLAAASAWTGLAGDLGSAAA

SEQ ID NO: 210960 - protein, 20 aa, Mycobacterium bovis
GPRGGCACHRCNQRQPDHVD

SEQ ID NO: 210961 - protein, 18 aa, Mycobacterium bovis
GQAVGGAFVRLLDSSDEF

SEQ ID NO: 210962 - protein, 24 aa, Mycobacterium bovis
GQGGHGGNAILFGQGGAGGPGGTG

SEQ ID NO: 210963 - protein, 18 aa, Mycobacterium bovis
GQGGLGLAGINGGSGGQG

SEQ ID NO: 210964 - protein, 18 aa, Mycobacterium bovis
GQGGLLRGIPLARAGRRT

SEQ ID NO: 210965 - protein, 19 aa, Mycobacterium bovis
GQGLVAFVGVTHGDDLDKA

SEQ ID NO: 210966 - protein, 17 aa, Mycobacterium bovis
GQGSQWLGMGMGLHAGY

SEQ ID NO: 210967 - protein, 19 aa, Mycobacterium bovis
GQPAADALHAWLVDGRRAL

SEQ ID NO: 210968 - protein, 19 aa, Mycobacterium bovis
GRAIVRRPRVFCMDEPLSN

SEQ ID NO: 210969 - protein, 18 aa, Mycobacterium bovis
GRARAFALGQLRSLAERN

SEQ ID NO: 210970 - protein, 22 aa, Mycobacterium bovis
GREAAHLRAFRAYAAHSQEIAL

SEQ ID NO: 210971 - protein, 19 aa, Mycobacterium bovis
GREHIKEIQAFFKELSAAV

SEQ ID NO: 210972 - protein, 17 aa, Mycobacterium bovis
GRFALKIGDGRARCTPT

SEQ ID NO: 210973 - protein, 18 aa, Mycobacterium bovis
GRFALKIGDGRARCTPTD

SEQ ID NO: 210974 - protein, 23 aa, Mycobacterium bovis
GRGDALRLARRIAAALNASDNNA

SEQ ID NO: 210975 - protein, 18 aa, Mycobacterium bovis
GRIAVPLSVPQGGVTDER

SEQ ID NO: 210976 - protein, 17 aa, Mycobacterium bovis
GRLPEDWFDGDPTVIVD

SEQ ID NO: 210977 - protein, 18 aa, Mycobacterium bovis
GRLVAAYGRPVHDRHGAL

SEQ ID NO: 210978 - protein, 20 aa, Mycobacterium bovis
GRPGLGRSIRSWRVPMPMRC

SEQ ID NO: 210979 - protein, 18 aa, Mycobacterium bovis
GRSRLEVVDPSAAAQLAD

SEQ ID NO: 210980 - protein, 18 aa, Mycobacterium bovis
GRTARWIEIAAEWGTRDY

SEQ ID NO: 210981 - protein, 24 aa, Mycobacterium bovis
GRTERFWVGLSVYRPGGTAEPAPT

SEQ ID NO: 210982 - protein, 25 aa, Mycobacterium bovis
GRTLGLAGHAAFERRTLATVAKLLA

SEQ ID NO: 210983 - protein, 24 aa, Mycobacterium bovis
GRTTGNSCGVTWGPGESPGTLVMQ

SEQ ID NO: 210984 - protein, 17 aa, Mycobacterium bovis
GRVAALSRSRASDDPEF

SEQ ID NO: 210985 - protein, 19 aa, Mycobacterium bovis
GRVGPHLEIKVVDPATGET

SEQ ID NO: 210986 - protein, 19 aa, Mycobacterium bovis
GRVIVACFASNVDRVQQII

SEQ ID NO: 210987 - protein, 25 aa, Mycobacterium bovis
GRVVVMPWDRHIAAGTEISLDLLDP

SEQ ID NO: 210988 - protein, 19 aa, Mycobacterium bovis
GSAGLLGYVGRAGDGGAGG

SEQ ID NO: 210989 - protein, 23 aa, Mycobacterium bovis
GSDKVVRFILGLVQRYGPGLFGA

SEQ ID NO: 210990 - protein, 21 aa, Mycobacterium bovis
GSDPRGGYPPETGGYPPQPGY

SEQ ID NO: 210991 - protein, 18 aa, Mycobacterium bovis
GSGQAWQGAAAAMVVAAA

SEQ ID NO: 210992 - protein, 19 aa, Mycobacterium bovis
GSGVVNVTAGHGGNGGNGG

SEQ ID NO: 210993 - protein, 17 aa, Mycobacterium bovis
GSNIIGRGQDAQFRLPD

SEQ ID NO: 210994 - protein, 19 aa, Mycobacterium bovis
GSPIPVGLDPTGVAVNPVT

SEQ ID NO: 210995 - protein, 26 aa, Mycobacterium bovis
GSQGEGGLRIVGISAVGSIDDLSAFK

SEQ ID NO: 210996 - protein, 20 aa, Mycobacterium bovis
GSSGEGLAGVASVGGQPSQA

SEQ ID NO: 210997 - protein, 17 aa, Mycobacterium bovis
GSSYGPIGEACRRARRR

SEQ ID NO: 210998 - protein, 25 aa, Mycobacterium bovis
GSTGERGLHHLIWEVVDNAVDEAMA

SEQ ID NO: 210999 - protein, 27 aa, Mycobacterium bovis
GSTSGAHGKAGFGAPGGDGGDGGNGGH

SEQ ID NO: 211000 - protein, 27 aa, Mycobacterium bovis
GSTSGAHGKAGFSAPGGDGGDGGNGGH

SEQ ID NO: 211001 - protein, 19 aa, Mycobacterium bovis
GSVMKRAVERYDVNVVDLT

SEQ ID NO: 211002 - protein, 19 aa, Mycobacterium bovis
GTAGYAGGLTYNYNTYSTT

SEQ ID NO: 211003 - protein, 25 aa, Mycobacterium bovis
GTASSPFGIAIAIGGAGAQGGAGTS

SEQ ID NO: 211004 - protein, 18 aa, Mycobacterium bovis
GTCRETPDGLVITATPLR

SEQ ID NO: 211005 - protein, 18 aa, Mycobacterium bovis
GTFMAGPLSGLRVVELAG

SEQ ID NO: 211006 - protein, 18 aa, Mycobacterium bovis
GTGFLNKPVISWAGDNGI

SEQ ID NO: 211007 - protein, 25 aa, Mycobacterium bovis
GTGQAGGNGGWLWGNGGNSGSGAPG

SEQ ID NO: 211008 - protein, 17 aa, Mycobacterium bovis
GTPDTWVLWNLTGGPRG

SEQ ID NO: 211009 - protein, 24 aa, Mycobacterium bovis
GTPTKSCHFCWTCSDDAVGVTQSA

SEQ ID NO: 211010 - protein, 22 aa, Mycobacterium bovis
GTTCWRRPVAPVAIASAAEPGA

SEQ ID NO: 211011 - protein, 17 aa, Mycobacterium bovis
GTTRLLDNIAIEIGTFA

SEQ ID NO: 211012 - protein, 27 aa, Mycobacterium bovis
GTVSLRLPVRAPFAFEGVFGHLAATAV

SEQ ID NO: 211013 - protein, 17 aa, Mycobacterium bovis
GTWAVAVDRGGQLRWYG

SEQ ID NO: 211014 - protein, 23 aa, Mycobacterium bovis
GVAQGDIASAFGGDGGNGSDGVA

SEQ ID NO: 211015 - protein, 19 aa, Mycobacterium bovis
GVGGLGFDAGGAGGAGGKA

SEQ ID NO: 211016 - protein, 26 aa, Mycobacterium bovis
GVGGNGGRGGWLLGNGGAGGVGGVGG

SEQ ID NO: 211017 - protein, 17 aa, Mycobacterium bovis
GVGTLVMTHYVPAIGPG

SEQ ID NO: 211018 - protein, 20 aa, Mycobacterium bovis
GVPEISRKAFGQSLDTHGYP

SEQ ID NO: 211019 - protein, 18 aa, Mycobacterium bovis
GVSKPVLYQHFSSKLELY

SEQ ID NO: 211020 - protein, 19 aa, Mycobacterium bovis
GWQTYGDVVVRFEQSSNLH

SEQ ID NO: 211021 - protein, 34 aa, Mycobacterium bovis
GYGPAFRGLTAMWRRGDEVFAEVALPADAGVSVT

SEQ ID NO: 211022 - protein, 18 aa, Mycobacterium bovis
GYIVISAYVPKHWQKLCY

SEQ ID NO: 211023 - protein, 21 aa, Mycobacterium bovis
HAARRCATRLLDLHVVDGRLR

SEQ ID NO: 211024 - protein, 26 aa, Mycobacterium bovis
HAGPGGYCGYLLYNLTTSGFRPATFA

SEQ ID NO: 211025 - protein, 23 aa, Mycobacterium bovis
HAHFKIPGWRDALTRTGVVEGTR

SEQ ID NO: 211026 - protein, 17 aa, Mycobacterium bovis
HAKEQKAKVLAICNTNG

SEQ ID NO: 211027 - protein, 22 aa, Mycobacterium bovis
HASMLFLPVRILTSPITTLASM

SEQ ID NO: 211028 - protein, 19 aa, Mycobacterium bovis
HASYGAWYPRHPPTRQDEA

SEQ ID NO: 211029 - protein, 17 aa, Mycobacterium bovis
HAVTYGWLLSGLARAVT

SEQ ID NO: 211030 - protein, 18 aa, Mycobacterium bovis
HCALWRALIGLDSMERIS

SEQ ID NO: 211031 - protein, 19 aa, Mycobacterium bovis
HDAYCLRIAITETMSDLPV

SEQ ID NO: 211032 - protein, 20 aa, Mycobacterium bovis
HDDWRWVIDVDLWGSIHTVE

SEQ ID NO: 211033 - protein, 32 aa, Mycobacterium bovis
HDLIDYPAGAAFSWWPTMLLPPGSHQDNMTVG

SEQ ID NO: 211034 - protein, 23 aa, Mycobacterium bovis
HDLSSLRLLGSVGEPINPEAWRW

SEQ ID NO: 211035 - protein, 17 aa, Mycobacterium bovis
HDTTIRFTHELRMTLRE

SEQ ID NO: 211036 - protein, 17 aa, Mycobacterium bovis
HEALWRQLIAAYYVSER

SEQ ID NO: 211037 - protein, 26 aa, Mycobacterium bovis
HEDDWLAPGGFNFDAWRFENRCELLA

SEQ ID NO: 211038 - protein, 20 aa, Mycobacterium bovis
HFDTLLVMSVEPGFGGQRFI

SEQ ID NO: 211039 - protein, 18 aa, Mycobacterium bovis
HGDTEWLPPPHLDHGQPR

SEQ ID NO: 211040 - protein, 20 aa, Mycobacterium bovis
HGKLAYHAVTYGWLLSGLAR

SEQ ID NO: 211041 - protein, 20 aa, Mycobacterium bovis
HGLTGPAIRIRCKSLLNALH

SEQ ID NO: 211042 - protein, 17 aa, Mycobacterium bovis
HILEVQRLIRFMPKVVI

SEQ ID NO: 211043 - protein, 28 aa, Mycobacterium bovis
HISTLLLTLLFRFMRPLIENGHVFLAQP

SEQ ID NO: 211044 - protein, 18 aa, Mycobacterium bovis
HIVGAALFEALAETTTWD

SEQ ID NO: 211045 - protein, 19 aa, Mycobacterium bovis
HKPEESKRTFGARIVTPSA

SEQ ID NO: 211046 - protein, 25 aa, Mycobacterium bovis
HKPGLRRLAPLAFVRFRIDGKDWPA

SEQ ID NO: 211047 - protein, 26 aa, Mycobacterium bovis
HLADEAFRLLGHFDVVFSNAGIVVGG

SEQ ID NO: 211048 - protein, 25 aa, Mycobacterium bovis
HLDIPRVPVTLNYLFGSQPGGPLKI

SEQ ID NO: 211049 - protein, 20 aa, Mycobacterium bovis
HLEIRWDGQVALLADLNSTN

SEQ ID NO: 211050 - protein, 24 aa, Mycobacterium bovis
HLGARLFSIIAWRTYLVRDPHALS

SEQ ID NO: 211051 - protein, 17 aa, Mycobacterium bovis
HLIGHFVDQARRSGASW

SEQ ID NO: 211052 - protein, 22 aa, Mycobacterium bovis
HLRVVFPGVVGLFADLDSPISL

SEQ ID NO: 211053 - protein, 20 aa, Mycobacterium bovis
HPDEACGVLAGPEGSDRPER

SEQ ID NO: 211054 - protein, 17 aa, Mycobacterium bovis
HPDVWELAGHVSPNPGG

SEQ ID NO: 211055 - protein, 25 aa, Mycobacterium bovis
HPGVNELFALLAYGEVAAFYRLTDE

SEQ ID NO: 211056 - protein, 17 aa, Mycobacterium bovis
HPHLTPLAHRVVEPTEA

SEQ ID NO: 211057 - protein, 21 aa, Mycobacterium bovis
HPSRSASMFEYWDAPPTGHPL

SEQ ID NO: 211058 - protein, 17 aa, Mycobacterium bovis
HPVHIYLQFDGLDEATH

SEQ ID NO: 211059 - protein, 22 aa, Mycobacterium bovis
HRAACIRTELVTGRSAADIYRV

SEQ ID NO: 211060 - protein, 24 aa, Mycobacterium bovis
HRAFKMLAEDGIDLQTCGLVAVGH

SEQ ID NO: 211061 - protein, 25 aa, Mycobacterium bovis
HRDLRLLAADMVFDLPVIGEAARKA

SEQ ID NO: 211062 - protein, 22 aa, Mycobacterium bovis
HRRELRLPPIRVYAMSRGDRGI

SEQ ID NO: 211063 - protein, 21 aa, Mycobacterium bovis
HRRHARVGPMAHLLGAEAVHL

SEQ ID NO: 211064 - protein, 18 aa, Mycobacterium bovis
HRSAARWVPPEPPPSKLS

SEQ ID NO: 211065 - protein, 22 aa, Mycobacterium bovis
HRSPLGRLPLRIGRSKSNDMVL

SEQ ID NO: 211066 - protein, 19 aa, Mycobacterium bovis
HRVAIEFDPPLPPEYQQLA

SEQ ID NO: 211067 - protein, 23 aa, Mycobacterium bovis
HTFNYLDLVRYLAVGNLNPSPLG

SEQ ID NO: 211068 - protein, 26 aa, Mycobacterium bovis
HTGPAMSAFNAWVLLKGLETLAIRVQ

SEQ ID NO: 211069 - protein, 21 aa, Mycobacterium bovis
HTLTAAARWYTATEIANAAAM

SEQ ID NO: 211070 - protein, 17 aa, Mycobacterium bovis
HTPEIAQGLRAVTDRDV

SEQ ID NO: 211071 - protein, 18 aa, Mycobacterium bovis
HVAYWWSAEPQRLSMAAS

SEQ ID NO: 211072 - protein, 20 aa, Mycobacterium bovis
HYRPSAKLAEFVRMRDLTCR

SEQ ID NO: 211073 - protein, 21 aa, Mycobacterium bovis
HYTYKLDWLAALRDTAEGWLR

SEQ ID NO: 211074 - protein, 20 aa, Mycobacterium bovis
IAAAEAMYEQMWAADVAAMV

SEQ ID NO: 211075 - protein, 18 aa, Mycobacterium bovis
IAEVKRASPSAGALATIA

SEQ ID NO: 211076 - protein, 23 aa, Mycobacterium bovis
IAGEDVARLFALVQVVADEHLAD

SEQ ID NO: 211077 - protein, 22 aa, Mycobacterium bovis
IAIDRLPAAIITRLTQTNDPLG

SEQ ID NO: 211078 - protein, 25 aa, Mycobacterium bovis
IALGHPFGGSGARLMTTVLHHMPDK

SEQ ID NO: 211079 - protein, 18 aa, Mycobacterium bovis
IALRADMDALPMAERTGA

SEQ ID NO: 211080 - protein, 20 aa, Mycobacterium bovis
IAMAGAPGFEADDVLGTLAT

SEQ ID NO: 211081 - protein, 28 aa, Mycobacterium bovis
IAQCVKAEMLAASSWRVAVNAGADSTGR

SEQ ID NO: 211082 - protein, 26 aa, Mycobacterium bovis
IAQMGRDGWLALGWPKEYGGQGRSAM

SEQ ID NO: 211083 - protein, 19 aa, Mycobacterium bovis
ICARRGPTLQWVRSAVTAQ

SEQ ID NO: 211084 - protein, 25 aa, Mycobacterium bovis
ICPICRKEQLTLVSWVFGEHLGAVS

SEQ ID NO: 211085 - protein, 17 aa, Mycobacterium bovis
IDARKGVVVVGADRVGP

SEQ ID NO: 211086 - protein, 19 aa, Mycobacterium bovis
IDAVLEFRVSEEVLLERLK

SEQ ID NO: 211087 - protein, 23 aa, Mycobacterium bovis
IDDIKAPLLAALGAADLALATVN

SEQ ID NO: 211088 - protein, 17 aa, Mycobacterium bovis
IDFTNIYFYTVLYHALR

SEQ ID NO: 211089 - protein, 17 aa, Mycobacterium bovis
IDGAFAHMALCMALSTS

SEQ ID NO: 211090 - protein, 25 aa, Mycobacterium bovis
IDGSRAATHAALWAVDEAVNRDIPL

SEQ ID NO: 211091 - protein, 23 aa, Mycobacterium bovis
IDHSAPWPLGPTHPSNLKCACRK

SEQ ID NO: 211092 - protein, 20 aa, Mycobacterium bovis
IDLRQDWPKALQKAGFDPSK

SEQ ID NO: 211093 - protein, 26 aa, Mycobacterium bovis
IDLVPEYIGNLLLYFQPDATVTMLDA

SEQ ID NO: 211094 - protein, 24 aa, Mycobacterium bovis
IDNPDRWAPPYAEAGAYNVTFHAE

SEQ ID NO: 211095 - protein, 20 aa, Mycobacterium bovis
IDPALVGRKVELVFDPFDLT

SEQ ID NO: 211096 - protein, 19 aa, Mycobacterium bovis
IDYLRSRLTGIAGEGNKEI

SEQ ID NO: 211097 - protein, 20 aa, Mycobacterium bovis
IEVIEFCLGIPHLLKGEYTE

SEQ ID NO: 211098 - protein, 20 aa, Mycobacterium bovis
IEVRLAGAPMGRAIPYHIGR

SEQ ID NO: 211099 - protein, 17 aa, Mycobacterium bovis
IFAHRVFQELAGLATLP

SEQ ID NO: 211100 - protein, 17 aa, Mycobacterium bovis
IGDAVGLTSTSSVAHQL

SEQ ID NO: 211101 - protein, 17 aa, Mycobacterium bovis
IGMGNNFIQAAKTLGLI

SEQ ID NO: 211102 - protein, 19 aa, Mycobacterium bovis
IGPNNGFPGTSSIVTAMPG

SEQ ID NO: 211103 - protein, 24 aa, Mycobacterium bovis
IGVPRPYWRSKPISVVELHLDPPD

SEQ ID NO: 211104 - protein, 20 aa, Mycobacterium bovis
IHAALRINGFTVMLNDDVPQ

SEQ ID NO: 211105 - protein, 19 aa, Mycobacterium bovis
IHGVQICQHHCPVSHVAEE

SEQ ID NO: 211106 - protein, 19 aa, Mycobacterium bovis
IHLRGHTPGSIALALGGPV

SEQ ID NO: 211107 - protein, 17 aa, Mycobacterium bovis
IKQALLALQRVSERDTD

SEQ ID NO: 211108 - protein, 21 aa, Mycobacterium bovis
IKSAVAFGALLSRGIGDTIRV

SEQ ID NO: 211109 - protein, 18 aa, Mycobacterium bovis
IKVEAPGGEAARQITSVL

SEQ ID NO: 211110 - protein, 27 aa, Mycobacterium bovis
IKVSARPSDSVAIALRVGVPIYVEEAV

SEQ ID NO: 211111 - protein, 24 aa, Mycobacterium bovis
ILCACCTTSCPVFWHEGSYFGPAA

SEQ ID NO: 211112 - protein, 19 aa, Mycobacterium bovis
ILDRGEKLMGFGHRVYRAE

SEQ ID NO: 211113 - protein, 18 aa, Mycobacterium bovis
INAAFALGGGRLLTQTVE

SEQ ID NO: 211114 - protein, 28 aa, Mycobacterium bovis
INAPAQTLLGRPLIGNGADGSTPGQAGG

SEQ ID NO: 211115 - protein, 17 aa, Mycobacterium bovis
INGCKTWISNARRSGLF

SEQ ID NO: 211116 - protein, 19 aa, Mycobacterium bovis
INIACSLGMLTAEQVDQLA

SEQ ID NO: 211117 - protein, 18 aa, Mycobacterium bovis
IPAGTALGAFNLPTLSIP

SEQ ID NO: 211118 - protein, 18 aa, Mycobacterium bovis
IPEVLSKVRAVRKMVDAG

SEQ ID NO: 211119 - protein, 17 aa, Mycobacterium bovis
IPPPNSALVSWLPFYHD

SEQ ID NO: 211120 - protein, 24 aa, Mycobacterium bovis
IPPPNSALVSWLPFYHDMGLVIGI

SEQ ID NO: 211121 - protein, 18 aa, Mycobacterium bovis
IPQFRTLVILSNHGPINL

SEQ ID NO: 211122 - protein, 17 aa, Mycobacterium bovis
IPRHHRAAGGLQSVAKA

SEQ ID NO: 211123 - protein, 19 aa, Mycobacterium bovis
IPVRRSWRLNERHYGALQG

SEQ ID NO: 211124 - protein, 19 aa, Mycobacterium bovis
IQGLLTEAARTWADRLIGA

SEQ ID NO: 211125 - protein, 24 aa, Mycobacterium bovis
IQWAIRLARRGAVIVVDNVIRGGG

SEQ ID NO: 211126 - protein, 26 aa, Mycobacterium bovis
IRDFARVSFSYGLNAKWPVYLSTKNT

SEQ ID NO: 211127 - protein, 25 aa, Mycobacterium bovis
IRECDAICQVVRVFVDDDVTHVTGR

SEQ ID NO: 211128 - protein, 20 aa, Mycobacterium bovis
IRHRWNWTDVRRWLTDPTGR

SEQ ID NO: 211129 - protein, 24 aa, Mycobacterium bovis
IRIDLRKTYLFAFLDDHSRLVPGY

SEQ ID NO: 211130 - protein, 17 aa, Mycobacterium bovis
IRLEGKSVLISDSERLA

SEQ ID NO: 211131 - protein, 17 aa, Mycobacterium bovis
IRLRFGLDDGQPRTLDQ

SEQ ID NO: 211132 - protein, 19 aa, Mycobacterium bovis
IRLVTPVQWAMRQTVRDTE

SEQ ID NO: 211133 - protein, 20 aa, Mycobacterium bovis
IRLVTPVQWAMRQTVRDTEL

SEQ ID NO: 211134 - protein, 17 aa, Mycobacterium bovis
IRPNGRMLAIKGERAHD

SEQ ID NO: 211135 - protein, 17 aa, Mycobacterium bovis
IRRRAFARALRIAGSPD

SEQ ID NO: 211136 - protein, 24 aa, Mycobacterium bovis
IRTGRANPGMFSRITIDYYGAATP

SEQ ID NO: 211137 - protein, 22 aa, Mycobacterium bovis
IRWMGSGPLTGLAEIQLPDLQP

SEQ ID NO: 211138 - protein, 26 aa, Mycobacterium bovis
ISAYVPKHWQKLCYLIGRPDLVEDQR

SEQ ID NO: 211139 - protein, 17 aa, Mycobacterium bovis
ISELKQQYTIVIVTHNM

SEQ ID NO: 211140 - protein, 17 aa, Mycobacterium bovis
ISEQGITAAEEFLSDPE

SEQ ID NO: 211141 - protein, 19 aa, Mycobacterium bovis
ISKPVGLGFSKGGGENDYE

SEQ ID NO: 211142 - protein, 17 aa, Mycobacterium bovis
ISTDIGAPGILDLRRVR

SEQ ID NO: 211143 - protein, 17 aa, Mycobacterium bovis
ITKYIPLHTPAVVMSIN

SEQ ID NO: 211144 - protein, 18 aa, Mycobacterium bovis
ITVLKGAVLFVTDLARAI

SEQ ID NO: 211145 - protein, 23 aa, Mycobacterium bovis
IVDEPFLAPARIDLTALRAHAVA

SEQ ID NO: 211146 - protein, 18 aa, Mycobacterium bovis
IVELYISYLRKKIDNGRE

SEQ ID NO: 211147 - protein, 22 aa, Mycobacterium bovis
IVELYISYLRKKIDNGREPMIH

SEQ ID NO: 211148 - protein, 28 aa, Mycobacterium bovis
IVIGCGPIGLAVICMLKSRGVHTVIASD

SEQ ID NO: 211149 - protein, 22 aa, Mycobacterium bovis
IVPKHIPVTWWPKTDSVSPQLG

SEQ ID NO: 211150 - protein, 19 aa, Mycobacterium bovis
IVPPPLIAANRARLTSLVT

SEQ ID NO: 211151 - protein, 19 aa, Mycobacterium bovis
IYAGLATDTGSFRWASVRG

SEQ ID NO: 211152 - protein, 18 aa, Mycobacterium bovis
KAAPGVLAGPAPITPPAS

SEQ ID NO: 211153 - protein, 18 aa, Mycobacterium bovis
KAARFVRTCDCFNIPIVM

SEQ ID NO: 211154 - protein, 17 aa, Mycobacterium bovis
KAKRRKGVGFATQPSDA

SEQ ID NO: 211155 - protein, 20 aa, Mycobacterium bovis
KALADFLFDDERAMVRIDMS

SEQ ID NO: 211156 - protein, 21 aa, Mycobacterium bovis
KARFVPGNENFQMGAYLKSND

SEQ ID NO: 211157 - protein, 22 aa, Mycobacterium bovis
KARFVPGNENFQMGAYLKSNDG

SEQ ID NO: 211158 - protein, 18 aa, Mycobacterium bovis
KAVASAFEAARAATVHPM

SEQ ID NO: 211159 - protein, 21 aa, Mycobacterium bovis
KCYRIRRAPGHSASFRITGAA

SEQ ID NO: 211160 - protein, 20 aa, Mycobacterium bovis
KDSPEVIAYLEAENDYTERT

SEQ ID NO: 211161 - protein, 18 aa, Mycobacterium bovis
KEQGAWAELFRHFVDDGV

SEQ ID NO: 211162 - protein, 25 aa, Mycobacterium bovis
KGTLFRRFGSRAGLMMVLLDEDERA

SEQ ID NO: 211163 - protein, 17 aa, Mycobacterium bovis
KHHLLKTFWTGWRDVQL

SEQ ID NO: 211164 - protein, 40 aa, Mycobacterium bovis
KIFGPTRDWECYCGKYKRAPFKGIICERCGVEVTRAKVRR

SEQ ID NO: 211165 - protein, 40 aa, Mycobacterium bovis
KIFGPTRDWECYCGKYKRVPFKGIICERCGVEVTRAKVRR

SEQ ID NO: 211166 - protein, 40 aa, Mycobacterium bovis; identical to SEQ ID NO: 81452

SEQ ID NO: 211167 - protein, 17 aa, Mycobacterium bovis
KLRTKWVPERAKMLREL

SEQ ID NO: 211168 - protein, 17 aa, Mycobacterium bovis
KLSVGLGRLAAEDPTLR

SEQ ID NO: 211169 - protein, 21 aa, Mycobacterium bovis
KNAKGDTEWLPPAHLDHGQPR

SEQ ID NO: 211170 - protein, 19 aa, Mycobacterium bovis
KNVRCLLIYNQQWIGSTTT

SEQ ID NO: 211171 - protein, 17 aa, Mycobacterium bovis
KPSPFAWIPFGGGTRRC

SEQ ID NO: 211172 - protein, 19 aa, Mycobacterium bovis
KQLAAPFADVIAFARDWGF

SEQ ID NO: 211173 - protein, 17 aa, Mycobacterium bovis
KQLRARSSVPVIMVTAR

SEQ ID NO: 211174 - protein, 17 aa, Mycobacterium bovis
KRIPLDVAEGDTVIYSK

SEQ ID NO: 211175 - protein, 23 aa, Mycobacterium bovis
KRLASPAQRIMLFANDRGCTKPG

SEQ ID NO: 211176 - protein, 19 aa, Mycobacterium bovis
KRLDFGLLGPLQMTIDGTP

SEQ ID NO: 211177 - protein, 21 aa, Mycobacterium bovis
KRLGRRVTEIALVFRRAPHLP

SEQ ID NO: 211178 - protein, 28 aa, Mycobacterium bovis
KRLPRLTRMQRFWISLYFPLTMRSLCNA

SEQ ID NO: 211179 - protein, 22 aa, Mycobacterium bovis
KSICPVCKVVVDAQVNIRHDKV

SEQ ID NO: 211180 - protein, 21 aa, Mycobacterium bovis
KSRPLWEMYLVEGLEKNRIAL

SEQ ID NO: 211181 - protein, 21 aa, Mycobacterium bovis
KTLTCVLPAYLNALAGNGVHI

SEQ ID NO: 211182 - protein, 18 aa, Mycobacterium bovis
KTRKNAKGDTEWLPPAHL

SEQ ID NO: 211183 - protein, 20 aa, Mycobacterium bovis
KTSISAPIVESWRAQRGAQC

SEQ ID NO: 211184 - protein, 20 aa, Mycobacterium bovis
KVGLFPRPLPREAAITQVAD

SEQ ID NO: 211185 - protein, 23 aa, Mycobacterium bovis
KVKWTGSRVDLVFGSNSELRALV

SEQ ID NO: 211186 - protein, 17 aa, Mycobacterium bovis
KVPTPLLDFIAPKVAGL

SEQ ID NO: 211187 - protein, 23 aa, Mycobacterium bovis
KWAVRWKPALNALAITFADRMPA

SEQ ID NO: 211188 - protein, 18 aa, Mycobacterium bovis
KYLSRTNIASTQMALIVQ

SEQ ID NO: 211189 - protein, 22 aa, Mycobacterium bovis
LAAAAGELRSLGATLKVSNAAA

SEQ ID NO: 211190 - protein, 17 aa, Mycobacterium bovis
LAAELAVAASSFGSVTS

SEQ ID NO: 211191 - protein, 17 aa, Mycobacterium bovis
LAAITTLGPKFWAQDAI

SEQ ID NO: 211192 - protein, 19 aa, Mycobacterium bovis
LACGCGKPDCPSGAGNDER

SEQ ID NO: 211193 - protein, 17 aa, Mycobacterium bovis
LADALGVLPVLATDVLR

SEQ ID NO: 211194 - protein, 24 aa, Mycobacterium bovis
LADARRLAPGGAIVVGGAAGSSAL

SEQ ID NO: 211195 - protein, 18 aa, Mycobacterium bovis
LADRGMRLTLRVYAYSSC

SEQ ID NO: 211196 - protein, 19 aa, Mycobacterium bovis
LAESFSEVHPLPGRDLMPV

SEQ ID NO: 211197 - protein, 19 aa, Mycobacterium bovis
LALAADWRVSGDNVKFGAT

SEQ ID NO: 211198 - protein, 17 aa, Mycobacterium bovis
LALALLGFRAFQLGDPA

SEQ ID NO: 211199 - protein, 27 aa, Mycobacterium bovis
LAMAARLKGYRLICVMPENTSVERRQL

SEQ ID NO: 211200 - protein, 19 aa, Mycobacterium bovis
LARLQEVWLGRQIAEVKSK

SEQ ID NO: 211201 - protein, 22 aa, Mycobacterium bovis
LASAPPGYRLAVADNQYDVARF

SEQ ID NO: 211202 - protein, 17 aa, Mycobacterium bovis
LASRLIDVTGWLATQPD

SEQ ID NO: 211203 - protein, 19 aa, Mycobacterium bovis
LATASRLVARLGPEAVRII

SEQ ID NO: 211204 - protein, 17 aa, Mycobacterium bovis
LATDVLRRLRMVKEETE

SEQ ID NO: 211205 - protein, 17 aa, Mycobacterium bovis
LATEIPLRTWLFRIADD

SEQ ID NO: 211206 - protein, 17 aa, Mycobacterium bovis
LAVDEVFQMQSEARAEA

SEQ ID NO: 211207 - protein, 19 aa, Mycobacterium bovis
LDALVAHLPADRWADPTPA

SEQ ID NO: 211208 - protein, 17 aa, Mycobacterium bovis
LDARVPERFRGDVEPVD

SEQ ID NO: 211209 - protein, 23 aa, Mycobacterium bovis
LDERDFPASAVRFFASARSQGRK

SEQ ID NO: 211210 - protein, 19 aa, Mycobacterium bovis
LDGTDGITPNGGNGGNGGN

SEQ ID NO: 211211 - protein, 18 aa, Mycobacterium bovis
LDKMGWRSSDTAELCYTD

SEQ ID NO: 211212 - protein, 24 aa, Mycobacterium bovis
LDVDRDCFARIAPGLPSSVIRIAE

SEQ ID NO: 211213 - protein, 20 aa, Mycobacterium bovis
LEALPQFRFDADACELLAQF

SEQ ID NO: 211214 - protein, 18 aa, Mycobacterium bovis
LEPPRFCAQCGRRMVVQV

SEQ ID NO: 211215 - protein, 18 aa, Mycobacterium bovis
LEPVSVWAPECSEDLLYL

SEQ ID NO: 211216 - protein, 19 aa, Mycobacterium bovis
LEPVSVWAPECSEDLLYLS

SEQ ID NO: 211217 - protein, 22 aa, Mycobacterium bovis
LEPVSVWAPECSEDLLYLSDLD

SEQ ID NO: 211218 - protein, 35 aa, Mycobacterium bovis
LEVQRLIRFMPKVVICLVNGWAAGGGHSLHVVCDL

SEQ ID NO: 211219 - protein, 23 aa, Mycobacterium bovis
LFAGWRSDPAFVLNLSPFDRGSV

SEQ ID NO: 211220 - protein, 19 aa, Mycobacterium bovis
LFGSHGQHYQAISAQVAAY

SEQ ID NO: 211221 - protein, 24 aa, Mycobacterium bovis
LFRESYRAFLDRHVAAYHDEWEKT

SEQ ID NO: 211222 - protein, 26 aa, Mycobacterium bovis
LFRNKIPIVAAIGSPVRPEGNAEQLN

SEQ ID NO: 211223 - protein, 17 aa, Mycobacterium bovis
LFYTGARALPFGDRLMA

SEQ ID NO: 211224 - protein, 19 aa, Mycobacterium bovis
LGAFVKRVSNPVAGHTVWT

SEQ ID NO: 211225 - protein, 22 aa, Mycobacterium bovis
LGDLRSFMFVQMFSRALTEDEL

SEQ ID NO: 211226 - protein, 22 aa, Mycobacterium bovis
LGDLRSFMFVQMFSRALTGDEL

SEQ ID NO: 211227 - protein, 17 aa, Mycobacterium bovis
LGDTLSGSGWVIDTPGI

SEQ ID NO: 211228 - protein, 23 aa, Mycobacterium bovis
LGFARLAIQHGYPIVPFASVGAE

SEQ ID NO: 211229 - protein, 18 aa, Mycobacterium bovis
LGGKGGDGGNGDHGGPAT

SEQ ID NO: 211230 - protein, 17 aa, Mycobacterium bovis
LGIGPNNGFPGTSSIVT

SEQ ID NO: 211231 - protein, 17 aa, Mycobacterium bovis
LGLTAPFNIDEVPNVIR

SEQ ID NO: 211232 - protein, 27 aa, Mycobacterium bovis
LGNFLSRSGAVGVLGIGPNNGFPGTSS

SEQ ID NO: 211233 - protein, 18 aa, Mycobacterium bovis
LGPPPDEPNQFVVEGAPR

SEQ ID NO: 211234 - protein, 17 aa, Mycobacterium bovis
LGQWPFTSGPGFGHTRN

SEQ ID NO: 211235 - protein, 18 aa, Mycobacterium bovis
LGVLPVLATDVLRRLRMV

SEQ ID NO: 211236 - protein, 29 aa, Mycobacterium bovis
LHGSLFEFRCARCGVPYTDALPEMPEPAI

SEQ ID NO: 211237 - protein, 18 aa, Mycobacterium bovis
LHLRRALVTVGLFGGDAP

SEQ ID NO: 211238 - protein, 19 aa, Mycobacterium bovis
LHLRRALVTVGLFGGDAPV

SEQ ID NO: 211239 - protein, 21 aa, Mycobacterium bovis
LHLRRALVTVGLFGGDAPVRD

SEQ ID NO: 211240 - protein, 25 aa, Mycobacterium bovis
LHRLLRRYRLELSRPDYQPRWDYSA

SEQ ID NO: 211241 - protein, 17 aa, Mycobacterium bovis
LIERDAWLRCMHTAVAS

SEQ ID NO: 211242 - protein, 18 aa, Mycobacterium bovis
LILPIAVAVQNRITVNEL

SEQ ID NO: 211243 - protein, 18 aa, Mycobacterium bovis
LKFPSLHDSPPMLAGKSV

SEQ ID NO: 211244 - protein, 20 aa, Mycobacterium bovis
LKGAVLFVTDLARAIPVPTQ

SEQ ID NO: 211245 - protein, 18 aa, Mycobacterium bovis
LKPPRSGLPVIEVLDTEL

SEQ ID NO: 211246 - protein, 22 aa, Mycobacterium bovis
LKWQRSDPEFAYSDRERDGLLE

SEQ ID NO: 211247 - protein, 17 aa, Mycobacterium bovis
LLAPGILSDRVRGYARE

SEQ ID NO: 211248 - protein, 22 aa, Mycobacterium bovis
LLARIGDAFLALPNGFTAHPRV

SEQ ID NO: 211249 - protein, 23 aa, Mycobacterium bovis
LLARRMGKTRVIAETGAGQHGVA

SEQ ID NO: 211250 - protein, 18 aa, Mycobacterium bovis
LLASSGFAARLAGRSADE

SEQ ID NO: 211251 - protein, 20 aa, Mycobacterium bovis
LLFPACATSAAASRHRKPTH

SEQ ID NO: 211252 - protein, 23 aa, Mycobacterium bovis
LLGGFERRGRWNVPKKLTTFTLW

SEQ ID NO: 211253 - protein, 25 aa, Mycobacterium bovis
LLGLVERLPWLSAVPAYFVGVGVRP

SEQ ID NO: 211254 - protein, 24 aa, Mycobacterium bovis
LLGNGNFGFGNAFGDGNLGSGNVG

SEQ ID NO: 211255 - protein, 19 aa, Mycobacterium bovis
LLHRADAAVLPSHYEPFGL

SEQ ID NO: 211256 - protein, 25 aa, Mycobacterium bovis
LLILRRPRAGLSYEALLETVEQRLP

SEQ ID NO: 211257 - protein, 17 aa, Mycobacterium bovis
LLRWEHPTLGTLLPGRF

SEQ ID NO: 211258 - protein, 24 aa, Mycobacterium bovis
LLSMRTGQGYAEFAVSSFGTDAVI

SEQ ID NO: 211259 - protein, 18 aa, Mycobacterium bovis
LLTDWRVTRGRLHEELLA

SEQ ID NO: 211260 - protein, 17 aa, Mycobacterium bovis
LLTELGWALRRAPLPPT

SEQ ID NO: 211261 - protein, 18 aa, Mycobacterium bovis
LLVPPSDRPWRLAMSTAG

SEQ ID NO: 211262 - protein, 17 aa, Mycobacterium bovis
LLVRYGIPAVTDRQRSS

SEQ ID NO: 211263 - protein, 23 aa, Mycobacterium bovis
LLVSARSLLQCAALHDLVDVVLS

SEQ ID NO: 211264 - protein, 19 aa, Mycobacterium bovis
LMAELPAGGVMVVVAASEE

SEQ ID NO: 211265 - protein, 27 aa, Mycobacterium bovis
LMAGMVSGLDRKNCWTIAEHRGDTTPM

SEQ ID NO: 211266 - protein, 23 aa, Mycobacterium bovis
LMDSHPFTWLPLLSRVLGSAQLV

SEQ ID NO: 211267 - protein, 19 aa, Mycobacterium bovis
LMGRLAVVVDFAMEADAQY

SEQ ID NO: 211268 - protein, 22 aa, Mycobacterium bovis
LMPASSAARCAARIVGGPRLYG

SEQ ID NO: 211269 - protein, 18 aa, Mycobacterium bovis
LMPVNSFAGTRGWGYDGV

SEQ ID NO: 211270 - protein, 24 aa, Mycobacterium bovis
LMVEAVAPYVAWMRATAIQAEQAA

SEQ ID NO: 211271 - protein, 24 aa, Mycobacterium bovis
LNAQAAAFHHSFVQTLNAAGGAYS

SEQ ID NO: 211272 - protein, 17 aa, Mycobacterium bovis
LNQMLVWGFTGQVISAV

SEQ ID NO: 211273 - protein, 18 aa, Mycobacterium bovis
LNRLRALTHDDFRNAWFV

SEQ ID NO: 211274 - protein, 22 aa, Mycobacterium bovis
LPAELTPLAAWVACIADARTVT

SEQ ID NO: 211275 - protein, 17 aa, Mycobacterium bovis
LPAWAESSTSHYVQTKD

SEQ ID NO: 211276 - protein, 24 aa, Mycobacterium bovis
LPDDQVCLVVEVFRMLADATRVQV

SEQ ID NO: 211277 - protein, 29 aa, Mycobacterium bovis
LPDGISRLRFRLRWRGFRLIVDANHTDVT

SEQ ID NO: 211278 - protein, 19 aa, Mycobacterium bovis
LPDRLRVHSLARTLGTTSR

SEQ ID NO: 211279 - protein, 25 aa, Mycobacterium bovis
LPEPDLPRWRRAVEVATQRWVASTA

SEQ ID NO: 211280 - protein, 20 aa, Mycobacterium bovis
LPGMVKRGAGAVLNIASIAG

SEQ ID NO: 211281 - protein, 17 aa, Mycobacterium bovis
LPGPLSTVSPWLDQTIR

SEQ ID NO: 211282 - protein, 26 aa, Mycobacterium bovis
LPHPTSRRELLAALTKRGRDVVRQVT

SEQ ID NO: 211283 - protein, 17 aa, Mycobacterium bovis
LPLRIGRSKSNDMVLPD

SEQ ID NO: 211284 - protein, 29 aa, Mycobacterium bovis
LPLRWGEYRAGGLARARWGLLEPPEPWLP

SEQ ID NO: 211285 - protein, 23 aa, Mycobacterium bovis
LPPEINSALMFAGAGPGPMLAAA

SEQ ID NO: 211286 - protein, 17 aa, Mycobacterium bovis
LPQLVVHPYTLTGPIVI

SEQ ID NO: 211287 - protein, 25 aa, Mycobacterium bovis
LPQRCYSGLELRDDRLVLSPQWPEA

SEQ ID NO: 211288 - protein, 17 aa, Mycobacterium bovis
LPRADLLSVDEISLIVD

SEQ ID NO: 211289 - protein, 17 aa, Mycobacterium bovis
LPRELVGEGTLFLLKVI

SEQ ID NO: 211290 - protein, 23 aa, Mycobacterium bovis
LPSTTMGGFAIPAGPGYFNSSAT

SEQ ID NO: 211291 - protein, 21 aa, Mycobacterium bovis
LPVPARRVGRVILVDEPAGQP

SEQ ID NO: 211292 - protein, 17 aa, Mycobacterium bovis
LRAEARAHFGFPDDARV

SEQ ID NO: 211293 - protein, 21 aa, Mycobacterium bovis
LRAELTVACDGRWSIARHEAG

SEQ ID NO: 211294 - protein, 23 aa, Mycobacterium bovis
LRAHVPDAGGMIIASDRTTARAY

SEQ ID NO: 211295 - protein, 18 aa, Mycobacterium bovis
LRDIEWRIGPGERIGIVG

SEQ ID NO: 211296 - protein, 19 aa, Mycobacterium bovis
LRFQPRWKELFPTARQLQV

SEQ ID NO: 211297 - protein, 19 aa, Mycobacterium bovis
LRILLGLVKADGGSVRLLG

SEQ ID NO: 211298 - protein, 18 aa, Mycobacterium bovis
LRLFVYDCAADRAMTARR

SEQ ID NO: 211299 - protein, 23 aa, Mycobacterium bovis
LRLSHPELLYHPTQSWVVDDNFD

SEQ ID NO: 211300 - protein, 20 aa, Mycobacterium bovis
LRLVDLCERLGLAKSTTRRL

SEQ ID NO: 211301 - protein, 19 aa, Mycobacterium bovis
LRMFTGAGSAPMLAASVAW

SEQ ID NO: 211302 - protein, 23 aa, Mycobacterium bovis
LRPSDLARAIAFVAETPRGCVVV

SEQ ID NO: 211303 - protein, 17 aa, Mycobacterium bovis
LRRFQHYLGEPLGGFTG

SEQ ID NO: 211304 - protein, 17 aa, Mycobacterium bovis
LRRGLVWRRRASELRTE

SEQ ID NO: 211305 - protein, 20 aa, Mycobacterium bovis
LRRSGRISGAKAWLGTALAL

SEQ ID NO: 211306 - protein, 17 aa, Mycobacterium bovis
LRSLGATLKVSNAAAAV

SEQ ID NO: 211307 - protein, 21 aa, Mycobacterium bovis
LRSLPGCHLLVRPEVMRRDVD

SEQ ID NO: 211308 - protein, 19 aa, Mycobacterium bovis
LRVDEVLFATGRAPRTDDI

SEQ ID NO: 211309 - protein, 18 aa, Mycobacterium bovis
LSAGYTFMGFAEDLPAVG

SEQ ID NO: 211310 - protein, 23 aa, Mycobacterium bovis
LSERLTALPGWELVDGKLRHTFG

SEQ ID NO: 211311 - protein, 31 aa, Mycobacterium bovis
LSGFERFPAWMWRNTVVRDFVEWLRTRNQRY

SEQ ID NO: 211312 - protein, 21 aa, Mycobacterium bovis
LSPDGRCKAFAAAADGTGFSE

SEQ ID NO: 211313 - protein, 26 aa, Mycobacterium bovis
LSPSLRRPQPLFSLVNFFDAQVGPLS

SEQ ID NO: 211314 - protein, 17 aa, Mycobacterium bovis
LSRRLAHWTRLYPEVRV

SEQ ID NO: 211315 - protein, 26 aa, Mycobacterium bovis
LSSSLWRSSFSWWWKVLVRGWPWTAE

SEQ ID NO: 211316 - protein, 17 aa, Mycobacterium bovis
LSTRLEVEIKRDGYEWS

SEQ ID NO: 211317 - protein, 19 aa, Mycobacterium bovis
LSVEVNGGIGPIVVPDITI

SEQ ID NO: 211318 - protein, 23 aa, Mycobacterium bovis
LSWRRVRTGDLGLAVWGGREEYR

SEQ ID NO: 211319 - protein, 35 aa, Mycobacterium bovis
LTAQTPRQNPMWSAARVVMAARAAAALASAAPAGP

SEQ ID NO: 211320 - protein, 20 aa, Mycobacterium bovis
LTDEARMAPDLRGRISMASM

SEQ ID NO: 211321 - protein, 17 aa, Mycobacterium bovis
LTEYGVRVLGGLSALNS

SEQ ID NO: 211322 - protein, 20 aa, Mycobacterium bovis
LTFLCAWGPAYLPERDQRMG

SEQ ID NO: 211323 - protein, 17 aa, Mycobacterium bovis
LTGDNLVGIGALNSGIG

SEQ ID NO: 211324 - protein, 17 aa, Mycobacterium bovis
LTGGPRGGCACHRCNQR

SEQ ID NO: 211325 - protein, 20 aa, Mycobacterium bovis
LTIRLLGRTEIRRLAKELDF

SEQ ID NO: 211326 - protein, 18 aa, Mycobacterium bovis
LTIVEGFALLSVPSSFVQ

SEQ ID NO: 211327 - protein, 17 aa, Mycobacterium bovis
LTLNFGVANQGGLNAGI

SEQ ID NO: 211328 - protein, 17 aa, Mycobacterium bovis
LTLNLGVGNIGSLNLGS

SEQ ID NO: 211329 - protein, 21 aa, Mycobacterium bovis
LTPLVPMPGRFIYAGIADRLV

SEQ ID NO: 211330 - protein, 17 aa, Mycobacterium bovis
LTRPHWVSDGGLLDNRP

SEQ ID NO: 211331 - protein, 27 aa, Mycobacterium bovis
LTRTLKGWADRGVRVIGLDAGGGTALD

SEQ ID NO: 211332 - protein, 25 aa, Mycobacterium bovis
LTSIALPRIRDFRGLSPKQFDGVGS

SEQ ID NO: 211333 - protein, 19 aa, Mycobacterium bovis
LTSVFRATRAALRYFRDAP

SEQ ID NO: 211334 - protein, 23 aa, Mycobacterium bovis
LTVPEKPRGIVVFAHGSGSSRHS

SEQ ID NO: 211335 - protein, 23 aa, Mycobacterium bovis
LTWLLSRWACVFGTPACQGTVAG

SEQ ID NO: 211336 - protein, 24 aa, Mycobacterium bovis
LVAALQRRGHLAAVDLDRIFDAAR

SEQ ID NO: 211337 - protein, 25 aa, Mycobacterium bovis
LVALAAKLVHDFDIAPGHVFATGMS

SEQ ID NO: 211338 - protein, 25 aa, Mycobacterium bovis
LVALGELFAYRWSRCGGREEWVMDT

SEQ ID NO: 211339 - protein, 17 aa, Mycobacterium bovis
LVAVRMVSEGVDVPRLS

SEQ ID NO: 211340 - protein, 24 aa, Mycobacterium bovis
LVAVRRAGGVVIPQVFFTNSGQVV

SEQ ID NO: 211341 - protein, 19 aa, Mycobacterium bovis
LVGGSWQGRSSVAMAAAAA

SEQ ID NO: 211342 - protein, 25 aa, Mycobacterium bovis
LVGMSVDCARYWLDADKPISKSDAV

SEQ ID NO: 211343 - protein, 22 aa, Mycobacterium bovis
LVHHPCVGDLGWIADAPKAPLG

SEQ ID NO: 211344 - protein, 21 aa, Mycobacterium bovis
LVKTFWGWRDQQLPDGTLILT

SEQ ID NO: 211345 - protein, 20 aa, Mycobacterium bovis
LVLDAGCDWQRARGQLLALP

SEQ ID NO: 211346 - protein, 19 aa, Mycobacterium bovis
LVLGDWKQFLIVDRVGSMV

SEQ ID NO: 211347 - protein, 35 aa, Mycobacterium bovis
LVNTTEPVVFISLNGGQMVPVLLDTGSTGLVMDSQ

SEQ ID NO: 211348 - protein, 23 aa, Mycobacterium bovis
LVRDGRACLVEAHLQRLTQSARL

SEQ ID NO: 211349 - protein, 19 aa, Mycobacterium bovis
LWAQAGFRPVDPAVAADFA

SEQ ID NO: 211350 - protein, 19 aa, Mycobacterium bovis
LYMDLRLAVPGEVVLPTAG

SEQ ID NO: 211351 - protein, 19 aa, Mycobacterium bovis
LYRNEERNFWAVSRHHDVL

SEQ ID NO: 211352 - protein, 17 aa, Mycobacterium bovis
LYVGPTINRTARLRDLA

SEQ ID NO: 211353 - protein, 23 aa, Mycobacterium bovis
MAAAVAPYLGWLAAAAAQAQRSA

SEQ ID NO: 211354 - protein, 17 aa, Mycobacterium bovis
MAPTHRSPAVMAVTAVP

SEQ ID NO: 211355 - protein, 17 aa, Mycobacterium bovis
MFFGAGSGPMLAAAAAW

SEQ ID NO: 211356 - protein, 18 aa, Mycobacterium bovis
MFFGAGSGPMLAAAAAWD

SEQ ID NO: 211357 - protein, 20 aa, Mycobacterium bovis
MGALHSWCLAAERPELVSAL

SEQ ID NO: 211358 - protein, 20 aa, Mycobacterium bovis
MGCSICWHGPAGTPTMSVTI

SEQ ID NO: 211359 - protein, 19 aa, Mycobacterium bovis
MGGRMSVVVAGRLPDRVAA

SEQ ID NO: 211360 - protein, 18 aa, Mycobacterium bovis
MGRPEYPTPVGSYTVLSK

SEQ ID NO: 211361 - protein, 17 aa, Mycobacterium bovis
MGTWKFFRASVDGRPVF

SEQ ID NO: 211362 - protein, 20 aa, Mycobacterium bovis
MGWAGIKVGVDYEGDHHRTD

SEQ ID NO: 211363 - protein, 26 aa, Mycobacterium bovis
MHAVRAWRSADDFPCTEHMAYKIAQV

SEQ ID NO: 211364 - protein, 23 aa, Mycobacterium bovis
MIEMLRGGPDYLMFLYKTKGPVV

SEQ ID NO: 211365 - protein, 21 aa, Mycobacterium bovis
MKVGLRRGKIIVVRPEHDHGL

SEQ ID NO: 211366 - protein, 24 aa, Mycobacterium bovis
MLAMSAPYVEWLERTAAQTKQTAT

SEQ ID NO: 211367 - protein, 21 aa, Mycobacterium bovis
MLREYLEAMRALWTQEEACYD

SEQ ID NO: 211368 - protein, 22 aa, Mycobacterium bovis
MLRGRRALDVAGNGRYARQLVE

SEQ ID NO: 211369 - protein, 19 aa, Mycobacterium bovis
MPLQEVVRIAADEAGVPPP

SEQ ID NO: 211370 - protein, 18 aa, Mycobacterium bovis
MPRKPGGDLARLPSRVWR

SEQ ID NO: 211371 - protein, 17 aa, Mycobacterium bovis
MQVCGGPGDSGAPVTVD

SEQ ID NO: 211372 - protein, 25 aa, Mycobacterium bovis
MRANLERWAPLLPEGATLVSLAKGI

SEQ ID NO: 211373 - protein, 19 aa, Mycobacterium bovis
MRRGELVIVFPGGAREVNK

SEQ ID NO: 211374 - protein, 26 aa, Mycobacterium bovis
MRRTNACDRRRFGLSLTIHEDACRII

SEQ ID NO: 211375 - protein, 21 aa, Mycobacterium bovis
MRVPLEGGGRLVVELTPDEAA

SEQ ID NO: 211376 - protein, 17 aa, Mycobacterium bovis
MSALSRMSRGEHRSITL

SEQ ID NO: 211377 - protein, 17 aa, Mycobacterium bovis
MSVPPSWATPSSTPVSA

SEQ ID NO: 211378 - protein, 25 aa, Mycobacterium bovis
MSVPPTWQGSIPISMASSAMSGLGV

SEQ ID NO: 211379 - protein, 17 aa, Mycobacterium bovis
MTCFLTPNGRPFFCGTY

SEQ ID NO: 211380 - protein, 17 aa, Mycobacterium bovis
MTIPWQIAQKLHAVTAV

SEQ ID NO: 211381 - protein, 18 aa, Mycobacterium bovis
MTKGRPGLGRSIRSWRVP

SEQ ID NO: 211382 - protein, 17 aa, Mycobacterium bovis
MTLDVDRDCFARIAPGL

SEQ ID NO: 211383 - protein, 19 aa, Mycobacterium bovis
MVAAASAWNGLAAELSVAA

SEQ ID NO: 211384 - protein, 19 aa, Mycobacterium bovis
MVAATMWDRYRQAVAGRIA

SEQ ID NO: 211385 - protein, 29 aa, Mycobacterium bovis
MVGRPADGPPAWLRFFGCNPRHHSLAFLP

SEQ ID NO: 211386 - protein, 23 aa, Mycobacterium bovis
MVSGLDRKNCWTIAEHRGDTTPM

SEQ ID NO: 211387 - protein, 25 aa, Mycobacterium bovis
MYEQMWAADVAAMVGYHGGASAAAA

SEQ ID NO: 211388 - protein, 18 aa, Mycobacterium bovis
MYVGLLLILRRPRAGLSY

SEQ ID NO: 211389 - protein, 20 aa, Mycobacterium bovis
NAGDYGFFWITAVTTDGSIV

SEQ ID NO: 211390 - protein, 24 aa, Mycobacterium bovis
NAHLRAAHHLSLCAQCAAEVDDQS

SEQ ID NO: 211391 - protein, 23 aa, Mycobacterium bovis
NANLGGGNWGFANLGSGNIGNTN

SEQ ID NO: 211392 - protein, 26 aa, Mycobacterium bovis
NAPVQEWQLADGDVIRLGHSEIIVRM

SEQ ID NO: 211393 - protein, 24 aa, Mycobacterium bovis
NELPFNVAGIFTGYIGPIPLSTFV

SEQ ID NO: 211394 - protein, 25 aa, Mycobacterium bovis
NELREMLPHNAVEYFVSYYDYYQPE

SEQ ID NO: 211395 - protein, 18 aa, Mycobacterium bovis
NEWVRLSVRHVLDAGEAL

SEQ ID NO: 211396 - protein, 24 aa, Mycobacterium bovis
NFGAMLRAECARLNRAGLTTCSEM

SEQ ID NO: 211397 - protein, 20 aa, Mycobacterium bovis
NFGDCLSYALAIDRREPLLW

SEQ ID NO: 211398 - protein, 24 aa, Mycobacterium bovis
NGERTGNVCLVTLGLNLFSRGVDP

SEQ ID NO: 211399 - protein, 25 aa, Mycobacterium bovis
NGGAGGAGGWLFGNGGAGGVGGAGG

SEQ ID NO: 211400 - protein, 26 aa, Mycobacterium bovis
NGGAGGFASTGLGGPGGAGGPGGAGD

SEQ ID NO: 211401 - protein, 20 aa, Mycobacterium bovis
NGGAGGLLFGDGGNGGAGGA

SEQ ID NO: 211402 - protein, 25 aa, Mycobacterium bovis
NGGHGGSAAKLFGDGGAGGAGGMGS

SEQ ID NO: 211403 - protein, 18 aa, Mycobacterium bovis
NGGTGGNGLLFGAGGTGG

SEQ ID NO: 211404 - protein, 27 aa, Mycobacterium bovis
NGGVGGRGGDGVFAGAGGQGGLGGQGG

SEQ ID NO: 211405 - protein, 21 aa, Mycobacterium bovis
NGVARVIAYRWLRVGRLPVPA

SEQ ID NO: 211406 - protein, 20 aa, Mycobacterium bovis
NGVDGFDINETTGRDGDGGD

SEQ ID NO: 211407 - protein, 21 aa, Mycobacterium bovis
NKLAAPVGVRSDCLGVDAPLP

SEQ ID NO: 211408 - protein, 22 aa, Mycobacterium bovis
NLAQDRIRTWSDWFDNNTRSAR

SEQ ID NO: 211409 - protein, 19 aa, Mycobacterium bovis
NLHLAQCNWLVPSDQLGGL

SEQ ID NO: 211410 - protein, 22 aa, Mycobacterium bovis
NLRIARVLYDFVNNEALPGTDI

SEQ ID NO: 211411 - protein, 17 aa, Mycobacterium bovis
NNIGFGLTGDNLVGIGA

SEQ ID NO: 211412 - protein, 20 aa, Mycobacterium bovis
NNNIGFGLTGDNLVGIGALN

SEQ ID NO: 211413 - protein, 23 aa, Mycobacterium bovis
NPIARLVWRLCKIDGKPSRYRSE

SEQ ID NO: 211414 - protein, 25 aa, Mycobacterium bovis
NQDWWPNRLNLKVLHQNPAVADPMG

SEQ ID NO: 211415 - protein, 20 aa, Mycobacterium bovis
NRAPLPVLLPSMRRGGVAAV

SEQ ID NO: 211416 - protein, 30 aa, Mycobacterium bovis
NRLRLALDSDLCAAVTGMPGPLAHPGLVCD

SEQ ID NO: 211417 - protein, 21 aa, Mycobacterium bovis
NRPTGAFMFLGPTGVGKTELA

SEQ ID NO: 211418 - protein, 19 aa, Mycobacterium bovis
NRQEIKQALLALQRVSERD

SEQ ID NO: 211419 - protein, 17 aa, Mycobacterium bovis
NRSALDVMLDWDPTTAY

SEQ ID NO: 211420 - protein, 29 aa, Mycobacterium bovis
NSAIVRPLLRFFFKSWFRVEVSGVENIPR

SEQ ID NO: 211421 - protein, 24 aa, Mycobacterium bovis
NTGFGNAGFFNMGIGNAGNEDMGV

SEQ ID NO: 211422 - protein, 23 aa, Mycobacterium bovis
NTIIDKWLPLSWSLNMVNRSMGH

SEQ ID NO: 211423 - protein, 25 aa, Mycobacterium bovis
NTPVVWRGPMLHRALQQFLADVYWG

SEQ ID NO: 211424 - protein, 23 aa, Mycobacterium bovis
NVEQNLLNLINAPTQTLLGRPLI

SEQ ID NO: 211425 - protein, 24 aa, Mycobacterium bovis
NVPRLVPGWTKPIVIGRHAFGDQY

SEQ ID NO: 211426 - protein, 17 aa, Mycobacterium bovis
NWQRIRHRWNWTDVRRW

SEQ ID NO: 211427 - protein, 25 aa, Mycobacterium bovis
NYDDFFKRCFNIMPADGRMTVQSSV

SEQ ID NO: 211428 - protein, 18 aa, Mycobacterium bovis
NYGSLNWGSGNTGTGNAG

SEQ ID NO: 211429 - protein, 26 aa, Mycobacterium bovis
NYGSVIARLTGMHWWGPASTSMLAMS

SEQ ID NO: 211430 - protein, 19 aa, Mycobacterium bovis
PAAGPAWFDIAGVRMAPAE

SEQ ID NO: 211431 - protein, 19 aa, Mycobacterium bovis
PAALRAAQMLAAEWDVAAD

SEQ ID NO: 211432 - protein, 18 aa, Mycobacterium bovis
PAALRLLATDAIVVLVSA

SEQ ID NO: 211433 - protein, 26 aa, Mycobacterium bovis
PAASAPLRLAASAAVTAGTAGAEVTA

SEQ ID NO: 211434 - protein, 19 aa, Mycobacterium bovis
PAEALAWMCDRAVDLLLLE

SEQ ID NO: 211435 - protein, 20 aa, Mycobacterium bovis
PAEPILRPGARGMFDDCGVS

SEQ ID NO: 211436 - protein, 20 aa, Mycobacterium bovis
PAGLFSIPNPFAVTYYLIKG

SEQ ID NO: 211437 - protein, 18 aa, Mycobacterium bovis
PAGMAAPALPVGLAVTAA

SEQ ID NO: 211438 - protein, 19 aa, Mycobacterium bovis
PAHRAGAAYAELALLRGDP

SEQ ID NO: 211439 - protein, 20 aa, Mycobacterium bovis
PAKLAGWWAEQFDGTTRELL

SEQ ID NO: 211440 - protein, 26 aa, Mycobacterium bovis
PAKLWTIADLGGWGSVDPQLFDKATG

SEQ ID NO: 211441 - protein, 17 aa, Mycobacterium bovis
PALDLYGLLSPRADRHL

SEQ ID NO: 211442 - protein, 24 aa, Mycobacterium bovis
PAPLPCTPRGIVHLLRRYDISIAG

SEQ ID NO: 211443 - protein, 23 aa, Mycobacterium bovis
PAPPRLRSPLVLLDGASMWFRSF

SEQ ID NO: 211444 - protein, 23 aa, Mycobacterium bovis
PAQQQCTDWAKALFRAVGPQRTP

SEQ ID NO: 211445 - protein, 25 aa, Mycobacterium bovis
PARKRRMFDLLVRMGYKEIEVGFPS

SEQ ID NO: 211446 - protein, 24 aa, Mycobacterium bovis
PATVRYLREFRFRGDIDGYAEGEL

SEQ ID NO: 211447 - protein, 31 aa, Mycobacterium bovis
PAVPNYRGSCWIPFSIELEGDAASFVGEIGK

SEQ ID NO: 211448 - protein, 17 aa, Mycobacterium bovis
PAVSFLLISSGSAEVSH

SEQ ID NO: 211449 - protein, 17 aa, Mycobacterium bovis
PDARVVILFSDIEESTA

SEQ ID NO: 211450 - protein, 26 aa, Mycobacterium bovis
PDGVLRARKLPDWPTGPLPKVRVAAA

SEQ ID NO: 211451 - protein, 19 aa, Mycobacterium bovis
PDLPGPLSTVSPWLDQTIR

SEQ ID NO: 211452 - protein, 17 aa, Mycobacterium bovis
PDPRTAPLVKQAYADIL

SEQ ID NO: 211453 - protein, 23 aa, Mycobacterium bovis
PDSLHWDCFSFGVIQRADSFTFY

SEQ ID NO: 211454 - protein, 26 aa, Mycobacterium bovis
PDTCIECPQGSVGEIWVQGGNVASGY

SEQ ID NO: 211455 - protein, 20 aa, Mycobacterium bovis
PDTWVLWNLTGGPRGGCACH

SEQ ID NO: 211456 - protein, 17 aa, Mycobacterium bovis
PDVFYWAHATFFVGTLH

SEQ ID NO: 211457 - protein, 27 aa, Mycobacterium bovis
PDVMGGMPCIRGLRIPVATVVAMVADQ

SEQ ID NO: 211458 - protein, 21 aa, Mycobacterium bovis
PEINSALMFAGAGPGPMLAAA

SEQ ID NO: 211459 - protein, 20 aa, Mycobacterium bovis
PELLACLQRLEVERRRQGAA

SEQ ID NO: 211460 - protein, 35 aa, Mycobacterium bovis
PEMRRDGWVRLHWEFACLRYGAAGVRTCEQRPVRV

SEQ ID NO: 211461 - protein, 20 aa, Mycobacterium bovis
PEPHPVLPTTPWQHTQHWIT

SEQ ID NO: 211462 - protein, 24 aa, Mycobacterium bovis
PEQNAWWWDVLKFGRSSAYAEFFD

SEQ ID NO: 211463 - protein, 20 aa, Mycobacterium bovis
PETIAYGLIPRAHRGIVAVN

SEQ ID NO: 211464 - protein, 18 aa, Mycobacterium bovis
PFAARWPVEVHIYPNRLV

SEQ ID NO: 211465 - protein, 20 aa, Mycobacterium bovis
PGAAGGDAGLLFGSGGAGGA

SEQ ID NO: 211466 - protein, 21 aa, Mycobacterium bovis
PGAIRRRLAAELGLTPDRVDL

SEQ ID NO: 211467 - protein, 17 aa, Mycobacterium bovis
PGASVCTSIGSAARPRA

SEQ ID NO: 211468 - protein, 25 aa, Mycobacterium bovis
PGGAGDFASGVGGVGGAGGDGGAGG

SEQ ID NO: 211469 - protein, 17 aa, Mycobacterium bovis
PGHPVHIYLQFDGLDEA

SEQ ID NO: 211470 - protein, 18 aa, Mycobacterium bovis
PGMHALRASTIVAALQYM

SEQ ID NO: 211471 - protein, 25 aa, Mycobacterium bovis
PGPWKESLRLLAHEVMPRLNARLAT

SEQ ID NO: 211472 - protein, 22 aa, Mycobacterium bovis
PGQAGGPGGLLYGNGGNGAAGG

SEQ ID NO: 211473 - protein, 30 aa, Mycobacterium bovis
PGSGAPGGHGGWLFGGGGTGGSGVSGGAGG

SEQ ID NO: 211474 - protein, 22 aa, Mycobacterium bovis
PGSLAAKWLVTRVPVAGLAEKC

SEQ ID NO: 211475 - protein, 19 aa, Mycobacterium bovis
PHALKGRFSGVAMAAVDDD

SEQ ID NO: 211476 - protein, 23 aa, Mycobacterium bovis
PHGSRPGIDLVVAAEAGMTTGMP

SEQ ID NO: 211477 - protein, 19 aa, Mycobacterium bovis
PHKAEAPSGTAARTAKLIA

SEQ ID NO: 211478 - protein, 18 aa, Mycobacterium bovis
PHLVPVVFALGARRPAEA

SEQ ID NO: 211479 - protein, 18 aa, Mycobacterium bovis
PHRSAVLTASLTSPRGKR

SEQ ID NO: 211480 - protein, 19 aa, Mycobacterium bovis
PILDDAAAWFIGRTASRSD

SEQ ID NO: 211481 - protein, 18 aa, Mycobacterium bovis
PIRLRTVAATVFTRPEIA

SEQ ID NO: 211482 - protein, 23 aa, Mycobacterium bovis
PIRRYDVDAAILFSDIVVPLRAA

SEQ ID NO: 211483 - protein, 17 aa, Mycobacterium bovis
PKLACATFLADYLPGPV

SEQ ID NO: 211484 - protein, 21 aa, Mycobacterium bovis
PKPQNYPGLPTVSFVIPNADN

SEQ ID NO: 211485 - protein, 21 aa, Mycobacterium bovis
PKTDVAVCWNVAATGAAQLVG

SEQ ID NO: 211486 - protein, 18 aa, Mycobacterium bovis
PKVAVALKDPSYRLKTTT

SEQ ID NO: 211487 - protein, 19 aa, Mycobacterium bovis
PLAPHGLPGHLVGFVEALR

SEQ ID NO: 211488 - protein, 23 aa, Mycobacterium bovis
PLMRGYLRLGARACGEPAHDPDF

SEQ ID NO: 211489 - protein, 24 aa, Mycobacterium bovis
PLPGPRLLHDMAFTENYVILNDFP

SEQ ID NO: 211490 - protein, 20 aa, Mycobacterium bovis
PLRFQPRWKELFPTARQLQV

SEQ ID NO: 211491 - protein, 21 aa, Mycobacterium bovis
PLRGLPRPEWVMQLCHPDIRE

SEQ ID NO: 211492 - protein, 17 aa, Mycobacterium bovis
PLRLGLGGGGTDVEPYS

SEQ ID NO: 211493 - protein, 17 aa, Mycobacterium bovis
PLSGLRVVELAGIGPGP

SEQ ID NO: 211494 - protein, 19 aa, Mycobacterium bovis
PMDCHLMIDNPDRWAPPYA

SEQ ID NO: 211495 - protein, 21 aa, Mycobacterium bovis
PMGCSICWHGPAGTPTMSVTI

SEQ ID NO: 211496 - protein, 19 aa, Mycobacterium bovis
PNCNGRIPADTALLPEVLA

SEQ ID NO: 211497 - protein, 20 aa, Mycobacterium bovis
PNDYGLKIERAIDAYLETWP

SEQ ID NO: 211498 - protein, 28 aa, Mycobacterium bovis
PNRRPTGQRGFFAWFRVGSDVLVRNAFR

SEQ ID NO: 211499 - protein, 17 aa, Mycobacterium bovis
PPAPSRPSASPAEPPTR

SEQ ID NO: 211500 - protein, 25 aa, Mycobacterium bovis
PPARYFGPNLSRLSAVRQKYDPSRV

SEQ ID NO: 211501 - protein, 18 aa, Mycobacterium bovis
PPATVVFARRGKQIARGS

SEQ ID NO: 211502 - protein, 18 aa, Mycobacterium bovis
PPDKIWTLIADVRNTGRF

SEQ ID NO: 211503 - protein, 22 aa, Mycobacterium bovis
PPELETRIAILRKKAQMERLAI

SEQ ID NO: 211504 - protein, 25 aa, Mycobacterium bovis
PPPHLDHGQPWTCEIHYTCACCCLP

SEQ ID NO: 211505 - protein, 19 aa, Mycobacterium bovis
PPPYEQRPPVSPGPAAGYG

SEQ ID NO: 211506 - protein, 20 aa, Mycobacterium bovis
PPPYEQRPPVSPGPAAGYGA

SEQ ID NO: 211507 - protein, 18 aa, Mycobacterium bovis
PPQTFKIENPLAVVATST

SEQ ID NO: 211508 - protein, 24 aa, Mycobacterium bovis
PPRWLPGPRELRAWTLAAGSPEAD

SEQ ID NO: 211509 - protein, 21 aa, Mycobacterium bovis
PPTGPHWRLLSAVKELDPSWA

SEQ ID NO: 211510 - protein, 23 aa, Mycobacterium bovis
PPVRELMGYRWLRRDEWLHRRFG

SEQ ID NO: 211511 - protein, 20 aa, Mycobacterium bovis
PPVVTEATAGPAAPAASAPL

SEQ ID NO: 211512 - protein, 17 aa, Mycobacterium bovis
PPWDPGTAIIAVSDIEA

SEQ ID NO: 211513 - protein, 18 aa, Mycobacterium bovis
PPYEQRPPVSPGPAAGYG

SEQ ID NO: 211514 - protein, 21 aa, Mycobacterium bovis
PPYQGTVRMAFLLQGDHDAYF

SEQ ID NO: 211515 - protein, 18 aa, Mycobacterium bovis
PQPAIPNMPLDLGASQSE

SEQ ID NO: 211516 - protein, 17 aa, Mycobacterium bovis
PQVAALFLAGHLGARLF

SEQ ID NO: 211517 - protein, 24 aa, Mycobacterium bovis
PQVARTARPASAPPAVTEATAGTA

SEQ ID NO: 211518 - protein, 20 aa, Mycobacterium bovis
PRAACRLAPARPFEYPGRRD

SEQ ID NO: 211519 - protein, 19 aa, Mycobacterium bovis
PRARAGWDRATGRIPADAP

SEQ ID NO: 211520 - protein, 18 aa, Mycobacterium bovis
PRECDAVLYTRAGPEIGV

SEQ ID NO: 211521 - protein, 19 aa, Mycobacterium bovis
PRGKTVWFTGLSGSGKSSV

SEQ ID NO: 211522 - protein, 20 aa, Mycobacterium bovis
PRGPAVWYQRGRSGAPPVGG

SEQ ID NO: 211523 - protein, 20 aa, Mycobacterium bovis
PRKLLARFFVWLTVGLYDPP

SEQ ID NO: 211524 - protein, 20 aa, Mycobacterium bovis
PRLRGWGESMSRQAGGRAGG

SEQ ID NO: 211525 - protein, 20 aa, Mycobacterium bovis
PRNLGAIMRSVAAFGGHGVL

SEQ ID NO: 211526 - protein, 21 aa, Mycobacterium bovis
PRPARPELVVLCDVSGSVAGF

SEQ ID NO: 211527 - protein, 22 aa, Mycobacterium bovis
PRQRGIPFIFVRTDKAGNISKR

SEQ ID NO: 211528 - protein, 18 aa, Mycobacterium bovis
PRQVLGHRSPAELFTALL

SEQ ID NO: 211529 - protein, 22 aa, Mycobacterium bovis
PRRHPGRRSPLWQQRQRAARLM

SEQ ID NO: 211530 - protein, 21 aa, Mycobacterium bovis
PRVAHCIYAGLATDTGSFRWA

SEQ ID NO: 211531 - protein, 20 aa, Mycobacterium bovis
PRVAWERELLPGAQVVIAPT

SEQ ID NO: 211532 - protein, 24 aa, Mycobacterium bovis
PRVVLAAAPPGYRLSIPDNTCDLG

SEQ ID NO: 211533 - protein, 21 aa, Mycobacterium bovis
PRYAELIKRTQWWGRQMLIWG

SEQ ID NO: 211534 - protein, 21 aa, Mycobacterium bovis
PSGGFVPAGTTISVYTSDGQT

SEQ ID NO: 211535 - protein, 17 aa, Mycobacterium bovis
PSIGWRTSTRLPRDHYV

SEQ ID NO: 211536 - protein, 28 aa, Mycobacterium bovis
PSKSGLTWTQRLVSLLVFDGPDLPGPLS

SEQ ID NO: 211537 - protein, 17 aa, Mycobacterium bovis
PSRVWRAVREARDVLDD

SEQ ID NO: 211538 - protein, 22 aa, Mycobacterium bovis
PSSKLGGLWKTVSPHLSPISNI

SEQ ID NO: 211539 - protein, 34 aa, Mycobacterium bovis
PTASVWCFATASAREWWGLVWADRILQSDLAHQL

SEQ ID NO: 211540 - protein, 27 aa, Mycobacterium bovis
PTKGIFTSSFGYRWGVLHAGIDLANAI

SEQ ID NO: 211541 - protein, 17 aa, Mycobacterium bovis
PTPAPGWTIAHQIGHLL

SEQ ID NO: 211542 - protein, 23 aa, Mycobacterium bovis
PTQLRFDRWFLPLAVPLGLGPKN

SEQ ID NO: 211543 - protein, 20 aa, Mycobacterium bovis
PTSRGFERFYGFLGGETDQW

SEQ ID NO: 211544 - protein, 19 aa, Mycobacterium bovis
PTTELLAAGADEVSAAIAS

SEQ ID NO: 211545 - protein, 17 aa, Mycobacterium bovis
PVCDLGRQIGYLLASQE

SEQ ID NO: 211546 - protein, 29 aa, Mycobacterium bovis
PVDVDGFVFPTCRWVHPIGPGNRSLPFPT

SEQ ID NO: 211547 - protein, 20 aa, Mycobacterium bovis
PVIDCARPQSNHAFGAEPGV

SEQ ID NO: 211548 - protein, 23 aa, Mycobacterium bovis
PVLECLRAGVPATALYVALGTEA

SEQ ID NO: 211549 - protein, 19 aa, Mycobacterium bovis
PVLGSEVLAAKAIPERAMR

SEQ ID NO: 211550 - protein, 20 aa, Mycobacterium bovis
PVLPAGRLVNFGTVHRVPAG

SEQ ID NO: 211551 - protein, 21 aa, Mycobacterium bovis
PVLVAFCARSPHGVSAGGSRL

SEQ ID NO: 211552 - protein, 18 aa, Mycobacterium bovis
PWRSTSRQSDWGSIEAPV

SEQ ID NO: 211553 - protein, 17 aa, Mycobacterium bovis
PYLPPYYHPGLNAPEIR

SEQ ID NO: 211554 - protein, 25 aa, Mycobacterium bovis
PYYQRFGFRVTREIALPDAGPPLWA

SEQ ID NO: 211555 - protein, 18 aa, Mycobacterium bovis
PYYRRLRDEAPLYRNEER

SEQ ID NO: 211556 - protein, 40 aa, Mycobacterium bovis
QAAAAQVAAFHSRFVQALTAGAGAYAFAEAANASPLQSAM

SEQ ID NO: 211557 - protein, 25 aa, Mycobacterium bovis
QAGQPNSGTEPGFGGDGGLGGAGAT

SEQ ID NO: 211558 - protein, 17 aa, Mycobacterium bovis
QAGRWSPTALRILGAAA

SEQ ID NO: 211559 - protein, 24 aa, Mycobacterium bovis
QANGFDVGRRLGIGSRETYIPALK

SEQ ID NO: 211560 - protein, 21 aa, Mycobacterium bovis
QARLTEVGLWDAVKDRLSDSP

SEQ ID NO: 211561 - protein, 24 aa, Mycobacterium bovis
QDEVSTAIAALFGSHGQHYQAISA

SEQ ID NO: 211562 - protein, 35 aa, Mycobacterium bovis
QELESFFRGAGWNVIKVVWGREWDALLHADRDRAL

SEQ ID NO: 211563 - protein, 26 aa, Mycobacterium bovis
QFSMCINCMLCYSACPVYALDPDFLG

SEQ ID NO: 211564 - protein, 25 aa, Mycobacterium bovis
QGDLWAAPSGWRGGGHMAPVRTAMR

SEQ ID NO: 211565 - protein, 25 aa, Mycobacterium bovis
QGGIGGAGERGADGAGPNANGANGE

SEQ ID NO: 211566 - protein, 25 aa, Mycobacterium bovis
QHPDFLRLFYLLSMERSQDPVVAAV

SEQ ID NO: 211567 - protein, 25 aa, Mycobacterium bovis
QIERYRAATLMARVRAAKGMKVAQP

SEQ ID NO: 211568 - protein, 20 aa, Mycobacterium bovis
QIGCSLRLFVYDCAADRAMT

SEQ ID NO: 211569 - protein, 17 aa, Mycobacterium bovis
QKAMAFAAANNLKVAPR

SEQ ID NO: 211570 - protein, 18 aa, Mycobacterium bovis
QKSHCPISPATYVARRRI

SEQ ID NO: 211571 - protein, 18 aa, Mycobacterium bovis
QLAPLVFEGTSFGGALMT

SEQ ID NO: 211572 - protein, 18 aa, Mycobacterium bovis
QLARASVMALSYVAQSAR

SEQ ID NO: 211573 - protein, 23 aa, Mycobacterium bovis
QLEHWGCPWSRKPDGRVAVRPFG

SEQ ID NO: 211574 - protein, 19 aa, Mycobacterium bovis
QLMIACNLGAEPTCVPVSG

SEQ ID NO: 211575 - protein, 23 aa, Mycobacterium bovis
QLPDPRLGLICNRALRRTLVLRR

SEQ ID NO: 211576 - protein, 18 aa, Mycobacterium bovis
QLRDELYVGPTINRTARL

SEQ ID NO: 211577 - protein, 25 aa, Mycobacterium bovis
QLRSRSWWSGFDVVLLVDDWHMIVG

SEQ ID NO: 211578 - protein, 18 aa, Mycobacterium bovis
QLVGSMSVPPTWQGSIPI

SEQ ID NO: 211579 - protein, 25 aa, Mycobacterium bovis
QLVSTAAADAARIGSAINTANTAAA

SEQ ID NO: 211580 - protein, 20 aa, Mycobacterium bovis
QNAPAIAAAEAMYEQMWAAD

SEQ ID NO: 211581 - protein, 22 aa, Mycobacterium bovis
QPLDWFCLFSSAAALTGSPGQS

SEQ ID NO: 211582 - protein, 23 aa, Mycobacterium bovis
QPPELETRIAILRKKAQMERLAV

SEQ ID NO: 211583 - protein, 23 aa, Mycobacterium bovis
QQGFCGTCKVRVLAGQVDRRGRI

SEQ ID NO: 211584 - protein, 20 aa, Mycobacterium bovis
QQPKRPALRPTKAAATTAAT

SEQ ID NO: 211585 - protein, 22 aa, Mycobacterium bovis
QQQRLCIARAIAVQPDVLLMDE

SEQ ID NO: 211586 - protein, 18 aa, Mycobacterium bovis
QRAAGEMRSRLRALDAAA

SEQ ID NO: 211587 - protein, 27 aa, Mycobacterium bovis
QRAKNMFALGLLSWMYGRELEHSEAFI

SEQ ID NO: 211588 - protein, 20 aa, Mycobacterium bovis
QRASSMPVNRYRPFAEEVEP

SEQ ID NO: 211589 - protein, 18 aa, Mycobacterium bovis
QRGLRPIQIWVPDVNAPE

SEQ ID NO: 211590 - protein, 18 aa, Mycobacterium bovis
QRPARWMHLMASDFHAFS

SEQ ID NO: 211591 - protein, 19 aa, Mycobacterium bovis
QRRSASVTAVAWRTSAGAA

SEQ ID NO: 211592 - protein, 26 aa, Mycobacterium bovis
QRTSLAPIRLRIGLHTGEVQLRDELY

SEQ ID NO: 211593 - protein, 26 aa, Mycobacterium bovis
QSGRFEFRAGPIFTNLLLADEINRTP

SEQ ID NO: 211594 - protein, 20 aa, Mycobacterium bovis
QSLTGRPLIGDGANGIDGTG

SEQ ID NO: 211595 - protein, 22 aa, Mycobacterium bovis
QSTSWAQRWLAATGSRDYLGAF

SEQ ID NO: 211596 - protein, 17 aa, Mycobacterium bovis
QSVRLGRGRGFYDRSLR

SEQ ID NO: 211597 - protein, 18 aa, Mycobacterium bovis
QTAAGLWLEACAAKQFCT

SEQ ID NO: 211598 - protein, 18 aa, Mycobacterium bovis
QTDGFLRGHGGDGGNAVG

SEQ ID NO: 211599 - protein, 23 aa, Mycobacterium bovis
QTGMGRTGAFFAHQHDGITPDVV

SEQ ID NO: 211600 - protein, 21 aa, Mycobacterium bovis
QTVGDAFARIFGGSIVPQEVE

SEQ ID NO: 211601 - protein, 27 aa, Mycobacterium bovis
QVAAYQERFVLALSQAGSTYAVAEAAS

SEQ ID NO: 211602 - protein, 23 aa, Mycobacterium bovis
QVEKEAFALLALQHPVAGELREI

SEQ ID NO: 211603 - protein, 17 aa, Mycobacterium bovis
QYQAWKHTQLIIDVVPG

SEQ ID NO: 211604 - protein, 19 aa, Mycobacterium bovis
RAAGIARRTLFRYYASKNA

SEQ ID NO: 211605 - protein, 20 aa, Mycobacterium bovis
RAAGIARRTLFRYYASKNAI

SEQ ID NO: 211606 - protein, 21 aa, Mycobacterium bovis
RAAGIARRTLFRYYASKNAIP

SEQ ID NO: 211607 - protein, 19 aa, Mycobacterium bovis
RAEGRDAGWCPCTCPGGDP

SEQ ID NO: 211608 - protein, 20 aa, Mycobacterium bovis
RAGGQVWLMPHNPAFDPIPG

SEQ ID NO: 211609 - protein, 17 aa, Mycobacterium bovis
RAHGIAFETSWLDPFTE

SEQ ID NO: 211610 - protein, 25 aa, Mycobacterium bovis
RALESRPGVVLHPGQAVCHFGVSTG

SEQ ID NO: 211611 - protein, 41 aa, Mycobacterium bovis
RALLEHVWALMGMPCGKYLVVMLELWLPLVAAAGDLDKPFA

SEQ ID NO: 211612 - protein, 19 aa, Mycobacterium bovis
RALLSAYCETWSVYVAAVQ

SEQ ID NO: 211613 - protein, 18 aa, Mycobacterium bovis
RALSLPSLPCEVAVNEPE

SEQ ID NO: 211614 - protein, 20 aa, Mycobacterium bovis
RANCPVDVGKPCPFLIAEGV

SEQ ID NO: 211615 - protein, 17 aa, Mycobacterium bovis
RAQAIAGLRALAAGQHA

SEQ ID NO: 211616 - protein, 17 aa, Mycobacterium bovis
RARFKKVADVLGIEQTI

SEQ ID NO: 211617 - protein, 24 aa, Mycobacterium bovis
RASDAAACALDLQRTSLAPIRLRI

SEQ ID NO: 211618 - protein, 21 aa, Mycobacterium bovis
RASVMALSYVAQSARGIYQPA

SEQ ID NO: 211619 - protein, 18 aa, Mycobacterium bovis
RATDTVAGISGRVQLTHG

SEQ ID NO: 211620 - protein, 25 aa, Mycobacterium bovis
RCATYPVLAVQAWAAFHDMTLRAVI

SEQ ID NO: 211621 - protein, 19 aa, Mycobacterium bovis
RDGCPSDCGLCPDHKQHAC

SEQ ID NO: 211622 - protein, 19 aa, Mycobacterium bovis
RDGRGCVIVEDMAIASKSA

SEQ ID NO: 211623 - protein, 19 aa, Mycobacterium bovis
RDPDTMIPDVRYTPNPNDA

SEQ ID NO: 211624 - protein, 17 aa, Mycobacterium bovis
RDVDWWLTFSSAAALLG

SEQ ID NO: 211625 - protein, 18 aa, Mycobacterium bovis
RDVVAGLVSDIAWDTPVS

SEQ ID NO: 211626 - protein, 18 aa, Mycobacterium bovis
REAKKICMGCEVRHECLE

SEQ ID NO: 211627 - protein, 26 aa, Mycobacterium bovis
REELQPRLPAVMDRLDRAIPRGVGTA

SEQ ID NO: 211628 - protein, 29 aa, Mycobacterium bovis
REHAEARLGYPLDRSHTAAVIWGDQAQGD

SEQ ID NO: 211629 - protein, 18 aa, Mycobacterium bovis
RELTAFVTYDHRLLSGCR

SEQ ID NO: 211630 - protein, 17 aa, Mycobacterium bovis
RENSSLVAALDRLDAAV

SEQ ID NO: 211631 - protein, 18 aa, Mycobacterium bovis
REPHSWDLCVGHAGRITA

SEQ ID NO: 211632 - protein, 20 aa, Mycobacterium bovis
REQRRADALGALAGGADRLG

SEQ ID NO: 211633 - protein, 17 aa, Mycobacterium bovis
RERMRFVHAHHQLLSEA

SEQ ID NO: 211634 - protein, 17 aa, Mycobacterium bovis
RERVAPLIAKYRLAGDH

SEQ ID NO: 211635 - protein, 17 aa, Mycobacterium bovis
RERYSMLAACFEPDVAC

SEQ ID NO: 211636 - protein, 17 aa, Mycobacterium bovis
REVHCSRATIYRRAGGK

SEQ ID NO: 211637 - protein, 19 aa, Mycobacterium bovis
RGADGRVIVACFASNVDRV

SEQ ID NO: 211638 - protein, 19 aa, Mycobacterium bovis
RGGPPEGWQDSFVSSYATM

SEQ ID NO: 211639 - protein, 23 aa, Mycobacterium bovis
RGPGQMLGGLPVGQMGARAGGGL

SEQ ID NO: 211640 - protein, 20 aa, Mycobacterium bovis
RGRRGIVAARELLPFADGRA

SEQ ID NO: 211641 - protein, 21 aa, Mycobacterium bovis
RGVTVGRPLGLLLTRRSENAT

SEQ ID NO: 211642 - protein, 25 aa, Mycobacterium bovis
RGWAGSLKRHGEWIVPTRLALVRRL

SEQ ID NO: 211643 - protein, 17 aa, Mycobacterium bovis
RHFRFGPEPDRSQTFAC

SEQ ID NO: 211644 - protein, 21 aa, Mycobacterium bovis
RHLEIRWDGQVALLADLNSTN

SEQ ID NO: 211645 - protein, 23 aa, Mycobacterium bovis
RHLEIRWDGQVALLADLNSTNGT

SEQ ID NO: 211646 - protein, 18 aa, Mycobacterium bovis
RHTSLLPLLHNYREPAKP

SEQ ID NO: 211647 - protein, 19 aa, Mycobacterium bovis
RHVWGWRRLLLKQILECVL

SEQ ID NO: 211648 - protein, 17 aa, Mycobacterium bovis
RIAGVLASAGLDVAITD

SEQ ID NO: 211649 - protein, 18 aa, Mycobacterium bovis
RIAPVGPSAVSIELADGL

SEQ ID NO: 211650 - protein, 22 aa, Mycobacterium bovis
RIEEARGALIEGIIEESEDESL

SEQ ID NO: 211651 - protein, 17 aa, Mycobacterium bovis
RIGRIASPDGVAFASID

SEQ ID NO: 211652 - protein, 26 aa, Mycobacterium bovis
RIIARMLAVMLRRRMQEAGMDTGGVE

SEQ ID NO: 211653 - protein, 17 aa, Mycobacterium bovis
RKFGGGALSVYIDDRQV

SEQ ID NO: 211654 - protein, 41 aa, Mycobacterium bovis
RKKLPSVQVGDPFMEKVLIECCLELYAGGLVIGIQDLGGAG

SEQ ID NO: 211655 - protein, 17 aa, Mycobacterium bovis
RKLKINTILSVGEHSVR

SEQ ID NO: 211656 - protein, 17 aa, Mycobacterium bovis
RKNHKVFRRRRFFEGEP

SEQ ID NO: 211657 - protein, 17 aa, Mycobacterium bovis
RKNLHVWAGECHVHAGI

SEQ ID NO: 211658 - protein, 25 aa, Mycobacterium bovis
RKPSRVPVWFMRQAGRSLPEYRALR

SEQ ID NO: 211659 - protein, 18 aa, Mycobacterium bovis
RLAGQWGDRVRPLVGDLT

SEQ ID NO: 211660 - protein, 26 aa, Mycobacterium bovis
RLAQRQGIEILGPVGVAARTAATVGD

SEQ ID NO: 211661 - protein, 22 aa, Mycobacterium bovis
RLDSGEQLKVWRAMEDADEVPV

SEQ ID NO: 211662 - protein, 24 aa, Mycobacterium bovis
RLGPCPQHRYSFINVRRVASGSNT

SEQ ID NO: 211663 - protein, 19 aa, Mycobacterium bovis
RLIAFGRERMRFVHAHHQL

SEQ ID NO: 211664 - protein, 18 aa, Mycobacterium bovis
RLKESVQAHGIYNQNLQA

SEQ ID NO: 211665 - protein, 18 aa, Mycobacterium bovis
RLLAEPTAWLFGPEAHGL

SEQ ID NO: 211666 - protein, 18 aa, Mycobacterium bovis
RLMRFDKHGPLDLILYHD

SEQ ID NO: 211667 - protein, 17 aa, Mycobacterium bovis
RLPADHPGVNELFALLA

SEQ ID NO: 211668 - protein, 17 aa, Mycobacterium bovis
RLPRTPIAEVFAELVDA

SEQ ID NO: 211669 - protein, 23 aa, Mycobacterium bovis
RLSDGIDIVAGWAEKAGLDVALA

SEQ ID NO: 211670 - protein, 23 aa, Mycobacterium bovis
RLVKAGKVDKDWDADATKGIPFG

SEQ ID NO: 211671 - protein, 21 aa, Mycobacterium bovis
RMALPPCHAFFQFYVADGRLS

SEQ ID NO: 211672 - protein, 18 aa, Mycobacterium bovis
RMRTTLGVRHWQLEGRIG

SEQ ID NO: 211673 - protein, 19 aa, Mycobacterium bovis
RNAFVQLVLSNLFGQNAPA

SEQ ID NO: 211674 - protein, 18 aa, Mycobacterium bovis
RNGALRMVRGVKNRFGAA

SEQ ID NO: 211675 - protein, 17 aa, Mycobacterium bovis
RPDNLLAVANAAIGAAI

SEQ ID NO: 211676 - protein, 21 aa, Mycobacterium bovis
RPDQLAKLAARIMDCLNPDGD

SEQ ID NO: 211677 - protein, 20 aa, Mycobacterium bovis
RPDYSITGWVILTLIQHGTP

SEQ ID NO: 211678 - protein, 20 aa, Mycobacterium bovis
RPFDAIALVSVRLCHVQTDP

SEQ ID NO: 211679 - protein, 18 aa, Mycobacterium bovis
RPGAELRRLTPRNTDQLL

SEQ ID NO: 211680 - protein, 19 aa, Mycobacterium bovis
RPHYIKTLRIWGDTLQSNK

SEQ ID NO: 211681 - protein, 17 aa, Mycobacterium bovis
RPIHLMGLDKTFRLFST

SEQ ID NO: 211682 - protein, 17 aa, Mycobacterium bovis
RPIIFNLPATVEMTTPN

SEQ ID NO: 211683 - protein, 18 aa, Mycobacterium bovis
RPRAVNVRGADDAALPPV

SEQ ID NO: 211684 - protein, 19 aa, Mycobacterium bovis
RQFPLDWRANGPIASTGLA

SEQ ID NO: 211685 - protein, 19 aa, Mycobacterium bovis
RQGEPAVSFLLISSGSAEV

SEQ ID NO: 211686 - protein, 22 aa, Mycobacterium bovis
RQKGLPGARARRRGLSDAALGT

SEQ ID NO: 211687 - protein, 23 aa, Mycobacterium bovis
RQLDWMVCRTVATLLRSKVSARP

SEQ ID NO: 211688 - protein, 20 aa, Mycobacterium bovis
RQVPDNGGMYFVPAFSGLFA

SEQ ID NO: 211689 - protein, 18 aa, Mycobacterium bovis
RQWLVRWAAHPGRATRGF

SEQ ID NO: 211690 - protein, 18 aa, Mycobacterium bovis
RQYFGSKVLRTVIPRSVK

SEQ ID NO: 211691 - protein, 26 aa, Mycobacterium bovis
RRAAELGVTCSIFVDQIHYWGDVIVD

SEQ ID NO: 211692 - protein, 18 aa, Mycobacterium bovis
RRAGYMYGTVLARGLRGH

SEQ ID NO: 211693 - protein, 20 aa, Mycobacterium bovis
RRCARRRAEIFTWQRAAASM

SEQ ID NO: 211694 - protein, 21 aa, Mycobacterium bovis
RRDGWWQGLGPYDVVLDALGG

SEQ ID NO: 211695 - protein, 21 aa, Mycobacterium bovis
RRDRGWLAWCARFDRGHRGDR

SEQ ID NO: 211696 - protein, 18 aa, Mycobacterium bovis
RREAPVYWHRPTEHTPDG

SEQ ID NO: 211697 - protein, 22 aa, Mycobacterium bovis
RRGRDRIPLTGRIAVIVDDGIA

SEQ ID NO: 211698 - protein, 24 aa, Mycobacterium bovis
RRIDPRNSTVLVWGAVNAGMAANA

SEQ ID NO: 211699 - protein, 20 aa, Mycobacterium bovis
RRIPTWASRVVSGLARDRPV

SEQ ID NO: 211700 - protein, 20 aa, Mycobacterium bovis
RRLAEKLWNLRVLADEKSAS

SEQ ID NO: 211701 - protein, 18 aa, Mycobacterium bovis
RRLTEVRKNGVLPYLRPD

SEQ ID NO: 211702 - protein, 21 aa, Mycobacterium bovis
RRRELVKQAKHKGEEAKVSVR

SEQ ID NO: 211703 - protein, 25 aa, Mycobacterium bovis
RRRLAPWGARCCWTRRTGSGRCNRL

SEQ ID NO: 211704 - protein, 17 aa, Mycobacterium bovis
RRYLDMFTFVASSALGM

SEQ ID NO: 211705 - protein, 17 aa, Mycobacterium bovis
RSGTPVQVLGFREHASW

SEQ ID NO: 211706 - protein, 24 aa, Mycobacterium bovis
RSITWDQGIEMARHIDITADLGAP

SEQ ID NO: 211707 - protein, 25 aa, Mycobacterium bovis
RSLAYDRAWWFARFVAAAYGTAKLR

SEQ ID NO: 211708 - protein, 18 aa, Mycobacterium bovis
RSNGFGFTFADAENLLDY

SEQ ID NO: 211709 - protein, 18 aa, Mycobacterium bovis
RSPHGVSAGGSRLVGVAF

SEQ ID NO: 211710 - protein, 20 aa, Mycobacterium bovis
RSSHTWFVLRELLGHQNVNI

SEQ ID NO: 211711 - protein, 20 aa, Mycobacterium bovis
RSWRVPMPMRCGGARSIRPS

SEQ ID NO: 211712 - protein, 32 aa, Mycobacterium bovis
RTADDLLERYWRGEQRLATIAHQCEVKSDQSE

SEQ ID NO: 211713 - protein, 21 aa, Mycobacterium bovis
RTGHGFLDWPAGAREATTARL

SEQ ID NO: 211714 - protein, 21 aa, Mycobacterium bovis
RTRRPPAFPEDIWVPERDPGT

SEQ ID NO: 211715 - protein, 23 aa, Mycobacterium bovis
RTSEAYRVMSMLAMDDPAHLRMR

SEQ ID NO: 211716 - protein, 24 aa, Mycobacterium bovis
RTSNDLLLVPSIVEPSNFLENISR

SEQ ID NO: 211717 - protein, 21 aa, Mycobacterium bovis
RTVRARIAGLDYRLDVNTLHR

SEQ ID NO: 211718 - protein, 19 aa, Mycobacterium bovis
RTWLPTGWDSEMSDEYEWA

SEQ ID NO: 211719 - protein, 25 aa, Mycobacterium bovis
RVAQTRAAPHLARITCPALVLNAEA

SEQ ID NO: 211720 - protein, 17 aa, Mycobacterium bovis
RVFAELSPHPLLTHAVD

SEQ ID NO: 211721 - protein, 19 aa, Mycobacterium bovis
RVISDVWLSNLLAWLTRRA

SEQ ID NO: 211722 - protein, 21 aa, Mycobacterium bovis
RVPTEKGYREFVDQLEDVKPL

SEQ ID NO: 211723 - protein, 19 aa, Mycobacterium bovis
RVQLASLLVGEWDVIALDE

SEQ ID NO: 211724 - protein, 17 aa, Mycobacterium bovis
RVRDPRLRRALTPDYEP

SEQ ID NO: 211725 - protein, 19 aa, Mycobacterium bovis
RVRIGTTWGARCGTVTICS

SEQ ID NO: 211726 - protein, 25 aa, Mycobacterium bovis
RVRRNPRGSYQIAVVGLKGGAGKTT

SEQ ID NO: 211727 - protein, 19 aa, Mycobacterium bovis
RVTGRKNLHVWAGECHVHA

SEQ ID NO: 211728 - protein, 20 aa, Mycobacterium bovis
RVVSKPAALVHGMFVALPAA

SEQ ID NO: 211729 - protein, 19 aa, Mycobacterium bovis
RWDKPFLAIFGYRDPILGQ

SEQ ID NO: 211730 - protein, 19 aa, Mycobacterium bovis
RWLAEGVADFVARPKTPPP

SEQ ID NO: 211731 - protein, 18 aa, Mycobacterium bovis
RWRPWRSYATQHLWTTLE

SEQ ID NO: 211732 - protein, 18 aa, Mycobacterium bovis
RWRSSGGVIAARIPAAAY

SEQ ID NO: 211733 - protein, 23 aa, Mycobacterium bovis
RWSAVLVGAWWPAPSAALRAAAQ

SEQ ID NO: 211734 - protein, 20 aa, Mycobacterium bovis
RWVLDADIKACFDRIDHADL

SEQ ID NO: 211735 - protein, 21 aa, Mycobacterium bovis
RYADAWIPIVVVRPSDYSRAL

SEQ ID NO: 211736 - protein, 18 aa, Mycobacterium bovis
RYAQRVMDWLHPDGDLTD

SEQ ID NO: 211737 - protein, 20 aa, Mycobacterium bovis
RYDPGALRRSRISARTRDLC

SEQ ID NO: 211738 - protein, 20 aa, Mycobacterium bovis
RYIILKGRNSEHLFVAAESL

SEQ ID NO: 211739 - protein, 26 aa, Mycobacterium bovis
RYNPDYLPGALLPPSIHATADAEEAL

SEQ ID NO: 211740 - protein, 32 aa, Mycobacterium bovis
SAAAAKLAGLVFPQPPAPIAVSGTDSVVAAIN

SEQ ID NO: 211741 - protein, 19 aa, Mycobacterium bovis
SAAENYGSVIARLTGMHWW

SEQ ID NO: 211742 - protein, 18 aa, Mycobacterium bovis
SAALLKLPVANWPALGGM

SEQ ID NO: 211743 - protein, 22 aa, Mycobacterium bovis
SAESRTLARLGLANYFAAATVL

SEQ ID NO: 211744 - protein, 18 aa, Mycobacterium bovis
SAFPKPQNYPGLPTVSFV

SEQ ID NO: 211745 - protein, 19 aa, Mycobacterium bovis
SAGKWPDKFLAGAAGVAHG

SEQ ID NO: 211746 - protein, 24 aa, Mycobacterium bovis
SALPPRFQASAAFAANLSTINTLR

SEQ ID NO: 211747 - protein, 17 aa, Mycobacterium bovis
SARELAHDTTIRFTHEL

SEQ ID NO: 211748 - protein, 26 aa, Mycobacterium bovis
SARGRLGLLELRGFEMPPHLHMAMVQ

SEQ ID NO: 211749 - protein, 18 aa, Mycobacterium bovis
SARYRPWMPAAGNHENEV

SEQ ID NO: 211750 - protein, 23 aa, Mycobacterium bovis
SASTICDPGFLVLVEGVLGETGL

SEQ ID NO: 211751 - protein, 25 aa, Mycobacterium bovis
SATDHPDLFWALRGGGGGNFGVTTS

SEQ ID NO: 211752 - protein, 18 aa, Mycobacterium bovis
SAVPAYFVGVGVRPEHAP

SEQ ID NO: 211753 - protein, 17 aa, Mycobacterium bovis
SCRCSRAVHIQGISPPL

SEQ ID NO: 211754 - protein, 23 aa, Mycobacterium bovis
SDAFAGAPIRVGAFLAEDHALRL

SEQ ID NO: 211755 - protein, 18 aa, Mycobacterium bovis
SDCGLCPDHKQHACLGLI

SEQ ID NO: 211756 - protein, 20 aa, Mycobacterium bovis
SDGRGPVLVHALEGFSDAGH

SEQ ID NO: 211757 - protein, 21 aa, Mycobacterium bovis
SDGRGPVLVHALEGFSDAGHA

SEQ ID NO: 211758 - protein, 21 aa, Mycobacterium bovis
SDNLPSCITKYIPLHTPAVVM

SEQ ID NO: 211759 - protein, 17 aa, Mycobacterium bovis
SDPWRKLSANRDNRVFV

SEQ ID NO: 211760 - protein, 17 aa, Mycobacterium bovis
SDRPRSVIWVTGRGTAE

SEQ ID NO: 211761 - protein, 21 aa, Mycobacterium bovis
SELKAADSLAEYVLELARKLI

SEQ ID NO: 211762 - protein, 19 aa, Mycobacterium bovis
SETDWDALRAAYPRDAERV

SEQ ID NO: 211763 - protein, 21 aa, Mycobacterium bovis
SGAAIPAFKPLGGRELGAGMS

SEQ ID NO: 211764 - protein, 17 aa, Mycobacterium bovis
SGEGRWTAIAAIDEGVP

SEQ ID NO: 211765 - protein, 19 aa, Mycobacterium bovis
SGGAASMFAAPAAATAAVT

SEQ ID NO: 211766 - protein, 18 aa, Mycobacterium bovis
SGGCGPSPGGGQPGYGGY

SEQ ID NO: 211767 - protein, 33 aa, Mycobacterium bovis
SGGDGGGGISLGGQGGNGGFGGAGGNGGIGTDA

SEQ ID NO: 211768 - protein, 19 aa, Mycobacterium bovis
SGHGNTGFFNAGSFNTGML

SEQ ID NO: 211769 - protein, 26 aa, Mycobacterium bovis
SGKQRSRLALWSRRLLGEAITQAQLV

SEQ ID NO: 211770 - protein, 22 aa, Mycobacterium bovis
SGNGPLAAFVHALADVGFDVAV

SEQ ID NO: 211771 - protein, 20 aa, Mycobacterium bovis
SGNYLPRFGPYLSSASNPWG

SEQ ID NO: 211772 - protein, 21 aa, Mycobacterium bovis
SGNYLPRFGPYLSSASNPWGD

SEQ ID NO: 211773 - protein, 17 aa, Mycobacterium bovis
SGQPLDWFCLFSSAAAL

SEQ ID NO: 211774 - protein, 20 aa, Mycobacterium bovis
SGSAKWNLLAPYAAKSDGGR

SEQ ID NO: 211775 - protein, 24 aa, Mycobacterium bovis
SHQLRVLRNLGLVVGDRAGRSIVY

SEQ ID NO: 211776 - protein, 19 aa, Mycobacterium bovis
SIRILKMLFEHGIETVISP

SEQ ID NO: 211777 - protein, 21 aa, Mycobacterium bovis
SIRLVTPVQWAMRQTVRDTEL

SEQ ID NO: 211778 - protein, 20 aa, Mycobacterium bovis
SKNAIPWGDFSTHLAQLQGL

SEQ ID NO: 211779 - protein, 27 aa, Mycobacterium bovis
SKSGLTWTQRLVSLLVFDGPDLPGPLS

SEQ ID NO: 211780 - protein, 19 aa, Mycobacterium bovis
SKTVWGVGIAPSITTASLR

SEQ ID NO: 211781 - protein, 19 aa, Mycobacterium bovis
SLARLLAPVLPKLDTVHTV

SEQ ID NO: 211782 - protein, 19 aa, Mycobacterium bovis
SLATDSWLSAASFQETTRV

SEQ ID NO: 211783 - protein, 22 aa, Mycobacterium bovis
SLEVIDLRSLAPLDFDTIAASI

SEQ ID NO: 211784 - protein, 19 aa, Mycobacterium bovis
SLRIFPATHYVAGPERMAH

SEQ ID NO: 211785 - protein, 21 aa, Mycobacterium bovis
SLRMYLGAGSGPMLAAAAAWD

SEQ ID NO: 211786 - protein, 23 aa, Mycobacterium bovis
SLVKFACAWTYIALDPAVVQSVP

SEQ ID NO: 211787 - protein, 17 aa, Mycobacterium bovis
SNFPPKRHKTRVLAAAE

SEQ ID NO: 211788 - protein, 19 aa, Mycobacterium bovis
SNTIAPFLGLLGGVAAADA

SEQ ID NO: 211789 - protein, 18 aa, Mycobacterium bovis
SPAVMAVTAVPVATAGWS

SEQ ID NO: 211790 - protein, 17 aa, Mycobacterium bovis
SPEGLKRNLRLRDGRWH

SEQ ID NO: 211791 - protein, 28 aa, Mycobacterium bovis
SPGATAFPWRRQSALVQWYVETSGSPSE

SEQ ID NO: 211792 - protein, 18 aa, Mycobacterium bovis
SPGFLGFQLLRPVKGEER

SEQ ID NO: 211793 - protein, 18 aa, Mycobacterium bovis
SPGLELYSPAQLGLDHGH

SEQ ID NO: 211794 - protein, 18 aa, Mycobacterium bovis
SPSGLLLAELKPRRLVEN

SEQ ID NO: 211795 - protein, 33 aa, Mycobacterium bovis
SRAHPRAAFFGRSGLRRNIRWDPLDSVYFAGYA

SEQ ID NO: 211796 - protein, 24 aa, Mycobacterium bovis
SRCARCARCARGWHDQGRHVWGWR

SEQ ID NO: 211797 - protein, 17 aa, Mycobacterium bovis
SRFEHLVGYPFAPHYVD

SEQ ID NO: 211798 - protein, 19 aa, Mycobacterium bovis
SRLKGKQVEFFAAALGGPE

SEQ ID NO: 211799 - protein, 23 aa, Mycobacterium bovis
SRLPRWRAMAAHALCKRDDLARQ

SEQ ID NO: 211800 - protein, 19 aa, Mycobacterium bovis
SRPAALMVPDGVLRARKLP

SEQ ID NO: 211801 - protein, 20 aa, Mycobacterium bovis
SRSLRACIDLAALGENTIAI

SEQ ID NO: 211802 - protein, 23 aa, Mycobacterium bovis
SRTIRLPVHLVEQVNKLARIKRE

SEQ ID NO: 211803 - protein, 23 aa, Mycobacterium bovis
SRVRVWCGGTLVADHDRIWAKHQ

SEQ ID NO: 211804 - protein, 18 aa, Mycobacterium bovis
SRYWPADDYRAGVVQTSF

SEQ ID NO: 211805 - protein, 17 aa, Mycobacterium bovis
SSGVVWGRVPITAPAGA

SEQ ID NO: 211806 - protein, 39 aa, Mycobacterium bovis
SSHAPRPRMLVFGAIDFAAALARQGSFLGYRVTVCDARA

SEQ ID NO: 211807 - protein, 18 aa, Mycobacterium bovis
STFFRGRWPRLLRSLYPI

SEQ ID NO: 211808 - protein, 20 aa, Mycobacterium bovis
STIPAYARSWSAHTRCWFID

SEQ ID NO: 211809 - protein, 17 aa, Mycobacterium bovis
STIRKPPIEHAAGPLGS

SEQ ID NO: 211810 - protein, 23 aa, Mycobacterium bovis
STLQRPSMRGVPFTFVQVDRAGN

SEQ ID NO: 211811 - protein, 23 aa, Mycobacterium bovis
STTIGAFAIPGGPGYFNSSTAPS

SEQ ID NO: 211812 - protein, 19 aa, Mycobacterium bovis
SVAALWSVFSCRRHTTRDT

SEQ ID NO: 211813 - protein, 18 aa, Mycobacterium bovis
SVALDWLRNNGYQDLASR

SEQ ID NO: 211814 - protein, 21 aa, Mycobacterium bovis
SVCYLPLTYDHRLIDGADAGR

SEQ ID NO: 211815 - protein, 23 aa, Mycobacterium bovis
SVFPFDGTRRWFHLECNPQYDDY

SEQ ID NO: 211816 - protein, 24 aa, Mycobacterium bovis
SVLTRSCKRWFGTGPAAYRNQARL

SEQ ID NO: 211817 - protein, 27 aa, Mycobacterium bovis
SVRSPAYCFTLPFAHQALMPINVVATA

SEQ ID NO: 211818 - protein, 24 aa, Mycobacterium bovis
SVSDALDILRWAPQAASGPVAKVI

SEQ ID NO: 211819 - protein, 21 aa, Mycobacterium bovis
SVSMTAQWWLDAREPKKEVVA

SEQ ID NO: 211820 - protein, 24 aa, Mycobacterium bovis
SVWGGFPAAVSWRSTSEQVHADLG

SEQ ID NO: 211821 - protein, 22 aa, Mycobacterium bovis
SWQAREWLPFVGIERADTDRPH

SEQ ID NO: 211822 - protein, 26 aa, Mycobacterium bovis
SWQQALRGLPGLGQVASAISGGAASM

SEQ ID NO: 211823 - protein, 20 aa, Mycobacterium bovis
SYNGMLYFGINADRDAMSDV

SEQ ID NO: 211824 - protein, 22 aa, Mycobacterium bovis
SYRLRAVSAVGLRFPLNGTANG

SEQ ID NO: 211825 - protein, 20 aa, Mycobacterium bovis
TAAALWLVAPCTELYHDSRA

SEQ ID NO: 211826 - protein, 28 aa, Mycobacterium bovis
TAAELAPRVVATVPQLVQLAPHAVQMSQ

SEQ ID NO: 211827 - protein, 23 aa, Mycobacterium bovis
TAELLRLALTGKRKPYIYTSTIA

SEQ ID NO: 211828 - protein, 24 aa, Mycobacterium bovis
TAESSLRGANLWDEVKDRLDKPGG

SEQ ID NO: 211829 - protein, 26 aa, Mycobacterium bovis
TAGRVATAATAAWVGPGETVAPPVVT

SEQ ID NO: 211830 - protein, 17 aa, Mycobacterium bovis
TALVLPAAGAPAVVLPR

SEQ ID NO: 211831 - protein, 19 aa, Mycobacterium bovis
TALWEEWPPSGARASIHSY

SEQ ID NO: 211832 - protein, 25 aa, Mycobacterium bovis
TAMPDTNVAPAYRSSVSASVSASAA

SEQ ID NO: 211833 - protein, 18 aa, Mycobacterium bovis
TAMPGLLNNGVLIDESAG

SEQ ID NO: 211834 - protein, 17 aa, Mycobacterium bovis
TAPILLGALPFDVSRPA

SEQ ID NO: 211835 - protein, 21 aa, Mycobacterium bovis
TAVACPRFVDFVERGVTSGRQ

SEQ ID NO: 211836 - protein, 38 aa, Mycobacterium bovis
TCEIHYTCACCCLPPNLRRPLRRTARRGPPTRGLPKAV

SEQ ID NO: 211837 - protein, 23 aa, Mycobacterium bovis
TCIECPDGTVGEIWVHGDNVANG

SEQ ID NO: 211838 - protein, 17 aa, Mycobacterium bovis
TDIDAVLEFRVSEEVLL

SEQ ID NO: 211839 - protein, 26 aa, Mycobacterium bovis
TDPHARLPLPLARDEIRYLGTTFNDL

SEQ ID NO: 211840 - protein, 26 aa, Mycobacterium bovis
TDSEAMDAFGLLCRMEGIIPAIESAH

SEQ ID NO: 211841 - protein, 28 aa, Mycobacterium bovis
TDTGSFRWASVRGYRLAARLVEIGVDNA

SEQ ID NO: 211842 - protein, 17 aa, Mycobacterium bovis
TDTRIATAVARTVTARL

SEQ ID NO: 211843 - protein, 23 aa, Mycobacterium bovis
TDVPTGVVVPYFWSDQYDVKIQC

SEQ ID NO: 211844 - protein, 17 aa, Mycobacterium bovis
TEHFLRSVFRDAPHEEP

SEQ ID NO: 211845 - protein, 18 aa, Mycobacterium bovis
TESLGRFSEVANRALAAT

SEQ ID NO: 211846 - protein, 21 aa, Mycobacterium bovis
TESWMGPASMAMVAAAQPYLA

SEQ ID NO: 211847 - protein, 26 aa, Mycobacterium bovis
TEVLDWSGAPFAKWFVGGELNVAYNC

SEQ ID NO: 211848 - protein, 18 aa, Mycobacterium bovis
TFDRPALGPSAFNTIIDK

SEQ ID NO: 211849 - protein, 18 aa, Mycobacterium bovis
TFGGLKPVHALADCGRVV

SEQ ID NO: 211850 - protein, 20 aa, Mycobacterium bovis
TFGMDSWFPSLKIYNRNGQL

SEQ ID NO: 211851 - protein, 29 aa, Mycobacterium bovis
TFPEFPLPLGDPSVRCGGDLLSMMLMDEQ

SEQ ID NO: 211852 - protein, 19 aa, Mycobacterium bovis
TFQRCKLNWAEAGSGEHAR

SEQ ID NO: 211853 - protein, 24 aa, Mycobacterium bovis
TGGAGGGAFVHIVTATSTGGSGGF

SEQ ID NO: 211854 - protein, 28 aa, Mycobacterium bovis
TGGNGGDAEPGVPPGAGGAGGAGTTGGK

SEQ ID NO: 211855 - protein, 22 aa, Mycobacterium bovis
TGGVEPWAYLIVGGVQLATHSW

SEQ ID NO: 211856 - protein, 25 aa, Mycobacterium bovis
TGKFEWLDNDVVQWVPDRFWPAHST

SEQ ID NO: 211857 - protein, 19 aa, Mycobacterium bovis
TGLPGVLSRRIDPRNSTVL

SEQ ID NO: 211858 - protein, 22 aa, Mycobacterium bovis
TGYVMPHWPRPWGRAAGAVEQL

SEQ ID NO: 211859 - protein, 22 aa, Mycobacterium bovis
THGHTEWLPPPHLDHGQPRTNT

SEQ ID NO: 211860 - protein, 18 aa, Mycobacterium bovis
TIDPDVMGGMPCIRGLRI

SEQ ID NO: 211861 - protein, 18 aa, Mycobacterium bovis
TILGLSLAHGGHLTHGMR

SEQ ID NO: 211862 - protein, 17 aa, Mycobacterium bovis
TILYLYATMFKLKKSLD

SEQ ID NO: 211863 - protein, 23 aa, Mycobacterium bovis
TKDVHIGPSDHVGWLDDRKWAYV

SEQ ID NO: 211864 - protein, 26 aa, Mycobacterium bovis
TKGFKFSTYATWWIRQAITRGMADQS

SEQ ID NO: 211865 - protein, 20 aa, Mycobacterium bovis
TKGIPFGSVVTFVVRAGNPK

SEQ ID NO: 211866 - protein, 28 aa, Mycobacterium bovis
TKPPKVVSQRGWRHWVHALTRINLGLSP

SEQ ID NO: 211867 - protein, 19 aa, Mycobacterium bovis
TLASLKWVLANRAYTPWYL

SEQ ID NO: 211868 - protein, 22 aa, Mycobacterium bovis
TLDSCVRDGLMSSRAAETAETL

SEQ ID NO: 211869 - protein, 17 aa, Mycobacterium bovis
TLLDRAYAKKFRFPTFL

SEQ ID NO: 211870 - protein, 19 aa, Mycobacterium bovis
TLLGRPLIGDGAHGTAPGQ

SEQ ID NO: 211871 - protein, 21 aa, Mycobacterium bovis
TLQSFLPPPFDAIPNPIEDLD

SEQ ID NO: 211872 - protein, 21 aa, Mycobacterium bovis
TLRRILYDHIYLRHFRPKPDY

SEQ ID NO: 211873 - protein, 18 aa, Mycobacterium bovis
TLSKLVRHHLLLPITATR

SEQ ID NO: 211874 - protein, 29 aa, Mycobacterium bovis
TLSTQAAAFHSRFVQALTTAAASYASVEA

SEQ ID NO: 211875 - protein, 20 aa, Mycobacterium bovis
TLTEAFLWEEHRRVTKTATV

SEQ ID NO: 211876 - protein, 26 aa, Mycobacterium bovis
TLTSRPGGGGWGWGVEPPGAAVAEVI

SEQ ID NO: 211877 - protein, 24 aa, Mycobacterium bovis
TMLPTGEVVRRCYTDVLAAARPAT

SEQ ID NO: 211878 - protein, 23 aa, Mycobacterium bovis
TPNRWQVRPGPVAARRWDIEPDL

SEQ ID NO: 211879 - protein, 20 aa, Mycobacterium bovis
TPQPLQWDCFLFGIIQSDDH

SEQ ID NO: 211880 - protein, 24 aa, Mycobacterium bovis
TPSSKLGGLWKTVSPHLSPISNMV

SEQ ID NO: 211881 - protein, 18 aa, Mycobacterium bovis
TQFGRDFDDRLAVAIHFA

SEQ ID NO: 211882 - protein, 32 aa, Mycobacterium bovis
TQGWLRNPERVWGWYLWRHYLVANVEPNDGHR

SEQ ID NO: 211883 - protein, 18 aa, Mycobacterium bovis
TQVLRCLDAELARSSADP

SEQ ID NO: 211884 - protein, 23 aa, Mycobacterium bovis
TRDSSIWIGPRVVIPSLALRARV

SEQ ID NO: 211885 - protein, 22 aa, Mycobacterium bovis
TRLWEHWGKPEIVWYPGGHTGF

SEQ ID NO: 211886 - protein, 24 aa, Mycobacterium bovis
TRPPRPGRRLPVYPAAADVDPPGP

SEQ ID NO: 211887 - protein, 21 aa, Mycobacterium bovis
TSAINRLRWLVHELDPERAPA

SEQ ID NO: 211888 - protein, 17 aa, Mycobacterium bovis
TSGEMYLGPGAGPMLAA

SEQ ID NO: 211889 - protein, 17 aa, Mycobacterium bovis
TSGRADTYFDFGGVHAA

SEQ ID NO: 211890 - protein, 22 aa, Mycobacterium bovis
TSILQRRVVFRANRAEVQAIAT

SEQ ID NO: 211891 - protein, 19 aa, Mycobacterium bovis
TSIRTRLTAIESVLGNAIR

SEQ ID NO: 211892 - protein, 24 aa, Mycobacterium bovis
TSRPCGPGWTPARIGRRTRARRAD

SEQ ID NO: 211893 - protein, 24 aa, Mycobacterium bovis
TSVRMPLTLNIPAGIPLEPGIYEW

SEQ ID NO: 211894 - protein, 28 aa, Mycobacterium bovis
TTALFGHSYGSLLSGIALKDGASSLVDN

SEQ ID NO: 211895 - protein, 25 aa, Mycobacterium bovis
TTPEFAIPPIGVGGFTLPQITTQEI

SEQ ID NO: 211896 - protein, 24 aa, Mycobacterium bovis
TTQPAASWRRGRPGTPKQRPPTPG

SEQ ID NO: 211897 - protein, 24 aa, Mycobacterium bovis
TTTHLFEAWQRWRVQEGVPEISRK

SEQ ID NO: 211898 - protein, 20 aa, Mycobacterium bovis
TVAEWSHLLAGHGLVVEHVV

SEQ ID NO: 211899 - protein, 24 aa, Mycobacterium bovis
TVCILDRPRHAQLIHDVRATGARI

SEQ ID NO: 211900 - protein, 19 aa, Mycobacterium bovis
TVIAGALGNWLMSRGEAVA

SEQ ID NO: 211901 - protein, 21 aa, Mycobacterium bovis
TVKTFKRAGGQVWLMPHNPAF

SEQ ID NO: 211902 - protein, 18 aa, Mycobacterium bovis
TVQRDGTCVLVIAPAPAL

SEQ ID NO: 211903 - protein, 19 aa, Mycobacterium bovis
TVYSGEWWHFDGPGPGAGV

SEQ ID NO: 211904 - protein, 18 aa, Mycobacterium bovis
TWTGAGGVKGFFEKTFAP

SEQ ID NO: 211905 - protein, 22 aa, Mycobacterium bovis
TYAFQRRRFWLSGDGVAADAAG

SEQ ID NO: 211906 - protein, 23 aa, Mycobacterium bovis
TYAFQRRRFWLSGDGVAADAAGL

SEQ ID NO: 211907 - protein, 23 aa, Mycobacterium bovis
TYAFQRRRFWLSGDGVAADAASL

SEQ ID NO: 211908 - protein, 24 aa, Mycobacterium bovis
TYREVRAGHQVRWTILLDGAVRIS

SEQ ID NO: 211909 - protein, 23 aa, Mycobacterium bovis
VAAKLLRRKRFDIVGPPHHVEVE

SEQ ID NO: 211910 - protein, 23 aa, Mycobacterium bovis
VAANRNAFVQLVLSNLFGQNAPA

SEQ ID NO: 211911 - protein, 24 aa, Mycobacterium bovis
VAANRNAFVQLVLSNLFGQNAPAI

SEQ ID NO: 211912 - protein, 20 aa, Mycobacterium bovis
VAARRAGVPITELTETLPSG

SEQ ID NO: 211913 - protein, 20 aa, Mycobacterium bovis
VADAGWKYLSTGAYAGSLDD

SEQ ID NO: 211914 - protein, 18 aa, Mycobacterium bovis
VAELLGVPVSKVAQQLRE

SEQ ID NO: 211915 - protein, 25 aa, Mycobacterium bovis
VAFRGTAPAGRGFWFPPTVLTPKRG

SEQ ID NO: 211916 - protein, 25 aa, Mycobacterium bovis
VAGSRIDPVLARSWLLVNGAHGDRF

SEQ ID NO: 211917 - protein, 18 aa, Mycobacterium bovis
VAITLTWSQLYRRTLNVA

SEQ ID NO: 211918 - protein, 18 aa, Mycobacterium bovis
VAKCAVAFEADDHNVAEG

SEQ ID NO: 211919 - protein, 20 aa, Mycobacterium bovis
VALDRGEFFLVYQPIIRLAD

SEQ ID NO: 211920 - protein, 17 aa, Mycobacterium bovis
VAMGRAIVRRPRVFCMD

SEQ ID NO: 211921 - protein, 22 aa, Mycobacterium bovis
VAPCLFTKGGAVTWHIPESTAP

SEQ ID NO: 211922 - protein, 18 aa, Mycobacterium bovis
VARAYLDSRVQTIYGGTT

SEQ ID NO: 211923 - protein, 24 aa, Mycobacterium bovis
VARENRLRTALAALDNFDFDYVFV

SEQ ID NO: 211924 - protein, 19 aa, Mycobacterium bovis
VARRLAREEGLLVGISSGA

SEQ ID NO: 211925 - protein, 18 aa, Mycobacterium bovis
VATSFSARLFNLLITNAP

SEQ ID NO: 211926 - protein, 23 aa, Mycobacterium bovis
VAVLLRITEVFGVDATFFASQDD

SEQ ID NO: 211927 - protein, 19 aa, Mycobacterium bovis
VCDCGGLIRPDIVWFGEPL

SEQ ID NO: 211928 - protein, 21 aa, Mycobacterium bovis
VCTSIGSAARPRAVNHPSIEG

SEQ ID NO: 211929 - protein, 19 aa, Mycobacterium bovis
VDAFPRGAGRMLAIMHALD

SEQ ID NO: 211930 - protein, 19 aa, Mycobacterium bovis
VDLAFRMVGDIGVAEDMVQ

SEQ ID NO: 211931 - protein, 18 aa, Mycobacterium bovis
VDLLPGLLSQALDELLEA

SEQ ID NO: 211932 - protein, 25 aa, Mycobacterium bovis
VDRHLPAFLRFAGREFIGVQGTQLS

SEQ ID NO: 211933 - protein, 22 aa, Mycobacterium bovis
VDRIVSIEAFEHFGHENYDDFF

SEQ ID NO: 211934 - protein, 25 aa, Mycobacterium bovis
VDTHFGRLVRRWRWTTAEDPVKVEQ

SEQ ID NO: 211935 - protein, 19 aa, Mycobacterium bovis
VDVGKPCPFLIAEGVADST

SEQ ID NO: 211936 - protein, 17 aa, Mycobacterium bovis
VDWWLTFSSAAALLGTP

SEQ ID NO: 211937 - protein, 20 aa, Mycobacterium bovis
VEAPTGWPNILPDDFTILDG

SEQ ID NO: 211938 - protein, 21 aa, Mycobacterium bovis
VEGGWKINGQKVWTSGAQYCA

SEQ ID NO: 211939 - protein, 18 aa, Mycobacterium bovis
VELFTAEAIWEMPPYTGW

SEQ ID NO: 211940 - protein, 17 aa, Mycobacterium bovis
VELYISYLRKKIDNGRE

SEQ ID NO: 211941 - protein, 25 aa, Mycobacterium bovis
VEPLRPGPPPTVWSRRWRQPWAPPT

SEQ ID NO: 211942 - protein, 20 aa, Mycobacterium bovis
VEPRMLLVHFLRDQLRLTGT

SEQ ID NO: 211943 - protein, 21 aa, Mycobacterium bovis
VEQNLLNLINAPTQTLLGRPL

SEQ ID NO: 211944 - protein, 22 aa, Mycobacterium bovis
VEQNLLNLINAPTQTLLGRPLI

SEQ ID NO: 211945 - protein, 20 aa, Mycobacterium bovis
VEQRPELVLDRVRAFLAAGT

SEQ ID NO: 211946 - protein, 28 aa, Mycobacterium bovis
VERLCRRLADQAVRQWGFMQGLKQKLGP

SEQ ID NO: 211947 - protein, 21 aa, Mycobacterium bovis
VEVCRTCSWNHLVKSYVLGAA

SEQ ID NO: 211948 - protein, 18 aa, Mycobacterium bovis
VFEGTSFGGALMTTTGVE

SEQ ID NO: 211949 - protein, 30 aa, Mycobacterium bovis
VFQTRPSGLPGLRHKYSLDIAPGNFVTIND

SEQ ID NO: 211950 - protein, 18 aa, Mycobacterium bovis
VFRAWKLHDELGLNIVMP

SEQ ID NO: 211951 - protein, 17 aa, Mycobacterium bovis
VGAFLAEDHALRLLNLR

SEQ ID NO: 211952 - protein, 22 aa, Mycobacterium bovis
VGDLPGWLALHGYQNSRKRAVA

SEQ ID NO: 211953 - protein, 25 aa, Mycobacterium bovis
VGGDGGRGGLLAGNGGTGGAGGNGG

SEQ ID NO: 211954 - protein, 19 aa, Mycobacterium bovis
VGGIGGLLLGLDGANAPAS

SEQ ID NO: 211955 - protein, 25 aa, Mycobacterium bovis
VGGPGGGHGLLGLGGSHGAGGAGGS

SEQ ID NO: 211956 - protein, 17 aa, Mycobacterium bovis
VGIVEVDGFPVFDVPPD

SEQ ID NO: 211957 - protein, 24 aa, Mycobacterium bovis
VGLLRAEGRDAGWCPCTCPGGDPH

SEQ ID NO: 211958 - protein, 18 aa, Mycobacterium bovis
VGLMEFQSMYTALIMGEP

SEQ ID NO: 211959 - protein, 25 aa, Mycobacterium bovis
VGMATCKRCGDAVPYIILPNLQTGE

SEQ ID NO: 211960 - protein, 17 aa, Mycobacterium bovis
VGRHLLEVNPCFDRLAR

SEQ ID NO: 211961 - protein, 25 aa, Mycobacterium bovis
VGSTVCSAGKYARKHVPWVNFSNVP

SEQ ID NO: 211962 - protein, 17 aa, Mycobacterium bovis
VGVLDMLAAFYNDAPDE

SEQ ID NO: 211963 - protein, 20 aa, Mycobacterium bovis
VHELVRRWSGHMVTSQGDGF

SEQ ID NO: 211964 - protein, 17 aa, Mycobacterium bovis
VHIYLQFDGLDEATHRR

SEQ ID NO: 211965 - protein, 17 aa, Mycobacterium bovis
VHRCRLPFCDVTVGLVR

SEQ ID NO: 211966 - protein, 23 aa, Mycobacterium bovis
VHRGQARIAYRLAERYQDKLLHV

SEQ ID NO: 211967 - protein, 19 aa, Mycobacterium bovis
VIDCARPQSNHAFGAEPGV

SEQ ID NO: 211968 - protein, 20 aa, Mycobacterium bovis
VIERGIPLTMEMAKFIRFIV

SEQ ID NO: 211969 - protein, 17 aa, Mycobacterium bovis
VIRRLQPDFLVTVTAAV

SEQ ID NO: 211970 - protein, 40 aa, Mycobacterium bovis
VKDAPIRDWVKLAVTRARISGMPVLFWLDPYRPHENELIK

SEQ ID NO: 211971 - protein, 19 aa, Mycobacterium bovis
VKGAWVLARYDDGRPSQVR

SEQ ID NO: 211972 - protein, 17 aa, Mycobacterium bovis
VKPPTWWHSLPTDRPII

SEQ ID NO: 211973 - protein, 25 aa, Mycobacterium bovis
VLAAARRLRIIPGIASRTRTGGSAT

SEQ ID NO: 211974 - protein, 20 aa, Mycobacterium bovis
VLAKDCPSFGLGPTEPLLAA

SEQ ID NO: 211975 - protein, 19 aa, Mycobacterium bovis
VLARPPWDPGTAIIAVSDI

SEQ ID NO: 211976 - protein, 24 aa, Mycobacterium bovis
VLDWSEAPFAKWFVGGELNVAYNC

SEQ ID NO: 211977 - protein, 18 aa, Mycobacterium bovis
VLNRIACGQSIPAIAAEL

SEQ ID NO: 211978 - protein, 18 aa, Mycobacterium bovis
VMPGRPRPGYLPRVIDGA

SEQ ID NO: 211979 - protein, 29 aa, Mycobacterium bovis
VNAPIQAVTGRPLIGNGANGAPGSGAPGG

SEQ ID NO: 211980 - protein, 17 aa, Mycobacterium bovis
VNHEPFVTLGIHIGART

SEQ ID NO: 211981 - protein, 17 aa, Mycobacterium bovis
VNHGLVFRHFGTKDQLV

SEQ ID NO: 211982 - protein, 23 aa, Mycobacterium bovis
VNHLPLTLPLRYLGMSDAEVDQI

SEQ ID NO: 211983 - protein, 25 aa, Mycobacterium bovis
VNTHCNLDCPICFADSGHQPDGYAI

SEQ ID NO: 211984 - protein, 25 aa, Mycobacterium bovis
VNVPRRCCRPGCPHYAVATLTFVYS

SEQ ID NO: 211985 - protein, 23 aa, Mycobacterium bovis
VPAFDRTALVTALRADQAGQTSF

SEQ ID NO: 211986 - protein, 30 aa, Mycobacterium bovis
VPGDDTAIWRRIRVVPFEVVIPADEQDREL

SEQ ID NO: 211987 - protein, 25 aa, Mycobacterium bovis
VPLPSKWRIAFGEPICTADYASTDA

SEQ ID NO: 211988 - protein, 23 aa, Mycobacterium bovis
VPPGHKWARRSRVVSARELAQTP

SEQ ID NO: 211989 - protein, 19 aa, Mycobacterium bovis
VQDHVASVFRHEDLASALA

SEQ ID NO: 211990 - protein, 20 aa, Mycobacterium bovis
VQLIEPVAFCIGFEHPPTIR

SEQ ID NO: 211991 - protein, 17 aa, Mycobacterium bovis
VQLVLCAGAADTPEVAD

SEQ ID NO: 211992 - protein, 17 aa, Mycobacterium bovis
VRAARDYHNGILDGDAV

SEQ ID NO: 211993 - protein, 18 aa, Mycobacterium bovis
VRGGEGFFNRQEIKQALL

SEQ ID NO: 211994 - protein, 25 aa, Mycobacterium bovis
VRLAFVCAVDMPYLTVELIEDLARR

SEQ ID NO: 211995 - protein, 18 aa, Mycobacterium bovis
VRLLNMVPYFQANPRITR

SEQ ID NO: 211996 - protein, 23 aa, Mycobacterium bovis
VRQALRMRPDRIVVGEVRGAEVV

SEQ ID NO: 211997 - protein, 33 aa, Mycobacterium bovis
VRRCGMVSPTVFWPIPRVYSGLVRIDRYETSPW

SEQ ID NO: 211998 - protein, 18 aa, Mycobacterium bovis
VRRHLPNVALFHYADYQA

SEQ ID NO: 211999 - protein, 29 aa, Mycobacterium bovis
VRRLARLHTPLPLLAFTAWPEVRSQLAMT

SEQ ID NO: 212000 - protein, 23 aa, Mycobacterium bovis
VRSRRPGETASIFVPSVPNLLQL

SEQ ID NO: 212001 - protein, 24 aa, Mycobacterium bovis
VRSYELPTRVLLISAHDEPAIVYQ

SEQ ID NO: 212002 - protein, 17 aa, Mycobacterium bovis
VRVGRDVPGFIGNRLQH

SEQ ID NO: 212003 - protein, 24 aa, Mycobacterium bovis
VRVIRTLRRLGIRSVAVYSDPDVD

SEQ ID NO: 212004 - protein, 20 aa, Mycobacterium bovis
VSAAIAALFGAHAQAYQTIS

SEQ ID NO: 212005 - protein, 18 aa, Mycobacterium bovis
VSASRARAILSSRHIHRV

SEQ ID NO: 212006 - protein, 18 aa, Mycobacterium bovis
VSEVDIYDGLTINIGKPT

SEQ ID NO: 212007 - protein, 17 aa, Mycobacterium bovis
VSRSGWYGIDPVPADLF

SEQ ID NO: 212008 - protein, 23 aa, Mycobacterium bovis
VSTAAADAARIGSAINTANTAAA

SEQ ID NO: 212009 - protein, 21 aa, Mycobacterium bovis
VTADVTLTRAWCLRELGDDDA

SEQ ID NO: 212010 - protein, 17 aa, Mycobacterium bovis
VTDGKMFIIGRIKDLLI

SEQ ID NO: 212011 - protein, 20 aa, Mycobacterium bovis
VTPGATPWVTWGEFVETRML

SEQ ID NO: 212012 - protein, 29 aa, Mycobacterium bovis
VTTMAACIGGVFRECRPENVIAIDAVPSF

SEQ ID NO: 212013 - protein, 27 aa, Mycobacterium bovis
VTVGTATAALLMQATAGRVATAATAAW

SEQ ID NO: 212014 - protein, 17 aa, Mycobacterium bovis
VTVKTTWTGAGGVKGFF

SEQ ID NO: 212015 - protein, 23 aa, Mycobacterium bovis
VTYARIGERWRIGSDGLVLEVSA

SEQ ID NO: 212016 - protein, 23 aa, Mycobacterium bovis
VVCDPLRRLNRMHATPEESIRIV

SEQ ID NO: 212017 - protein, 24 aa, Mycobacterium bovis
VVFGRLQRHVAMIVVAQFAATLTD

SEQ ID NO: 212018 - protein, 21 aa, Mycobacterium bovis
VVGALKLGLTAPFNIDEVPNV

SEQ ID NO: 212019 - protein, 19 aa, Mycobacterium bovis
VVGCCRSVPHVQRVLSHLE

SEQ ID NO: 212020 - protein, 20 aa, Mycobacterium bovis
VVGGALAYLAVKTLINATQL

SEQ ID NO: 212021 - protein, 17 aa, Mycobacterium bovis
VVINPVLETSEIPETMP

SEQ ID NO: 212022 - protein, 21 aa, Mycobacterium bovis
VVYPRHGAALVEAIETRTIKG

SEQ ID NO: 212023 - protein, 24 aa, Mycobacterium bovis
VVYVCKACHGVAILADNIEPILYH

SEQ ID NO: 212024 - protein, 22 aa, Mycobacterium bovis
VWLAEELTRSWRVQWPELPDAM

SEQ ID NO: 212025 - protein, 19 aa, Mycobacterium bovis
VYLRKRCREHGSFEALVYG

SEQ ID NO: 212026 - protein, 22 aa, Mycobacterium bovis
VYYRVFGGWLRQRRNIRDMTKT

SEQ ID NO: 212027 - protein, 17 aa, Mycobacterium bovis
WAGTLIVVSHDRYLLER

SEQ ID NO: 212028 - protein, 20 aa, Mycobacterium bovis
WCRDRETFGRPLISRQSVQN

SEQ ID NO: 212029 - protein, 24 aa, Mycobacterium bovis
WDDLLRPGIEVITPSPLSSGSAKW

SEQ ID NO: 212030 - protein, 19 aa, Mycobacterium bovis
WDIEPDLTNAVAFLSAAVV

SEQ ID NO: 212031 - protein, 20 aa, Mycobacterium bovis
WDLPGRCNIRAMNYAINAHL

SEQ ID NO: 212032 - protein, 22 aa, Mycobacterium bovis
WEQVADWDFVCEQLAAAEPWWQ

SEQ ID NO: 212033 - protein, 19 aa, Mycobacterium bovis
WGVGIAPSITTASLRAVVS

SEQ ID NO: 212034 - protein, 35 aa, Mycobacterium bovis
WHLTAPLTLFGHCMGAIVAFEFARLAERNGVPVRA

SEQ ID NO: 212035 - protein, 21 aa, Mycobacterium bovis
WKDTAAPLWTFPRVAWERELL

SEQ ID NO: 212036 - protein, 19 aa, Mycobacterium bovis
WKTVSPHLSPISNMVSMAN

SEQ ID NO: 212037 - protein, 23 aa, Mycobacterium bovis
WLADHLRRRWARNTGGLLVVTHD

SEQ ID NO: 212038 - protein, 18 aa, Mycobacterium bovis
WLLQRRKRAERALTSVVA

SEQ ID NO: 212039 - protein, 19 aa, Mycobacterium bovis
WLRTADRGSWALADATVDP

SEQ ID NO: 212040 - protein, 21 aa, Mycobacterium bovis
WLSGQLGRPLSLIAETDRNDP

SEQ ID NO: 212041 - protein, 19 aa, Mycobacterium bovis
WNEGVKGAWVLARYDDGRP

SEQ ID NO: 212042 - protein, 17 aa, Mycobacterium bovis
WNLLAPYAAKSDGGRNN

SEQ ID NO: 212043 - protein, 17 aa, Mycobacterium bovis
WNPQRASSMPVNRYRPF

SEQ ID NO: 212044 - protein, 21 aa, Mycobacterium bovis
WPADDYRAGVVQTSFDKQFVR

SEQ ID NO: 212045 - protein, 30 aa, Mycobacterium bovis
WPADYGHYGPLFIRMAWHAAGTYRIHDGRG

SEQ ID NO: 212046 - protein, 21 aa, Mycobacterium bovis
WPATLDRVLAIGGPDASYVPG

SEQ ID NO: 212047 - protein, 25 aa, Mycobacterium bovis
WPTGPLPKVRVAAALPPPADYLTRI

SEQ ID NO: 212048 - protein, 17 aa, Mycobacterium bovis
WPTYPLMYRVSAAHEEG

SEQ ID NO: 212049 - protein, 21 aa, Mycobacterium bovis
WQQVLRNLGIDIGKNGQINLG

SEQ ID NO: 212050 - protein, 18 aa, Mycobacterium bovis
WQTYGDVVVRFEQSSNLH

SEQ ID NO: 212051 - protein, 17 aa, Mycobacterium bovis
WRASALAEMIQEAGLVP

SEQ ID NO: 212052 - protein, 17 aa, Mycobacterium bovis
WRRFKAAQDSFFTARNA

SEQ ID NO: 212053 - protein, 17 aa, Mycobacterium bovis
WRSSGGVIAARIPAAAY

SEQ ID NO: 212054 - protein, 21 aa, Mycobacterium bovis
WRTDFLNDMGLVIADSIKPFA

SEQ ID NO: 212055 - protein, 20 aa, Mycobacterium bovis
WRTSTRLPRDHYVRLDGNDY

SEQ ID NO: 212056 - protein, 18 aa, Mycobacterium bovis
WSGSWGNGRGRGCRCGRG

SEQ ID NO: 212057 - protein, 20 aa, Mycobacterium bovis
WSMPLIRPNGRMLAIKGERA

SEQ ID NO: 212058 - protein, 17 aa, Mycobacterium bovis
WSPTALRILGAAAELIA

SEQ ID NO: 212059 - protein, 17 aa, Mycobacterium bovis
WTFPRVAWERELLPGAQ

SEQ ID NO: 212060 - protein, 18 aa, Mycobacterium bovis
WVIDVDLWGSIHTVEAFL

SEQ ID NO: 212061 - protein, 18 aa, Mycobacterium bovis
WVLANRAYTPWYLVRYWR

SEQ ID NO: 212062 - protein, 22 aa, Mycobacterium bovis
YAEMWAQDAMAMYGYAGSSATA

SEQ ID NO: 212063 - protein, 23 aa, Mycobacterium bovis
YAFDKRRFWLSAEGSGADVSGLG

SEQ ID NO: 212064 - protein, 19 aa, Mycobacterium bovis
YAGGLTYNYNTYSTTVDFG

SEQ ID NO: 212065 - protein, 17 aa, Mycobacterium bovis
YCELDFTTPLELAVATI

SEQ ID NO: 212066 - protein, 23 aa, Mycobacterium bovis
YDDLKFSCGCREIRHFYHDGSMR

SEQ ID NO: 212067 - protein, 23 aa, Mycobacterium bovis
YDESACDAWIGRIRCGDTDRVTL

SEQ ID NO: 212068 - protein, 17 aa, Mycobacterium bovis
YEKFFRIGFKKQAEALG

SEQ ID NO: 212069 - protein, 20 aa, Mycobacterium bovis
YFRLLTRWVGGGFRVPGDDV

SEQ ID NO: 212070 - protein, 17 aa, Mycobacterium bovis
YGLIPRAHRGIVAVNEL

SEQ ID NO: 212071 - protein, 24 aa, Mycobacterium bovis
YGRSAACWARRLVFVNGHGGNVGA

SEQ ID NO: 212072 - protein, 18 aa, Mycobacterium bovis
YHLSRPAEALAWMCDRAV

SEQ ID NO: 212073 - protein, 18 aa, Mycobacterium bovis
YHQSLPLAEMLYARGSGL

SEQ ID NO: 212074 - protein, 19 aa, Mycobacterium bovis
YKFRPWRDVKVLADGASIR

SEQ ID NO: 212075 - protein, 20 aa, Mycobacterium bovis
YLVRYWRLLRFKLANPHIIT

SEQ ID NO: 212076 - protein, 19 aa, Mycobacterium bovis
YMKYLRGCEHYFTDEMLDC

SEQ ID NO: 212077 - protein, 22 aa, Mycobacterium bovis
YNHYPIGWAMAFNTPYKLFKRY

SEQ ID NO: 212078 - protein, 27 aa, Mycobacterium bovis
YPFASLPRRCVRLEGAEDLLATMAGER

SEQ ID NO: 212079 - protein, 18 aa, Mycobacterium bovis
YPKIKQWLSQVLGNFPVY

SEQ ID NO: 212080 - protein, 18 aa, Mycobacterium bovis
YPVEGGGNQDWWPNRLNL

SEQ ID NO: 212081 - protein, 18 aa, Mycobacterium bovis
YQEVITMHECRSAKQLAT

SEQ ID NO: 212082 - protein, 20 aa, Mycobacterium bovis
YQPWLDRLLGMSWDDSEHRK

SEQ ID NO: 212083 - protein, 29 aa, Mycobacterium bovis
YRIGREIGCKLVSFGSGAHFCLGAHLARM

SEQ ID NO: 212084 - protein, 20 aa, Mycobacterium bovis
YRLAARLVEIGVDNATVSRT

SEQ ID NO: 212085 - protein, 17 aa, Mycobacterium bovis
YRLRAVSAVGLRFPLNG

SEQ ID NO: 212086 - protein, 19 aa, Mycobacterium bovis
YRLRAVSAVGLRFPLNGTA

SEQ ID NO: 212087 - protein, 17 aa, Mycobacterium bovis
YRTVRIGAHQARILLAK

SEQ ID NO: 212088 - protein, 19 aa, Mycobacterium bovis
YRVFAELSPHPLLTHAVEQ

SEQ ID NO: 212089 - protein, 22 aa, Mycobacterium bovis
YTVQAQKLWAQAGFRPVDPAVA

SEQ ID NO: 212090 - protein, 22 aa, Mycobacterium bovis
YVHSAPWALPALGLENVSHGCI

SEQ ID NO: 212091 - protein, 17 aa, Mycobacterium bovis
YVRAMRQKRSWRNTEPA

SEQ ID NO: 212092 - protein, 24 aa, Mycobacterium bovis
YVVEKRFNLSWSIEGTRSRTGKML

SEQ ID NO: 212093 - protein, 17 aa, Mycobacterium bovis
YWLAPSGFTRAPQNSVD

SEQ ID NO: 212094 - protein, 21 aa, Mycobacterium bovis
ATPKPSWPWVRTLLHSIYDQP

SEQ ID NO: 212095 - protein, 19 aa, Mycobacterium bovis
PKLRQGSYFPDWLLQRRKR

SEQ ID NO: 212096 - protein, 17 aa, Mycobacterium bovis
NTGRPLIGNGANGAPGT

SEQ ID NO: 212097 - protein, 18 aa, Mycobacterium bovis
APVAPGLALPRLVRSRIV

SEQ ID NO: 212098 - protein, 20 aa, Mycobacterium bovis
DGAPGGWLIGNGGAGGSGAA

SEQ ID NO: 212099 - protein, 22 aa, Mycobacterium bovis
FDNWPLGWGFDHFWGFPSGAAG

SEQ ID NO: 212100 - protein, 18 aa, Mycobacterium bovis
GARHCARLRGAIVGKSKS

SEQ ID NO: 212101 - protein, 21 aa, Mycobacterium bovis
GGAGMNSLDPLLAAQDGGQGG

SEQ ID NO: 212102 - protein, 20 aa, Mycobacterium bovis
LSPGLKRSSLIGGIRYYDTV

SEQ ID NO: 212103 - protein, 18 aa, Mycobacterium bovis
RDHIAGAIKLDWRTDLQD

SEQ ID NO: 212104 - protein, 20 aa, Mycobacterium bovis
RHLLSVLIDREWRHGVRVGV

SEQ ID NO: 212105 - protein, 18 aa, Mycobacterium bovis
VLIDREWRHGVRVGVETA

SEQ ID NO: 212106 - protein, 19 aa, Mycobacterium bovis
AALRCLKRRLARTVFQALR

SEQ ID NO: 212107 - protein, 21 aa, Mycobacterium bovis
AGTGWLPGWRLTFGGEDIGWE

SEQ ID NO: 212108 - protein, 22 aa, Mycobacterium bovis
ALGELFAYRWSRCGGREEWVMD

SEQ ID NO: 212109 - protein, 18 aa, Mycobacterium bovis
ALLFPSLCHFSGGIPAPE

SEQ ID NO: 212110 - protein, 18 aa, Mycobacterium bovis
EQFSCWRIKLPHVEAAKF

SEQ ID NO: 212111 - protein, 17 aa, Mycobacterium bovis
FPSLCHFSGGIPAPEAD

SEQ ID NO: 212112 - protein, 18 aa, Mycobacterium bovis
GTAMDRFRWLVAAQGGDL

SEQ ID NO: 212113 - protein, 17 aa, Mycobacterium bovis
LAAWRLGAGRSRPGARV

SEQ ID NO: 212114 - protein, 18 aa, Mycobacterium bovis
QMSALLMAIVWRGMDRGE

SEQ ID NO: 212115 - protein, 18 aa, Mycobacterium bovis
STAIAALFGSHGQHYQAI

SEQ ID NO: 212116 - protein, 18 aa, Mycobacterium bovis
TLTGRPLIGNGANGTPGT

SEQ ID NO: 212117 - protein, 22 aa, Mycobacterium bovis
APARAYNPLFIWGESGLGKTHL

SEQ ID NO: 212118 - protein, 17 aa, Mycobacterium bovis
ARFSRPLAFGTAGLRGH

SEQ ID NO: 212119 - protein, 17 aa, Mycobacterium bovis
AVADLFAAFGMLPVGYY

SEQ ID NO: 212120 - protein, 18 aa, Mycobacterium bovis
AVVLRATWAVARVLTDRG

SEQ ID NO: 212121 - protein, 19 aa, Mycobacterium bovis
CWRIKLPHVEAAKFDAALQ

SEQ ID NO: 212122 - protein, 19 aa, Mycobacterium bovis
DELKARFSRPLAFGTAGLR

SEQ ID NO: 212123 - protein, 20 aa, Mycobacterium bovis
EDRLRTRFEWGLITDVQPPE

SEQ ID NO: 212124 - protein, 21 aa, Mycobacterium bovis
EGFGWPWSVCRWVAGENPSAA

SEQ ID NO: 212125 - protein, 21 aa, Mycobacterium bovis
EKEAWLSMVMLEWGSCGQVAT

SEQ ID NO: 212126 - protein, 22 aa, Mycobacterium bovis
EVPMKRFDLMNGIQVRGTYAVS

SEQ ID NO: 212127 - protein, 18 aa, Mycobacterium bovis
FMGGFALWVDEQRHLHHT

SEQ ID NO: 212128 - protein, 17 aa, Mycobacterium bovis
GAMARLGVWSGDGLQLD

SEQ ID NO: 212129 - protein, 17 aa, Mycobacterium bovis
GPCKMVAPVLEEIATER

SEQ ID NO: 212130 - protein, 17 aa, Mycobacterium bovis
GQLRARFAAGLSAMYAA

SEQ ID NO: 212131 - protein, 18 aa, Mycobacterium bovis
GRGSIRMRGVVEVEEDSR

SEQ ID NO: 212132 - protein, 18 aa, Mycobacterium bovis
IEAIKLVALVADRGAQVR

SEQ ID NO: 212133 - protein, 17 aa, Mycobacterium bovis
LADLSFADYLMWVRRND

SEQ ID NO: 212134 - protein, 23 aa, Mycobacterium bovis
LPLPQRRFGGVVGRTMAESVGDW

SEQ ID NO: 212135 - protein, 18 aa, Mycobacterium bovis
LREDPPRRLAGFPATVTD

SEQ ID NO: 212136 - protein, 17 aa, Mycobacterium bovis
PAIAAVRAEYERVVRQR

SEQ ID NO: 212137 - protein, 25 aa, Mycobacterium bovis
PHSERLFCIPATIDLAGAEIELVSM

SEQ ID NO: 212138 - protein, 20 aa, Mycobacterium bovis
RCAVGIPTVSGWRMLSGDET

SEQ ID NO: 212139 - protein, 20 aa, Mycobacterium bovis
RGDIKIALFGNHAPKTVANF

SEQ ID NO: 212140 - protein, 19 aa, Mycobacterium bovis
RGVLFPKHRTDLLGCAVSV

SEQ ID NO: 212141 - protein, 23 aa, Mycobacterium bovis
RPRSCAALPRILRDNGYVTGAFG

SEQ ID NO: 212142 - protein, 19 aa, Mycobacterium bovis
RSAFVQLVLSNVFGQNAPA

SEQ ID NO: 212143 - protein, 18 aa, Mycobacterium bovis
SGLGYPASTPVLGAQPID

SEQ ID NO: 212144 - protein, 26 aa, Mycobacterium bovis
SRSSPRAGDGFIRLDVDGVVSYASPN

SEQ ID NO: 212145 - protein, 23 aa, Mycobacterium bovis
STLLLTLLFRFMRPLIENGHVFL

SEQ ID NO: 212146 - protein, 21 aa, Mycobacterium bovis
TEPKLKCYLEIRCAVTGDLPA

SEQ ID NO: 212147 - protein, 24 aa, Mycobacterium bovis
TGVWSRLMLDIARWRRRRREELAA

SEQ ID NO: 212148 - protein, 19 aa, Mycobacterium bovis
VGPRVARRFGRVLLELGGN

SEQ ID NO: 212149 - protein, 22 aa, Mycobacterium bovis
VKGPDFPTAGLIVGSQGTADAY

SEQ ID NO: 212150 - protein, 18 aa, Mycobacterium bovis
WATWCGPCKMVAPVLEEI

SEQ ID NO: 212151 - protein, 18 aa, Mycobacterium bovis
WLAFTFELCRQRIMDPST

SEQ ID NO: 212152 - protein, 17 aa, Mycobacterium bovis
AAAAGFPRPILHGLCTY

SEQ ID NO: 212153 - protein, 19 aa, Mycobacterium bovis
AAACLRKTDWLFPQYRELG

SEQ ID NO: 212154 - protein, 21 aa, Mycobacterium bovis
AAAGRPWWEWAATHERAFTAA

SEQ ID NO: 212155 - protein, 19 aa, Mycobacterium bovis
AAALARQGSFLGYRVTVCD

SEQ ID NO: 212156 - protein, 18 aa, Mycobacterium bovis
AAALPEYMLPAAYVVLDE

SEQ ID NO: 212157 - protein, 36 aa, Mycobacterium bovis
AAAQVAAFHSRFVQALTAGAGAYAFAEAANASPLQS

SEQ ID NO: 212158 - protein, 28 aa, Mycobacterium bovis
AAATPGWLEWFINWYLPISQLFYNTVGL

SEQ ID NO: 212159 - protein, 19 aa, Mycobacterium bovis
AAAVPVVFLTAWYGLADLA

SEQ ID NO: 212160 - protein, 29 aa, Mycobacterium bovis
AADEVSTAVAALFSQHAQGYQAAAAQVAA

SEQ ID NO: 212161 - protein, 20 aa, Mycobacterium bovis
AADGSFEWRLRPSAPGQLVI

SEQ ID NO: 212162 - protein, 18 aa, Mycobacterium bovis
AADRCGRLALPRRTHVSV

SEQ ID NO: 212163 - protein, 18 aa, Mycobacterium bovis
AAEARYAEMWAQDAAAMY

SEQ ID NO: 212164 - protein, 24 aa, Mycobacterium bovis
AAGFDIASLWPVKPLLSLSALETH

SEQ ID NO: 212165 - protein, 26 aa, Mycobacterium bovis
AAGGNGGNGGWLFGAGGTGGIGGTGA

SEQ ID NO: 212166 - protein, 19 aa, Mycobacterium bovis
AAGRAAPRLTVWVPVAVNP

SEQ ID NO: 212167 - protein, 24 aa, Mycobacterium bovis
AAGRASGVLPRYGVRLTVMAHPPA

SEQ ID NO: 212168 - protein, 17 aa, Mycobacterium bovis
AAHARFVAAAAKVNTLL

SEQ ID NO: 212169 - protein, 18 aa, Mycobacterium bovis
AAILASIAFHTRVTADDV

SEQ ID NO: 212170 - protein, 22 aa, Mycobacterium bovis
AAKDWLCLLEAFDAPQRSGLVR

SEQ ID NO: 212171 - protein, 21 aa, Mycobacterium bovis
AALGLICPWADLAVDIEATRP

SEQ ID NO: 212172 - protein, 18 aa, Mycobacterium bovis
AALPFKRRLFGQIVAAAV

SEQ ID NO: 212173 - protein, 19 aa, Mycobacterium bovis
AAMALRIGVAVAHRDRDYE

SEQ ID NO: 212174 - protein, 17 aa, Mycobacterium bovis
AARLGLAGWPRAAEESI

SEQ ID NO: 212175 - protein, 20 aa, Mycobacterium bovis
AARLKGYRLICVMPENTSVE

SEQ ID NO: 212176 - protein, 21 aa, Mycobacterium bovis
AARLRLPIDVIATVPMAENMP

SEQ ID NO: 212177 - protein, 20 aa, Mycobacterium bovis
AARMWARLRIHLAESGRRVR

SEQ ID NO: 212178 - protein, 22 aa, Mycobacterium bovis
AARRFPVPIAMFAELIDGARME

SEQ ID NO: 212179 - protein, 21 aa, Mycobacterium bovis
AASARGSLRLSLGHTSVEADV

SEQ ID NO: 212180 - protein, 18 aa, Mycobacterium bovis
AATHAALWAVDEAVNRDI

SEQ ID NO: 212181 - protein, 17 aa, Mycobacterium bovis
AAYAMRWVAKNVVAAGL

SEQ ID NO: 212182 - protein, 19 aa, Mycobacterium bovis
AAYQERFVLALSQAGSTYA

SEQ ID NO: 212183 - protein, 17 aa, Mycobacterium bovis
AAYQERFVLALSQASST

SEQ ID NO: 212184 - protein, 17 aa, Mycobacterium bovis
ACIKAAADRVVFINTGF

SEQ ID NO: 212185 - protein, 17 aa, Mycobacterium bovis
ACRQCLVEVEGQRKPLA

SEQ ID NO: 212186 - protein, 23 aa, Mycobacterium bovis
ACSSSLVAIHWAMSSLRSGECDL

SEQ ID NO: 212187 - protein, 22 aa, Mycobacterium bovis
ACTLRGWLGMWSLRVAQTRAAP

SEQ ID NO: 212188 - protein, 19 aa, Mycobacterium bovis
ADAFRSWRLLVSKYGTQAP

SEQ ID NO: 212189 - protein, 28 aa, Mycobacterium bovis
ADALALAICHCWRAPTIARMAEATSRAE

SEQ ID NO: 212190 - protein, 17 aa, Mycobacterium bovis
ADEIAELLLKWKKTPQR

SEQ ID NO: 212191 - protein, 19 aa, Mycobacterium bovis
ADEIVRWATPVTAFQRTAL

SEQ ID NO: 212192 - protein, 20 aa, Mycobacterium bovis
ADELGCRSLALVAFGTGVGG

SEQ ID NO: 212193 - protein, 23 aa, Mycobacterium bovis
ADEVSVAISALFGSHAQGYQTLS

SEQ ID NO: 212194 - protein, 24 aa, Mycobacterium bovis
ADEVSVAVAALFGTHAQEYQTVSA

SEQ ID NO: 212195 - protein, 18 aa, Mycobacterium bovis
ADFGELRWRDGVAVTVVL

SEQ ID NO: 212196 - protein, 22 aa, Mycobacterium bovis
ADGKRSGLWPGLRETFKSGSSQ

SEQ ID NO: 212197 - protein, 21 aa, Mycobacterium bovis
ADGPPAWLRFFGCNPRHHSLA

SEQ ID NO: 212198 - protein, 20 aa, Mycobacterium bovis
ADHARLDFLAGLRVVPAELG

SEQ ID NO: 212199 - protein, 17 aa, Mycobacterium bovis
ADIEACWNLGATVAAQL

SEQ ID NO: 212200 - protein, 19 aa, Mycobacterium bovis
ADLLPGCAGLRVVESVYGH

SEQ ID NO: 212201 - protein, 21 aa, Mycobacterium bovis
ADLPPAVGVLVEYRGDDAAAA

SEQ ID NO: 212202 - protein, 20 aa, Mycobacterium bovis
ADLRQDWPAALRDAGFDPTA

SEQ ID NO: 212203 - protein, 23 aa, Mycobacterium bovis
ADSGLRTSVQFVGPLSVVDSALA

SEQ ID NO: 212204 - protein, 19 aa, Mycobacterium bovis
ADWPRLVAPVFDPKKAVVF

SEQ ID NO: 212205 - protein, 18 aa, Mycobacterium bovis
ADYRGRRVIVYFYPAAST

SEQ ID NO: 212206 - protein, 19 aa, Mycobacterium bovis
AEAGWPVRVWAAALPQQTT

SEQ ID NO: 212207 - protein, 21 aa, Mycobacterium bovis
AEAIRRFGPIFAQYYGQSEAP

SEQ ID NO: 212208 - protein, 23 aa, Mycobacterium bovis
AEAKARRGPLCLGIDPHPELLRG

SEQ ID NO: 212209 - protein, 22 aa, Mycobacterium bovis
AEAYRAISLLLRRPPGREAYPG

SEQ ID NO: 212210 - protein, 23 aa, Mycobacterium bovis
AEDPRVAGLIARVQLPPSPAGAV

SEQ ID NO: 212211 - protein, 17 aa, Mycobacterium bovis
AEELPLLGSCTFKAAGH

SEQ ID NO: 212212 - protein, 18 aa, Mycobacterium bovis
AEEMLYLAMEDFRVDVVV

SEQ ID NO: 212213 - protein, 26 aa, Mycobacterium bovis
AEGFLPALLDWCRKNHVVFIADEVQT

SEQ ID NO: 212214 - protein, 17 aa, Mycobacterium bovis
AEGFSWTPVHTMAGPDT

SEQ ID NO: 212215 - protein, 18 aa, Mycobacterium bovis
AEGVACYQLFISGLLDVT

SEQ ID NO: 212216 - protein, 19 aa, Mycobacterium bovis
AEHPRPDYVLLHISDTHLI

SEQ ID NO: 212217 - protein, 18 aa, Mycobacterium bovis
AEIARLALFLTTPAARHI

SEQ ID NO: 212218 - protein, 17 aa, Mycobacterium bovis
AEIPLLVVITEGIPVQD

SEQ ID NO: 212219 - protein, 22 aa, Mycobacterium bovis
AELGERCAFGLQLIAPRLPPFD

SEQ ID NO: 212220 - protein, 24 aa, Mycobacterium bovis
AELGPWRWAPTFAFIDQQAAEVHW

SEQ ID NO: 212221 - protein, 18 aa, Mycobacterium bovis
AELLVRYRVGVQAVQTVE

SEQ ID NO: 212222 - protein, 17 aa, Mycobacterium bovis
AELLYRAGLPRALYAIV

SEQ ID NO: 212223 - protein, 21 aa, Mycobacterium bovis
AELRIAQAQLVGWLEGLFHGI

SEQ ID NO: 212224 - protein, 21 aa, Mycobacterium bovis
AELVRRLSVVHGRVTLSSGRE

SEQ ID NO: 212225 - protein, 17 aa, Mycobacterium bovis
AEMTVALLLAVARHLIP

SEQ ID NO: 212226 - protein, 28 aa, Mycobacterium bovis
AEPALPRLLRRLVIMGGMFDGQPITEWN

SEQ ID NO: 212227 - protein, 19 aa, Mycobacterium bovis
AEPKWVLAMGVCASSGGMF

SEQ ID NO: 212228 - protein, 21 aa, Mycobacterium bovis
AEPPCAQLAALVRCVGPVEAA

SEQ ID NO: 212229 - protein, 18 aa, Mycobacterium bovis
AETGIIYIDEVDKIARKS

SEQ ID NO: 212230 - protein, 21 aa, Mycobacterium bovis
AEVWRRGSVIGSWLLDLTAIA

SEQ ID NO: 212231 - protein, 17 aa, Mycobacterium bovis
AEYFVWFKGEYDVDDTD

SEQ ID NO: 212232 - protein, 20 aa, Mycobacterium bovis
AFAFAGGRLGYLIATPAVID

SEQ ID NO: 212233 - protein, 19 aa, Mycobacterium bovis
AFILPPSIFHWLNYSVTAY

SEQ ID NO: 212234 - protein, 18 aa, Mycobacterium bovis
AFPRLSVIRAPRHDRVVG

SEQ ID NO: 212235 - protein, 18 aa, Mycobacterium bovis
AGALCLPDAAMLVAARGR

SEQ ID NO: 212236 - protein, 25 aa, Mycobacterium bovis
AGAVVSPVWPAPRALGLRAVAATAT

SEQ ID NO: 212237 - protein, 18 aa, Mycobacterium bovis
AGCGVCPGCEPMIQSCAS

SEQ ID NO: 212238 - protein, 18 aa, Mycobacterium bovis
AGDAIACALELQLSTLAP

SEQ ID NO: 212239 - protein, 18 aa, Mycobacterium bovis
AGFYASICNAVWDGNVSL

SEQ ID NO: 212240 - protein, 20 aa, Mycobacterium bovis
AGGAGGWLIGQSGSTGGGGA

SEQ ID NO: 212241 - protein, 21 aa, Mycobacterium bovis
AGGAGGWLWGNGGAGGNGGVG

SEQ ID NO: 212242 - protein, 17 aa, Mycobacterium bovis
AGGCPHPLVVVAGAATR

SEQ ID NO: 212243 - protein, 23 aa, Mycobacterium bovis
AGGDRAGALVGRDGGPGGNGGAG

SEQ ID NO: 212244 - protein, 17 aa, Mycobacterium bovis
AGGFGVLGAVGFTPEQL

SEQ ID NO: 212245 - protein, 18 aa, Mycobacterium bovis
AGGFTLDGLGGWFIDGVQ

SEQ ID NO: 212246 - protein, 18 aa, Mycobacterium bovis
AGGGGWVGAVNFGPISVQ

SEQ ID NO: 212247 - protein, 17 aa, Mycobacterium bovis
AGGKGWDGGPIGNGQVG

SEQ ID NO: 212248 - protein, 20 aa, Mycobacterium bovis
AGGMGIPAFYTPAGVGTQVA

SEQ ID NO: 212249 - protein, 23 aa, Mycobacterium bovis
AGGNGGRGGMLIGNGGAGGAGGT

SEQ ID NO: 212250 - protein, 23 aa, Mycobacterium bovis
AGGRGGAGGLGFGSEAPGRPGGA

SEQ ID NO: 212251 - protein, 17 aa, Mycobacterium bovis
AGGRGGDAGLLFGAAGT

SEQ ID NO: 212252 - protein, 24 aa, Mycobacterium bovis
AGHYTLRAAIDWQQHKPNGSHVVN

SEQ ID NO: 212253 - protein, 17 aa, Mycobacterium bovis
AGIAALFSAHAQEYQAL

SEQ ID NO: 212254 - protein, 19 aa, Mycobacterium bovis
AGLGGCGGGAFTAGVTTGG

SEQ ID NO: 212255 - protein, 17 aa, Mycobacterium bovis
AGLKLLAFRGRFVEIGK

SEQ ID NO: 212256 - protein, 18 aa, Mycobacterium bovis
AGLVGKLSVPQGWTVAAP

SEQ ID NO: 212257 - protein, 17 aa, Mycobacterium bovis
AGNWRYLADYAIGATLA

SEQ ID NO: 212258 - protein, 19 aa, Mycobacterium bovis
AGPALACGNAFVLKPSERD

SEQ ID NO: 212259 - protein, 17 aa, Mycobacterium bovis
AGSIGFNASAPGAAGSP

SEQ ID NO: 212260 - protein, 18 aa, Mycobacterium bovis
AGVLRFVVLDGLAKPGRM

SEQ ID NO: 212261 - protein, 24 aa, Mycobacterium bovis
AGVRALRDGVVWRIAAETFTDMLE

SEQ ID NO: 212262 - protein, 20 aa, Mycobacterium bovis
AGWSGVRWRNLTGGIVALHA

SEQ ID NO: 212263 - protein, 23 aa, Mycobacterium bovis
AGYRAVHVWLRLPAGRVEIQIRT

SEQ ID NO: 212264 - protein, 20 aa, Mycobacterium bovis
AHAAWLWSRRRAVVAGNSAA

SEQ ID NO: 212265 - protein, 19 aa, Mycobacterium bovis
AHLLPVFRLRYLPTPLGLH

SEQ ID NO: 212266 - protein, 17 aa, Mycobacterium bovis
AHLRPGQLVLIHGGASG

SEQ ID NO: 212267 - protein, 18 aa, Mycobacterium bovis
AHRPRPGYLPVLRAYDYA

SEQ ID NO: 212268 - protein, 23 aa, Mycobacterium bovis
AHTQLAWVLGCFTGFGQASRMTQ

SEQ ID NO: 212269 - protein, 18 aa, Mycobacterium bovis
AIGGGLCLALAADIRVAS

SEQ ID NO: 212270 - protein, 17 aa, Mycobacterium bovis
AIGRGGWFIGTGGMATI

SEQ ID NO: 212271 - protein, 19 aa, Mycobacterium bovis
AIHRFPGSMAKRIQALAQI

SEQ ID NO: 212272 - protein, 22 aa, Mycobacterium bovis
AIKRVLPGLGYRLTSRGVRVAT

SEQ ID NO: 212273 - protein, 17 aa, Mycobacterium bovis
AILPLYYLRRAGIAESD

SEQ ID NO: 212274 - protein, 19 aa, Mycobacterium bovis
AIPRRWRSPAPLWGDTSFH

SEQ ID NO: 212275 - protein, 19 aa, Mycobacterium bovis
AIRAFRAAYELGVGTVAVY

SEQ ID NO: 212276 - protein, 18 aa, Mycobacterium bovis
AIRPEFSANVAIDSFTVP

SEQ ID NO: 212277 - protein, 22 aa, Mycobacterium bovis
AITRPRWLWKFAKTLRPPDLRV

SEQ ID NO: 212278 - protein, 17 aa, Mycobacterium bovis
AIVASSWHGKICDALLD

SEQ ID NO: 212279 - protein, 20 aa, Mycobacterium bovis
AIVKGLRTGTDFEYELQMAQ

SEQ ID NO: 212280 - protein, 23 aa, Mycobacterium bovis
AKAAPLWRVLVALSIRHVGPTAA

SEQ ID NO: 212281 - protein, 18 aa, Mycobacterium bovis
AKACARIMLGATIAQLRA

SEQ ID NO: 212282 - protein, 19 aa, Mycobacterium bovis
AKALWLRSRRRGVLAGYSA

SEQ ID NO: 212283 - protein, 21 aa, Mycobacterium bovis
AKGEMRWQFHHVIDVAPTILE

SEQ ID NO: 212284 - protein, 18 aa, Mycobacterium bovis
AKGSLRGGLVLGLEDSSS

SEQ ID NO: 212285 - protein, 17 aa, Mycobacterium bovis
AKHAQGLNVRWWSPQQV

SEQ ID NO: 212286 - protein, 17 aa, Mycobacterium bovis
AKIALPGTEVWAIDGDG

SEQ ID NO: 212287 - protein, 17 aa, Mycobacterium bovis
AKLACDWFIDHLCGPGP

SEQ ID NO: 212288 - protein, 21 aa, Mycobacterium bovis
AKLDVIVPMSFLCDGYGLNVT

SEQ ID NO: 212289 - protein, 18 aa, Mycobacterium bovis
AKLGFPQRDPHGAPIPGA

SEQ ID NO: 212290 - protein, 17 aa, Mycobacterium bovis
AKLRLAVLAGRLRAAGV

SEQ ID NO: 212291 - protein, 17 aa, Mycobacterium bovis
AKQRGHRGLAYVLVAED

SEQ ID NO: 212292 - protein, 19 aa, Mycobacterium bovis
AKTTFGRIGVKVWIYKGDI

SEQ ID NO: 212293 - protein, 17 aa, Mycobacterium bovis
ALAECLGQLLGGQHESS

SEQ ID NO: 212294 - protein, 17 aa, Mycobacterium bovis
ALAGFGLTEPGAGSDAG

SEQ ID NO: 212295 - protein, 19 aa, Mycobacterium bovis
ALAGKSGFGGFGGLLLGAD

SEQ ID NO: 212296 - protein, 23 aa, Mycobacterium bovis
ALARARRALNEFGVEGLATVIPF

SEQ ID NO: 212297 - protein, 22 aa, Mycobacterium bovis
ALCARFRISGLPVVDDDGALVG

SEQ ID NO: 212298 - protein, 22 aa, Mycobacterium bovis
ALCRAAGVPARIAFQTIDAPDK

SEQ ID NO: 212299 - protein, 20 aa, Mycobacterium bovis
ALDDVVKFLLPRGSTRKAAK

SEQ ID NO: 212300 - protein, 22 aa, Mycobacterium bovis
ALDGAGLGTVWGRQLATSMLAD

SEQ ID NO: 212301 - protein, 18 aa, Mycobacterium bovis
ALFGRPLIGNGANGTAAS

SEQ ID NO: 212302 - protein, 23 aa, Mycobacterium bovis
ALGCTIKLLSICERITTDEGSQR

SEQ ID NO: 212303 - protein, 19 aa, Mycobacterium bovis
ALGVTHFSVGPIIVPRIAG

SEQ ID NO: 212304 - protein, 19 aa, Mycobacterium bovis
ALHEVVGWWAKLPVTGMQP

SEQ ID NO: 212305 - protein, 19 aa, Mycobacterium bovis
ALIELCGLLGYDARRDTDP

SEQ ID NO: 212306 - protein, 18 aa, Mycobacterium bovis
ALLGRPLIGNGANGAPGT

SEQ ID NO: 212307 - protein, 19 aa, Mycobacterium bovis
ALLGRPLIGNGANGAPGTG

SEQ ID NO: 212308 - protein, 24 aa, Mycobacterium bovis
ALPNGRYGWRISLPAMVCYWSELA

SEQ ID NO: 212309 - protein, 18 aa, Mycobacterium bovis
ALQGLALPTASQSASATP

SEQ ID NO: 212310 - protein, 22 aa, Mycobacterium bovis
ALRGQHSWAAAIPWSDIQKYWM

SEQ ID NO: 212311 - protein, 22 aa, Mycobacterium bovis
ALSTARFEFRWNDQFALSLDPD

SEQ ID NO: 212312 - protein, 20 aa, Mycobacterium bovis
ALVDRWAPGRVMLNAYGPTE

SEQ ID NO: 212313 - protein, 20 aa, Mycobacterium bovis
ALVTLDWLGAHGFGRLLQHT

SEQ ID NO: 212314 - protein, 21 aa, Mycobacterium bovis
ALWTGDYHGLVGFSFSIDIAG

SEQ ID NO: 212315 - protein, 17 aa, Mycobacterium bovis
ALYRLLMSWGVRPGLVL

SEQ ID NO: 212316 - protein, 19 aa, Mycobacterium bovis
AMDAFGLLCRMEGIIPAIE

SEQ ID NO: 212317 - protein, 20 aa, Mycobacterium bovis
AMFDGRFVGFADFLIRDGHR

SEQ ID NO: 212318 - protein, 24 aa, Mycobacterium bovis
AMSKFEVLTAMAFAAFADAPVDVA

SEQ ID NO: 212319 - protein, 23 aa, Mycobacterium bovis
AMVCAARGYRCVLTMPETMSLER

SEQ ID NO: 212320 - protein, 19 aa, Mycobacterium bovis
ANALRSWSVLRFEVTEDPS

SEQ ID NO: 212321 - protein, 18 aa, Mycobacterium bovis
ANAMSWFWYLMALNPQAR

SEQ ID NO: 212322 - protein, 19 aa, Mycobacterium bovis
ANGDPGFAGGKGGNGGIGG

SEQ ID NO: 212323 - protein, 18 aa, Mycobacterium bovis
ANLRLVVSLAKRYTGRGM

SEQ ID NO: 212324 - protein, 18 aa, Mycobacterium bovis
ANMWALRALGVRRVFGPC

SEQ ID NO: 212325 - protein, 17 aa, Mycobacterium bovis
APAALGLICPWADLAVD

SEQ ID NO: 212326 - protein, 23 aa, Mycobacterium bovis
APERLRSGWLNGIKHWQVDYTGR

SEQ ID NO: 212327 - protein, 17 aa, Mycobacterium bovis
APGGFNFDAWRFENRCE

SEQ ID NO: 212328 - protein, 18 aa, Mycobacterium bovis
APKGWGWVAPYIGMIWPN

SEQ ID NO: 212329 - protein, 20 aa, Mycobacterium bovis
APMFHAWGFSQLVLASSLAC

SEQ ID NO: 212330 - protein, 17 aa, Mycobacterium bovis
APRLTVWVPVAVNPGAA

SEQ ID NO: 212331 - protein, 21 aa, Mycobacterium bovis
APRPRMLVFGAIDFAAALARQ

SEQ ID NO: 212332 - protein, 25 aa, Mycobacterium bovis
APSRSLPLLECWTALAALSRDTTKL

SEQ ID NO: 212333 - protein, 20 aa, Mycobacterium bovis
APSSGIGIVEGWRGTIVHRV

SEQ ID NO: 212334 - protein, 20 aa, Mycobacterium bovis
APVDGCIRIGLRYINEIRAS

SEQ ID NO: 212335 - protein, 17 aa, Mycobacterium bovis
APVKIFLTASAETRARR

SEQ ID NO: 212336 - protein, 17 aa, Mycobacterium bovis
APVVLGWAGFRDVAQRY

SEQ ID NO: 212337 - protein, 19 aa, Mycobacterium bovis
APYNDIVSWNWTELPSALG

SEQ ID NO: 212338 - protein, 17 aa, Mycobacterium bovis
AQAAAFHHSFVQTLNAA

SEQ ID NO: 212339 - protein, 19 aa, Mycobacterium bovis
AQAAWLWSRRRGVIAGQSA

SEQ ID NO: 212340 - protein, 18 aa, Mycobacterium bovis
AQAIRFAKEFARNATESG

SEQ ID NO: 212341 - protein, 20 aa, Mycobacterium bovis
AQEWLRFGWFFLVTRRDPKG

SEQ ID NO: 212342 - protein, 17 aa, Mycobacterium bovis
AQFPFDIIPTLLQGLAT

SEQ ID NO: 212343 - protein, 17 aa, Mycobacterium bovis
AQILAGFCDVALVIGAD

SEQ ID NO: 212344 - protein, 17 aa, Mycobacterium bovis
AQLCERAELAAHWLSHG

SEQ ID NO: 212345 - protein, 22 aa, Mycobacterium bovis
AQLLERFGMFGIRMSIAVLAAG

SEQ ID NO: 212346 - protein, 20 aa, Mycobacterium bovis
AQLVMSNWFGLNAPLIAAVE

SEQ ID NO: 212347 - protein, 24 aa, Mycobacterium bovis
AQRLAEACGLDLVALGKVVRHSDS

SEQ ID NO: 212348 - protein, 17 aa, Mycobacterium bovis
AQVALAWLISLPGVVAI

SEQ ID NO: 212349 - protein, 18 aa, Mycobacterium bovis
AQVAVRWAARDAELRKIP

SEQ ID NO: 212350 - protein, 25 aa, Mycobacterium bovis
AQVVPWASLLQRFPGLGAGATGATG

SEQ ID NO: 212351 - protein, 18 aa, Mycobacterium bovis
AQYSQWGALLARTDPSAP

SEQ ID NO: 212352 - protein, 20 aa, Mycobacterium bovis
ARAALQRWSLMRSDHPVTSV

SEQ ID NO: 212353 - protein, 19 aa, Mycobacterium bovis
ARAFGLPIVEVIAGGNISE

SEQ ID NO: 212354 - protein, 17 aa, Mycobacterium bovis
ARCALAWSVQTAALARE

SEQ ID NO: 212355 - protein, 19 aa, Mycobacterium bovis
AREALAWGLISAVYPDSDF

SEQ ID NO: 212356 - protein, 18 aa, Mycobacterium bovis
ARGCAKWLASEDFSQAID

SEQ ID NO: 212357 - protein, 18 aa, Mycobacterium bovis
ARGKIAMLAKVRRAPALI

SEQ ID NO: 212358 - protein, 19 aa, Mycobacterium bovis
ARGLFPRHLDTIVNVPAPS

SEQ ID NO: 212359 - protein, 20 aa, Mycobacterium bovis
ARGPAVVEFNCRFGDPETQA

SEQ ID NO: 212360 - protein, 18 aa, Mycobacterium bovis
ARHLDCWVLGTVCKGGKQ

SEQ ID NO: 212361 - protein, 18 aa, Mycobacterium bovis
ARIEFKLRDWLFARQRYW

SEQ ID NO: 212362 - protein, 18 aa, Mycobacterium bovis
ARLDLPVGVARVLVGDLV

SEQ ID NO: 212363 - protein, 19 aa, Mycobacterium bovis
ARLGHRLTIAMTRWQALVN

SEQ ID NO: 212364 - protein, 18 aa, Mycobacterium bovis
ARLKVGIISAGRVGTALG

SEQ ID NO: 212365 - protein, 19 aa, Mycobacterium bovis
ARLTSLVTHNVFGQNTASI

SEQ ID NO: 212366 - protein, 20 aa, Mycobacterium bovis
ARPARAWLFTVARNMIIDER

SEQ ID NO: 212367 - protein, 19 aa, Mycobacterium bovis
ARPSPFYIMDEVEAALDDV

SEQ ID NO: 212368 - protein, 18 aa, Mycobacterium bovis
ARPTSTWTYMVNDNPLSD

SEQ ID NO: 212369 - protein, 21 aa, Mycobacterium bovis
ARPTYAGGLLKIWNERNYRFW

SEQ ID NO: 212370 - protein, 21 aa, Mycobacterium bovis
ARQEPGLSWAAGLRDNGQTTL

SEQ ID NO: 212371 - protein, 19 aa, Mycobacterium bovis
ARQLLDLMVHSVYSNKDAF

SEQ ID NO: 212372 - protein, 19 aa, Mycobacterium bovis
ARQRPGLLAAWLDGDLGEL

SEQ ID NO: 212373 - protein, 17 aa, Mycobacterium bovis
ARRCAAQSWPLDRVKAV

SEQ ID NO: 212374 - protein, 23 aa, Mycobacterium bovis
ARRLYASRGWLPWHGPTSVLAPT

SEQ ID NO: 212375 - protein, 17 aa, Mycobacterium bovis
ARSGVDVVRLVAGDPLT

SEQ ID NO: 212376 - protein, 20 aa, Mycobacterium bovis
ARSRSALGWIIERYRVTTDK

SEQ ID NO: 212377 - protein, 20 aa, Mycobacterium bovis
ARSTGWTGLIVHGAVRDAAA

SEQ ID NO: 212378 - protein, 18 aa, Mycobacterium bovis
ARVLLVWDAPNLDMGLGS

SEQ ID NO: 212379 - protein, 18 aa, Mycobacterium bovis
ARYGIVWGAMGAARSAWQ

SEQ ID NO: 212380 - protein, 23 aa, Mycobacterium bovis
ARYLFRRVVSWGRSSNVFLRNGA

SEQ ID NO: 212381 - protein, 18 aa, Mycobacterium bovis
ARYLRICVLTQYKSHSLD

SEQ ID NO: 212382 - protein, 18 aa, Mycobacterium bovis
ARYLWPSMFAQVADEYDR

SEQ ID NO: 212383 - protein, 18 aa, Mycobacterium bovis
ASATLIWRRPRWARRLQP

SEQ ID NO: 212384 - protein, 17 aa, Mycobacterium bovis
ASAWLDALVGWRRASGL

SEQ ID NO: 212385 - protein, 17 aa, Mycobacterium bovis
ASCPPILVLTGRPDDTW

SEQ ID NO: 212386 - protein, 26 aa, Mycobacterium bovis
ASHCYPHFRRFLAEVVRVLRPGGYFP

SEQ ID NO: 212387 - protein, 23 aa, Mycobacterium bovis
ASPKETWLRLLLIDAGLPVPTTQ

SEQ ID NO: 212388 - protein, 23 aa, Mycobacterium bovis
ASRARFGDVLPFLVKVLAADEPL

SEQ ID NO: 212389 - protein, 23 aa, Mycobacterium bovis
ASREARAAYRWMRANQPVFRDRN

SEQ ID NO: 212390 - protein, 19 aa, Mycobacterium bovis
ASSPFGIAIAIGGAGAQGG

SEQ ID NO: 212391 - protein, 27 aa, Mycobacterium bovis
ASSTWADSPRAWPIRAPSRLQVWRTRA

SEQ ID NO: 212392 - protein, 17 aa, Mycobacterium bovis
ASVTCGIGFADLSSFTA

SEQ ID NO: 212393 - protein, 20 aa, Mycobacterium bovis
ASYLLSLRAAWQADNNIPNS

SEQ ID NO: 212394 - protein, 18 aa, Mycobacterium bovis
ATAAFDLARIGSQVSAAS

SEQ ID NO: 212395 - protein, 18 aa, Mycobacterium bovis
ATEARYGEMWAQDASAMY

SEQ ID NO: 212396 - protein, 23 aa, Mycobacterium bovis
ATERYQVLVGWDFEPASEYGTKA

SEQ ID NO: 212397 - protein, 17 aa, Mycobacterium bovis
ATFHDRFVQTLSAAASS

SEQ ID NO: 212398 - protein, 20 aa, Mycobacterium bovis
ATGRPPRWVRPIVDALGFAP

SEQ ID NO: 212399 - protein, 22 aa, Mycobacterium bovis
ATLLTARCPVLFAPAMHTEMWL

SEQ ID NO: 212400 - protein, 21 aa, Mycobacterium bovis
ATLVGRLSVPAAWSTAAPATT

SEQ ID NO: 212401 - protein, 17 aa, Mycobacterium bovis
ATNEIRALMALPPGQAP

SEQ ID NO: 212402 - protein, 21 aa, Mycobacterium bovis
ATRLVAEWPPRLNIPDPDPLR

SEQ ID NO: 212403 - protein, 24 aa, Mycobacterium bovis
ATSPLLAPINEFFLANTGRPLIGN

SEQ ID NO: 212404 - protein, 23 aa, Mycobacterium bovis
ATTCGRPFADFELRIADDGEVLL

SEQ ID NO: 212405 - protein, 17 aa, Mycobacterium bovis
ATVSHDFDAELPAADAV

SEQ ID NO: 212406 - protein, 18 aa, Mycobacterium bovis
ATYRLVKRSGFVASSTYA

SEQ ID NO: 212407 - protein, 24 aa, Mycobacterium bovis
AVAGIRLALSLGFRVRVAATVASP

SEQ ID NO: 212408 - protein, 18 aa, Mycobacterium bovis
AVAGWRGAPRPVLARELL

SEQ ID NO: 212409 - protein, 23 aa, Mycobacterium bovis
AVAKRRGWPILKFNSRGGVGIRR

SEQ ID NO: 212410 - protein, 19 aa, Mycobacterium bovis
AVDSLWFDALRSVAVDHRD

SEQ ID NO: 212411 - protein, 17 aa, Mycobacterium bovis
AVEEFRFHVGLARAAGN

SEQ ID NO: 212412 - protein, 24 aa, Mycobacterium bovis
AVESGLRVARKWGADVNGLPAGRH

SEQ ID NO: 212413 - protein, 24 aa, Mycobacterium bovis
AVGGVGGNGGWLYGNGGAGGLGGT

SEQ ID NO: 212414 - protein, 19 aa, Mycobacterium bovis
AVGSVCWLVGCSSGASSTT

SEQ ID NO: 212415 - protein, 18 aa, Mycobacterium bovis
AVLACPLAGPAGPAETVA

SEQ ID NO: 212416 - protein, 17 aa, Mycobacterium bovis
AVLARLDLGSVLIPMPA

SEQ ID NO: 212417 - protein, 17 aa, Mycobacterium bovis
AVLDRLAVYRARSVDID

SEQ ID NO: 212418 - protein, 17 aa, Mycobacterium bovis
AVLGLAFDGGWWVLGIR

SEQ ID NO: 212419 - protein, 25 aa, Mycobacterium bovis
AVNFGPISVQGFGLFGHGGDGGNGG

SEQ ID NO: 212420 - protein, 25 aa, Mycobacterium bovis
AVPPHGWVNLHFSLLPAWRGAAPVQ

SEQ ID NO: 212421 - protein, 20 aa, Mycobacterium bovis
AVPSRLAWEAGVALADSLLA

SEQ ID NO: 212422 - protein, 23 aa, Mycobacterium bovis
AVQAWRGFSRWLMRAYDVLVDED

SEQ ID NO: 212423 - protein, 23 aa, Mycobacterium bovis
AVRDWPKPLGFVWGLDDPVATTN

SEQ ID NO: 212424 - protein, 17 aa, Mycobacterium bovis
AVSEIPWSYDIGSNIEI

SEQ ID NO: 212425 - protein, 26 aa, Mycobacterium bovis
AVVGLSLPGTVAWHAVPRWFARNKDR

SEQ ID NO: 212426 - protein, 22 aa, Mycobacterium bovis
AVYRLAWAALRGCPTSSVRTAF

SEQ ID NO: 212427 - protein, 24 aa, Mycobacterium bovis
AWERGRFAAPYLRDSLLAAGALCE

SEQ ID NO: 212428 - protein, 20 aa, Mycobacterium bovis
AWLDALVGWRRASGLPAAVI

SEQ ID NO: 212429 - protein, 19 aa, Mycobacterium bovis
AWPRFGLELPELLPDKLAG

SEQ ID NO: 212430 - protein, 19 aa, Mycobacterium bovis
AWRTKRLIVFDVDSTLVQG

SEQ ID NO: 212431 - protein, 18 aa, Mycobacterium bovis
AYAKMVMNFGRFAMPQVG

SEQ ID NO: 212432 - protein, 20 aa, Mycobacterium bovis
AYLARAGLRVRLLERLAQTG

SEQ ID NO: 212433 - protein, 17 aa, Mycobacterium bovis
AYPVLWRNLTAIVASVL

SEQ ID NO: 212434 - protein, 18 aa, Mycobacterium bovis
AYRLNWPAGTVVYEIDQP

SEQ ID NO: 212435 - protein, 18 aa, Mycobacterium bovis
CAAQSWSLDRIKSVKQAA

SEQ ID NO: 212436 - protein, 20 aa, Mycobacterium bovis
CAAVGRIAYLLGLRGPAVAV

SEQ ID NO: 212437 - protein, 18 aa, Mycobacterium bovis
CAECHLDAPMVNRALAGA

SEQ ID NO: 212438 - protein, 19 aa, Mycobacterium bovis
CAIQNLWLAARSEGLGMGW

SEQ ID NO: 212439 - protein, 18 aa, Mycobacterium bovis
CAPFLHLFVAYGRLTLEG

SEQ ID NO: 212440 - protein, 19 aa, Mycobacterium bovis
CAPLTWPEGWRRWPQRVYG

SEQ ID NO: 212441 - protein, 21 aa, Mycobacterium bovis
CAVQRIMFRDGLVLNFDDYNE

SEQ ID NO: 212442 - protein, 23 aa, Mycobacterium bovis
CDKALEGFTMFALNQGEVCTCPS

SEQ ID NO: 212443 - protein, 17 aa, Mycobacterium bovis
CDPEVVEALKFHLRDLA

SEQ ID NO: 212444 - protein, 19 aa, Mycobacterium bovis
CGALRRYHEALGVPISTLP

SEQ ID NO: 212445 - protein, 19 aa, Mycobacterium bovis
CGGGRRWASAEARRHVTQG

SEQ ID NO: 212446 - protein, 19 aa, Mycobacterium bovis
CGLRRLIPLYAMVETALAP

SEQ ID NO: 212447 - protein, 19 aa, Mycobacterium bovis
CGPIGLAVICMLKSRGVHT

SEQ ID NO: 212448 - protein, 18 aa, Mycobacterium bovis
CGPPGMLEAVRVARNQHA

SEQ ID NO: 212449 - protein, 17 aa, Mycobacterium bovis
CGRRRLGAIGAEIENAV

SEQ ID NO: 212450 - protein, 20 aa, Mycobacterium bovis
CGVCESCVSLAPNAPGSIDV

SEQ ID NO: 212451 - protein, 17 aa, Mycobacterium bovis
CGWFDAVIARYAARVNG

SEQ ID NO: 212452 - protein, 18 aa, Mycobacterium bovis
CKKRHRLPGLDFVRGDAE

SEQ ID NO: 212453 - protein, 25 aa, Mycobacterium bovis
CLDKYARLFAWLGLWERHTDLAVIP

SEQ ID NO: 212454 - protein, 19 aa, Mycobacterium bovis
CLQFDLPIRLFEIGSSAGL

SEQ ID NO: 212455 - protein, 17 aa, Mycobacterium bovis
CPGLCPQCGVPLASEPG

SEQ ID NO: 212456 - protein, 17 aa, Mycobacterium bovis
CQQRFPFPMTVFDSDCG

SEQ ID NO: 212457 - protein, 25 aa, Mycobacterium bovis
CQQVWCPLCALAALVTGEQHPLLTV

SEQ ID NO: 212458 - protein, 18 aa, Mycobacterium bovis
CREYRITPVFVEVREGQS

SEQ ID NO: 212459 - protein, 18 aa, Mycobacterium bovis
CRLYCGACDAGARSTTSL

SEQ ID NO: 212460 - protein, 18 aa, Mycobacterium bovis
CRTPTIAAVQGWCIGGAV

SEQ ID NO: 212461 - protein, 24 aa, Mycobacterium bovis
CSKGFPSYFLIVADLISYARSAGI

SEQ ID NO: 212462 - protein, 19 aa, Mycobacterium bovis
CSWSVAGTGQFLAHDGASP

SEQ ID NO: 212463 - protein, 18 aa, Mycobacterium bovis
CTGYERFERYLLGLDDGI

SEQ ID NO: 212464 - protein, 18 aa, Mycobacterium bovis
CTTMSWPQRADHAAQAAR

SEQ ID NO: 212465 - protein, 21 aa, Mycobacterium bovis
CVKAEMLAASSWRVAVNAGAD

SEQ ID NO: 212466 - protein, 20 aa, Mycobacterium bovis
CWRADGQLEFLGRTDDQVKI

SEQ ID NO: 212467 - protein, 20 aa, Mycobacterium bovis
CWRIAAKSLRPLPVAHKEMS

SEQ ID NO: 212468 - protein, 21 aa, Mycobacterium bovis
CYSLRIASAMAHDEGWLAEHM

SEQ ID NO: 212469 - protein, 20 aa, Mycobacterium bovis
DAARLTAVWIADWADDTVHL

SEQ ID NO: 212470 - protein, 18 aa, Mycobacterium bovis
DAFAHWRQAQGLPATAIA

SEQ ID NO: 212471 - protein, 23 aa, Mycobacterium bovis
DAKWASSISGYWRRGRTEEMFRK

SEQ ID NO: 212472 - protein, 24 aa, Mycobacterium bovis
DALVGPCWPAVFAAIGSAVTDTGE

SEQ ID NO: 212473 - protein, 25 aa, Mycobacterium bovis
DATARFGLLPLRWALACLLIDIGTV

SEQ ID NO: 212474 - protein, 18 aa, Mycobacterium bovis
DAVIAVHLRGHFLLTRNA

SEQ ID NO: 212475 - protein, 19 aa, Mycobacterium bovis
DAVRYSVRFAKPVLLPATA

SEQ ID NO: 212476 - protein, 20 aa, Mycobacterium bovis
DAVVCSLVLCSVSDPGAVLA

SEQ ID NO: 212477 - protein, 20 aa, Mycobacterium bovis
DAWEDFLFWLAADRKTARRI

SEQ ID NO: 212478 - protein, 20 aa, Mycobacterium bovis
DCELDWWLGFSSAASLLGSP

SEQ ID NO: 212479 - protein, 22 aa, Mycobacterium bovis
DCIQVLGGIGCTWEHDAHLYLR

SEQ ID NO: 212480 - protein, 18 aa, Mycobacterium bovis
DDVARAWSLLGLTVAGPD

SEQ ID NO: 212481 - protein, 17 aa, Mycobacterium bovis
DDVLPAIAFAVAHTGKP

SEQ ID NO: 212482 - protein, 23 aa, Mycobacterium bovis
DEARLQRLLAFVARQEPRLNWAV

SEQ ID NO: 212483 - protein, 17 aa, Mycobacterium bovis
DEHLLVRAGHAFQQVTG

SEQ ID NO: 212484 - protein, 17 aa, Mycobacterium bovis
DEISRALTLLAELWSRY

SEQ ID NO: 212485 - protein, 24 aa, Mycobacterium bovis
DEPELRFELCLGVSGVHYPHETGR

SEQ ID NO: 212486 - protein, 17 aa, Mycobacterium bovis
DEPKCSLCQALTAASSQ

SEQ ID NO: 212487 - protein, 20 aa, Mycobacterium bovis
DEPKGVPVFAWKGETLEEYW

SEQ ID NO: 212488 - protein, 17 aa, Mycobacterium bovis
DERGMRTVMCILNGQLR

SEQ ID NO: 212489 - protein, 18 aa, Mycobacterium bovis
DESLWRLLCEQVGAAALV

SEQ ID NO: 212490 - protein, 24 aa, Mycobacterium bovis
DESRLTFLAVRRWYGWSAGRILNL

SEQ ID NO: 212491 - protein, 22 aa, Mycobacterium bovis
DEVSAAIASLFSGNAQAYQALS

SEQ ID NO: 212492 - protein, 17 aa, Mycobacterium bovis
DFLHGRWLVLRRGKRSI

SEQ ID NO: 212493 - protein, 19 aa, Mycobacterium bovis
DFMGCCAVAVLAHKAERCR

SEQ ID NO: 212494 - protein, 18 aa, Mycobacterium bovis
DFVGALIYLLSDASSFYT

SEQ ID NO: 212495 - protein, 17 aa, Mycobacterium bovis
DFVRWKKLRGGIGALTT

SEQ ID NO: 212496 - protein, 29 aa, Mycobacterium bovis
DFWFDPLCPWCWITSRWILEVAKVRDIEV

SEQ ID NO: 212497 - protein, 18 aa, Mycobacterium bovis
DGGRAVLVLSDWPAPQAP

SEQ ID NO: 212498 - protein, 26 aa, Mycobacterium bovis
DGGTGGRGGLLMGAGAGGHGGTGGAG

SEQ ID NO: 212499 - protein, 25 aa, Mycobacterium bovis
DGISRLRFRLRWRGFRLIVDANHTD

SEQ ID NO: 212500 - protein, 19 aa, Mycobacterium bovis
DGKAKWSAPLGFLAQTPPA

SEQ ID NO: 212501 - protein, 19 aa, Mycobacterium bovis
DGLLEIGRALNIPPLATND

SEQ ID NO: 212502 - protein, 19 aa, Mycobacterium bovis
DGLRYLDWLAAYSAVNLGH

SEQ ID NO: 212503 - protein, 22 aa, Mycobacterium bovis
DGTDSIELWAWVGAYDHVALCQ

SEQ ID NO: 212504 - protein, 23 aa, Mycobacterium bovis
DGTRIPVSIVHRADIEFPAPALI

SEQ ID NO: 212505 - protein, 17 aa, Mycobacterium bovis
DGVFPLAAFRKIVDINL

SEQ ID NO: 212506 - protein, 17 aa, Mycobacterium bovis
DGVVRPVVFLAYSGQAR

SEQ ID NO: 212507 - protein, 23 aa, Mycobacterium bovis
DHCLDLPGLFVWRRYHPSRPSGK

SEQ ID NO: 212508 - protein, 21 aa, Mycobacterium bovis
DIAEVLALLGVRPVWDDASRR

SEQ ID NO: 212509 - protein, 20 aa, Mycobacterium bovis
DIDFAFGVGQLFANVPYAQL

SEQ ID NO: 212510 - protein, 23 aa, Mycobacterium bovis
DIDRFGRRFGCVVMDGFGSTEGG

SEQ ID NO: 212511 - protein, 19 aa, Mycobacterium bovis
DIGQLGWWSASPARASALE

SEQ ID NO: 212512 - protein, 18 aa, Mycobacterium bovis
DIPNDFVVGYGLDYDERY

SEQ ID NO: 212513 - protein, 22 aa, Mycobacterium bovis
DIVLFPAWVWRSPLKPSPLDPP

SEQ ID NO: 212514 - protein, 21 aa, Mycobacterium bovis
DIVSWNWTELPSALGVTNHLA

SEQ ID NO: 212515 - protein, 24 aa, Mycobacterium bovis
DIWRRPDLAPGRRAPVLIQVPGGA

SEQ ID NO: 212516 - protein, 21 aa, Mycobacterium bovis
DIYRCHPALWSLDTTPEGYSW

SEQ ID NO: 212517 - protein, 19 aa, Mycobacterium bovis
DKPFLMPVEDVFTITGRGT

SEQ ID NO: 212518 - protein, 20 aa, Mycobacterium bovis
DKVVRWWLPERWAFVDEIPR

SEQ ID NO: 212519 - protein, 24 aa, Mycobacterium bovis
DLAAECWMHIGIDLFWFALPPEQL

SEQ ID NO: 212520 - protein, 18 aa, Mycobacterium bovis
DLAWSRITYWRALLTSAV

SEQ ID NO: 212521 - protein, 19 aa, Mycobacterium bovis
DLGDRFGFCIPDLAVWDNP

SEQ ID NO: 212522 - protein, 18 aa, Mycobacterium bovis
DLLKCSFCGKSQKQVKKL

SEQ ID NO: 212523 - protein, 18 aa, Mycobacterium bovis
DLQDIIAILGIDELSEED

SEQ ID NO: 212524 - protein, 19 aa, Mycobacterium bovis
DLRDEWQIALCNNGFDANR

SEQ ID NO: 212525 - protein, 21 aa, Mycobacterium bovis
DLSNILLLGPVGDLFPILSIP

SEQ ID NO: 212526 - protein, 24 aa, Mycobacterium bovis
DMKLPISLALGWPRRVSGAAAACD

SEQ ID NO: 212527 - protein, 18 aa, Mycobacterium bovis
DMRSGVAFSENYDDPAAE

SEQ ID NO: 212528 - protein, 21 aa, Mycobacterium bovis
DMTYLQWLRRYVELAIGEGNS

SEQ ID NO: 212529 - protein, 17 aa, Mycobacterium bovis
DNLRHTVRFAAAVQAAL

SEQ ID NO: 212530 - protein, 17 aa, Mycobacterium bovis
DNPVLWRRLELLGDREY

SEQ ID NO: 212531 - protein, 24 aa, Mycobacterium bovis
DNRAWRLYRRLGFTDIIRGYHFAG

SEQ ID NO: 212532 - protein, 17 aa, Mycobacterium bovis
DPAGARLCVRPMSEFQS

SEQ ID NO: 212533 - protein, 24 aa, Mycobacterium bovis
DPGESRFYLSLGDELMRRFNGAAL

SEQ ID NO: 212534 - protein, 21 aa, Mycobacterium bovis
DPGSVSYLFSRKGVVTLEKNG

SEQ ID NO: 212535 - protein, 23 aa, Mycobacterium bovis
DPLLPEVAWSWLVDALTARTDQV

SEQ ID NO: 212536 - protein, 17 aa, Mycobacterium bovis
DPMLLAWTVPVVDLDPT

SEQ ID NO: 212537 - protein, 22 aa, Mycobacterium bovis
DPRVRDGLAWCYARVQIMRYRG

SEQ ID NO: 212538 - protein, 24 aa, Mycobacterium bovis
DPTGRHAFGASFLARIFPPGSHIP

SEQ ID NO: 212539 - protein, 22 aa, Mycobacterium bovis
DQDRCRGWRMCVSGCPYKKVYF

SEQ ID NO: 212540 - protein, 20 aa, Mycobacterium bovis
DQPFAVWPWAAPKLGGARPA

SEQ ID NO: 212541 - protein, 19 aa, Mycobacterium bovis
DRERCILCARCTRFSDQIA

SEQ ID NO: 212542 - protein, 17 aa, Mycobacterium bovis
DRFKAISQRGTHYKVIE

SEQ ID NO: 212543 - protein, 19 aa, Mycobacterium bovis
DRHTAGWAMRELVVLHEVA

SEQ ID NO: 212544 - protein, 21 aa, Mycobacterium bovis
DRLRRWMAVAARIELRTGGAY

SEQ ID NO: 212545 - protein, 24 aa, Mycobacterium bovis
DRMAFRSAAYWDILAKLDASVSDP

SEQ ID NO: 212546 - protein, 17 aa, Mycobacterium bovis
DRMQFCSEFEWIAPSGR

SEQ ID NO: 212547 - protein, 17 aa, Mycobacterium bovis
DRNALHEVVGWWAKLPV

SEQ ID NO: 212548 - protein, 22 aa, Mycobacterium bovis
DRRGRLLWSLPKGHIELGETAE

SEQ ID NO: 212549 - protein, 17 aa, Mycobacterium bovis
DRVGIAWLRHTCGVCKY

SEQ ID NO: 212550 - protein, 17 aa, Mycobacterium bovis
DSEGWIYLAGRTADWMR

SEQ ID NO: 212551 - protein, 26 aa, Mycobacterium bovis
DSFAPRLSFFWGIGMNFFMEVAKLRA

SEQ ID NO: 212552 - protein, 25 aa, Mycobacterium bovis
DSIRMMSLVGRWRRKGIAVDFATLA

SEQ ID NO: 212553 - protein, 24 aa, Mycobacterium bovis
DSLGWLRDFLRLHTGGLVVISHNV

SEQ ID NO: 212554 - protein, 17 aa, Mycobacterium bovis
DTEWPLPLLDLARIASD

SEQ ID NO: 212555 - protein, 17 aa, Mycobacterium bovis
DTGRCRVPLILRLDPKI

SEQ ID NO: 212556 - protein, 20 aa, Mycobacterium bovis
DTHARVGLLPTWGLSVRLPQ

SEQ ID NO: 212557 - protein, 22 aa, Mycobacterium bovis
DTLRRAGERFGFAVESMSLVSE

SEQ ID NO: 212558 - protein, 22 aa, Mycobacterium bovis
DTRAYRLPWPPGTVVYEIDQPA

SEQ ID NO: 212559 - protein, 26 aa, Mycobacterium bovis
DVALIVGVPMDFRLGFGGVFGSTTQL

SEQ ID NO: 212560 - protein, 17 aa, Mycobacterium bovis
DVCPVEWARMANRSVLQ

SEQ ID NO: 212561 - protein, 19 aa, Mycobacterium bovis
DVEPCAAVGVELRRRGHAV

SEQ ID NO: 212562 - protein, 17 aa, Mycobacterium bovis
DVFAHWRRAQGLPVSAI

SEQ ID NO: 212563 - protein, 20 aa, Mycobacterium bovis
DVGCGWGATMMRAVEKYDVN

SEQ ID NO: 212564 - protein, 17 aa, Mycobacterium bovis
DVGCSWLPLYHDMGLAF

SEQ ID NO: 212565 - protein, 17 aa, Mycobacterium bovis
DVHIGPSDHVGWLDDRK

SEQ ID NO: 212566 - protein, 20 aa, Mycobacterium bovis
DVIRYLRWFTFLSADELAEL

SEQ ID NO: 212567 - protein, 18 aa, Mycobacterium bovis
DVKFEWHALPYLLGFKKA

SEQ ID NO: 212568 - protein, 17 aa, Mycobacterium bovis
DVKRFRGFDNWEGDAAT

SEQ ID NO: 212569 - protein, 23 aa, Mycobacterium bovis
DVLNRLKPGIVMCREKQDTTSAV

SEQ ID NO: 212570 - protein, 17 aa, Mycobacterium bovis
DVLPLWVAEMDVKLPPT

SEQ ID NO: 212571 - protein, 18 aa, Mycobacterium bovis
DVPSLGWRVYRLVPADEA

SEQ ID NO: 212572 - protein, 17 aa, Mycobacterium bovis
DVPWVLMHWRAVSADTP

SEQ ID NO: 212573 - protein, 18 aa, Mycobacterium bovis
DVRLLLPMPADWSYAEAA

SEQ ID NO: 212574 - protein, 18 aa, Mycobacterium bovis
DVTLRPAQYLPWHPGRCA

SEQ ID NO: 212575 - protein, 25 aa, Mycobacterium bovis
DVVRRARFAAAFTFQYSKRPGTPAA

SEQ ID NO: 212576 - protein, 17 aa, Mycobacterium bovis
DVYRVGQNVAWQRWTEI

SEQ ID NO: 212577 - protein, 24 aa, Mycobacterium bovis
DWAEMLMRMYIRWAEQHKYPVEVF

SEQ ID NO: 212578 - protein, 18 aa, Mycobacterium bovis
EAAISLALAERGHTTVGL

SEQ ID NO: 212579 - protein, 18 aa, Mycobacterium bovis
EACDRGGPGLLLRAKHAV

SEQ ID NO: 212580 - protein, 19 aa, Mycobacterium bovis
EADLARFPADVARVVVRLI

SEQ ID NO: 212581 - protein, 19 aa, Mycobacterium bovis
EADRWPDKPGRYFTVRAGS

SEQ ID NO: 212582 - protein, 18 aa, Mycobacterium bovis
EAECARWVAEQLAEVGYQ

SEQ ID NO: 212583 - protein, 25 aa, Mycobacterium bovis
EAEIACGRASAVIAELEALTFEHPY

SEQ ID NO: 212584 - protein, 17 aa, Mycobacterium bovis
EAFRPGTMEKLGLGPDD

SEQ ID NO: 212585 - protein, 18 aa, Mycobacterium bovis
EAGMMWREVYRLRQPVLL

SEQ ID NO: 212586 - protein, 18 aa, Mycobacterium bovis
EAGWWRLGLAEEIGGMPA

SEQ ID NO: 212587 - protein, 19 aa, Mycobacterium bovis
EAICPWCIADGSAASRFDA

SEQ ID NO: 212588 - protein, 19 aa, Mycobacterium bovis
EALTSLPGVGVWTAAETTQ

SEQ ID NO: 212589 - protein, 18 aa, Mycobacterium bovis
EANGDRYLPIWIGQSEAA

SEQ ID NO: 212590 - protein, 22 aa, Mycobacterium bovis
EASLGITLPVALVWAYPTISDL

SEQ ID NO: 212591 - protein, 17 aa, Mycobacterium bovis
EAVTAIWHGRVEIDRFN

SEQ ID NO: 212592 - protein, 17 aa, Mycobacterium bovis
ECLRTGAWEGLKPAELA

SEQ ID NO: 212593 - protein, 19 aa, Mycobacterium bovis
EDKPFWWAHFDRLNYPVDE

SEQ ID NO: 212594 - protein, 25 aa, Mycobacterium bovis
EDPRWRFGVPPANNANYAWIQHILY

SEQ ID NO: 212595 - protein, 22 aa, Mycobacterium bovis
EDSRWTVQLAWKAGRSDNLAHF

SEQ ID NO: 212596 - protein, 22 aa, Mycobacterium bovis
EDWKCWARWRLIRARAPWLTRA

SEQ ID NO: 212597 - protein, 25 aa, Mycobacterium bovis
EDYFKLGYRGARFAFGYGACPDLED

SEQ ID NO: 212598 - protein, 18 aa, Mycobacterium bovis
EELWLRLGNTTSLAHGPF

SEQ ID NO: 212599 - protein, 21 aa, Mycobacterium bovis
EEMPVAVPWSLPAARSAHAGN

SEQ ID NO: 212600 - protein, 19 aa, Mycobacterium bovis
EEPPEHLIFIFATTEPEKV

SEQ ID NO: 212601 - protein, 20 aa, Mycobacterium bovis
EEVAGFLADYGWRLTEQAGP

SEQ ID NO: 212602 - protein, 38 aa, Mycobacterium bovis
EFEIPIKLRVSVCVIYIPFKGCVKHVSVTIPITTEHLG

SEQ ID NO: 212603 - protein, 19 aa, Mycobacterium bovis
EFIGRLPVVASVTNLDKES

SEQ ID NO: 212604 - protein, 22 aa, Mycobacterium bovis
EFQCGPRMPMLPGAWDLGTWDR

SEQ ID NO: 212605 - protein, 20 aa, Mycobacterium bovis
EFTEGIGFDKGFLSAYFVTD

SEQ ID NO: 212606 - protein, 17 aa, Mycobacterium bovis
EGGRFACGGARPADREV

SEQ ID NO: 212607 - protein, 24 aa, Mycobacterium bovis
EGHPGHGPRYLWTRTVAGRGTKGR

SEQ ID NO: 212608 - protein, 19 aa, Mycobacterium bovis
EGLLNYLALLGWSIADDHD

SEQ ID NO: 212609 - protein, 17 aa, Mycobacterium bovis
EGNLWFEWSRSLDDPAE

SEQ ID NO: 212610 - protein, 19 aa, Mycobacterium bovis
EGPARAWERGRFAAPYLRD

SEQ ID NO: 212611 - protein, 18 aa, Mycobacterium bovis
EGTVIRWLKKIGDSVQVD

SEQ ID NO: 212612 - protein, 19 aa, Mycobacterium bovis
EGVAVDWSSVFAGLGGRRV

SEQ ID NO: 212613 - protein, 26 aa, Mycobacterium bovis
EGVPRWRKATGLGWLTAEYAMLPSAT

SEQ ID NO: 212614 - protein, 19 aa, Mycobacterium bovis
EGVVSLGLYSRIFRNNILA

SEQ ID NO: 212615 - protein, 19 aa, Mycobacterium bovis
EHAELPPGWVLTTSGRISG

SEQ ID NO: 212616 - protein, 21 aa, Mycobacterium bovis
EHFNWLEGLGFQFERSYFPGK

SEQ ID NO: 212617 - protein, 19 aa, Mycobacterium bovis
EHLPGIAVPTVFTHGTADP

SEQ ID NO: 212618 - protein, 17 aa, Mycobacterium bovis
EHPSVCLLASWVPPDTP

SEQ ID NO: 212619 - protein, 25 aa, Mycobacterium bovis
EHPYPHCWRCRNPLIYRSVSSWFVR

SEQ ID NO: 212620 - protein, 19 aa, Mycobacterium bovis
EIAGRLAARIGSGLLVDVV

SEQ ID NO: 212621 - protein, 19 aa, Mycobacterium bovis
EICDGWLPIFYSPRMAGMY

SEQ ID NO: 212622 - protein, 21 aa, Mycobacterium bovis
EIDNLRAAFAFSRENGDTGHA

SEQ ID NO: 212623 - protein, 23 aa, Mycobacterium bovis
EIDNLRAAFAWSRENGHITEALQ

SEQ ID NO: 212624 - protein, 19 aa, Mycobacterium bovis
EINSALIFAGAGPEPMAAA

SEQ ID NO: 212625 - protein, 22 aa, Mycobacterium bovis
EIPAIPPFFPGFPPDYVTVSGQ

SEQ ID NO: 212626 - protein, 17 aa, Mycobacterium bovis
EIREFLEGYVIGQDTAK

SEQ ID NO: 212627 - protein, 18 aa, Mycobacterium bovis
EISARILMKLKRDAEAYL

SEQ ID NO: 212628 - protein, 20 aa, Mycobacterium bovis
EITRLVPFIEWLRGAYPDQL

SEQ ID NO: 212629 - protein, 20 aa, Mycobacterium bovis
EIWRFTPLRRLRGLHDGSAR

SEQ ID NO: 212630 - protein, 21 aa, Mycobacterium bovis
EIYRAPLSYPYRDGLLDKQLA

SEQ ID NO: 212631 - protein, 20 aa, Mycobacterium bovis
EIYVPFSWFEPMWLENLGFA

SEQ ID NO: 212632 - protein, 21 aa, Mycobacterium bovis
EKRFSMPWGHPARRMREFVAA

SEQ ID NO: 212633 - protein, 18 aa, Mycobacterium bovis
ELAAAGLHRIRWWTDEAG

SEQ ID NO: 212634 - protein, 22 aa, Mycobacterium bovis
ELDGLRLITWRGASRAEQGLPF

SEQ ID NO: 212635 - protein, 18 aa, Mycobacterium bovis
ELFLRAAQAYGVKRGQRM

SEQ ID NO: 212636 - protein, 18 aa, Mycobacterium bovis
ELHEIYKLGVVSIPTNMP

SEQ ID NO: 212637 - protein, 17 aa, Mycobacterium bovis
ELLLKWKKTPQRPVSLP

SEQ ID NO: 212638 - protein, 18 aa, Mycobacterium bovis
ELLRRLKGLPGFGEQKAR

SEQ ID NO: 212639 - protein, 19 aa, Mycobacterium bovis
ELMPLPIALAHRLSRRLTE

SEQ ID NO: 212640 - protein, 23 aa, Mycobacterium bovis
ELMPRTPFIGGLGIVFERYEPDD

SEQ ID NO: 212641 - protein, 21 aa, Mycobacterium bovis
ELPAVRVGRSFRVHAKAVHDM

SEQ ID NO: 212642 - protein, 21 aa, Mycobacterium bovis
ELRARFNLRYPLAHLRPFLST

SEQ ID NO: 212643 - protein, 18 aa, Mycobacterium bovis
ELRIGLATAEDIRQWSYG

SEQ ID NO: 212644 - protein, 18 aa, Mycobacterium bovis
ELYFPGSPVLSVRGSFAE

SEQ ID NO: 212645 - protein, 20 aa, Mycobacterium bovis
EMGGPFSLELCGGTHVSNTA

SEQ ID NO: 212646 - protein, 18 aa, Mycobacterium bovis
EMTRPRFGSWLRNSTRGA

SEQ ID NO: 212647 - protein, 17 aa, Mycobacterium bovis
ENGRSWSRWSFIGAGAP

SEQ ID NO: 212648 - protein, 18 aa, Mycobacterium bovis
ENRAELMILIATNLLGQN

SEQ ID NO: 212649 - protein, 18 aa, Mycobacterium bovis
EPDRAAAIVRRTVPGATA

SEQ ID NO: 212650 - protein, 18 aa, Mycobacterium bovis
EPLKCLTENLWALHTNRY

SEQ ID NO: 212651 - protein, 21 aa, Mycobacterium bovis
EPLPRTLVWSAAWEMTREAEL

SEQ ID NO: 212652 - protein, 19 aa, Mycobacterium bovis
EPMLFEWTDRDTLLYAIGV

SEQ ID NO: 212653 - protein, 21 aa, Mycobacterium bovis
EPRLSLQWWVRVESLAKAAGD

SEQ ID NO: 212654 - protein, 21 aa, Mycobacterium bovis
EPWRGEPLLAYLRKMVFWSMV

SEQ ID NO: 212655 - protein, 21 aa, Mycobacterium bovis
EQMKMFLTRLGFGSKVVVTGD

SEQ ID NO: 212656 - protein, 18 aa, Mycobacterium bovis
ERALFLGQWGLRGQRGGE

SEQ ID NO: 212657 - protein, 19 aa, Mycobacterium bovis
ERARNGLSIVIAPEGTRLD

SEQ ID NO: 212658 - protein, 21 aa, Mycobacterium bovis
ERFRYGFAIAPELVRTVLRDN

SEQ ID NO: 212659 - protein, 18 aa, Mycobacterium bovis
ERGRRFLIHTARIAYVEI

SEQ ID NO: 212660 - protein, 22 aa, Mycobacterium bovis
ERIGLRFVLEIRVPAGVDGRIT

SEQ ID NO: 212661 - protein, 18 aa, Mycobacterium bovis
ERLRLSGTRIELEELLQL

SEQ ID NO: 212662 - protein, 17 aa, Mycobacterium bovis
ERNYRFWADLTEALKTG

SEQ ID NO: 212663 - protein, 17 aa, Mycobacterium bovis
ERRPGWVGLPLAGVQTR

SEQ ID NO: 212664 - protein, 19 aa, Mycobacterium bovis
ESAGFKWLAPYTGSAIAQH

SEQ ID NO: 212665 - protein, 28 aa, Mycobacterium bovis
ESFFRGAGWNVIKVVWGREWDALLHADR

SEQ ID NO: 212666 - protein, 22 aa, Mycobacterium bovis
ESMSGRLIGKVALVSGGARGMG

SEQ ID NO: 212667 - protein, 20 aa, Mycobacterium bovis
ESPIDWDIAWPAGDLQVNLT

SEQ ID NO: 212668 - protein, 18 aa, Mycobacterium bovis
ESRGRLSAVVQRELADEA

SEQ ID NO: 212669 - protein, 21 aa, Mycobacterium bovis
ESYPTAMLMVFKLHRDFDIAE

SEQ ID NO: 212670 - protein, 23 aa, Mycobacterium bovis
ETARGAVCAAEIAAADPTVGMMW

SEQ ID NO: 212671 - protein, 17 aa, Mycobacterium bovis
ETARLWLSLGHHDRHGV

SEQ ID NO: 212672 - protein, 17 aa, Mycobacterium bovis
ETELMAWAIPRAANRFW

SEQ ID NO: 212673 - protein, 17 aa, Mycobacterium bovis
ETIDWGRTVLALGLDTI

SEQ ID NO: 212674 - protein, 25 aa, Mycobacterium bovis
ETLLVVLCGVGFYIGFVGSYQRMAT

SEQ ID NO: 212675 - protein, 18 aa, Mycobacterium bovis
ETLVRAASDLANIGSTLG

SEQ ID NO: 212676 - protein, 23 aa, Mycobacterium bovis
ETNVEFWAAVVLDFARVPANMMP

SEQ ID NO: 212677 - protein, 32 aa, Mycobacterium bovis; identical to SEQ ID NO: 198861

SEQ ID NO: 212678 - protein, 25 aa, Mycobacterium bovis
EVALFRLLGSWGVRPDFVMGHSIGE

SEQ ID NO: 212679 - protein, 20 aa, Mycobacterium bovis
EVFRRTRIVAHEVRRHCTTG

SEQ ID NO: 212680 - protein, 28 aa, Mycobacterium bovis
EVLTELWALIGYRIPTPIPRIGYAEAMR

SEQ ID NO: 212681 - protein, 26 aa, Mycobacterium bovis
EVPAPPFWGSRIVKGLAVADYTGLLD

SEQ ID NO: 212682 - protein, 17 aa, Mycobacterium bovis
EVPEVWAAVTSVFRDYG

SEQ ID NO: 212683 - protein, 19 aa, Mycobacterium bovis
EVRLFLRRVPALAFLPNRR

SEQ ID NO: 212684 - protein, 21 aa, Mycobacterium bovis
EVSAAMAALFGAHAQEYQRLS

SEQ ID NO: 212685 - protein, 22 aa, Mycobacterium bovis
EVSAAVAALFGSYAQSYQAFGA

SEQ ID NO: 212686 - protein, 21 aa, Mycobacterium bovis
EVSARAGVEVTVFEPAEALIT

SEQ ID NO: 212687 - protein, 17 aa, Mycobacterium bovis
EVTIGKMFVVDTGQLDG

SEQ ID NO: 212688 - protein, 24 aa, Mycobacterium bovis
EWAARAGPRWSYADVLGYFRRIEN

SEQ ID NO: 212689 - protein, 18 aa, Mycobacterium bovis
EWPGIDWPATQSMAEQVL

SEQ ID NO: 212690 - protein, 25 aa, Mycobacterium bovis
FAAAFKPPLRWGIRMTGHRFFREYP

SEQ ID NO: 212691 - protein, 17 aa, Mycobacterium bovis
FAACPICHLHLRSFANR

SEQ ID NO: 212692 - protein, 17 aa, Mycobacterium bovis
FAAEAAFVFAMIAVDLS

SEQ ID NO: 212693 - protein, 23 aa, Mycobacterium bovis
FAESVPMWGPRGAALIQAIPEAT

SEQ ID NO: 212694 - protein, 17 aa, Mycobacterium bovis
FAFSLVYEVSFGTPGEE

SEQ ID NO: 212695 - protein, 24 aa, Mycobacterium bovis
FAGIGIPIAEIWGMSELSCVATAS

SEQ ID NO: 212696 - protein, 17 aa, Mycobacterium bovis
FAIGAVLSMHFAKQAAR

SEQ ID NO: 212697 - protein, 17 aa, Mycobacterium bovis
FAIPPIGVGGFTLPQIT

SEQ ID NO: 212698 - protein, 19 aa, Mycobacterium bovis
FAIRLELRYLSERDETSML

SEQ ID NO: 212699 - protein, 17 aa, Mycobacterium bovis
FAIYIKMHHSLIDGYTG

SEQ ID NO: 212700 - protein, 17 aa, Mycobacterium bovis
FAKAFWNVVNWADVQSR

SEQ ID NO: 212701 - protein, 22 aa, Mycobacterium bovis
FAKPYAEWRGMFAGNGMLLPAS

SEQ ID NO: 212702 - protein, 18 aa, Mycobacterium bovis
FALLPLGELWVAAARMRQ

SEQ ID NO: 212703 - protein, 20 aa, Mycobacterium bovis
FAPRCPLVIDECLTAEPELL

SEQ ID NO: 212704 - protein, 17 aa, Mycobacterium bovis
FAQAAAVPVVFLTAWYG

SEQ ID NO: 212705 - protein, 20 aa, Mycobacterium bovis
FATASAREWWGLVWADRILQ

SEQ ID NO: 212706 - protein, 25 aa, Mycobacterium bovis
FAVAPDFIGFGAAYGGAGGLGGAAT

SEQ ID NO: 212707 - protein, 18 aa, Mycobacterium bovis
FDGLRLAGRRVRRPELTL

SEQ ID NO: 212708 - protein, 18 aa, Mycobacterium bovis
FDGRIITVPFSFKEIDDD

SEQ ID NO: 212709 - protein, 17 aa, Mycobacterium bovis
FDLCIEAMGAIDTQQRL

SEQ ID NO: 212710 - protein, 19 aa, Mycobacterium bovis
FDPIYCWPKPVTKPYPPLY

SEQ ID NO: 212711 - protein, 21 aa, Mycobacterium bovis
FDPKKAVVFDDRWASAREDLV

SEQ ID NO: 212712 - protein, 17 aa, Mycobacterium bovis
FELLAARRRDQLIDIDV

SEQ ID NO: 212713 - protein, 17 aa, Mycobacterium bovis
FELRPGQALVITVPVSD

SEQ ID NO: 212714 - protein, 17 aa, Mycobacterium bovis
FEPGEFVALLGQSGSGK

SEQ ID NO: 212715 - protein, 25 aa, Mycobacterium bovis
FEVFIRPPLRMAMGLPDPYRPHRSA

SEQ ID NO: 212716 - protein, 18 aa, Mycobacterium bovis
FGAWYEMFPRSTGGWDDD

SEQ ID NO: 212717 - protein, 17 aa, Mycobacterium bovis
FGGAPGFGNDTTAPSSG

SEQ ID NO: 212718 - protein, 17 aa, Mycobacterium bovis
FGGPPVFNLGLANRGVV

SEQ ID NO: 212719 - protein, 24 aa, Mycobacterium bovis
FGGSGGRGGLLLGTGGAGGDGGVG

SEQ ID NO: 212720 - protein, 24 aa, Mycobacterium bovis
FGHCMGAIVAFEFARLAERNGVPV

SEQ ID NO: 212721 - protein, 17 aa, Mycobacterium bovis
FGMQDVIWRGAYYTPNG

SEQ ID NO: 212722 - protein, 24 aa, Mycobacterium bovis
FGPLRIRFWACGIFEVQRARYGIT

SEQ ID NO: 212723 - protein, 17 aa, Mycobacterium bovis
FGSLMSGFANFDDEVSG

SEQ ID NO: 212724 - protein, 19 aa, Mycobacterium bovis
FGTELPPLEGIYLAAFAGR

SEQ ID NO: 212725 - protein, 17 aa, Mycobacterium bovis
FGTSRWSSKLVHGGLRY

SEQ ID NO: 212726 - protein, 17 aa, Mycobacterium bovis
FGVLVIRCALCTDTVKR

SEQ ID NO: 212727 - protein, 18 aa, Mycobacterium bovis
FGVPMGFGGPHAGYLAVH

SEQ ID NO: 212728 - protein, 19 aa, Mycobacterium bovis
FHIFSHSWGGMLAQQYVLD

SEQ ID NO: 212729 - protein, 25 aa, Mycobacterium bovis
FHVYARIAPCWSFPQVRLAAQTVAR

SEQ ID NO: 212730 - protein, 23 aa, Mycobacterium bovis
FILAEIFPGGWLPSIPTVHEYAE

SEQ ID NO: 212731 - protein, 19 aa, Mycobacterium bovis
FKDAELLGMPWIVVVGRGW

SEQ ID NO: 212732 - protein, 17 aa, Mycobacterium bovis
FKIPGWRDALTRTGVVE

SEQ ID NO: 212733 - protein, 19 aa, Mycobacterium bovis
FKKACAGFRSLGRGATEEP

SEQ ID NO: 212734 - protein, 19 aa, Mycobacterium bovis
FLGGLRFAGAQVVPIRVYR

SEQ ID NO: 212735 - protein, 18 aa, Mycobacterium bovis
FLGPRPAGWWVRRRLHEV

SEQ ID NO: 212736 - protein, 18 aa, Mycobacterium bovis
FLHKELYREYSLRPPKGV

SEQ ID NO: 212737 - protein, 17 aa, Mycobacterium bovis
FLLGLVVSTGVGGGLVL

SEQ ID NO: 212738 - protein, 25 aa, Mycobacterium bovis
FLNGEARLPLALPTSATGGIPVTVE

SEQ ID NO: 212739 - protein, 18 aa, Mycobacterium bovis
FLPDRWVYEFGRRRNIAI

SEQ ID NO: 212740 - protein, 17 aa, Mycobacterium bovis
FLPKRPLVEVLRDLASR

SEQ ID NO: 212741 - protein, 19 aa, Mycobacterium bovis
FLVDCGRGVLQRAAAVGVG

SEQ ID NO: 212742 - protein, 18 aa, Mycobacterium bovis
FLWMWPNARISVMGGEQA

SEQ ID NO: 212743 - protein, 18 aa, Mycobacterium bovis
FMGCCAFAALADEAQRCR

SEQ ID NO: 212744 - protein, 18 aa, Mycobacterium bovis
FMLHPVMMDIALQTLGAT

SEQ ID NO: 212745 - protein, 20 aa, Mycobacterium bovis
FNEFRAIAGIGEMFDTLLVY

SEQ ID NO: 212746 - protein, 17 aa, Mycobacterium bovis
FNLSWSIEGTRSRTGKM

SEQ ID NO: 212747 - protein, 25 aa, Mycobacterium bovis
FNNGFLWRGDHQGLIFGSPGFFNST

SEQ ID NO: 212748 - protein, 17 aa, Mycobacterium bovis
FPAPVPVGSRVRATSSL

SEQ ID NO: 212749 - protein, 17 aa, Mycobacterium bovis
FPDAVRYSVRFAKPVLL

SEQ ID NO: 212750 - protein, 18 aa, Mycobacterium bovis
FPEELGKMGFVFNFITYG

SEQ ID NO: 212751 - protein, 19 aa, Mycobacterium bovis
FPKFDWPRIDAPYMRPGLD

SEQ ID NO: 212752 - protein, 20 aa, Mycobacterium bovis
FPLYCCANGKALLAALPPER

SEQ ID NO: 212753 - protein, 20 aa, Mycobacterium bovis
FPPVELFMQMPWRTEIIQGL

SEQ ID NO: 212754 - protein, 20 aa, Mycobacterium bovis
FPQSFGFSTLGGWLATRSGG

SEQ ID NO: 212755 - protein, 19 aa, Mycobacterium bovis
FPTCLERGAGIPAVERLAY

SEQ ID NO: 212756 - protein, 19 aa, Mycobacterium bovis
FQVSAEWSWLVLVGAVVGD

SEQ ID NO: 212757 - protein, 18 aa, Mycobacterium bovis
FRAAAGIYRAARRAGETV

SEQ ID NO: 212758 - protein, 18 aa, Mycobacterium bovis
FRDGLCFVDLAPIADPGM

SEQ ID NO: 212759 - protein, 17 aa, Mycobacterium bovis
FRFELDAGLWLLATGSE

SEQ ID NO: 212760 - protein, 17 aa, Mycobacterium bovis
FRFPRIGTAVFDGIEIE

SEQ ID NO: 212761 - protein, 17 aa, Mycobacterium bovis
FRFVEEMIRLGADARTD

SEQ ID NO: 212762 - protein, 20 aa, Mycobacterium bovis
FRLLVLRTAWLIDKHHDYQK

SEQ ID NO: 212763 - protein, 17 aa, Mycobacterium bovis
FRLTDAAVWERFYGSSH

SEQ ID NO: 212764 - protein, 24 aa, Mycobacterium bovis
FRPEVSDGLFLRLAITSVDSLACA

SEQ ID NO: 212765 - protein, 21 aa, Mycobacterium bovis
FRPGPRRRLGVLVDHLVAGSK

SEQ ID NO: 212766 - protein, 25 aa, Mycobacterium bovis
FRPSKIAFLAWHAWNDAERGNWPPG

SEQ ID NO: 212767 - protein, 19 aa, Mycobacterium bovis
FRYVMMVLRHIPRSIFRKL

SEQ ID NO: 212768 - protein, 23 aa, Mycobacterium bovis
FSALELLHAWALVHDDLIDRSAT

SEQ ID NO: 212769 - protein, 17 aa, Mycobacterium bovis
FSALTGWEAPDPAWWTA

SEQ ID NO: 212770 - protein, 18 aa, Mycobacterium bovis
FSGSSGQLAREWVAAGAR

SEQ ID NO: 212771 - protein, 19 aa, Mycobacterium bovis
FSLLPAWRGAAPVQAAIAA

SEQ ID NO: 212772 - protein, 19 aa, Mycobacterium bovis
FSLPLARMVLTSAPVTVLE

SEQ ID NO: 212773 - protein, 19 aa, Mycobacterium bovis
FSMPIHQVMVMPGSVMTIP

SEQ ID NO: 212774 - protein, 17 aa, Mycobacterium bovis
FSPLRLPPDLDFTSLFH

SEQ ID NO: 212775 - protein, 17 aa, Mycobacterium bovis
FSPRSQYLVGHLAPVKL

SEQ ID NO: 212776 - protein, 24 aa, Mycobacterium bovis
FSRFELLRLLAFSRIGALPITKAS

SEQ ID NO: 212777 - protein, 18 aa, Mycobacterium bovis
FSTYATWWIRQAITRAMA

SEQ ID NO: 212778 - protein, 18 aa, Mycobacterium bovis
FTAAGIRKTWVFQAFDDA

SEQ ID NO: 212779 - protein, 20 aa, Mycobacterium bovis
FTADFFATWGKLAAVRTPTI

SEQ ID NO: 212780 - protein, 17 aa, Mycobacterium bovis
FTKLAARFLGPVLGGVQ

SEQ ID NO: 212781 - protein, 17 aa, Mycobacterium bovis
FTLPGERIHVVFRSDES

SEQ ID NO: 212782 - protein, 18 aa, Mycobacterium bovis
FVAAYMPFLAWLIQASAD

SEQ ID NO: 212783 - protein, 17 aa, Mycobacterium bovis
FVDDFVLYWGFLALAQV

SEQ ID NO: 212784 - protein, 17 aa, Mycobacterium bovis
FVEHTGIPFLPMSMAKG

SEQ ID NO: 212785 - protein, 24 aa, Mycobacterium bovis
FVHAVALAEVWRSCGVLPDLTVGH

SEQ ID NO: 212786 - protein, 17 aa, Mycobacterium bovis
FVQALAGAMGAYAAAEA

SEQ ID NO: 212787 - protein, 18 aa, Mycobacterium bovis
FVVLDGLAKPGRMVGPDP

SEQ ID NO: 212788 - protein, 17 aa, Mycobacterium bovis
FVVPSRGLIGWRTDFLT

SEQ ID NO: 212789 - protein, 23 aa, Mycobacterium bovis
GAAGGAGGWLFGNGGNGGHGATN

SEQ ID NO: 212790 - protein, 26 aa, Mycobacterium bovis
GAAGGVGGRGGWLLGNGGTGGAGGAA

SEQ ID NO: 212791 - protein, 21 aa, Mycobacterium bovis
GACPGPFGAPIPGFARSYQPS

SEQ ID NO: 212792 - protein, 20 aa, Mycobacterium bovis
GADAVNVVFMPTEPQAATGT

SEQ ID NO: 212793 - protein, 23 aa, Mycobacterium bovis
GAEASWVVGITWWSAVVGGFQMS

SEQ ID NO: 212794 - protein, 20 aa, Mycobacterium bovis
GAELLVEIARFWVGLAKLDD

SEQ ID NO: 212795 - protein, 19 aa, Mycobacterium bovis
GAELRKCWNIDFDDAGAIG

SEQ ID NO: 212796 - protein, 26 aa, Mycobacterium bovis
GAGGAGPVLFGHGGAGGMGGQGGTGG

SEQ ID NO: 212797 - protein, 22 aa, Mycobacterium bovis
GAGGDGGLFFGVGGAGGAGGTG

SEQ ID NO: 212798 - protein, 27 aa, Mycobacterium bovis
GAGGHGGAGGWLYGNGGAGGFGGAGAV

SEQ ID NO: 212799 - protein, 18 aa, Mycobacterium bovis
GAGGLIWGNGGAGGNGGN

SEQ ID NO: 212800 - protein, 17 aa, Mycobacterium bovis
GAGGLLFGNGGAGGPGA

SEQ ID NO: 212801 - protein, 17 aa, Mycobacterium bovis
GAGGPGFNGGAGGAGGR

SEQ ID NO: 212802 - protein, 22 aa, Mycobacterium bovis
GAGGRGGKGIDGGFGGDGGNGG

SEQ ID NO: 212803 - protein, 18 aa, Mycobacterium bovis
GAGGRSGLFEVLAAGGAG

SEQ ID NO: 212804 - protein, 25 aa, Mycobacterium bovis
GAGGTAGWFFGFGGNGGAGGIGVAG

SEQ ID NO: 212805 - protein, 17 aa, Mycobacterium bovis
GAGRWRGGDGAVRRLEF

SEQ ID NO: 212806 - protein, 21 aa, Mycobacterium bovis
GAGTFPWVLAITMPYSDAAQR

SEQ ID NO: 212807 - protein, 20 aa, Mycobacterium bovis
GAGVSGLWLLSGMRDDGVLT

SEQ ID NO: 212808 - protein, 23 aa, Mycobacterium bovis
GAKMVTAVACARVPKLTVVIGGS

SEQ ID NO: 212809 - protein, 17 aa, Mycobacterium bovis
GALIGFLGPRVYELLYG

SEQ ID NO: 212810 - protein, 19 aa, Mycobacterium bovis
GALKLGVELGRGAVIVVNL

SEQ ID NO: 212811 - protein, 20 aa, Mycobacterium bovis
GALSEWRATLIVRESACLDV

SEQ ID NO: 212812 - protein, 21 aa, Mycobacterium bovis
GAPLLSLRTDRDWLADIVRFV

SEQ ID NO: 212813 - protein, 17 aa, Mycobacterium bovis
GARGLAHFGVYQELTEA

SEQ ID NO: 212814 - protein, 24 aa, Mycobacterium bovis
GASPRFLLDFSRRFPDAAVVRLER

SEQ ID NO: 212815 - protein, 22 aa, Mycobacterium bovis
GASSEAARAWWGNFLAQKANEA

SEQ ID NO: 212816 - protein, 19 aa, Mycobacterium bovis
GATLWRSGIQRVLRGFVER

SEQ ID NO: 212817 - protein, 19 aa, Mycobacterium bovis
GAVGEIWLRGTTVVRGYLG

SEQ ID NO: 212818 - protein, 17 aa, Mycobacterium bovis
GAWSDIGQLGWWSASPA

SEQ ID NO: 212819 - protein, 19 aa, Mycobacterium bovis
GAWWPARPDAPMAGVTYWR

SEQ ID NO: 212820 - protein, 18 aa, Mycobacterium bovis
GCADLHRSDRDAAWPAIA

SEQ ID NO: 212821 - protein, 19 aa, Mycobacterium bovis
GCAGLRYNLFFDDRTLDGD

SEQ ID NO: 212822 - protein, 20 aa, Mycobacterium bovis
GCGMACPFCATGQGGLTRNL

SEQ ID NO: 212823 - protein, 24 aa, Mycobacterium bovis
GCPYRCTFCGTGAMSAMLGKDSYR

SEQ ID NO: 212824 - protein, 17 aa, Mycobacterium bovis
GCSFPNCDVPGYLTEVH

SEQ ID NO: 212825 - protein, 19 aa, Mycobacterium bovis
GDAALALLRAELRPGDVVL

SEQ ID NO: 212826 - protein, 20 aa, Mycobacterium bovis
GDARGGAALSVREVTGVPIL

SEQ ID NO: 212827 - protein, 17 aa, Mycobacterium bovis
GDARRLATMVLLIAQST

SEQ ID NO: 212828 - protein, 19 aa, Mycobacterium bovis
GDCLFPGGVGKTWQPADFT

SEQ ID NO: 212829 - protein, 23 aa, Mycobacterium bovis
GDEVSAAIAALFSSHGQQYQAMS

SEQ ID NO: 212830 - protein, 19 aa, Mycobacterium bovis
GDFVKIDFGALVAGYHSDM

SEQ ID NO: 212831 - protein, 19 aa, Mycobacterium bovis
GDHQMGFGGFNSGSGNIGF

SEQ ID NO: 212832 - protein, 21 aa, Mycobacterium bovis
GDLPPRFPIVGGHEGSGVIEE

SEQ ID NO: 212833 - protein, 17 aa, Mycobacterium bovis
GDQQGLFSAGYRVHVPE

SEQ ID NO: 212834 - protein, 19 aa, Mycobacterium bovis
GDRWYWHWDPQFIGGIAAF

SEQ ID NO: 212835 - protein, 24 aa, Mycobacterium bovis
GDYFKRGAIELAWALLTNSLAAGG

SEQ ID NO: 212836 - protein, 17 aa, Mycobacterium bovis
GDYQGLIGLPLLGIPVT

SEQ ID NO: 212837 - protein, 20 aa, Mycobacterium bovis
GECVALLFERCAPAVVAMVA

SEQ ID NO: 212838 - protein, 19 aa, Mycobacterium bovis
GEGGLRIVGISAVGSIDDL

SEQ ID NO: 212839 - protein, 25 aa, Mycobacterium bovis
GEHIGWRFWMGIAFELTSDPQELRE

SEQ ID NO: 212840 - protein, 18 aa, Mycobacterium bovis
GELERIGGRYGLQTMCEG

SEQ ID NO: 212841 - protein, 18 aa, Mycobacterium bovis
GELIPLCHPLGIEAVTVT

SEQ ID NO: 212842 - protein, 20 aa, Mycobacterium bovis
GELYLPRFLFGVFLSEQMIA

SEQ ID NO: 212843 - protein, 21 aa, Mycobacterium bovis
GEPLPRWQIALYWRTDGRPLW

SEQ ID NO: 212844 - protein, 22 aa, Mycobacterium bovis
GERFVLGVGFGWNVEELADHGV

SEQ ID NO: 212845 - protein, 20 aa, Mycobacterium bovis
GERLAVGVPKAFYQLDGQTL

SEQ ID NO: 212846 - protein, 20 aa, Mycobacterium bovis
GETLSALALRFYGDAELYRL

SEQ ID NO: 212847 - protein, 20 aa, Mycobacterium bovis
GETRRLRVCGPLNTVVNAAW

SEQ ID NO: 212848 - protein, 18 aa, Mycobacterium bovis
GEYRRCVRHGLADMYGFI

SEQ ID NO: 212849 - protein, 22 aa, Mycobacterium bovis
GFADHFLPVAFDRFTRADTARG

SEQ ID NO: 212850 - protein, 18 aa, Mycobacterium bovis
GFATLWVGEHVVMVDRPA

SEQ ID NO: 212851 - protein, 17 aa, Mycobacterium bovis
GFELAYRLLSYPKPVVM

SEQ ID NO: 212852 - protein, 19 aa, Mycobacterium bovis
GFGELRWALSGAAPIPKET

SEQ ID NO: 212853 - protein, 17 aa, Mycobacterium bovis
GFLGRYLALEWLDRMDL

SEQ ID NO: 212854 - protein, 18 aa, Mycobacterium bovis
GFPDGCFQTLLVSSGAVE

SEQ ID NO: 212855 - protein, 17 aa, Mycobacterium bovis
GFRRLRALFTHRRDNGL

SEQ ID NO: 212856 - protein, 17 aa, Mycobacterium bovis
GFTGWRPQLPVTQWSVT

SEQ ID NO: 212857 - protein, 19 aa, Mycobacterium bovis
GFVFPTCRWVHPIGPGNRS

SEQ ID NO: 212858 - protein, 19 aa, Mycobacterium bovis
GGACRRYLQELGDLPTNTL

SEQ ID NO: 212859 - protein, 23 aa, Mycobacterium bovis
GGAGGAAGLWGHGGAGGAGGSAS

SEQ ID NO: 212860 - protein, 22 aa, Mycobacterium bovis
GGAGGHGGWLWGNGGVGGSGGA

SEQ ID NO: 212861 - protein, 26 aa, Mycobacterium bovis
GGAGGQAALLFGRGGTGGAGGYGGDG

SEQ ID NO: 212862 - protein, 23 aa, Mycobacterium bovis
GGAGGRGGLLIGDGGAGGAGGVG

SEQ ID NO: 212863 - protein, 18 aa, Mycobacterium bovis
GGAGPLLIGNGGVGGLGG

SEQ ID NO: 212864 - protein, 17 aa, Mycobacterium bovis
GGALAPGTVRQWLAEHA

SEQ ID NO: 212865 - protein, 21 aa, Mycobacterium bovis
GGDGGRGGLLAGNGGTGGAGG

SEQ ID NO: 212866 - protein, 22 aa, Mycobacterium bovis
GGDGGRGGLLYGDGGAGGAGGN

SEQ ID NO: 212867 - protein, 23 aa, Mycobacterium bovis
GGEGGVGSILGGPGGNGGTGGNA

SEQ ID NO: 212868 - protein, 22 aa, Mycobacterium bovis
GGFRYGPAFGVELQFWVYEETV

SEQ ID NO: 212869 - protein, 26 aa, Mycobacterium bovis
GGGGGDGFDGTMAGLGGTGGSGGTGG

SEQ ID NO: 212870 - protein, 24 aa, Mycobacterium bovis
GGGGGNGGTGWNGGKGDTGSGGGA

SEQ ID NO: 212871 - protein, 25 aa, Mycobacterium bovis
GGGKRLRPLFAYWGWHAVASREPDP

SEQ ID NO: 212872 - protein, 22 aa, Mycobacterium bovis
GGGMCFTFLAAQGFSVGTSLLE

SEQ ID NO: 212873 - protein, 30 aa, Mycobacterium bovis
GGGTGGAGGHAWLFGHGGTGGIGGGPGGNG

SEQ ID NO: 212874 - protein, 27 aa, Mycobacterium bovis
GGHGGNGGNPGWLLGTAGGGGNGGAGS

SEQ ID NO: 212875 - protein, 17 aa, Mycobacterium bovis
GGIGVNTGTGWAYGGNG

SEQ ID NO: 212876 - protein, 22 aa, Mycobacterium bovis
GGKCPQCGTYVFPPRADNCPNP

SEQ ID NO: 212877 - protein, 19 aa, Mycobacterium bovis
GGLIGRAGSDGGVGAGGAG

SEQ ID NO: 212878 - protein, 25 aa, Mycobacterium bovis
GGLMPGFGGAPWVGGHWGLGGEGHS

SEQ ID NO: 212879 - protein, 17 aa, Mycobacterium bovis
GGLRRFLDELGELPNKS

SEQ ID NO: 212880 - protein, 19 aa, Mycobacterium bovis
GGNAGMLFGSGGGGGTGGF

SEQ ID NO: 212881 - protein, 21 aa, Mycobacterium bovis
GGNGATGTWGHNLGAGGTGGN

SEQ ID NO: 212882 - protein, 23 aa, Mycobacterium bovis
GGNGGHGGLWIGNGGDGGAGGVG

SEQ ID NO: 212883 - protein, 26 aa, Mycobacterium bovis
GGNGGHGGNGGWLLGNGGNGGLGGDG

SEQ ID NO: 212884 - protein, 19 aa, Mycobacterium bovis
GGNGGWLYGNGGLGGNGGA

SEQ ID NO: 212885 - protein, 19 aa, Mycobacterium bovis
GGPCARTVLDTALLHQVIA

SEQ ID NO: 212886 - protein, 21 aa, Mycobacterium bovis
GGRTGRPFPWHSLGEAYLGRR

SEQ ID NO: 212887 - protein, 24 aa, Mycobacterium bovis
GGSGGRGGLLFGNGGNGSVGGMGG

SEQ ID NO: 212888 - protein, 21 aa, Mycobacterium bovis
GGSGGSLFGFGGAGGTGGSSG

SEQ ID NO: 212889 - protein, 19 aa, Mycobacterium bovis
GGSMGRYGGVWAHDETRKS

SEQ ID NO: 212890 - protein, 22 aa, Mycobacterium bovis
GGTGGPGGFGIFGGGAGGDGGS

SEQ ID NO: 212891 - protein, 21 aa, Mycobacterium bovis
GGTVGEMFGRKVARLMEWCAM

SEQ ID NO: 212892 - protein, 18 aa, Mycobacterium bovis
GGVGGVFGNGGFGGAGGL

SEQ ID NO: 212893 - protein, 19 aa, Mycobacterium bovis
GGVLYRFAVDPDRSAQFLL

SEQ ID NO: 212894 - protein, 23 aa, Mycobacterium bovis
GHAAELFGWLGPHPDTMVSSAAT

SEQ ID NO: 212895 - protein, 22 aa, Mycobacterium bovis
GHCRGVCLGGYLLQGGYGWNSR

SEQ ID NO: 212896 - protein, 21 aa, Mycobacterium bovis
GHDTFCPVGPWIVTDLAPFDP

SEQ ID NO: 212897 - protein, 18 aa, Mycobacterium bovis
GHDYTWFVLNAKIIEKEF

SEQ ID NO: 212898 - protein, 25 aa, Mycobacterium bovis
GHIELAAPVTHIWYFKGVPSRLGYL

SEQ ID NO: 212899 - protein, 17 aa, Mycobacterium bovis
GHRCGACRIEIGRGELA

SEQ ID NO: 212900 - protein, 22 aa, Mycobacterium bovis
GHRIRAAIHFDDLQWERRYRRV

SEQ ID NO: 212901 - protein, 20 aa, Mycobacterium bovis
GIANFLGFSVLHGGAGGAGG

SEQ ID NO: 212902 - protein, 26 aa, Mycobacterium bovis
GIGGGPGGNGGWLLGNGGHGGAGGIG

SEQ ID NO: 212903 - protein, 21 aa, Mycobacterium bovis
GIHVFLRIATDWDFVEVRRAG

SEQ ID NO: 212904 - protein, 19 aa, Mycobacterium bovis
GIKVARRLLANVAHVAVFD

SEQ ID NO: 212905 - protein, 19 aa, Mycobacterium bovis
GILNRGAGISGVYNTGALG

SEQ ID NO: 212906 - protein, 19 aa, Mycobacterium bovis
GILNRGAGISGVYNTGTLG

SEQ ID NO: 212907 - protein, 25 aa, Mycobacterium bovis
GILWRGDYQGLAGFAVGYTLPLFPA

SEQ ID NO: 212908 - protein, 17 aa, Mycobacterium bovis
GISRPTFYFYFPSKEAV

SEQ ID NO: 212909 - protein, 21 aa, Mycobacterium bovis
GKAEKCTLCYPRIEVGLPTVC

SEQ ID NO: 212910 - protein, 20 aa, Mycobacterium bovis
GKFLNNWRMAELHAKEAPDR

SEQ ID NO: 212911 - protein, 22 aa, Mycobacterium bovis
GKGGASGMLIGNGGNGGSGGVG

SEQ ID NO: 212912 - protein, 18 aa, Mycobacterium bovis
GKGGGRLPITLWIVDTNA

SEQ ID NO: 212913 - protein, 23 aa, Mycobacterium bovis
GKQAASAFAMWFPIEGGSKYGGY

SEQ ID NO: 212914 - protein, 21 aa, Mycobacterium bovis
GKRYALPHARILMHQPLGGVT

SEQ ID NO: 212915 - protein, 19 aa, Mycobacterium bovis
GKVPFVFRTLPGYTFYASQ

SEQ ID NO: 212916 - protein, 27 aa, Mycobacterium bovis
GLADAAWRGPAAVAMARAVAPYLGWLI

SEQ ID NO: 212917 - protein, 21 aa, Mycobacterium bovis
GLAGRWLRPGGLFAVEHDDTT

SEQ ID NO: 212918 - protein, 24 aa, Mycobacterium bovis
GLCSARMYFAYGLGNSVWFPLATG

SEQ ID NO: 212919 - protein, 20 aa, Mycobacterium bovis
GLDDCFRLLAGGVRGAVQRQ

SEQ ID NO: 212920 - protein, 19 aa, Mycobacterium bovis
GLEFPVVFVTGWEDGMFPH

SEQ ID NO: 212921 - protein, 19 aa, Mycobacterium bovis
GLGARLFQVGSRGGDGGVG

SEQ ID NO: 212922 - protein, 23 aa, Mycobacterium bovis
GLGGLGLVVARWLVDRGAGRVVL

SEQ ID NO: 212923 - protein, 19 aa, Mycobacterium bovis
GLIGPEWFPDSYPWVPSIN

SEQ ID NO: 212924 - protein, 17 aa, Mycobacterium bovis
GLKVSIPEEVAWRMGWI

SEQ ID NO: 212925 - protein, 19 aa, Mycobacterium bovis
GLLRPDAGLVRLGDRVLTD

SEQ ID NO: 212926 - protein, 20 aa, Mycobacterium bovis
GLLWRADRQGLLAANYTITI

SEQ ID NO: 212927 - protein, 18 aa, Mycobacterium bovis
GLQARLGLDSGKWTHEQM

SEQ ID NO: 212928 - protein, 22 aa, Mycobacterium bovis
GLQCGFCTPGMLITARALLDRN

SEQ ID NO: 212929 - protein, 20 aa, Mycobacterium bovis
GLRQRWALVGGFAVSARSEP

SEQ ID NO: 212930 - protein, 18 aa, Mycobacterium bovis
GLRRCLRPRPAVATELDL

SEQ ID NO: 212931 - protein, 19 aa, Mycobacterium bovis
GLSSRAEWLPAWEEGLRRA

SEQ ID NO: 212932 - protein, 23 aa, Mycobacterium bovis
GLVGEKARYMWVSTFHSTCVRIL

SEQ ID NO: 212933 - protein, 17 aa, Mycobacterium bovis
GLVGFSFSIDIAGSTLL

SEQ ID NO: 212934 - protein, 19 aa, Mycobacterium bovis
GMAPEEWRAFAARASLHAA

SEQ ID NO: 212935 - protein, 24 aa, Mycobacterium bovis
GMGGLRLLLSLARAYADEPDEVGG

SEQ ID NO: 212936 - protein, 17 aa, Mycobacterium bovis
GMPWIVVVGRGWADGVV

SEQ ID NO: 212937 - protein, 25 aa, Mycobacterium bovis
GNGADAAAVVGFGANGDPGFAGGKG

SEQ ID NO: 212938 - protein, 21 aa, Mycobacterium bovis
GNGGAGGWIYGHGGHGGAGGN

SEQ ID NO: 212939 - protein, 18 aa, Mycobacterium bovis
GNGGWLYGNGGPGGAAGL

SEQ ID NO: 212940 - protein, 25 aa, Mycobacterium bovis
GNPEGGWTLVSWDGIPVGPASLPTA

SEQ ID NO: 212941 - protein, 20 aa, Mycobacterium bovis
GNSWPMARLTLALSPATLPK

SEQ ID NO: 212942 - protein, 26 aa, Mycobacterium bovis
GNYSNGFWWRGDYQGLAGISQTITVP

SEQ ID NO: 212943 - protein, 23 aa, Mycobacterium bovis
GPCYRCLHPAPPPPGLVPSCAEG

SEQ ID NO: 212944 - protein, 23 aa, Mycobacterium bovis
GPESWGFTGWRWFSGTAPRYIRD

SEQ ID NO: 212945 - protein, 22 aa, Mycobacterium bovis
GPGGGHGLLGLGGSHGAGGAGG

SEQ ID NO: 212946 - protein, 17 aa, Mycobacterium bovis
GPGGLFLALPGARADGH

SEQ ID NO: 212947 - protein, 20 aa, Mycobacterium bovis
GPHFECWTVLGAWAEQTSHI

SEQ ID NO: 212948 - protein, 23 aa, Mycobacterium bovis
GPHMAGGGWAWADFVAEADPSNP

SEQ ID NO: 212949 - protein, 18 aa, Mycobacterium bovis
GPIVIGSFFLPAFNIPGI

SEQ ID NO: 212950 - protein, 17 aa, Mycobacterium bovis
GPPMGFFRIGWVRTLAN

SEQ ID NO: 212951 - protein, 21 aa, Mycobacterium bovis
GPRLRYLLAVKACFAVFQTGT

SEQ ID NO: 212952 - protein, 22 aa, Mycobacterium bovis
GPVEALARVEFCGQGVDLIAEL

SEQ ID NO: 212953 - protein, 20 aa, Mycobacterium bovis
GQCAACATDGRTPCEPGSAA

SEQ ID NO: 212954 - protein, 20 aa, Mycobacterium bovis
GQDGHWRLGPAITELATHVD

SEQ ID NO: 212955 - protein, 17 aa, Mycobacterium bovis
GQGSVLVPFSWQGVSLH

SEQ ID NO: 212956 - protein, 18 aa, Mycobacterium bovis
GQLRLSVRQVMWGADAGL

SEQ ID NO: 212957 - protein, 23 aa, Mycobacterium bovis
GQRAAGLSQIWSRQLGRAIGPDS

SEQ ID NO: 212958 - protein, 18 aa, Mycobacterium bovis
GQVTSGLTAGVWQGAAAA

SEQ ID NO: 212959 - protein, 18 aa, Mycobacterium bovis
GRAARLGHRLTIAMTRWQ

SEQ ID NO: 212960 - protein, 17 aa, Mycobacterium bovis
GRDAWEFALLRGALQRG

SEQ ID NO: 212961 - protein, 17 aa, Mycobacterium bovis
GRDDWAVHIALWRRSSN

SEQ ID NO: 212962 - protein, 20 aa, Mycobacterium bovis
GRFGALIPRLVRQGINGEGL

SEQ ID NO: 212963 - protein, 18 aa, Mycobacterium bovis
GRGARFLLGLVVSTGVGG

SEQ ID NO: 212964 - protein, 17 aa, Mycobacterium bovis
GRHIPVFAHVTVETTGT

SEQ ID NO: 212965 - protein, 18 aa, Mycobacterium bovis
GRHVPKLRQVIGCVFQDF

SEQ ID NO: 212966 - protein, 19 aa, Mycobacterium bovis
GRIKDLLIVYGRNHSPDDI

SEQ ID NO: 212967 - protein, 20 aa, Mycobacterium bovis
GRIKDLLIVYGRNHSPDDIE

SEQ ID NO: 212968 - protein, 17 aa, Mycobacterium bovis
GRIPIWLPPAKRLPDGL

SEQ ID NO: 212969 - protein, 18 aa, Mycobacterium bovis
GRLSDMVRRILRSMFAVG

SEQ ID NO: 212970 - protein, 19 aa, Mycobacterium bovis
GRLSEWRATLIVRESACLD

SEQ ID NO: 212971 - protein, 20 aa, Mycobacterium bovis
GRLWLARGGTYALANIRGGG

SEQ ID NO: 212972 - protein, 20 aa, Mycobacterium bovis
GRPKPVPIWAALDTDRGDRL

SEQ ID NO: 212973 - protein, 21 aa, Mycobacterium bovis
GRPPGPCPIPLSAGDDGPGRG

SEQ ID NO: 212974 - protein, 17 aa, Mycobacterium bovis
GRPVLVGGLGGRGVVAG

SEQ ID NO: 212975 - protein, 19 aa, Mycobacterium bovis
GRSEVRILFAFDPARQAIM

SEQ ID NO: 212976 - protein, 19 aa, Mycobacterium bovis
GRSGFLLAPWTAEQIVSEL

SEQ ID NO: 212977 - protein, 17 aa, Mycobacterium bovis
GRSGLRRNIRWDPLDSV

SEQ ID NO: 212978 - protein, 17 aa, Mycobacterium bovis
GRSWSRWSFIGAGAPTA

SEQ ID NO: 212979 - protein, 18 aa, Mycobacterium bovis
GRTDCKWGAYLDNVGDFD

SEQ ID NO: 212980 - protein, 21 aa, Mycobacterium bovis
GRTPLPFYVWRAFARYSPVLP

SEQ ID NO: 212981 - protein, 18 aa, Mycobacterium bovis
GSAFGPGGTGGMGGAGGT

SEQ ID NO: 212982 - protein, 18 aa, Mycobacterium bovis
GSARCRDVLALKLNAQLI

SEQ ID NO: 212983 - protein, 17 aa, Mycobacterium bovis
GSDSLREPVVWQRLHQV

SEQ ID NO: 212984 - protein, 20 aa, Mycobacterium bovis
GSEAPGRPGGAGGTGGAGGN

SEQ ID NO: 212985 - protein, 18 aa, Mycobacterium bovis
GSFFPVIPVCSSTGVGTL

SEQ ID NO: 212986 - protein, 26 aa, Mycobacterium bovis
GSGGAGGNGGWLLGNGGIGGAGGTGG

SEQ ID NO: 212987 - protein, 23 aa, Mycobacterium bovis
GSIFLRPFLKYQIITVVAPNSPL

SEQ ID NO: 212988 - protein, 26 aa, Mycobacterium bovis
GSIRIPCTWCGLFGLKPQRDRISLEP

SEQ ID NO: 212989 - protein, 20 aa, Mycobacterium bovis
GSLLKELRSILAPECAARAR

SEQ ID NO: 212990 - protein, 18 aa, Mycobacterium bovis
GSMSLSFSDPRFDDVKAP

SEQ ID NO: 212991 - protein, 18 aa, Mycobacterium bovis
GSTMTLPLISMRFEGEDW

SEQ ID NO: 212992 - protein, 18 aa, Mycobacterium bovis
GSVIGSWLLDLTAIALRE

SEQ ID NO: 212993 - protein, 18 aa, Mycobacterium bovis
GSVLSGLAALHWRGPAAE

SEQ ID NO: 212994 - protein, 17 aa, Mycobacterium bovis
GSYRWLRPSGRRTAKEI

SEQ ID NO: 212995 - protein, 18 aa, Mycobacterium bovis
GTAKFLFTRTTVGEIGIL

SEQ ID NO: 212996 - protein, 18 aa, Mycobacterium bovis
GTDVVVWLGTLSTLSRTA

SEQ ID NO: 212997 - protein, 25 aa, Mycobacterium bovis
GTGGKGGDGFGVFGKGGAGGTGGRG

SEQ ID NO: 212998 - protein, 20 aa, Mycobacterium bovis
GTGLFSGFMSGFGNTGFLQS

SEQ ID NO: 212999 - protein, 18 aa, Mycobacterium bovis
GTGWRWRTWHLYPSASGG

SEQ ID NO: 213000 - protein, 19 aa, Mycobacterium bovis
GTLGTFTVHGFRFPEITGD

SEQ ID NO: 213001 - protein, 19 aa, Mycobacterium bovis
GTPGSPMVAPPPPTPITQV

SEQ ID NO: 213002 - protein, 21 aa, Mycobacterium bovis
GTRYLPPFAYFMDWPNAFQVL

SEQ ID NO: 213003 - protein, 19 aa, Mycobacterium bovis
GTVAKWRLQATQSRVRDVQ

SEQ ID NO: 213004 - protein, 26 aa, Mycobacterium bovis
GTVGAFPFGFGWQQSPGFFNSTTTPS

SEQ ID NO: 213005 - protein, 21 aa, Mycobacterium bovis
GVACYPARFQLVLAANPCPCA

SEQ ID NO: 213006 - protein, 18 aa, Mycobacterium bovis
GVEAGLIGPEWFPDSYPW

SEQ ID NO: 213007 - protein, 17 aa, Mycobacterium bovis
GVFCRRWGVPLIDGGTV

SEQ ID NO: 213008 - protein, 26 aa, Mycobacterium bovis
GVLWRGDYQGLLGFSYRPAVLPQTPF

SEQ ID NO: 213009 - protein, 17 aa, Mycobacterium bovis
GVMWKRFSETGAIKAKS

SEQ ID NO: 213010 - protein, 18 aa, Mycobacterium bovis
GVRDVVLCPGSRNAPLAF

SEQ ID NO: 213011 - protein, 18 aa, Mycobacterium bovis
GVRRFALRPVIGIDPAAV

SEQ ID NO: 213012 - protein, 20 aa, Mycobacterium bovis
GVTPAMWAWWFGWHGSDTRR

SEQ ID NO: 213013 - protein, 19 aa, Mycobacterium bovis
GVVIGRGCLGRPWLFAELS

SEQ ID NO: 213014 - protein, 18 aa, Mycobacterium bovis
GVVLLMWAGILAYLDRYG

SEQ ID NO: 213015 - protein, 17 aa, Mycobacterium bovis
GWRLPRRTAESALRASL

SEQ ID NO: 213016 - protein, 17 aa, Mycobacterium bovis
GYENLRFFASLYAGATA

SEQ ID NO: 213017 - protein, 18 aa, Mycobacterium bovis
GYHLGWWNADRSTAAGSS

SEQ ID NO: 213018 - protein, 18 aa, Mycobacterium bovis
GYRVRRFAARVVWKLAPD

SEQ ID NO: 213019 - protein, 17 aa, Mycobacterium bovis
HAAICWPLLVGMAKAKY

SEQ ID NO: 213020 - protein, 22 aa, Mycobacterium bovis
HAAKGLEWDAVFLVGLADGTLP

SEQ ID NO: 213021 - protein, 19 aa, Mycobacterium bovis
HAELEWWTSPFVLAHGVPP

SEQ ID NO: 213022 - protein, 19 aa, Mycobacterium bovis
HAPWPWGVIDQAARVLLPA

SEQ ID NO: 213023 - protein, 19 aa, Mycobacterium bovis
HAWVQAWTGGWWHYDPTND

SEQ ID NO: 213024 - protein, 18 aa, Mycobacterium bovis
HCAAMSFGSVTSGLVVGW

SEQ ID NO: 213025 - protein, 17 aa, Mycobacterium bovis
HCGDAFYHRGTLDGRFR

SEQ ID NO: 213026 - protein, 19 aa, Mycobacterium bovis
HCNIEHGCVVARAETLRGA

SEQ ID NO: 213027 - protein, 18 aa, Mycobacterium bovis
HDAQCTTMSWPQRADHAA

SEQ ID NO: 213028 - protein, 21 aa, Mycobacterium bovis
HDRLRLALLLCAVRPEIGGAL

SEQ ID NO: 213029 - protein, 22 aa, Mycobacterium bovis
HERETYDFFGIIFDGHPALTRI

SEQ ID NO: 213030 - protein, 19 aa, Mycobacterium bovis
HFNLSVGVTDAFLRAVERN

SEQ ID NO: 213031 - protein, 21 aa, Mycobacterium bovis
HGFGSFWWSWRHQLCGLTGAR

SEQ ID NO: 213032 - protein, 19 aa, Mycobacterium bovis
HGFPESWYSWRHQIPALAG

SEQ ID NO: 213033 - protein, 22 aa, Mycobacterium bovis
HGGDGFRTAGAGGRGGDGGKGA

SEQ ID NO: 213034 - protein, 21 aa, Mycobacterium bovis
HGGPHYLCLAIHAMVTDDSSR

SEQ ID NO: 213035 - protein, 23 aa, Mycobacterium bovis
HGIDTVVVGWGYGRADFIDKTST

SEQ ID NO: 213036 - protein, 20 aa, Mycobacterium bovis
HIAQLLPWIEANFRTYAEYD

SEQ ID NO: 213037 - protein, 22 aa, Mycobacterium bovis
HIESRPAVTLSWIREFPSLGAA

SEQ ID NO: 213038 - protein, 17 aa, Mycobacterium bovis
HILIDLPAVPGFGNTTG

SEQ ID NO: 213039 - protein, 17 aa, Mycobacterium bovis
HKKGSALVPSWVAFAVT

SEQ ID NO: 213040 - protein, 18 aa, Mycobacterium bovis
HLDFGTLAVNGFQIPAIT

SEQ ID NO: 213041 - protein, 18 aa, Mycobacterium bovis
HLGGWAVVSGVLHWRHSG

SEQ ID NO: 213042 - protein, 19 aa, Mycobacterium bovis
HLPKGLGVIGLLIEDPKPL

SEQ ID NO: 213043 - protein, 18 aa, Mycobacterium bovis
HMWFGDLVTMTWWDDLWL

SEQ ID NO: 213044 - protein, 19 aa, Mycobacterium bovis
HNGCPLGNLIPEWNDLVRR

SEQ ID NO: 213045 - protein, 19 aa, Mycobacterium bovis
HPDRAVAVLAALPAWTGEP

SEQ ID NO: 213046 - protein, 20 aa, Mycobacterium bovis
HPFMKFEGWTPLAQLKVGDR

SEQ ID NO: 213047 - protein, 24 aa, Mycobacterium bovis
HPGKWRVVFFWPKDFTFVCPTEIA

SEQ ID NO: 213048 - protein, 25 aa, Mycobacterium bovis
HPVAAFPQWFGRSWRRVAMLRYGEN

SEQ ID NO: 213049 - protein, 24 aa, Mycobacterium bovis
HQISRAGNMLSVFFGETPVTDFAS

SEQ ID NO: 213050 - protein, 17 aa, Mycobacterium bovis
HRAGHLGAMYPWQSGSD

SEQ ID NO: 213051 - protein, 17 aa, Mycobacterium bovis
HRKAFRRTIKWRTGCEG

SEQ ID NO: 213052 - protein, 25 aa, Mycobacterium bovis
HRLPLAIMRLRMLRRRSVRFFGTYD

SEQ ID NO: 213053 - protein, 18 aa, Mycobacterium bovis
HRRFGDIVQLVFALVPFR

SEQ ID NO: 213054 - protein, 17 aa, Mycobacterium bovis
HRRVPDRYPEVIVQAVS

SEQ ID NO: 213055 - protein, 20 aa, Mycobacterium bovis
HSPKRLESELTWIEEHTGGK

SEQ ID NO: 213056 - protein, 18 aa, Mycobacterium bovis
HSYGSLLSGIALKDGASS

SEQ ID NO: 213057 - protein, 18 aa, Mycobacterium bovis
HTPLPLLAFTAWPEVRSQ

SEQ ID NO: 213058 - protein, 19 aa, Mycobacterium bovis
HVPEIPAHVTVEVPVNIPI

SEQ ID NO: 213059 - protein, 23 aa, Mycobacterium bovis
HVTRLRADLCPEWPQPAQPGGSY

SEQ ID NO: 213060 - protein, 17 aa, Mycobacterium bovis
HVVPRWGGDANFITIIG

SEQ ID NO: 213061 - protein, 18 aa, Mycobacterium bovis
HWPMMVFRIGHARAPSVR

SEQ ID NO: 213062 - protein, 18 aa, Mycobacterium bovis
IAGRLGLRADVRRVPLFG

SEQ ID NO: 213063 - protein, 17 aa, Mycobacterium bovis
IAIVGMSCRFPGGVDSP

SEQ ID NO: 213064 - protein, 17 aa, Mycobacterium bovis
IAKELPMEYALELNRLI

SEQ ID NO: 213065 - protein, 17 aa, Mycobacterium bovis
IALPRRTVVTFTPEHTG

SEQ ID NO: 213066 - protein, 19 aa, Mycobacterium bovis
IALTFGVDIPIHIPINIDA

SEQ ID NO: 213067 - protein, 24 aa, Mycobacterium bovis
IAMPALRLDAAFAHLNLGDSHGNA

SEQ ID NO: 213068 - protein, 19 aa, Mycobacterium bovis
IANAAAMRVVLGAVNAPTQ

SEQ ID NO: 213069 - protein, 19 aa, Mycobacterium bovis
IANGSFAPSFVGFGGNGGN

SEQ ID NO: 213070 - protein, 25 aa, Mycobacterium bovis
IAQARLGPGRIHHCMRALGAAERAL

SEQ ID NO: 213071 - protein, 23 aa, Mycobacterium bovis
IARYNARCGRTFVLPNEQAAYDA

SEQ ID NO: 213072 - protein, 23 aa, Mycobacterium bovis
IATDHLMRFPGRFSEQLLPEHLH

SEQ ID NO: 213073 - protein, 20 aa, Mycobacterium bovis
IATGPRWRCPAGRCRRRPSD

SEQ ID NO: 213074 - protein, 18 aa, Mycobacterium bovis
IATTRFLLDVNISGGLPA

SEQ ID NO: 213075 - protein, 19 aa, Mycobacterium bovis
ICAFGRIGSMFACEDLGYV

SEQ ID NO: 213076 - protein, 19 aa, Mycobacterium bovis
ICIPVPFYHCFGMVMGNLA

SEQ ID NO: 213077 - protein, 18 aa, Mycobacterium bovis
ICSARTAAQFGIEPRVAM

SEQ ID NO: 213078 - protein, 19 aa, Mycobacterium bovis
IDAPALWPGLPIRPVKGEV

SEQ ID NO: 213079 - protein, 18 aa, Mycobacterium bovis
IDATHAWASVWTPQQPGR

SEQ ID NO: 213080 - protein, 25 aa, Mycobacterium bovis
IDEALKLADLVAVFAPGGALAQYDE

SEQ ID NO: 213081 - protein, 23 aa, Mycobacterium bovis
IDERARAGLFLAMQYPVEVPGVS

SEQ ID NO: 213082 - protein, 19 aa, Mycobacterium bovis
IDFFTRWAAGNIKATDVDD

SEQ ID NO: 213083 - protein, 19 aa, Mycobacterium bovis
IDLLLKRAASLGIQIRYET

SEQ ID NO: 213084 - protein, 22 aa, Mycobacterium bovis
IDNLRAAFTWSRGNGDIAAALQ

SEQ ID NO: 213085 - protein, 19 aa, Mycobacterium bovis
IDPWGGSYYVEWLTHRLAR

SEQ ID NO: 213086 - protein, 17 aa, Mycobacterium bovis
IDRVRWDDVVSRVFGRI

SEQ ID NO: 213087 - protein, 17 aa, Mycobacterium bovis
IDSPTLPTCERIAVLSQ

SEQ ID NO: 213088 - protein, 18 aa, Mycobacterium bovis
IEADIVRRGWPIGASLGS

SEQ ID NO: 213089 - protein, 23 aa, Mycobacterium bovis
IECPAGTIGEIWVKGDNVAEGYW

SEQ ID NO: 213090 - protein, 24 aa, Mycobacterium bovis
IEDWAEIWPCAGMAYPKALADDLR

SEQ ID NO: 213091 - protein, 20 aa, Mycobacterium bovis
IEHWTRLPVEVELASEFRYR

SEQ ID NO: 213092 - protein, 20 aa, Mycobacterium bovis
IEIELDQCWDLLRQRRALRQ

SEQ ID NO: 213093 - protein, 19 aa, Mycobacterium bovis
IEKMRVAGRIAAGALAEAG

SEQ ID NO: 213094 - protein, 18 aa, Mycobacterium bovis
IELARSGAKVAISDVDTD

SEQ ID NO: 213095 - protein, 19 aa, Mycobacterium bovis
IELGIKWLSLYAFSTENWK

SEQ ID NO: 213096 - protein, 19 aa, Mycobacterium bovis
IEMADWWAYLNGVRKTYPL

SEQ ID NO: 213097 - protein, 19 aa, Mycobacterium bovis
IERFLQLWAEGSMTIAMPS

SEQ ID NO: 213098 - protein, 19 aa, Mycobacterium bovis
IFTKFNIPINIARVFHRDQ

SEQ ID NO: 213099 - protein, 17 aa, Mycobacterium bovis
IGAVLSMHFAKQAARFF

SEQ ID NO: 213100 - protein, 17 aa, Mycobacterium bovis
IGGRYGLQTMCEGGGTA

SEQ ID NO: 213101 - protein, 19 aa, Mycobacterium bovis
IGIVEGWRGTIVHRVEIDV

SEQ ID NO: 213102 - protein, 18 aa, Mycobacterium bovis
IGLAAAKYWVCKRSTAHA

SEQ ID NO: 213103 - protein, 18 aa, Mycobacterium bovis
IGLLARLGYRFAPTQIPG

SEQ ID NO: 213104 - protein, 17 aa, Mycobacterium bovis
IGLRIAGGAIVWATPDH

SEQ ID NO: 213105 - protein, 19 aa, Mycobacterium bovis
IGRELDRYLPFLATTKVLM

SEQ ID NO: 213106 - protein, 20 aa, Mycobacterium bovis
IGRIKDLLIVYGRNHAPDDI

SEQ ID NO: 213107 - protein, 17 aa, Mycobacterium bovis
IGRRAANAVTVFFDGAT

SEQ ID NO: 213108 - protein, 17 aa, Mycobacterium bovis
IGSFFLPAFNIPGIDVP

SEQ ID NO: 213109 - protein, 21 aa, Mycobacterium bovis
IGTKELIAWLPTLLGLGGADL

SEQ ID NO: 213110 - protein, 18 aa, Mycobacterium bovis
IHQVMVMPGSVMTIPGMR

SEQ ID NO: 213111 - protein, 22 aa, Mycobacterium bovis
IIANRVSFAFGLRGPSVTIDSG

SEQ ID NO: 213112 - protein, 19 aa, Mycobacterium bovis
IIPWNFPILMAAWKLAPAL

SEQ ID NO: 213113 - protein, 17 aa, Mycobacterium bovis
IKASMGMGAIRVQPLAP

SEQ ID NO: 213114 - protein, 17 aa, Mycobacterium bovis
IKLGPSLWHRDFHDAVI

SEQ ID NO: 213115 - protein, 24 aa, Mycobacterium bovis
ILATEILDPLGFRWTNFGVAERDV

SEQ ID NO: 213116 - protein, 17 aa, Mycobacterium bovis
ILEEARVPFLKDAFGAD

SEQ ID NO: 213117 - protein, 17 aa, Mycobacterium bovis
ILMGYGWHRGRDEGQLL

SEQ ID NO: 213118 - protein, 25 aa, Mycobacterium bovis
ILSDLNAFMGIRWVHNAYPFTAAEV

SEQ ID NO: 213119 - protein, 18 aa, Mycobacterium bovis
ILSSIRLPGGHFRSDIGL

SEQ ID NO: 213120 - protein, 17 aa, Mycobacterium bovis
ILTCLMHGGLCVTGGEN

SEQ ID NO: 213121 - protein, 17 aa, Mycobacterium bovis
ILYRLYRPLIFALYCLP

SEQ ID NO: 213122 - protein, 25 aa, Mycobacterium bovis
INAAICCAAAEFATRTQATATGVAA

SEQ ID NO: 213123 - protein, 17 aa, Mycobacterium bovis
INELLNWQVASAGEDIN

SEQ ID NO: 213124 - protein, 23 aa, Mycobacterium bovis
INEPRFPSFKGIMAAKKKEVTVL

SEQ ID NO: 213125 - protein, 23 aa, Mycobacterium bovis
INGHVRAGGFGLVGACDMVVAGP

SEQ ID NO: 213126 - protein, 18 aa, Mycobacterium bovis
INLRFVLGYTPLEFRDTL

SEQ ID NO: 213127 - protein, 17 aa, Mycobacterium bovis
INSLRMYLGAGSAPMLQ

SEQ ID NO: 213128 - protein, 23 aa, Mycobacterium bovis
INYLRCIGCGLCIEACPTRALTM

SEQ ID NO: 213129 - protein, 17 aa, Mycobacterium bovis
IPAERWVYPQAGTDAHD

SEQ ID NO: 213130 - protein, 20 aa, Mycobacterium bovis
IPAFLRYDLRPVTGEWQIAA

SEQ ID NO: 213131 - protein, 18 aa, Mycobacterium bovis
IPCSAPLPAPRVSPYPAV

SEQ ID NO: 213132 - protein, 19 aa, Mycobacterium bovis
IPEDLAFAESRIRPSTIAA

SEQ ID NO: 213133 - protein, 22 aa, Mycobacterium bovis
IPGGWWLTFGQILGLAQNAPGV

SEQ ID NO: 213134 - protein, 19 aa, Mycobacterium bovis
IPGPLKWDLTRGVATDTPE

SEQ ID NO: 213135 - protein, 18 aa, Mycobacterium bovis
IPKPRFVLMPTPIWDQLF

SEQ ID NO: 213136 - protein, 20 aa, Mycobacterium bovis
IPLIDIPAAPGFGNSTTTPS

SEQ ID NO: 213137 - protein, 18 aa, Mycobacterium bovis
IPLIKIPAAPGFGNSTTS

SEQ ID NO: 213138 - protein, 18 aa, Mycobacterium bovis
IPLLDIPPAPGFGNSTTG

SEQ ID NO: 213139 - protein, 19 aa, Mycobacterium bovis
IPSLFAIYPTNDWHERETY

SEQ ID NO: 213140 - protein, 19 aa, Mycobacterium bovis
IPSPAAGVLTKIIAQEDDT

SEQ ID NO: 213141 - protein, 23 aa, Mycobacterium bovis
IPVCTRLGLSPPDVWTLSKLVRH

SEQ ID NO: 213142 - protein, 19 aa, Mycobacterium bovis
IPVGPRLGNVVVEVDHLDK

SEQ ID NO: 213143 - protein, 21 aa, Mycobacterium bovis
IPVKRLRQAGVLDLLLALANE

SEQ ID NO: 213144 - protein, 17 aa, Mycobacterium bovis
IQLYVKRVFIMGDCDQL

SEQ ID NO: 213145 - protein, 18 aa, Mycobacterium bovis
IQREWQWRLSRGESLQNL

SEQ ID NO: 213146 - protein, 17 aa, Mycobacterium bovis
IRAGAGLVLAGLVADGD

SEQ ID NO: 213147 - protein, 17 aa, Mycobacterium bovis
IRALMALPPGQAPDPSR

SEQ ID NO: 213148 - protein, 19 aa, Mycobacterium bovis
IRALYAFKRYAWWPYTLVM

SEQ ID NO: 213149 - protein, 21 aa, Mycobacterium bovis
IRAPSRLQVWRTRATTARECS

SEQ ID NO: 213150 - protein, 19 aa, Mycobacterium bovis
IREELKFSGDRAMAAEDPE

SEQ ID NO: 213151 - protein, 21 aa, Mycobacterium bovis
IRFGSLYLRDGVSLAGQQVVP

SEQ ID NO: 213152 - protein, 19 aa, Mycobacterium bovis
IRIDRFELLAARRRDQLID

SEQ ID NO: 213153 - protein, 17 aa, Mycobacterium bovis
IRLARFGPRAALPATAM

SEQ ID NO: 213154 - protein, 21 aa, Mycobacterium bovis
IRPGQYVRLHWARPRSRLPGQ

SEQ ID NO: 213155 - protein, 20 aa, Mycobacterium bovis
IRWSLDLLRRRFAKVIWVPG

SEQ ID NO: 213156 - protein, 18 aa, Mycobacterium bovis
IRYPARLAPLHGWGSDGA

SEQ ID NO: 213157 - protein, 20 aa, Mycobacterium bovis
ISAFVVRISCHLRIQNQAAD

SEQ ID NO: 213158 - protein, 17 aa, Mycobacterium bovis
ISARLDLPVGVARVLVG

SEQ ID NO: 213159 - protein, 19 aa, Mycobacterium bovis
ISARSEWAPEFAIHDLDSL

SEQ ID NO: 213160 - protein, 18 aa, Mycobacterium bovis
ISGMNAVAGWRGAPRPVL

SEQ ID NO: 213161 - protein, 17 aa, Mycobacterium bovis
ISPAWLRLDARFGSVYR

SEQ ID NO: 213162 - protein, 18 aa, Mycobacterium bovis
ISRALTLLAELWSRYHNV

SEQ ID NO: 213163 - protein, 25 aa, Mycobacterium bovis
ISRQLWWGHRIPIWYGPDGEQVCVG

SEQ ID NO: 213164 - protein, 22 aa, Mycobacterium bovis
ITAPEGWAFEYSRFQEAQKREI

SEQ ID NO: 213165 - protein, 17 aa, Mycobacterium bovis
ITATPAWDALRRHHDQI

SEQ ID NO: 213166 - protein, 17 aa, Mycobacterium bovis
ITEVIALQERLGLDVLV

SEQ ID NO: 213167 - protein, 19 aa, Mycobacterium bovis
ITIVDAHLDGGFGPVVLPP

SEQ ID NO: 213168 - protein, 20 aa, Mycobacterium bovis
ITKARWVYFLTRMRNPTGDT

SEQ ID NO: 213169 - protein, 17 aa, Mycobacterium bovis
ITLPTPRPPFHEELPRI

SEQ ID NO: 213170 - protein, 17 aa, Mycobacterium bovis
ITLRALGVTHFSVGPII

SEQ ID NO: 213171 - protein, 22 aa, Mycobacterium bovis
ITRARVHLALSWALSRSPGGRQ

SEQ ID NO: 213172 - protein, 18 aa, Mycobacterium bovis
IVLCAGAIQSAHLLMLSG

SEQ ID NO: 213173 - protein, 19 aa, Mycobacterium bovis
IVMPARLPNRIHPFVQEIV

SEQ ID NO: 213174 - protein, 17 aa, Mycobacterium bovis
IVSIGAFEAFKMERYAA

SEQ ID NO: 213175 - protein, 23 aa, Mycobacterium bovis
IVSRGGSIMAAWCLAHHRESFLY

SEQ ID NO: 213176 - protein, 19 aa, Mycobacterium bovis
IVVHLAPWLEPQPICWAID

SEQ ID NO: 213177 - protein, 19 aa, Mycobacterium bovis
IYGKLAWEKTIPNWFFEPD

SEQ ID NO: 213178 - protein, 18 aa, Mycobacterium bovis
KAATFLVEYARKYRQTIA

SEQ ID NO: 213179 - protein, 21 aa, Mycobacterium bovis
KAGYEVLERVGLDPKVATRYP

SEQ ID NO: 213180 - protein, 18 aa, Mycobacterium bovis
KANLFYRGLRFHRFPAVG

SEQ ID NO: 213181 - protein, 24 aa, Mycobacterium bovis
KAREFPVNFDVWWFKLPREGDAEF

SEQ ID NO: 213182 - protein, 17 aa, Mycobacterium bovis
KATIALLRRVEDVLDVE

SEQ ID NO: 213183 - protein, 20 aa, Mycobacterium bovis
KDPKRPSGSFIFAGPSGVGK

SEQ ID NO: 213184 - protein, 19 aa, Mycobacterium bovis
KECPAPGVMQGCLESTSGL

SEQ ID NO: 213185 - protein, 20 aa, Mycobacterium bovis
KEERGARIFIDFNQNARDRT

SEQ ID NO: 213186 - protein, 20 aa, Mycobacterium bovis
KEGDDVFVALSWTKHPPPQT

SEQ ID NO: 213187 - protein, 17 aa, Mycobacterium bovis
KEHFDFFPLTVDVEERM

SEQ ID NO: 213188 - protein, 21 aa, Mycobacterium bovis
KELCRRWYPRIYFGQPPKGLT

SEQ ID NO: 213189 - protein, 21 aa, Mycobacterium bovis
KELPMEYALELNRLIELQMEG

SEQ ID NO: 213190 - protein, 19 aa, Mycobacterium bovis
KEPFSRWASLLIHAGEPGA

SEQ ID NO: 213191 - protein, 19 aa, Mycobacterium bovis
KESLRLLAHEVMPRLNARL

SEQ ID NO: 213192 - protein, 23 aa, Mycobacterium bovis
KGADPGGLFPIPGAGGKGGTGGT

SEQ ID NO: 213193 - protein, 24 aa, Mycobacterium bovis
KGIFTSSFGYRWGVLHAGIDLANA

SEQ ID NO: 213194 - protein, 21 aa, Mycobacterium bovis
KGSALVPSWVAFAVTGLLEQH

SEQ ID NO: 213195 - protein, 24 aa, Mycobacterium bovis
KGTFRLAFGIGDFRRDTGFGEDPA

SEQ ID NO: 213196 - protein, 18 aa, Mycobacterium bovis
KGVPGRWRLCVLMRDDAT

SEQ ID NO: 213197 - protein, 20 aa, Mycobacterium bovis
KIDKGEFVFLIGPSGSGKST

SEQ ID NO: 213198 - protein, 19 aa, Mycobacterium bovis
KIVKFSGCYHGHVDALLAD

SEQ ID NO: 213199 - protein, 24 aa, Mycobacterium bovis
KKFRFPTFLGAFKYYTSYTLKTFD

SEQ ID NO: 213200 - protein, 22 aa, Mycobacterium bovis
KKLFCRMAEVFAGFLSYTDAQI

SEQ ID NO: 213201 - protein, 21 aa, Mycobacterium bovis
KKLSGLRARNGLLTASGDNAS

SEQ ID NO: 213202 - protein, 19 aa, Mycobacterium bovis
KLLAFRGRFVEIGKRDIYG

SEQ ID NO: 213203 - protein, 19 aa, Mycobacterium bovis
KLPTLRGRTVVTMFYENST

SEQ ID NO: 213204 - protein, 18 aa, Mycobacterium bovis
KLQKRLTEELAWVRSGAK

SEQ ID NO: 213205 - protein, 18 aa, Mycobacterium bovis
KLRQGSYFPDWLLQRRKR

SEQ ID NO: 213206 - protein, 19 aa, Mycobacterium bovis
KLVPFGAFVRVEEGIEGLV

SEQ ID NO: 213207 - protein, 20 aa, Mycobacterium bovis
KNEYPGKIFAILDSDHSMNH

SEQ ID NO: 213208 - protein, 18 aa, Mycobacterium bovis
KNPKEHFDFFPLTVDVEE

SEQ ID NO: 213209 - protein, 17 aa, Mycobacterium bovis
KNTVLWCGYTWQYWLTT

SEQ ID NO: 213210 - protein, 17 aa, Mycobacterium bovis
KPFVRWLTDLCVQLSEV

SEQ ID NO: 213211 - protein, 20 aa, Mycobacterium bovis
KPGAGVCPVRGHSNVQGDRT

SEQ ID NO: 213212 - protein, 17 aa, Mycobacterium bovis
KPLTFSALTGWEAPDPA

SEQ ID NO: 213213 - protein, 18 aa, Mycobacterium bovis
KPLYGSSLVTGWARLHGY

SEQ ID NO: 213214 - protein, 19 aa, Mycobacterium bovis
KPRPGRIVFVGSGPGDPGL

SEQ ID NO: 213215 - protein, 19 aa, Mycobacterium bovis
KPVGGFPVTFGWIHASRRG

SEQ ID NO: 213216 - protein, 17 aa, Mycobacterium bovis
KQRSRLALWSRRLLGEA

SEQ ID NO: 213217 - protein, 17 aa, Mycobacterium bovis
KQVRCVYVAIGQKGTTI

SEQ ID NO: 213218 - protein, 20 aa, Mycobacterium bovis
KRAFSEPVALNWAADGTDVD

SEQ ID NO: 213219 - protein, 21 aa, Mycobacterium bovis
KRALAGLPYRAAEIGLLVLAT

SEQ ID NO: 213220 - protein, 19 aa, Mycobacterium bovis
KRLPVPLFPGFDTLGTLEY

SEQ ID NO: 213221 - protein, 20 aa, Mycobacterium bovis
KRLTEELAWVRSGAKARQAK

SEQ ID NO: 213222 - protein, 20 aa, Mycobacterium bovis
KRLVDFAAGLAFALRGSFDK

SEQ ID NO: 213223 - protein, 19 aa, Mycobacterium bovis
KRPQIAIATWIVPSIVAFG

SEQ ID NO: 213224 - protein, 20 aa, Mycobacterium bovis
KRQALAWAMSVAGKRANALL

SEQ ID NO: 213225 - protein, 20 aa, Mycobacterium bovis
KRVCRDCGFFLPLAGSLGAM

SEQ ID NO: 213226 - protein, 25 aa, Mycobacterium bovis
KRWVTECLRAAYPLGRGHGPVSPLF

SEQ ID NO: 213227 - protein, 21 aa, Mycobacterium bovis
KSELWPDLNLGLPFTYHQGYQ

SEQ ID NO: 213228 - protein, 20 aa, Mycobacterium bovis
KTSRDAWCYNFSRGALEANI

SEQ ID NO: 213229 - protein, 17 aa, Mycobacterium bovis
KVERPDLVIGWWAAPTI

SEQ ID NO: 213230 - protein, 18 aa, Mycobacterium bovis
KVIRCFREGGGVPYSEYP

SEQ ID NO: 213231 - protein, 18 aa, Mycobacterium bovis
KVIRRYRVKGAREAVNLA

SEQ ID NO: 213232 - protein, 19 aa, Mycobacterium bovis
KVPGARCALAWSVQTAALA

SEQ ID NO: 213233 - protein, 24 aa, Mycobacterium bovis
KVPRAARVAVRWLRAVALDRIGDV

SEQ ID NO: 213234 - protein, 17 aa, Mycobacterium bovis
KVPRRLKELHLRLGTAT

SEQ ID NO: 213235 - protein, 19 aa, Mycobacterium bovis
KVSELPAGHGLNVNTLSYG

SEQ ID NO: 213236 - protein, 21 aa, Mycobacterium bovis
KWPRRMRKMFLSLIQRQLPEG

SEQ ID NO: 213237 - protein, 20 aa, Mycobacterium bovis
LAALGRPLIGNGADGAPGTG

SEQ ID NO: 213238 - protein, 18 aa, Mycobacterium bovis
LAAQGWVCLSIDYRVAPH

SEQ ID NO: 213239 - protein, 23 aa, Mycobacterium bovis
LAARLPLAYALGWQGRGREADAV

SEQ ID NO: 213240 - protein, 17 aa, Mycobacterium bovis
LACGNAFVLKPSERDPS

SEQ ID NO: 213241 - protein, 17 aa, Mycobacterium bovis
LACQRAGVPMQRYEHRA

SEQ ID NO: 213242 - protein, 18 aa, Mycobacterium bovis
LADAILIRKVDWVDEITR

SEQ ID NO: 213243 - protein, 18 aa, Mycobacterium bovis
LADCWRIAAKSLRPLPVA

SEQ ID NO: 213244 - protein, 17 aa, Mycobacterium bovis
LADGRELLFFSLPGPRT

SEQ ID NO: 213245 - protein, 23 aa, Mycobacterium bovis
LAEIRHWLQIFVQRFYSFSQFKR

SEQ ID NO: 213246 - protein, 20 aa, Mycobacterium bovis
LAELRLALMHGRLSADDKDA

SEQ ID NO: 213247 - protein, 21 aa, Mycobacterium bovis
LAEMPRVLRLCAARTGAELNV

SEQ ID NO: 213248 - protein, 26 aa, Mycobacterium bovis
LAERVGWRWRLVWYRAVAELLTGDYD

SEQ ID NO: 213249 - protein, 20 aa, Mycobacterium bovis
LAFERQWWKFAGVKEEAIKE

SEQ ID NO: 213250 - protein, 18 aa, Mycobacterium bovis
LAGLPAWLASGAPAAAMT

SEQ ID NO: 213251 - protein, 22 aa, Mycobacterium bovis
LAHEFDFRFLVGVLSVLGDKDV

SEQ ID NO: 213252 - protein, 18 aa, Mycobacterium bovis
LAHLRAFVLIPWIAVDPT

SEQ ID NO: 213253 - protein, 23 aa, Mycobacterium bovis
LAHPCPMCYGSLYYCSPDEVVFL

SEQ ID NO: 213254 - protein, 18 aa, Mycobacterium bovis
LAIPELPDAVFIESLRQL

SEQ ID NO: 213255 - protein, 17 aa, Mycobacterium bovis
LAIPRDEVRVMRKERNG

SEQ ID NO: 213256 - protein, 17 aa, Mycobacterium bovis
LAKRLGNRFDVRAVRLD

SEQ ID NO: 213257 - protein, 17 aa, Mycobacterium bovis
LALRLAEHGLRDERLAD

SEQ ID NO: 213258 - protein, 18 aa, Mycobacterium bovis
LALTELWRSYGVIPDAVI

SEQ ID NO: 213259 - protein, 23 aa, Mycobacterium bovis
LAMGHAMIRAGLRLKKLGTDRSW

SEQ ID NO: 213260 - protein, 17 aa, Mycobacterium bovis
LAMPRLDMVTGLYYLTT

SEQ ID NO: 213261 - protein, 17 aa, Mycobacterium bovis
LAPLHGWGSDGADTIGT

SEQ ID NO: 213262 - protein, 19 aa, Mycobacterium bovis
LAPLRGGYIADITPLGGGA

SEQ ID NO: 213263 - protein, 17 aa, Mycobacterium bovis
LAPQRLIVVLGHDHQRI

SEQ ID NO: 213264 - protein, 18 aa, Mycobacterium bovis
LAQMPPFLTGGSMIETVT

SEQ ID NO: 213265 - protein, 17 aa, Mycobacterium bovis
LAQRLALAAGRRLDDAQ

SEQ ID NO: 213266 - protein, 21 aa, Mycobacterium bovis
LARLYGWHRAMRIFDGPDEVH

SEQ ID NO: 213267 - protein, 18 aa, Mycobacterium bovis
LASIMSWQGWEELFELAR

SEQ ID NO: 213268 - protein, 17 aa, Mycobacterium bovis
LASRIYTDFTYRSGSTT

SEQ ID NO: 213269 - protein, 18 aa, Mycobacterium bovis
LAVLAGRLRAAGVRVDLA

SEQ ID NO: 213270 - protein, 25 aa, Mycobacterium bovis
LAVTRARISGMPVLFWLDPYRPHEN

SEQ ID NO: 213271 - protein, 17 aa, Mycobacterium bovis
LCARCTRFSDQIAGDPF

SEQ ID NO: 213272 - protein, 19 aa, Mycobacterium bovis
LCETFPTCLERGAGIPAVE

SEQ ID NO: 213273 - protein, 21 aa, Mycobacterium bovis
LCPQCGVPLASEPGHRHEQID

SEQ ID NO: 213274 - protein, 18 aa, Mycobacterium bovis
LCQILYWRGVGTCISGDP

SEQ ID NO: 213275 - protein, 17 aa, Mycobacterium bovis
LCRSVDIPARFVLGQAL

SEQ ID NO: 213276 - protein, 20 aa, Mycobacterium bovis
LCTELKLPLVVDAAQGLGHV

SEQ ID NO: 213277 - protein, 24 aa, Mycobacterium bovis
LDDGMLEWRLAGLPVDEGAPVGHG

SEQ ID NO: 213278 - protein, 18 aa, Mycobacterium bovis
LDDGWLTLLRRWLNDAQR

SEQ ID NO: 213279 - protein, 17 aa, Mycobacterium bovis
LDEYVDWLIEAGYPIRR

SEQ ID NO: 213280 - protein, 24 aa, Mycobacterium bovis
LDFMRSCSIRHRMASVIFSLEMSK

SEQ ID NO: 213281 - protein, 17 aa, Mycobacterium bovis
LDGLGGWFIDGVQGNPS

SEQ ID NO: 213282 - protein, 18 aa, Mycobacterium bovis
LDGTEVFDITGIDVLNDG

SEQ ID NO: 213283 - protein, 19 aa, Mycobacterium bovis
LDGWLLRAGHGAVLAANSA

SEQ ID NO: 213284 - protein, 19 aa, Mycobacterium bovis
LDIGCGWGGGLQRAIENYD

SEQ ID NO: 213285 - protein, 20 aa, Mycobacterium bovis
LDKARPVLILTREVVRPHLT

SEQ ID NO: 213286 - protein, 22 aa, Mycobacterium bovis
LDLCPRVRVNAIAPGSILTSAL

SEQ ID NO: 213287 - protein, 17 aa, Mycobacterium bovis
LDLLPRLLFRNGELDIS

SEQ ID NO: 213288 - protein, 19 aa, Mycobacterium bovis
LDLVPRVISAPEWTRLERG

SEQ ID NO: 213289 - protein, 18 aa, Mycobacterium bovis
LDMFGEWNRAYGPAGFLQ

SEQ ID NO: 213290 - protein, 18 aa, Mycobacterium bovis
LDPKIGLPDIRAVLTAVV

SEQ ID NO: 213291 - protein, 21 aa, Mycobacterium bovis
LDQPCSFYDWRRSAADGPRLH

SEQ ID NO: 213292 - protein, 19 aa, Mycobacterium bovis
LDRYLPFLATTKVLMAAVR

SEQ ID NO: 213293 - protein, 23 aa, Mycobacterium bovis
LDSRAWRLPWPDGTVVYELDQPK

SEQ ID NO: 213294 - protein, 23 aa, Mycobacterium bovis
LDVGCGWGGALVRAVEKYDVNVI

SEQ ID NO: 213295 - protein, 19 aa, Mycobacterium bovis
LDVGCGWGGMVRYAARRGV

SEQ ID NO: 213296 - protein, 21 aa, Mycobacterium bovis
LDVINAPALALLGRPLIGNGA

SEQ ID NO: 213297 - protein, 19 aa, Mycobacterium bovis
LDVPRITIVDAHLDGGFGP

SEQ ID NO: 213298 - protein, 21 aa, Mycobacterium bovis
LEALLRVLEPFGIREIAQSGM

SEQ ID NO: 213299 - protein, 17 aa, Mycobacterium bovis
LEFVRPVAVDLTYIPVV

SEQ ID NO: 213300 - protein, 19 aa, Mycobacterium bovis
LEGVLDVINAPALALLGRP

SEQ ID NO: 213301 - protein, 23 aa, Mycobacterium bovis
LEHPKMPLVPLIDGWETVVEMEA

SEQ ID NO: 213302 - protein, 17 aa, Mycobacterium bovis
LEHWRWMWDTNVLGTLR

SEQ ID NO: 213303 - protein, 21 aa, Mycobacterium bovis
LEKHARLAIAVNDIYLSTVGG

SEQ ID NO: 213304 - protein, 17 aa, Mycobacterium bovis
LELARTWVGLAGTMTTL

SEQ ID NO: 213305 - protein, 17 aa, Mycobacterium bovis
LELGFAAARRFSADPQS

SEQ ID NO: 213306 - protein, 18 aa, Mycobacterium bovis
LELIDWPVALVIATGHIL

SEQ ID NO: 213307 - protein, 20 aa, Mycobacterium bovis
LEPDLKWERFITAVRLLAER

SEQ ID NO: 213308 - protein, 17 aa, Mycobacterium bovis
LEPVGACRQCLVEVEGQ

SEQ ID NO: 213309 - protein, 17 aa, Mycobacterium bovis
LESELTWIEEHTGGKPY

SEQ ID NO: 213310 - protein, 17 aa, Mycobacterium bovis
LESRTITFLKIDPAPGI

SEQ ID NO: 213311 - protein, 21 aa, Mycobacterium bovis
LEVEEVYLPLARLIHLQVAAR

SEQ ID NO: 213312 - protein, 20 aa, Mycobacterium bovis
LEVIETHLLFGIPYDRIDVV

SEQ ID NO: 213313 - protein, 19 aa, Mycobacterium bovis
LEYHWGPDWVCWDADQTFQ

SEQ ID NO: 213314 - protein, 22 aa, Mycobacterium bovis
LFALGRLPGWIAHWREMHDEGD

SEQ ID NO: 213315 - protein, 18 aa, Mycobacterium bovis
LFALLAYGEVAAFYRLTD

SEQ ID NO: 213316 - protein, 23 aa, Mycobacterium bovis
LFFKEKRYDLARVGRYKVNKKLG

SEQ ID NO: 213317 - protein, 21 aa, Mycobacterium bovis
LFGRWELCALMQTVAELAEAM

SEQ ID NO: 213318 - protein, 24 aa, Mycobacterium bovis
LFGSVRSGLNTGLFNMGTAISGLF

SEQ ID NO: 213319 - protein, 17 aa, Mycobacterium bovis
LFRAIALALERPLDPDR

SEQ ID NO: 213320 - protein, 18 aa, Mycobacterium bovis
LFWDAAIFHRACEAVMPG

SEQ ID NO: 213321 - protein, 19 aa, Mycobacterium bovis
LFYRGLRFHRFPAVGDTLY

SEQ ID NO: 213322 - protein, 19 aa, Mycobacterium bovis
LFYSGFYLPMYWSSRAKLT

SEQ ID NO: 213323 - protein, 17 aa, Mycobacterium bovis
LGALVLTSCDAFEHFPP

SEQ ID NO: 213324 - protein, 17 aa, Mycobacterium bovis
LGAPCWIDLTTSDVDRA

SEQ ID NO: 213325 - protein, 20 aa, Mycobacterium bovis
LGAPGARVLLVWDAPNLDMG

SEQ ID NO: 213326 - protein, 18 aa, Mycobacterium bovis
LGDYDVLVGINLLREGLD

SEQ ID NO: 213327 - protein, 22 aa, Mycobacterium bovis
LGELRPLYRPGLVHIYHALTWG

SEQ ID NO: 213328 - protein, 17 aa, Mycobacterium bovis
LGGGVGWTTRRFGLSCD

SEQ ID NO: 213329 - protein, 17 aa, Mycobacterium bovis
LGIPYAWSRMRMMRSGK

SEQ ID NO: 213330 - protein, 17 aa, Mycobacterium bovis
LGLDYVDLYLIHWPAPP

SEQ ID NO: 213331 - protein, 19 aa, Mycobacterium bovis
LGLNAPWIAAVESLYEEYW

SEQ ID NO: 213332 - protein, 19 aa, Mycobacterium bovis
LGPRGRHVVLAKAFGGPTV

SEQ ID NO: 213333 - protein, 20 aa, Mycobacterium bovis
LGTFSWPGAYGTWWQADPSA

SEQ ID NO: 213334 - protein, 23 aa, Mycobacterium bovis
LGVGWPKEFGGLGFGPIEQQIFV

SEQ ID NO: 213335 - protein, 17 aa, Mycobacterium bovis
LGVLPGMGGSQRLTRAI

SEQ ID NO: 213336 - protein, 18 aa, Mycobacterium bovis
LGYYEWREGLLRGLAAHH

SEQ ID NO: 213337 - protein, 18 aa, Mycobacterium bovis
LHGLAGWVDVKPAVVSTA

SEQ ID NO: 213338 - protein, 23 aa, Mycobacterium bovis
LHLPGVAFGHDWLTGTSRYSGLL

SEQ ID NO: 213339 - protein, 22 aa, Mycobacterium bovis
LHSVKVIPSRGAWLEFDVDKRD

SEQ ID NO: 213340 - protein, 24 aa, Mycobacterium bovis
LIDFWRFNVAFARQILEQQPISGP

SEQ ID NO: 213341 - protein, 25 aa, Mycobacterium bovis
LIKSIGLRLGVPWYAYDTVTFSGEV

SEQ ID NO: 213342 - protein, 17 aa, Mycobacterium bovis
LILADAIVRACEDKPDY

SEQ ID NO: 213343 - protein, 17 aa, Mycobacterium bovis
LKAAFDWKSRHNQAHGI

SEQ ID NO: 213344 - protein, 17 aa, Mycobacterium bovis
LKARGSGQWASFSELVA

SEQ ID NO: 213345 - protein, 17 aa, Mycobacterium bovis
LKCLCRLHHLLATFCGW

SEQ ID NO: 213346 - protein, 17 aa, Mycobacterium bovis
LKGWINRWFYSVSGQVP

SEQ ID NO: 213347 - protein, 21 aa, Mycobacterium bovis
LKNVFAIAVGMGYSLGIGENT

SEQ ID NO: 213348 - protein, 18 aa, Mycobacterium bovis
LKSLRWAWNRAKDDVAPW

SEQ ID NO: 213349 - protein, 19 aa, Mycobacterium bovis
LKTSCAWAQARRDGQDPYP

SEQ ID NO: 213350 - protein, 20 aa, Mycobacterium bovis
LKWRWRQRVGSWKGRMPNLV

SEQ ID NO: 213351 - protein, 17 aa, Mycobacterium bovis
LLAARLARRIPYVTAVD

SEQ ID NO: 213352 - protein, 17 aa, Mycobacterium bovis
LLAPHWPAPYGRGASPA

SEQ ID NO: 213353 - protein, 22 aa, Mycobacterium bovis
LLDALRWLGLDWDEGPEVGGPY

SEQ ID NO: 213354 - protein, 19 aa, Mycobacterium bovis
LLDRVSSKYALVIYAAKRA

SEQ ID NO: 213355 - protein, 18 aa, Mycobacterium bovis
LLELSWEALERAGIDPTG

SEQ ID NO: 213356 - protein, 21 aa, Mycobacterium bovis
LLERGRYDLVLALASTHTGDG

SEQ ID NO: 213357 - protein, 17 aa, Mycobacterium bovis
LLESFLFYSGFYLPMYW

SEQ ID NO: 213358 - protein, 17 aa, Mycobacterium bovis
LLETSWEAIEHAGLDPA

SEQ ID NO: 213359 - protein, 17 aa, Mycobacterium bovis
LLEVSWEALEHAGIIPE

SEQ ID NO: 213360 - protein, 18 aa, Mycobacterium bovis
LLFARLLQYRAFKHVAEM

SEQ ID NO: 213361 - protein, 19 aa, Mycobacterium bovis
LLFGIPYDRIDVVVHPQSI

SEQ ID NO: 213362 - protein, 22 aa, Mycobacterium bovis
LLGKPAVLWFWAPWCPTCQGEA

SEQ ID NO: 213363 - protein, 23 aa, Mycobacterium bovis
LLGKSAYHALTFGWLMSGLARAV

SEQ ID NO: 213364 - protein, 28 aa, Mycobacterium bovis
LLGPVGDLFPILSIPGAMSQNFTNVVMT

SEQ ID NO: 213365 - protein, 17 aa, Mycobacterium bovis
LLGRPLIGNGADGGPGQ

SEQ ID NO: 213366 - protein, 23 aa, Mycobacterium bovis
LLGSLRFGNRFVHTGKPTPAGYA

SEQ ID NO: 213367 - protein, 18 aa, Mycobacterium bovis
LLIEVAWEALEDAGVPQH

SEQ ID NO: 213368 - protein, 19 aa, Mycobacterium bovis
LLIKDGRLAPDFDDEVIAQ

SEQ ID NO: 213369 - protein, 17 aa, Mycobacterium bovis
LLKIWNERNYRFWADLT

SEQ ID NO: 213370 - protein, 20 aa, Mycobacterium bovis
LLKPFARRYFQAIPGVWARR

SEQ ID NO: 213371 - protein, 24 aa, Mycobacterium bovis
LLKVRLRQGLPLARLGAAERERAE

SEQ ID NO: 213372 - protein, 21 aa, Mycobacterium bovis
LLLEVVCARLLLPSASDAESA

SEQ ID NO: 213373 - protein, 19 aa, Mycobacterium bovis
LLLGRPLIGDGANGGPGQN

SEQ ID NO: 213374 - protein, 19 aa, Mycobacterium bovis
LLLGRPLIGNGANGAPGTG

SEQ ID NO: 213375 - protein, 17 aa, Mycobacterium bovis
LLLPLGVRSLRAYGPTR

SEQ ID NO: 213376 - protein, 24 aa, Mycobacterium bovis
LLLRGSPCAIGWVAGWLSAEFPAR

SEQ ID NO: 213377 - protein, 19 aa, Mycobacterium bovis
LLMCRAEVAPILLGAIADA

SEQ ID NO: 213378 - protein, 17 aa, Mycobacterium bovis
LLNGFKWFASNCAGEAF

SEQ ID NO: 213379 - protein, 18 aa, Mycobacterium bovis
LLPGDGAQAFACSRKHGW

SEQ ID NO: 213380 - protein, 21 aa, Mycobacterium bovis
LLQRCPVCLYAGSIMPDDLLA

SEQ ID NO: 213381 - protein, 19 aa, Mycobacterium bovis
LLRFFFKSWFRVEVSGVEN

SEQ ID NO: 213382 - protein, 20 aa, Mycobacterium bovis
LLRSDILPISFGFPFGFSAA

SEQ ID NO: 213383 - protein, 19 aa, Mycobacterium bovis
LLSESGWYSALFGMQHETS

SEQ ID NO: 213384 - protein, 17 aa, Mycobacterium bovis
LLSGLLRAGRQVKDLVV

SEQ ID NO: 213385 - protein, 23 aa, Mycobacterium bovis
LLSGLPVRRLWGIGPVAEEKLHR

SEQ ID NO: 213386 - protein, 18 aa, Mycobacterium bovis
LLTGWRDAWELGRAARDN

SEQ ID NO: 213387 - protein, 18 aa, Mycobacterium bovis
LLTRGRYQYRPEPPFVLG

SEQ ID NO: 213388 - protein, 19 aa, Mycobacterium bovis
LLVRGGVVFSGYWRNEQAT

SEQ ID NO: 213389 - protein, 18 aa, Mycobacterium bovis
LLYRLERPLLFALQCMPL

SEQ ID NO: 213390 - protein, 18 aa, Mycobacterium bovis
LMAAARLDLAAVFLYAGS

SEQ ID NO: 213391 - protein, 19 aa, Mycobacterium bovis
LMRRIKQSFDPAGILNPGV

SEQ ID NO: 213392 - protein, 17 aa, Mycobacterium bovis
LMRRSGMIFIRRNIGND

SEQ ID NO: 213393 - protein, 24 aa, Mycobacterium bovis
LMRSCTGWPSGVWIDQPRRTAPDG

SEQ ID NO: 213394 - protein, 21 aa, Mycobacterium bovis
LMSVGDLIIGWLLQRQAAVAV

SEQ ID NO: 213395 - protein, 24 aa, Mycobacterium bovis
LNARAATFHAEFVSLLNGGAAAYT

SEQ ID NO: 213396 - protein, 25 aa, Mycobacterium bovis
LNDVLKGAWGYRGWVMSDWGGTPSW

SEQ ID NO: 213397 - protein, 17 aa, Mycobacterium bovis
LNFAWPTARIAVIGADG

SEQ ID NO: 213398 - protein, 29 aa, Mycobacterium bovis
LNFFPMGAWAKRTGAIFIRRQTKDIPVYR

SEQ ID NO: 213399 - protein, 20 aa, Mycobacterium bovis
LNLKEWKAEWGVADPREARG

SEQ ID NO: 213400 - protein, 19 aa, Mycobacterium bovis
LNMAIPWIAAERGFIDAVI

SEQ ID NO: 213401 - protein, 19 aa, Mycobacterium bovis
LNSKTRRPSVCNAAETLLV

SEQ ID NO: 213402 - protein, 18 aa, Mycobacterium bovis
LNTAIGTNWFPGTTPEVV

SEQ ID NO: 213403 - protein, 25 aa, Mycobacterium bovis
LNWWESRALYGWTVLVPRTKDQAGE

SEQ ID NO: 213404 - protein, 18 aa, Mycobacterium bovis
LPAGHGLNVNTLSYGDLA

SEQ ID NO: 213405 - protein, 17 aa, Mycobacterium bovis
LPAMVCYWSELARDIVL

SEQ ID NO: 213406 - protein, 22 aa, Mycobacterium bovis
LPDIKCVYWAGGNPFHHHQNLP

SEQ ID NO: 213407 - protein, 19 aa, Mycobacterium bovis
LPEGSGFEFLDKVVGGAVP

SEQ ID NO: 213408 - protein, 19 aa, Mycobacterium bovis
LPFDSPMYWHLFEPALRDA

SEQ ID NO: 213409 - protein, 19 aa, Mycobacterium bovis
LPGGHFRSDIGLRAAEGKI

SEQ ID NO: 213410 - protein, 19 aa, Mycobacterium bovis
LPGIWYAGSHGFELTAPDG

SEQ ID NO: 213411 - protein, 17 aa, Mycobacterium bovis
LPGYIFSGVAPVVTEML

SEQ ID NO: 213412 - protein, 20 aa, Mycobacterium bovis
LPIFGFGGAPGFGNDTTAPS

SEQ ID NO: 213413 - protein, 20 aa, Mycobacterium bovis
LPLEFARLAGYYLAEGHACL

SEQ ID NO: 213414 - protein, 22 aa, Mycobacterium bovis
LPLTLWLARFLKFIATEIFPGG

SEQ ID NO: 213415 - protein, 20 aa, Mycobacterium bovis
LPMSFTFARFLKFIVTEIFP

SEQ ID NO: 213416 - protein, 17 aa, Mycobacterium bovis
LPPEFRAAVVLCDIEGL

SEQ ID NO: 213417 - protein, 17 aa, Mycobacterium bovis
LPPGWVLTTSGRISGVT

SEQ ID NO: 213418 - protein, 18 aa, Mycobacterium bovis
LPPRTMRALLARICEQEG

SEQ ID NO: 213419 - protein, 18 aa, Mycobacterium bovis
LPPSGVPYLLGIQSVLVT

SEQ ID NO: 213420 - protein, 17 aa, Mycobacterium bovis
LPQAVPVTRLWLSKQQT

SEQ ID NO: 213421 - protein, 17 aa, Mycobacterium bovis
LPRPLRWLAGATRSAVL

SEQ ID NO: 213422 - protein, 18 aa, Mycobacterium bovis
LPSALGVTNHLAFRAQTY

SEQ ID NO: 213423 - protein, 18 aa, Mycobacterium bovis
LPSWWDRRRKLGLVLSAY

SEQ ID NO: 213424 - protein, 17 aa, Mycobacterium bovis
LPTVRGAFCLTFMDENT

SEQ ID NO: 213425 - protein, 17 aa, Mycobacterium bovis
LPVALVWAYPTISDLAT

SEQ ID NO: 213426 - protein, 21 aa, Mycobacterium bovis
LPVDWEPLGAIAIGYADEPSG

SEQ ID NO: 213427 - protein, 23 aa, Mycobacterium bovis
LPVKLCYAGPFFRYERPQAGRYR

SEQ ID NO: 213428 - protein, 17 aa, Mycobacterium bovis
LPVYIISIGRTFRTDEL

SEQ ID NO: 213429 - protein, 22 aa, Mycobacterium bovis
LPVYRPPLDMARLFNQPELGPT

SEQ ID NO: 213430 - protein, 17 aa, Mycobacterium bovis
LQARLRLAITRRRSTLA

SEQ ID NO: 213431 - protein, 19 aa, Mycobacterium bovis
LQHPDTFARLGVEPPRGVL

SEQ ID NO: 213432 - protein, 20 aa, Mycobacterium bovis
LQHRPRWQVTVSVVFDDWAA

SEQ ID NO: 213433 - protein, 19 aa, Mycobacterium bovis
LQKEGLNWVTWVVGETTYS

SEQ ID NO: 213434 - protein, 19 aa, Mycobacterium bovis
LQLRWPLRMLLGGKPLQHI

SEQ ID NO: 213435 - protein, 20 aa, Mycobacterium bovis
LQPRLPAVMDRLDRAIPRGV

SEQ ID NO: 213436 - protein, 19 aa, Mycobacterium bovis
LQTGVRWKDLGLVVVDEEQ

SEQ ID NO: 213437 - protein, 19 aa, Mycobacterium bovis
LQVAEAFGRYGAYLSQLNV

SEQ ID NO: 213438 - protein, 19 aa, Mycobacterium bovis
LRAEERWRPGLPPPPEQFY

SEQ ID NO: 213439 - protein, 19 aa, Mycobacterium bovis
LRAGLPPTLAVAGSYLDGI

SEQ ID NO: 213440 - protein, 23 aa, Mycobacterium bovis
LRALKRLKVVAAFQQSGNSPMGM

SEQ ID NO: 213441 - protein, 22 aa, Mycobacterium bovis
LRCPGLLPPGCHQPVLVVGLVG

SEQ ID NO: 213442 - protein, 17 aa, Mycobacterium bovis
LRDGLCFVDLAPITESG

SEQ ID NO: 213443 - protein, 19 aa, Mycobacterium bovis
LRDLLKFEFLFSGRAQFEK

SEQ ID NO: 213444 - protein, 18 aa, Mycobacterium bovis
LRELCKMDGAVVLSTDGS

SEQ ID NO: 213445 - protein, 18 aa, Mycobacterium bovis
LREPVVWQRLHQVDPAHL

SEQ ID NO: 213446 - protein, 19 aa, Mycobacterium bovis
LRFGLELVECTDFFSDTTF

SEQ ID NO: 213447 - protein, 19 aa, Mycobacterium bovis
LRFWLDRGVDGFRIDVAHG

SEQ ID NO: 213448 - protein, 17 aa, Mycobacterium bovis
LRHTVRFAAAVQAALED

SEQ ID NO: 213449 - protein, 17 aa, Mycobacterium bovis
LRHTVRFSAAVRSALDD

SEQ ID NO: 213450 - protein, 25 aa, Mycobacterium bovis
LRIAPELFLKRCIVGGFDKVFELNR

SEQ ID NO: 213451 - protein, 24 aa, Mycobacterium bovis
LRKSRSEMAWAFPAVPMVARAPAA

SEQ ID NO: 213452 - protein, 17 aa, Mycobacterium bovis
LRLAEHGLRDERLADIL

SEQ ID NO: 213453 - protein, 18 aa, Mycobacterium bovis
LRLALGVMLEIGPRGPER

SEQ ID NO: 213454 - protein, 19 aa, Mycobacterium bovis
LRLLLEFANELPALPSHLA

SEQ ID NO: 213455 - protein, 17 aa, Mycobacterium bovis
LRLPRGEGLGVPASGYE

SEQ ID NO: 213456 - protein, 18 aa, Mycobacterium bovis
LRLRGMSAMLARIKRRLR

SEQ ID NO: 213457 - protein, 17 aa, Mycobacterium bovis
LRLVALVDRLYDAGIPV

SEQ ID NO: 213458 - protein, 18 aa, Mycobacterium bovis
LRMADLQARVDLLRYALH

SEQ ID NO: 213459 - protein, 24 aa, Mycobacterium bovis
LRMLRPDLTIGFFLHIPFPPVELF

SEQ ID NO: 213460 - protein, 21 aa, Mycobacterium bovis
LRPAQYLPWHPGRCAQVFVGE

SEQ ID NO: 213461 - protein, 19 aa, Mycobacterium bovis
LRPCTRFGQRLRLRPFDLG

SEQ ID NO: 213462 - protein, 20 aa, Mycobacterium bovis
LRPDFPRPALLSGAGDAVEF

SEQ ID NO: 213463 - protein, 17 aa, Mycobacterium bovis
LRPEIWDEFTTRFGVAR

SEQ ID NO: 213464 - protein, 19 aa, Mycobacterium bovis
LRPGEWRTLGLFAADDNGE

SEQ ID NO: 213465 - protein, 17 aa, Mycobacterium bovis
LRPGLRMNIIANPGIPK

SEQ ID NO: 213466 - protein, 17 aa, Mycobacterium bovis
LRPGQALVITVPVSDAP

SEQ ID NO: 213467 - protein, 17 aa, Mycobacterium bovis
LRPGQLVLIHGGASGIG

SEQ ID NO: 213468 - protein, 20 aa, Mycobacterium bovis
LRPLGFRPALGFSRVDTTIS

SEQ ID NO: 213469 - protein, 18 aa, Mycobacterium bovis
LRPLRIVVPEGSMLAPTH

SEQ ID NO: 213470 - protein, 18 aa, Mycobacterium bovis
LRQVIGCVFQDFRLLQQK

SEQ ID NO: 213471 - protein, 20 aa, Mycobacterium bovis
LRRAHGIGGFLGGSGRWLRR

SEQ ID NO: 213472 - protein, 20 aa, Mycobacterium bovis
LRRYPWPQGHTMSVLSNALT

SEQ ID NO: 213473 - protein, 18 aa, Mycobacterium bovis
LRSAAPIWWNGQDPGKGG

SEQ ID NO: 213474 - protein, 17 aa, Mycobacterium bovis
LRSILAPECAARAREIS

SEQ ID NO: 213475 - protein, 17 aa, Mycobacterium bovis
LRTALRMQISTGYTVVE

SEQ ID NO: 213476 - protein, 19 aa, Mycobacterium bovis
LRTDRDWLADIVRFVASRR

SEQ ID NO: 213477 - protein, 18 aa, Mycobacterium bovis
LRTGTDFEYELQMAQMNK

SEQ ID NO: 213478 - protein, 18 aa, Mycobacterium bovis
LRYGFRPSKIAFLAWHAW

SEQ ID NO: 213479 - protein, 20 aa, Mycobacterium bovis
LRYKMCVDAVAFARHIGYSC

SEQ ID NO: 213480 - protein, 20 aa, Mycobacterium bovis
LRYPLPAAWCTDVDVELYLK

SEQ ID NO: 213481 - protein, 17 aa, Mycobacterium bovis
LSFLSVSSVDYWAYRPA

SEQ ID NO: 213482 - protein, 25 aa, Mycobacterium bovis
LSFSSLSGWARLGLRERFIGLTDTV

SEQ ID NO: 213483 - protein, 22 aa, Mycobacterium bovis
LSGDYQGLVGLNLVIDMPLPIS

SEQ ID NO: 213484 - protein, 22 aa, Mycobacterium bovis
LSGLAALHWRGPAAESMAVTAA

SEQ ID NO: 213485 - protein, 19 aa, Mycobacterium bovis
LSKLARPTSTWTYMVNDNP

SEQ ID NO: 213486 - protein, 17 aa, Mycobacterium bovis
LSKRGGGVALLLTNIRE

SEQ ID NO: 213487 - protein, 19 aa, Mycobacterium bovis
LSLFFRQHINYVLARPKLR

SEQ ID NO: 213488 - protein, 17 aa, Mycobacterium bovis
LSPAPALLALPAAESAW

SEQ ID NO: 213489 - protein, 18 aa, Mycobacterium bovis
LSPLLAESLSGLAPALIA

SEQ ID NO: 213490 - protein, 18 aa, Mycobacterium bovis
LSQRWGRLFVAVCYALRT

SEQ ID NO: 213491 - protein, 17 aa, Mycobacterium bovis
LSRAHTAAIIWSDELDG

SEQ ID NO: 213492 - protein, 22 aa, Mycobacterium bovis
LSSKEWPGMLAFYRNLAMALVG

SEQ ID NO: 213493 - protein, 17 aa, Mycobacterium bovis
LSVPAAWSTAAPATTAG

SEQ ID NO: 213494 - protein, 19 aa, Mycobacterium bovis
LSYKTGWYGSSLVVADRWF

SEQ ID NO: 213495 - protein, 17 aa, Mycobacterium bovis
LTAMWRRGDEVFAEVAL

SEQ ID NO: 213496 - protein, 17 aa, Mycobacterium bovis
LTAQDVFNNVARTCIEA

SEQ ID NO: 213497 - protein, 17 aa, Mycobacterium bovis
LTARTGGVVGRRVCAVV

SEQ ID NO: 213498 - protein, 25 aa, Mycobacterium bovis
LTDLVFAWRACRAVKSNAIVIAADG

SEQ ID NO: 213499 - protein, 26 aa, Mycobacterium bovis
LTDPEVLEWRYPVLLREFAVRQGSGG

SEQ ID NO: 213500 - protein, 20 aa, Mycobacterium bovis
LTGCAKAFRMGYIDCNQFTL

SEQ ID NO: 213501 - protein, 17 aa, Mycobacterium bovis
LTGRPLIGNGANGVAGT

SEQ ID NO: 213502 - protein, 18 aa, Mycobacterium bovis
LTLTELWRSYGVQPDLVI

SEQ ID NO: 213503 - protein, 23 aa, Mycobacterium bovis
LTRIPRVGVDWSQTTSFDEDTTA

SEQ ID NO: 213504 - protein, 23 aa, Mycobacterium bovis
LVDDIRINWVWNPPWGPDKITED

SEQ ID NO: 213505 - protein, 22 aa, Mycobacterium bovis
LVEGRVALTIPADWSTQRVVSG

SEQ ID NO: 213506 - protein, 19 aa, Mycobacterium bovis
LVFGRRAGLGAADYVRALS

SEQ ID NO: 213507 - protein, 24 aa, Mycobacterium bovis
LVLHDWGSALGFDWANQHRDRVQG

SEQ ID NO: 213508 - protein, 17 aa, Mycobacterium bovis
LVPAHLRDGHYSGAAAL

SEQ ID NO: 213509 - protein, 24 aa, Mycobacterium bovis
LVPDDLRPEWVLPRADEIAFGYSD

SEQ ID NO: 213510 - protein, 17 aa, Mycobacterium bovis
LVPFSWQGVSLHAAGAS

SEQ ID NO: 213511 - protein, 18 aa, Mycobacterium bovis
LVSAEGWHSLSIAYAETA

SEQ ID NO: 213512 - protein, 19 aa, Mycobacterium bovis
LVSDHIRAIVALGGFAWQV

SEQ ID NO: 213513 - protein, 18 aa, Mycobacterium bovis
LVSGDYQGLIGLPLLGIP

SEQ ID NO: 213514 - protein, 17 aa, Mycobacterium bovis
LVSRVGLERARRVVDLG

SEQ ID NO: 213515 - protein, 19 aa, Mycobacterium bovis
LVVSLAKRYTGRGMAFLDL

SEQ ID NO: 213516 - protein, 18 aa, Mycobacterium bovis
LWNAAEWSVQAQLDYLRT

SEQ ID NO: 213517 - protein, 25 aa, Mycobacterium bovis
LWRGNYEGLAGFSFGYPIPLFPAVG

SEQ ID NO: 213518 - protein, 23 aa, Mycobacterium bovis
LWYCGPWTLWVMAGRGVASGAGV

SEQ ID NO: 213519 - protein, 19 aa, Mycobacterium bovis
LYAEMWAQDALAMYGYAAA

SEQ ID NO: 213520 - protein, 21 aa, Mycobacterium bovis
LYCRNRIEIVIAMLGIVKAGA

SEQ ID NO: 213521 - protein, 18 aa, Mycobacterium bovis
LYDRVGFAAAGKFNEFDN

SEQ ID NO: 213522 - protein, 17 aa, Mycobacterium bovis
LYIALGISGAIQHRAGM

SEQ ID NO: 213523 - protein, 24 aa, Mycobacterium bovis
LYSRLRLATAASWSIRYVVERRAI

SEQ ID NO: 213524 - protein, 19 aa, Mycobacterium bovis
MAAAATAWDGLAMELASAA

SEQ ID NO: 213525 - protein, 22 aa, Mycobacterium bovis
MASQRTVICWAMGLTQHAHAVA

SEQ ID NO: 213526 - protein, 19 aa, Mycobacterium bovis
MDCGIPFCHNGCPLGNLIP

SEQ ID NO: 213527 - protein, 25 aa, Mycobacterium bovis
MDPRQRLALELTWELLEDAFVVPET

SEQ ID NO: 213528 - protein, 21 aa, Mycobacterium bovis
MDRKVWLPSGGTLVIDRTEAM

SEQ ID NO: 213529 - protein, 17 aa, Mycobacterium bovis
MEALDLLPLTDRRHLIE

SEQ ID NO: 213530 - protein, 20 aa, Mycobacterium bovis
MELGCDAVLLASAVTRAADP

SEQ ID NO: 213531 - protein, 26 aa, Mycobacterium bovis
MERLYKTSWRFAPFLWQEIEEGILPA

SEQ ID NO: 213532 - protein, 18 aa, Mycobacterium bovis
MGGAINCGKAQPGQVAAV

SEQ ID NO: 213533 - protein, 18 aa, Mycobacterium bovis
MGGTGGWLMGNGGMGGAG

SEQ ID NO: 213534 - protein, 20 aa, Mycobacterium bovis
MGLAELLAALGIPYDSEEAV

SEQ ID NO: 213535 - protein, 22 aa, Mycobacterium bovis
MGRDGWLALGWPKEYGGQGRSA

SEQ ID NO: 213536 - protein, 25 aa, Mycobacterium bovis
MIDVIRFWLGLGIDGFRLDAVPYLF

SEQ ID NO: 213537 - protein, 20 aa, Mycobacterium bovis
MKPDVCWQLPIRRSQEWVTR

SEQ ID NO: 213538 - protein, 17 aa, Mycobacterium bovis
MLCALPIERAIDAAETL

SEQ ID NO: 213539 - protein, 24 aa, Mycobacterium bovis
MLDDASKIVGCWNGLAKRSGTGIV

SEQ ID NO: 213540 - protein, 17 aa, Mycobacterium bovis
MLEVSWEALEHAGIDPL

SEQ ID NO: 213541 - protein, 18 aa, Mycobacterium bovis
MLIELDIHFRIEDDLYYP

SEQ ID NO: 213542 - protein, 19 aa, Mycobacterium bovis
MLLELSWEALERAGIDPTG

SEQ ID NO: 213543 - protein, 18 aa, Mycobacterium bovis
MPFSVPWTRASREDLPFN

SEQ ID NO: 213544 - protein, 20 aa, Mycobacterium bovis
MPGEFFALTVDHLFGRIWTR

SEQ ID NO: 213545 - protein, 24 aa, Mycobacterium bovis
MPGGFPIELGMTIRLAREKNYDLL

SEQ ID NO: 213546 - protein, 17 aa, Mycobacterium bovis
MPPALFAPIVENLANVR

SEQ ID NO: 213547 - protein, 18 aa, Mycobacterium bovis
MPYKSGFGPFAPEIYRAP

SEQ ID NO: 213548 - protein, 17 aa, Mycobacterium bovis
MQFCSEFEWIAPSGRGL

SEQ ID NO: 213549 - protein, 17 aa, Mycobacterium bovis
MRAGLTWQQVVLLRAYA

SEQ ID NO: 213550 - protein, 17 aa, Mycobacterium bovis
MRRAFPSWMAWSPFAPA

SEQ ID NO: 213551 - protein, 17 aa, Mycobacterium bovis
MRVVHELSALPAEVEAA

SEQ ID NO: 213552 - protein, 21 aa, Mycobacterium bovis
MSMARLLYWGCDVWLNNPLRP

SEQ ID NO: 213553 - protein, 25 aa, Mycobacterium bovis
MTGWQRLHFRFGFPAPLLEPLAVER

SEQ ID NO: 213554 - protein, 27 aa, Mycobacterium bovis
MTIPGMRLPFTSIVPFVVYYGPVELPQ

SEQ ID NO: 213555 - protein, 18 aa, Mycobacterium bovis
MTVALLLAVARHLIPADA

SEQ ID NO: 213556 - protein, 17 aa, Mycobacterium bovis
MVFGHRGINIPVVDHAT

SEQ ID NO: 213557 - protein, 20 aa, Mycobacterium bovis
MWRRGDEVFAEVALPADAGV

SEQ ID NO: 213558 - protein, 17 aa, Mycobacterium bovis
MYDRVHWSLTHMSQAGL

SEQ ID NO: 213559 - protein, 21 aa, Mycobacterium bovis
NAINPSVLWTLTPRIVSLDVE

SEQ ID NO: 213560 - protein, 20 aa, Mycobacterium bovis
NALCAAAVALECGASVEQVA

SEQ ID NO: 213561 - protein, 17 aa, Mycobacterium bovis
NASPMQAVLDVVNGPTQ

SEQ ID NO: 213562 - protein, 18 aa, Mycobacterium bovis
NAVIPGDGVGKAPHGGAG

SEQ ID NO: 213563 - protein, 21 aa, Mycobacterium bovis
NAVKLRLGIGYVIQNAGLMPH

SEQ ID NO: 213564 - protein, 21 aa, Mycobacterium bovis
NCGRPPRFCRRVGVRPPAPAA

SEQ ID NO: 213565 - protein, 19 aa, Mycobacterium bovis
NCYHLYPAHAAFGGYKQSG

SEQ ID NO: 213566 - protein, 25 aa, Mycobacterium bovis
NELGHPWTVLRATRRTDYLILEMAA

SEQ ID NO: 213567 - protein, 19 aa, Mycobacterium bovis
NFCTGELTTAIAMTEPGTG

SEQ ID NO: 213568 - protein, 19 aa, Mycobacterium bovis
NGAFWRGDQQGLFSAGYRV

SEQ ID NO: 213569 - protein, 23 aa, Mycobacterium bovis
NGAFWRGDYQGLLGFSYTSTIIP

SEQ ID NO: 213570 - protein, 24 aa, Mycobacterium bovis
NGAHGTVGAQFVPATSLPTPNGGA

SEQ ID NO: 213571 - protein, 19 aa, Mycobacterium bovis
NGAQGGWLIGNGGQGGDSG

SEQ ID NO: 213572 - protein, 25 aa, Mycobacterium bovis
NGGSGGRGDMAFKDGDGGAGGDGGD

SEQ ID NO: 213573 - protein, 19 aa, Mycobacterium bovis
NGIAAKGEMRWQFHHVIDV

SEQ ID NO: 213574 - protein, 22 aa, Mycobacterium bovis
NGILWRGDYQGLIGYSDTLSIP

SEQ ID NO: 213575 - protein, 17 aa, Mycobacterium bovis
NGLRPEIWDEFTTRFGV

SEQ ID NO: 213576 - protein, 24 aa, Mycobacterium bovis
NGMLWRGDHEGLFGLSYGITIPQF

SEQ ID NO: 213577 - protein, 25 aa, Mycobacterium bovis
NGNWVWRYDAIRTFGDFAGLWDDVD

SEQ ID NO: 213578 - protein, 24 aa, Mycobacterium bovis
NGSKGLPGLGRLGNPGLDGGTGGN

SEQ ID NO: 213579 - protein, 28 aa, Mycobacterium bovis
NHRKRIGELWARFSAVAADNPHAWIRNP

SEQ ID NO: 213580 - protein, 18 aa, Mycobacterium bovis
NHVLDYLAAKGWQPEGVS

SEQ ID NO: 213581 - protein, 19 aa, Mycobacterium bovis
NIAPWLRAAHRYGAKVKWA

SEQ ID NO: 213582 - protein, 19 aa, Mycobacterium bovis
NKTRLAALRVKDFGKREVM

SEQ ID NO: 213583 - protein, 19 aa, Mycobacterium bovis
NLPKGRLSDMVRRILRSMF

SEQ ID NO: 213584 - protein, 19 aa, Mycobacterium bovis
NLRCSYCMPERGLRWLPGE

SEQ ID NO: 213585 - protein, 26 aa, Mycobacterium bovis
NLTGVMTFGLPLAMTLNAVGSPITTA

SEQ ID NO: 213586 - protein, 18 aa, Mycobacterium bovis
NLYRAALMLSLKDAISRD

SEQ ID NO: 213587 - protein, 22 aa, Mycobacterium bovis
NMFALGLLSWMYGRELEHSEAF

SEQ ID NO: 213588 - protein, 17 aa, Mycobacterium bovis
NMRWRTFCDELLAVIDK

SEQ ID NO: 213589 - protein, 21 aa, Mycobacterium bovis
NPEIRPAHLLMALLTQNDGIA

SEQ ID NO: 213590 - protein, 21 aa, Mycobacterium bovis
NPGAVPGRAGGAGGLGGSGSD

SEQ ID NO: 213591 - protein, 19 aa, Mycobacterium bovis
NPLRFLRAAMKWCRKAQEL

SEQ ID NO: 213592 - protein, 21 aa, Mycobacterium bovis
NPPPRVAFMLGDAVPVAAVTT

SEQ ID NO: 213593 - protein, 23 aa, Mycobacterium bovis
NPRTRSGIMALELLDGTPDWDRF

SEQ ID NO: 213594 - protein, 23 aa, Mycobacterium bovis
NQIWQCPVVLLADVRSVGVQGDG

SEQ ID NO: 213595 - protein, 22 aa, Mycobacterium bovis
NQLWMCGLPGYSPGDLIDFEFC

SEQ ID NO: 213596 - protein, 17 aa, Mycobacterium bovis
NQQFALLFVDWLAANPG

SEQ ID NO: 213597 - protein, 19 aa, Mycobacterium bovis
NRGRAGYRLLYSVRQYALE

SEQ ID NO: 213598 - protein, 20 aa, Mycobacterium bovis
NRPHLAAAWEYDWPASRWRQ

SEQ ID NO: 213599 - protein, 18 aa, Mycobacterium bovis
NRPKIGWRRLEAQAVLSR

SEQ ID NO: 213600 - protein, 25 aa, Mycobacterium bovis
NSGNFGVDGEAGFSGGAGGNGGVGG

SEQ ID NO: 213601 - protein, 20 aa, Mycobacterium bovis
NSLITSWRALGWIGPEAAEA

SEQ ID NO: 213602 - protein, 18 aa, Mycobacterium bovis
NSLPGQWTAHVTLARRVG

SEQ ID NO: 213603 - protein, 20 aa, Mycobacterium bovis
NSYYDDMAWLALALERADRV

SEQ ID NO: 213604 - protein, 34 aa, Mycobacterium bovis
NTAALAAICRFEFAEVYPLLDWAAPYQEMMGPFG

SEQ ID NO: 213605 - protein, 21 aa, Mycobacterium bovis
NVANCLVALAILDTVGVSPEQ

SEQ ID NO: 213606 - protein, 19 aa, Mycobacterium bovis
NVAWPKVFRPPVIAATVTT

SEQ ID NO: 213607 - protein, 18 aa, Mycobacterium bovis
NVGRIVVHLAPWLEPQPI

SEQ ID NO: 213608 - protein, 18 aa, Mycobacterium bovis
NVIREFVEHTGIPFLPMS

SEQ ID NO: 213609 - protein, 18 aa, Mycobacterium bovis
NVQVVWEKFCRYFDVEPR

SEQ ID NO: 213610 - protein, 17 aa, Mycobacterium bovis
NVYRVVSNLGVFDFGGP

SEQ ID NO: 213611 - protein, 20 aa, Mycobacterium bovis
NWYTEFARLAPLMEKDVHYE

SEQ ID NO: 213612 - protein, 20 aa, Mycobacterium bovis
PAAVCPHVEWALSSTLQAKA

SEQ ID NO: 213613 - protein, 20 aa, Mycobacterium bovis
PAAVVPWDFDGDGLPMSVQL

SEQ ID NO: 213614 - protein, 18 aa, Mycobacterium bovis
PAGNHCRRIYATHDTHPV

SEQ ID NO: 213615 - protein, 21 aa, Mycobacterium bovis
PAMSAFNAWVLLKGLETLAIR

SEQ ID NO: 213616 - protein, 22 aa, Mycobacterium bovis
PANPRFLMCTPLSHAGAAFFTP

SEQ ID NO: 213617 - protein, 21 aa, Mycobacterium bovis
PANVMPIDWYLHVRHAVGGEI

SEQ ID NO: 213618 - protein, 20 aa, Mycobacterium bovis
PAPQFEVMYLLAVCDAAAAD

SEQ ID NO: 213619 - protein, 19 aa, Mycobacterium bovis
PARLYARFPAGFAGMPALL

SEQ ID NO: 213620 - protein, 18 aa, Mycobacterium bovis
PAWGMYCGYELFEHRAVR

SEQ ID NO: 213621 - protein, 17 aa, Mycobacterium bovis
PCAWLAEGLVRYLPARA

SEQ ID NO: 213622 - protein, 17 aa, Mycobacterium bovis
PCWLVGLLFPSADGCAG

SEQ ID NO: 213623 - protein, 18 aa, Mycobacterium bovis
PDAFKWIQRAAMDRRTTM

SEQ ID NO: 213624 - protein, 23 aa, Mycobacterium bovis
PDAGLRLARRFAHLTYRGEIELD

SEQ ID NO: 213625 - protein, 18 aa, Mycobacterium bovis
PDAVRHWNVDKADLDGLL

SEQ ID NO: 213626 - protein, 20 aa, Mycobacterium bovis
PDFGLRLARWQGLGILGPVA

SEQ ID NO: 213627 - protein, 17 aa, Mycobacterium bovis
PDIDPVLKMLLDTFPVT

SEQ ID NO: 213628 - protein, 18 aa, Mycobacterium bovis
PDIRCCILTGAGGYFCAG

SEQ ID NO: 213629 - protein, 17 aa, Mycobacterium bovis
PDLPTGKALVIAEGVLV

SEQ ID NO: 213630 - protein, 17 aa, Mycobacterium bovis
PDLRLPIYIGDDLTDED

SEQ ID NO: 213631 - protein, 19 aa, Mycobacterium bovis
PDLVIGWWAAPTILEHGTP

SEQ ID NO: 213632 - protein, 23 aa, Mycobacterium bovis
PDLVWDFRLPRVVSINVSGHKYG

SEQ ID NO: 213633 - protein, 22 aa, Mycobacterium bovis
PDNEFRVVLARRGQHWVSAVRV

SEQ ID NO: 213634 - protein, 19 aa, Mycobacterium bovis
PEALRAFGIRECADAARAL

SEQ ID NO: 213635 - protein, 20 aa, Mycobacterium bovis
PEEVAWRMGWIDDEQLVQRA

SEQ ID NO: 213636 - protein, 19 aa, Mycobacterium bovis
PEFRAAVVLCDIEGLSYEE

SEQ ID NO: 213637 - protein, 21 aa, Mycobacterium bovis
PEFSELFAAFPSFAGLRPTFD

SEQ ID NO: 213638 - protein, 22 aa, Mycobacterium bovis
PEGLRWLYNFIKAQGERNFGKI

SEQ ID NO: 213639 - protein, 17 aa, Mycobacterium bovis
PEIKLGVLPGMGGSQRL

SEQ ID NO: 213640 - protein, 20 aa, Mycobacterium bovis
PEIPAHLDVNIPIDIPITGS

SEQ ID NO: 213641 - protein, 25 aa, Mycobacterium bovis
PEIWDEFTTRFGVARVCEFYAASEG

SEQ ID NO: 213642 - protein, 23 aa, Mycobacterium bovis
PEKLHELQRLWLIEATRYNVLPL

SEQ ID NO: 213643 - protein, 18 aa, Mycobacterium bovis
PELLSRAAALNWDTTAPA

SEQ ID NO: 213644 - protein, 23 aa, Mycobacterium bovis
PELRAIFINSVWAPRLRIVESIL

SEQ ID NO: 213645 - protein, 18 aa, Mycobacterium bovis
PELRPMVQLDGGRFATSD

SEQ ID NO: 213646 - protein, 17 aa, Mycobacterium bovis
PELRRPITELGMVKSID

SEQ ID NO: 213647 - protein, 21 aa, Mycobacterium bovis
PELRSDVRLDFKPVVQTRYEP

SEQ ID NO: 213648 - protein, 17 aa, Mycobacterium bovis
PEPMVKMLLNNVLEHLA

SEQ ID NO: 213649 - protein, 19 aa, Mycobacterium bovis
PEPPIGHAMVRRSGTDVTV

SEQ ID NO: 213650 - protein, 18 aa, Mycobacterium bovis
PETQIAISAWGLLSPQGR

SEQ ID NO: 213651 - protein, 22 aa, Mycobacterium bovis
PETSVALGFGFRCGFLGLLHME

SEQ ID NO: 213652 - protein, 19 aa, Mycobacterium bovis
PFGPVAVAGFVVYRLDDGP

SEQ ID NO: 213653 - protein, 18 aa, Mycobacterium bovis
PFLRRFDIPPGIEHQEDA

SEQ ID NO: 213654 - protein, 22 aa, Mycobacterium bovis
PFQATAVIPVIGPVTVTLEGTP

SEQ ID NO: 213655 - protein, 19 aa, Mycobacterium bovis
PGAFCLTCGAPVREPTDIM

SEQ ID NO: 213656 - protein, 23 aa, Mycobacterium bovis
PGAGGNGGNANWFGSGGAGGQGG

SEQ ID NO: 213657 - protein, 20 aa, Mycobacterium bovis
PGDEAELFRAIALALERPLD

SEQ ID NO: 213658 - protein, 19 aa, Mycobacterium bovis
PGDGGGLVLLKPVQAALDD

SEQ ID NO: 213659 - protein, 22 aa, Mycobacterium bovis
PGELRFGPLQARDELAACEILA

SEQ ID NO: 213660 - protein, 18 aa, Mycobacterium bovis
PGGYFPYADLRPNNEIAA

SEQ ID NO: 213661 - protein, 18 aa, Mycobacterium bovis
PGHPEFRHTPGVEITTGP

SEQ ID NO: 213662 - protein, 26 aa, Mycobacterium bovis
PGLRALLRLGIYWAQEALAYGMTKRP

SEQ ID NO: 213663 - protein, 19 aa, Mycobacterium bovis
PGRREGWDYPDMARESGTK

SEQ ID NO: 213664 - protein, 19 aa, Mycobacterium bovis
PGRTVCKWGGFLDNPADFD

SEQ ID NO: 213665 - protein, 17 aa, Mycobacterium bovis
PGSAIAWIVRLTGGFEE

SEQ ID NO: 213666 - protein, 25 aa, Mycobacterium bovis
PGVLARVAALFSRRGFNIESLAVGA

SEQ ID NO: 213667 - protein, 18 aa, Mycobacterium bovis
PGYQGWQWAVVVASYSGA

SEQ ID NO: 213668 - protein, 17 aa, Mycobacterium bovis
PHLEAFKAKGYEVLLLT

SEQ ID NO: 213669 - protein, 18 aa, Mycobacterium bovis
PIAVIGMGCRFPGGVNNP

SEQ ID NO: 213670 - protein, 20 aa, Mycobacterium bovis
PICAPDLLLAQALLRTQQIK

SEQ ID NO: 213671 - protein, 23 aa, Mycobacterium bovis
PISRIPLTINIRIPVNITLNELP

SEQ ID NO: 213672 - protein, 19 aa, Mycobacterium bovis
PKAGPLIAVKLHILTRKTL

SEQ ID NO: 213673 - protein, 19 aa, Mycobacterium bovis
PKLGERLNLPAGWSYHTRV

SEQ ID NO: 213674 - protein, 20 aa, Mycobacterium bovis
PKLMRRLLLWEVRRRLGRSV

SEQ ID NO: 213675 - protein, 20 aa, Mycobacterium bovis
PKMRISGPAVRWVMTGWQRL

SEQ ID NO: 213676 - protein, 18 aa, Mycobacterium bovis
PKPLGMPLQYMVSGMAVK

SEQ ID NO: 213677 - protein, 25 aa, Mycobacterium bovis
PLDFPRLNWAPIEWRNLEDEQEKML

SEQ ID NO: 213678 - protein, 23 aa, Mycobacterium bovis
PLHTDLKEFGRWAADRIAEAIEF

SEQ ID NO: 213679 - protein, 20 aa, Mycobacterium bovis
PLLGICGGFQMLGRVIRDPY

SEQ ID NO: 213680 - protein, 21 aa, Mycobacterium bovis
PLPQTRFVLRKALAAHLPVIL

SEQ ID NO: 213681 - protein, 17 aa, Mycobacterium bovis
PLQSAMGAVSASAQTLL

SEQ ID NO: 213682 - protein, 21 aa, Mycobacterium bovis
PLRPGPPPTVWSRRWRQPWAP

SEQ ID NO: 213683 - protein, 19 aa, Mycobacterium bovis
PLRPWPGFVPMVYERYSQP

SEQ ID NO: 213684 - protein, 17 aa, Mycobacterium bovis
PLRVKAAAVGLAADEYH

SEQ ID NO: 213685 - protein, 21 aa, Mycobacterium bovis
PLVRRLWVLKVWGDVVDDRRG

SEQ ID NO: 213686 - protein, 17 aa, Mycobacterium bovis
PLWECWIIEGLNGNRWA

SEQ ID NO: 213687 - protein, 22 aa, Mycobacterium bovis
PMTAWAVGLLMRLPQRGVVTVA

SEQ ID NO: 213688 - protein, 18 aa, Mycobacterium bovis
PNAGSRFLLDQAITSAGR

SEQ ID NO: 213689 - protein, 17 aa, Mycobacterium bovis
PNFWAWLIAQVKTVDPD

SEQ ID NO: 213690 - protein, 18 aa, Mycobacterium bovis
PNLFATHRVRAVDDYASH

SEQ ID NO: 213691 - protein, 17 aa, Mycobacterium bovis
PPECLYGSLKMWAHLQR

SEQ ID NO: 213692 - protein, 18 aa, Mycobacterium bovis
PPGTIGEIWVHGDNVAGG

SEQ ID NO: 213693 - protein, 19 aa, Mycobacterium bovis
PPHPAHFLWLNWGPCPPRQ

SEQ ID NO: 213694 - protein, 18 aa, Mycobacterium bovis
PPHVPAMLVAGCDPRPNA

SEQ ID NO: 213695 - protein, 19 aa, Mycobacterium bovis
PPPSEGWRRLLYLLSGRLI

SEQ ID NO: 213696 - protein, 18 aa, Mycobacterium bovis
PPYVVRWLVNGHETTVYP

SEQ ID NO: 213697 - protein, 17 aa, Mycobacterium bovis
PQARLALITAIRAAGLD

SEQ ID NO: 213698 - protein, 17 aa, Mycobacterium bovis
PQFSAVLECASAARQLG

SEQ ID NO: 213699 - protein, 19 aa, Mycobacterium bovis
PQPICWAIDHVRVCVGHGY

SEQ ID NO: 213700 - protein, 17 aa, Mycobacterium bovis
PQQRLLIEVAWEALEDA

SEQ ID NO: 213701 - protein, 23 aa, Mycobacterium bovis
PQRGRISTWPLPEAFNGVTVNGV

SEQ ID NO: 213702 - protein, 23 aa, Mycobacterium bovis
PQTFYLSGLFFFGPVNLSASTLT

SEQ ID NO: 213703 - protein, 24 aa, Mycobacterium bovis
PQVARAALLFGMCFDAESAVRHGL

SEQ ID NO: 213704 - protein, 17 aa, Mycobacterium bovis
PRALQGLALPTASQSAS

SEQ ID NO: 213705 - protein, 17 aa, Mycobacterium bovis
PRCLPQRIAVPVTKLKT

SEQ ID NO: 213706 - protein, 18 aa, Mycobacterium bovis
PREALALALDQERTVTDQ

SEQ ID NO: 213707 - protein, 22 aa, Mycobacterium bovis
PRETWLRLLLIRAGFPRPQTQI

SEQ ID NO: 213708 - protein, 18 aa, Mycobacterium bovis
PRFVCALPKEFFAAVRAE

SEQ ID NO: 213709 - protein, 20 aa, Mycobacterium bovis
PRGGRRLFVFLGSTIGNLTP

SEQ ID NO: 213710 - protein, 18 aa, Mycobacterium bovis
PRGISFLLNRNRLNVAVS

SEQ ID NO: 213711 - protein, 22 aa, Mycobacterium bovis
PRGRGLMCAFSLPTTADRDELI

SEQ ID NO: 213712 - protein, 19 aa, Mycobacterium bovis
PRIATPMLARIGGAALAED

SEQ ID NO: 213713 - protein, 18 aa, Mycobacterium bovis
PRIRGGKVPFVFRTLPGY

SEQ ID NO: 213714 - protein, 22 aa, Mycobacterium bovis
PRKLLEEWLAMWSGHYQLKDKL

SEQ ID NO: 213715 - protein, 19 aa, Mycobacterium bovis
PRLAELGGRFWFGLDDGRA

SEQ ID NO: 213716 - protein, 18 aa, Mycobacterium bovis
PRLREFALREGLADAQLR

SEQ ID NO: 213717 - protein, 17 aa, Mycobacterium bovis
PRPRWRSAQALTSRSCN

SEQ ID NO: 213718 - protein, 18 aa, Mycobacterium bovis
PRTGLSMGEHAAVTAKQM

SEQ ID NO: 213719 - protein, 21 aa, Mycobacterium bovis
PRVDPALLLNCMLLAATERSV

SEQ ID NO: 213720 - protein, 19 aa, Mycobacterium bovis
PRVIKRWRRGKPLADAETI

SEQ ID NO: 213721 - protein, 17 aa, Mycobacterium bovis
PRWVLPVSDGVRELAVQ

SEQ ID NO: 213722 - protein, 17 aa, Mycobacterium bovis
PSGSFIFAGPSGVGKTE

SEQ ID NO: 213723 - protein, 17 aa, Mycobacterium bovis
PSHEKLAWARRVLAASR

SEQ ID NO: 213724 - protein, 22 aa, Mycobacterium bovis
PSIACSRWGMLSPEGRCKTFDA

SEQ ID NO: 213725 - protein, 18 aa, Mycobacterium bovis
PSVREYSVRYGLTERRQA

SEQ ID NO: 213726 - protein, 20 aa, Mycobacterium bovis
PSYTRPASWRGLDVPEVLLS

SEQ ID NO: 213727 - protein, 18 aa, Mycobacterium bovis
PTARRILRHFGIEQHFEV

SEQ ID NO: 213728 - protein, 17 aa, Mycobacterium bovis
PTLAGAVPTIWNDVMHY

SEQ ID NO: 213729 - protein, 18 aa, Mycobacterium bovis
PTTAAFCDAEFERMRVEA

SEQ ID NO: 213730 - protein, 18 aa, Mycobacterium bovis
PTYKRIRILGGHRLGMMM

SEQ ID NO: 213731 - protein, 17 aa, Mycobacterium bovis
PVALPVPAYMPFFDVLH

SEQ ID NO: 213732 - protein, 19 aa, Mycobacterium bovis
PVAVFRCGMILADTSYAGQ

SEQ ID NO: 213733 - protein, 17 aa, Mycobacterium bovis
PVAVVGIGCRFPGDVDG

SEQ ID NO: 213734 - protein, 26 aa, Mycobacterium bovis
PVGGLLARFPGFYIPFLDVPFNGATP

SEQ ID NO: 213735 - protein, 18 aa, Mycobacterium bovis
PWADAVWDTGIEFGTVGV

SEQ ID NO: 213736 - protein, 18 aa, Mycobacterium bovis
PWEHPDFWDIWKASLQGV

SEQ ID NO: 213737 - protein, 18 aa, Mycobacterium bovis
PWQIHDWILLTPWGLLSW

SEQ ID NO: 213738 - protein, 17 aa, Mycobacterium bovis
PWTVPKFYWTVLGLSAL

SEQ ID NO: 213739 - protein, 19 aa, Mycobacterium bovis
PYDPPWCRPLLGVRRSVTH

SEQ ID NO: 213740 - protein, 19 aa, Mycobacterium bovis
PYPSLKRMNPWKRFFHNQT

SEQ ID NO: 213741 - protein, 18 aa, Mycobacterium bovis
PYWYWALDRESIGGSVSA

SEQ ID NO: 213742 - protein, 19 aa, Mycobacterium bovis
QADKYDVPRICFVNKMDKI

SEQ ID NO: 213743 - protein, 21 aa, Mycobacterium bovis
QAGALPALFSGLARRPRRRQI

SEQ ID NO: 213744 - protein, 23 aa, Mycobacterium bovis
QARTIRIPVHMVEVINKLGRIQR

SEQ ID NO: 213745 - protein, 18 aa, Mycobacterium bovis
QCANRFDVVQAFTDDALT

SEQ ID NO: 213746 - protein, 26 aa, Mycobacterium bovis
QCGLPKLMALELFKPFVMKRLVDLNH

SEQ ID NO: 213747 - protein, 22 aa, Mycobacterium bovis
QCRDLLHWRFCRGVPPRATNDT

SEQ ID NO: 213748 - protein, 25 aa, Mycobacterium bovis
QDGILTIVGFAWRGDHVQILDSLPE

SEQ ID NO: 213749 - protein, 17 aa, Mycobacterium bovis
QDVAAMFGYHAGASAAV

SEQ ID NO: 213750 - protein, 18 aa, Mycobacterium bovis
QEDFIGIHFFSPVDKMPL

SEQ ID NO: 213751 - protein, 19 aa, Mycobacterium bovis
QEIFRRFTITAAGPSKGET

SEQ ID NO: 213752 - protein, 18 aa, Mycobacterium bovis
QELGLTWLAEIGAHGVVA

SEQ ID NO: 213753 - protein, 21 aa, Mycobacterium bovis
QELHELLTLPFRSASEFIDAT

SEQ ID NO: 213754 - protein, 17 aa, Mycobacterium bovis
QESFGLKESAWVIDELR

SEQ ID NO: 213755 - protein, 23 aa, Mycobacterium bovis
QEVRWCPGCGDYVILNTIRNFLP

SEQ ID NO: 213756 - protein, 18 aa, Mycobacterium bovis
QFARVHLDACDRWSVGLS

SEQ ID NO: 213757 - protein, 23 aa, Mycobacterium bovis
QFVKRLGTHAAIFTVPNFLELDY

SEQ ID NO: 213758 - protein, 20 aa, Mycobacterium bovis
QGGAGRGLWGTGGAGGHGGQ

SEQ ID NO: 213759 - protein, 20 aa, Mycobacterium bovis
QGQCTFSWPPRMELPGYKPN

SEQ ID NO: 213760 - protein, 22 aa, Mycobacterium bovis
QGRVALDWLDRVDVIGHSRSSG

SEQ ID NO: 213761 - protein, 22 aa, Mycobacterium bovis
QGVPMCAGYVPGIPRLGVPALL

SEQ ID NO: 213762 - protein, 18 aa, Mycobacterium bovis
QIAHCLAELVTLDTPTVS

SEQ ID NO: 213763 - protein, 22 aa, Mycobacterium bovis
QIKLAVLVATNFFGINTIPIAI

SEQ ID NO: 213764 - protein, 22 aa, Mycobacterium bovis
QIPKLRAGSFFPSLLERRRRID

SEQ ID NO: 213765 - protein, 17 aa, Mycobacterium bovis
QIRSIPTIMAFKNGKLL

SEQ ID NO: 213766 - protein, 19 aa, Mycobacterium bovis
QKARIFLALLGKQYGVTPK

SEQ ID NO: 213767 - protein, 19 aa, Mycobacterium bovis
QLDRFAIRLELRYLSERDE

SEQ ID NO: 213768 - protein, 20 aa, Mycobacterium bovis
QLFKQLLMVAGMERYYQIAR

SEQ ID NO: 213769 - protein, 18 aa, Mycobacterium bovis
QLLLLPLTSLRGLRHTLK

SEQ ID NO: 213770 - protein, 21 aa, Mycobacterium bovis
QLSGLRLGKVISISEASGAAP

SEQ ID NO: 213771 - protein, 23 aa, Mycobacterium bovis
QLTRKRLGTGLIEAFSTSCPNCS

SEQ ID NO: 213772 - protein, 23 aa, Mycobacterium bovis
QPDLRVLVDLGYGYGYADVPTPA

SEQ ID NO: 213773 - protein, 22 aa, Mycobacterium bovis
QPGCDAWCLAALAAVLVQENLC

SEQ ID NO: 213774 - protein, 19 aa, Mycobacterium bovis
QPIEWRYANDPAWIMRDKG

SEQ ID NO: 213775 - protein, 21 aa, Mycobacterium bovis
QPKLDVLDFWSIIKPELAGVH

SEQ ID NO: 213776 - protein, 17 aa, Mycobacterium bovis
QPVRRFGWRIMPQNLSD

SEQ ID NO: 213777 - protein, 23 aa, Mycobacterium bovis
QQYDAVWRWIDWPERRGRTDTGI

SEQ ID NO: 213778 - protein, 21 aa, Mycobacterium bovis
QQYPLDRLKAIGAQYDATIND

SEQ ID NO: 213779 - protein, 21 aa, Mycobacterium bovis
QRLAATIPRARFEVIEGARTF

SEQ ID NO: 213780 - protein, 20 aa, Mycobacterium bovis
QRLCTELELPALHVPPEHGG

SEQ ID NO: 213781 - protein, 19 aa, Mycobacterium bovis
QRLRLPWWHLWRAAEAAGA

SEQ ID NO: 213782 - protein, 21 aa, Mycobacterium bovis
QRLSAQAAGFHAQFVQALNAG

SEQ ID NO: 213783 - protein, 20 aa, Mycobacterium bovis
QRMSTVLSRRLWENAGSPEV

SEQ ID NO: 213784 - protein, 23 aa, Mycobacterium bovis
QRRFGVSYWTVFDEWAGRASAMR

SEQ ID NO: 213785 - protein, 23 aa, Mycobacterium bovis
QRWPETRIDPSLTRISALMDLLG

SEQ ID NO: 213786 - protein, 17 aa, Mycobacterium bovis
QSQVVAWWAPTFDEVNG

SEQ ID NO: 213787 - protein, 23 aa, Mycobacterium bovis
QSSNGPLSWLWQILFGTPNFPTS

SEQ ID NO: 213788 - protein, 18 aa, Mycobacterium bovis
QTGFARTGAMFACEHEGP

SEQ ID NO: 213789 - protein, 17 aa, Mycobacterium bovis
QTVARWLVLYLRRPGGQ

SEQ ID NO: 213790 - protein, 25 aa, Mycobacterium bovis
QVCAEWTRRGWLAVRYNLPYRRRRP

SEQ ID NO: 213791 - protein, 17 aa, Mycobacterium bovis
QVCSRLAATELYRRLRE

SEQ ID NO: 213792 - protein, 22 aa, Mycobacterium bovis
QVGPMLADWAKWGQARHNYFLR

SEQ ID NO: 213793 - protein, 22 aa, Mycobacterium bovis
QVLGFREHASWALASDTLEFVD

SEQ ID NO: 213794 - protein, 25 aa, Mycobacterium bovis
QVLKEIRSRLGFLLDVGLEYLSLSR

SEQ ID NO: 213795 - protein, 22 aa, Mycobacterium bovis
QYKDVILGLVFLKYVSDAYDER

SEQ ID NO: 213796 - protein, 24 aa, Mycobacterium bovis
RAACSASPVAPGWAVPPVAGVMAG

SEQ ID NO: 213797 - protein, 18 aa, Mycobacterium bovis
RAAGIPILGKTNMDEFAM

SEQ ID NO: 213798 - protein, 20 aa, Mycobacterium bovis
RAAVRPEWPVLVAAIAEWAK

SEQ ID NO: 213799 - protein, 20 aa, Mycobacterium bovis
RACQVRFAIYLGDLGRDTAA

SEQ ID NO: 213800 - protein, 20 aa, Mycobacterium bovis
RADPGEIVWTWVAYEQDPTR

SEQ ID NO: 213801 - protein, 21 aa, Mycobacterium bovis
RAELIRLLLNRALTTAGDDLA

SEQ ID NO: 213802 - protein, 18 aa, Mycobacterium bovis
RAEPDCLLDSLLLEDPGL

SEQ ID NO: 213803 - protein, 20 aa, Mycobacterium bovis
RAFDALAAWVRAAAAKNMVD

SEQ ID NO: 213804 - protein, 17 aa, Mycobacterium bovis
RAFLADKVVRWWLPERW

SEQ ID NO: 213805 - protein, 19 aa, Mycobacterium bovis
RAFRLQWPIGTTIFELDRP

SEQ ID NO: 213806 - protein, 20 aa, Mycobacterium bovis
RAGDPFQHWIGRRFDAVATD

SEQ ID NO: 213807 - protein, 21 aa, Mycobacterium bovis
RAGLPDGEFFGAIAQLPGASG

SEQ ID NO: 213808 - protein, 17 aa, Mycobacterium bovis
RAGTVALVIREDRGWAV

SEQ ID NO: 213809 - protein, 25 aa, Mycobacterium bovis
RAIPRGVGTAGVWRLPDRNTLQEVL

SEQ ID NO: 213810 - protein, 18 aa, Mycobacterium bovis
RAIWRINELLNWQVASAG

SEQ ID NO: 213811 - protein, 18 aa, Mycobacterium bovis
RALAVFGGMGLRLKGSDT

SEQ ID NO: 213812 - protein, 18 aa, Mycobacterium bovis
RALEDWCHQLAWPIRPAV

SEQ ID NO: 213813 - protein, 17 aa, Mycobacterium bovis
RALGCPQPLIAVASAAT

SEQ ID NO: 213814 - protein, 21 aa, Mycobacterium bovis
RALGRYGVCANVICPRARTAM

SEQ ID NO: 213815 - protein, 18 aa, Mycobacterium bovis
RALIAVRGLHRFAAAEGL

SEQ ID NO: 213816 - protein, 19 aa, Mycobacterium bovis
RAPGALGLHAALTGAPFSG

SEQ ID NO: 213817 - protein, 24 aa, Mycobacterium bovis
RAQGRHCVAVKWGLWQAPKAGEPA

SEQ ID NO: 213818 - protein, 20 aa, Mycobacterium bovis
RAQLLELVWGYDFAADTNVV

SEQ ID NO: 213819 - protein, 22 aa, Mycobacterium bovis
RARLAAAIGLPGNRVVWMNQVH

SEQ ID NO: 213820 - protein, 21 aa, Mycobacterium bovis
RARRAIAEFRIRGVSTNIPFL

SEQ ID NO: 213821 - protein, 19 aa, Mycobacterium bovis
RARVLRRWSVPPVRPPVTV

SEQ ID NO: 213822 - protein, 17 aa, Mycobacterium bovis
RARVVQLERGWVLRDET

SEQ ID NO: 213823 - protein, 21 aa, Mycobacterium bovis
RASIDPFGWYRSWEEMLTGMA

SEQ ID NO: 213824 - protein, 22 aa, Mycobacterium bovis
RASRLSAVVVRWSRARKRYERQ

SEQ ID NO: 213825 - protein, 18 aa, Mycobacterium bovis
RASVCVLGPLVGRCKRAR

SEQ ID NO: 213826 - protein, 17 aa, Mycobacterium bovis
RATLIVRESACLDVEDR

SEQ ID NO: 213827 - protein, 17 aa, Mycobacterium bovis
RATREFLVWAVNDAIER

SEQ ID NO: 213828 - protein, 19 aa, Mycobacterium bovis
RATSHWLTLPALKAFGAIP

SEQ ID NO: 213829 - protein, 22 aa, Mycobacterium bovis
RAVARLRIAVVRAIRTALQRRG

SEQ ID NO: 213830 - protein, 17 aa, Mycobacterium bovis
RAVELLDLVGISQPQRR

SEQ ID NO: 213831 - protein, 18 aa, Mycobacterium bovis
RAVHRCLLAGRFATALGA

SEQ ID NO: 213832 - protein, 20 aa, Mycobacterium bovis
RAVLVLSDWPAPQAPQSASG

SEQ ID NO: 213833 - protein, 26 aa, Mycobacterium bovis
RAVVTRYELVPGFPRFDVDDVYLGNG

SEQ ID NO: 213834 - protein, 23 aa, Mycobacterium bovis
RAYFRGECLRRFGADIAAASWDS

SEQ ID NO: 213835 - protein, 20 aa, Mycobacterium bovis
RAYRLDWPAGTIVYEIDQPK

SEQ ID NO: 213836 - protein, 21 aa, Mycobacterium bovis
RAYRLPWPAGTVVYEIDQPQV

SEQ ID NO: 213837 - protein, 19 aa, Mycobacterium bovis
RAYRLPWPDGTTVFELDRP

SEQ ID NO: 213838 - protein, 21 aa, Mycobacterium bovis
RCAAQSWPLDRVKAVKDAAGV

SEQ ID NO: 213839 - protein, 25 aa, Mycobacterium bovis
RCGSPAWNLPVVFGPIAVTYNLNSV

SEQ ID NO: 213840 - protein, 17 aa, Mycobacterium bovis
RCPDRPGLIDELGTLTW

SEQ ID NO: 213841 - protein, 23 aa, Mycobacterium bovis
RCSGRLRKLFNAVGVVFKGTGFY

SEQ ID NO: 213842 - protein, 23 aa, Mycobacterium bovis
RDAIRHAVAWARPGDVVLIAGKG

SEQ ID NO: 213843 - protein, 17 aa, Mycobacterium bovis
RDIYKFAAGSVFSRPFQ

SEQ ID NO: 213844 - protein, 17 aa, Mycobacterium bovis
RDLLKFDFYFADSTAFR

SEQ ID NO: 213845 - protein, 20 aa, Mycobacterium bovis
RDVPCPVCAGTRLKPEILAV

SEQ ID NO: 213846 - protein, 17 aa, Mycobacterium bovis
REAFLALIRSNWLGLNA

SEQ ID NO: 213847 - protein, 20 aa, Mycobacterium bovis
REALPLAERVDWLYAKASQH

SEQ ID NO: 213848 - protein, 23 aa, Mycobacterium bovis
REGHCGACACTLRAGKVNMGVND

SEQ ID NO: 213849 - protein, 23 aa, Mycobacterium bovis
REKLFPLICRYAVAYHVVFIPSA

SEQ ID NO: 213850 - protein, 21 aa, Mycobacterium bovis
RELGVQFARQGIRVNALCPGP

SEQ ID NO: 213851 - protein, 20 aa, Mycobacterium bovis
RELRSAGAVFGLLDVDDEFF

SEQ ID NO: 213852 - protein, 23 aa, Mycobacterium bovis
REMAYEGKIDWAFGELLALGSLV

SEQ ID NO: 213853 - protein, 20 aa, Mycobacterium bovis
REMLSRLGVEYVGDSRSVDF

SEQ ID NO: 213854 - protein, 18 aa, Mycobacterium bovis
RENLSWSAPRLHLVDLQY

SEQ ID NO: 213855 - protein, 20 aa, Mycobacterium bovis
RERLGLPGLRDWLRRQAKAG

SEQ ID NO: 213856 - protein, 23 aa, Mycobacterium bovis
RERPGRLLGFHWTKVHPDHPGLG

SEQ ID NO: 213857 - protein, 18 aa, Mycobacterium bovis
RERTVLVLRFFDSMTQTQ

SEQ ID NO: 213858 - protein, 21 aa, Mycobacterium bovis
RETFRAIGVDLMFDHIKQSLH

SEQ ID NO: 213859 - protein, 20 aa, Mycobacterium bovis
REVAELLLLGMPYRDIGARL

SEQ ID NO: 213860 - protein, 25 aa, Mycobacterium bovis
REWLTQWSRPGLIPVALVVVNVFVE

SEQ ID NO: 213861 - protein, 18 aa, Mycobacterium bovis
RFAAPCPGQHGWRAPAAA

SEQ ID NO: 213862 - protein, 21 aa, Mycobacterium bovis
RFADWLVRVVEAFADRPDQPL

SEQ ID NO: 213863 - protein, 18 aa, Mycobacterium bovis
RFLIHTARIAYVEIGVAD

SEQ ID NO: 213864 - protein, 17 aa, Mycobacterium bovis
RFLSVVLRRIRGMRSDT

SEQ ID NO: 213865 - protein, 18 aa, Mycobacterium bovis
RFRILPTLWEPGGDEITL

SEQ ID NO: 213866 - protein, 18 aa, Mycobacterium bovis
RFVREFPFNLMLWDLDRR

SEQ ID NO: 213867 - protein, 23 aa, Mycobacterium bovis
RFYPEIPSRFAVVARRGNDIRWF

SEQ ID NO: 213868 - protein, 18 aa, Mycobacterium bovis
RGAMGLNWYLTDPTLQFI

SEQ ID NO: 213869 - protein, 21 aa, Mycobacterium bovis
RGCLGRPWLFAELSAAFTGSP

SEQ ID NO: 213870 - protein, 20 aa, Mycobacterium bovis
RGCSHACRYCFARPTHEYLD

SEQ ID NO: 213871 - protein, 17 aa, Mycobacterium bovis
RGGKFLNNWRMAELHAK

SEQ ID NO: 213872 - protein, 18 aa, Mycobacterium bovis
RGGLRWSDRRDDFRTEIL

SEQ ID NO: 213873 - protein, 18 aa, Mycobacterium bovis
RGLRCIAPTWPLGAHPKP

SEQ ID NO: 213874 - protein, 17 aa, Mycobacterium bovis
RGLTAMWRRGDEVFAEV

SEQ ID NO: 213875 - protein, 17 aa, Mycobacterium bovis
RGMAARNRLDIVAALQN

SEQ ID NO: 213876 - protein, 20 aa, Mycobacterium bovis
RGPFPGALWLQVRDLEATQT

SEQ ID NO: 213877 - protein, 18 aa, Mycobacterium bovis
RGPMLHRALQQFLADVYW

SEQ ID NO: 213878 - protein, 19 aa, Mycobacterium bovis
RGPYRLGPEITRMATTVRL

SEQ ID NO: 213879 - protein, 22 aa, Mycobacterium bovis
RGRCTPIAAWLAGLGLFTKRSH

SEQ ID NO: 213880 - protein, 18 aa, Mycobacterium bovis
RGTAPAGRGFWFPPTVLT

SEQ ID NO: 213881 - protein, 17 aa, Mycobacterium bovis
RHARFMVNYATHWTEAR

SEQ ID NO: 213882 - protein, 18 aa, Mycobacterium bovis
RHHLPVPPAFCITTEVGV

SEQ ID NO: 213883 - protein, 17 aa, Mycobacterium bovis
RHLRLPLRNVLWEGDEA

SEQ ID NO: 213884 - protein, 20 aa, Mycobacterium bovis
RHPHCAWTVIIDESYPEAEG

SEQ ID NO: 213885 - protein, 18 aa, Mycobacterium bovis
RIAILLKVHHALIDGEGG

SEQ ID NO: 213886 - protein, 18 aa, Mycobacterium bovis
RIAPEIVEFWQGRENRMH

SEQ ID NO: 213887 - protein, 24 aa, Mycobacterium bovis
RIEQLRGSPLYTLRTKGKADLLKA

SEQ ID NO: 213888 - protein, 24 aa, Mycobacterium bovis
RIFKRIRPAFTYRRSLGVLTAARD

SEQ ID NO: 213889 - protein, 19 aa, Mycobacterium bovis
RIGFPAIVGIIADVLHAAD

SEQ ID NO: 213890 - protein, 18 aa, Mycobacterium bovis
RIGQRIAAWLNYYGAGNH

SEQ ID NO: 213891 - protein, 18 aa, Mycobacterium bovis
RIGVKVWIYKGDIVGGKR

SEQ ID NO: 213892 - protein, 18 aa, Mycobacterium bovis
RILAPRSRYDEIVAAVTN

SEQ ID NO: 213893 - protein, 24 aa, Mycobacterium bovis
RILPETRRYLGWRLSLLDLIGADT

SEQ ID NO: 213894 - protein, 20 aa, Mycobacterium bovis
RIPLISIPAAPGFGNSTTNP

SEQ ID NO: 213895 - protein, 21 aa, Mycobacterium bovis
RISSIPVEYVLAFVEGSNMGQ

SEQ ID NO: 213896 - protein, 17 aa, Mycobacterium bovis
RIVSFDAAGGWNIEEEG

SEQ ID NO: 213897 - protein, 21 aa, Mycobacterium bovis
RKEVFRLRLASGREVEATGSH

SEQ ID NO: 213898 - protein, 19 aa, Mycobacterium bovis
RKFGCGFAPSGWDSLTKHL

SEQ ID NO: 213899 - protein, 17 aa, Mycobacterium bovis
RKIAERRVFPAVDVNPS

SEQ ID NO: 213900 - protein, 17 aa, Mycobacterium bovis
RKTDWLFPQYRELGVYL

SEQ ID NO: 213901 - protein, 21 aa, Mycobacterium bovis
RKVLPGYILVRMDLTDDSWAA

SEQ ID NO: 213902 - protein, 19 aa, Mycobacterium bovis
RLAISELTGAYWAGPAAAS

SEQ ID NO: 213903 - protein, 17 aa, Mycobacterium bovis
RLAMAMAAIRARRSLDS

SEQ ID NO: 213904 - protein, 23 aa, Mycobacterium bovis
RLARSLFLYALCNGWINENTTVV

SEQ ID NO: 213905 - protein, 20 aa, Mycobacterium bovis
RLCLRFSSRLGITVASVDYR

SEQ ID NO: 213906 - protein, 26 aa, Mycobacterium bovis
RLDEWRCLECIRALRANQQAAQRLRG

SEQ ID NO: 213907 - protein, 17 aa, Mycobacterium bovis
RLEKLWLPGPDRLLDCV

SEQ ID NO: 213908 - protein, 18 aa, Mycobacterium bovis
RLETLLALIEGWVQTVVT

SEQ ID NO: 213909 - protein, 22 aa, Mycobacterium bovis
RLFPRGLAAFIELRDQRCRTPY

SEQ ID NO: 213910 - protein, 19 aa, Mycobacterium bovis
RLFPRSVFHSLKLAEHNLA

SEQ ID NO: 213911 - protein, 17 aa, Mycobacterium bovis
RLGIIIAGFDRRRIPLV

SEQ ID NO: 213912 - protein, 20 aa, Mycobacterium bovis
RLHHLLATFCGWRAQQLPDG

SEQ ID NO: 213913 - protein, 18 aa, Mycobacterium bovis
RLLARNGLSLQDFDFYEI

SEQ ID NO: 213914 - protein, 18 aa, Mycobacterium bovis
RLLCEQVGAAALVIPEEL

SEQ ID NO: 213915 - protein, 19 aa, Mycobacterium bovis
RLLLREVFTAAGGTHDDWD

SEQ ID NO: 213916 - protein, 18 aa, Mycobacterium bovis
RLLPALGFRVRFGVLVIR

SEQ ID NO: 213917 - protein, 20 aa, Mycobacterium bovis
RLNLPAGWSYHTRVLTSELR

SEQ ID NO: 213918 - protein, 17 aa, Mycobacterium bovis
RLRAVDFTLGYEVRSVN

SEQ ID NO: 213919 - protein, 17 aa, Mycobacterium bovis
RLRCYVVGVTRGAREPL

SEQ ID NO: 213920 - protein, 22 aa, Mycobacterium bovis
RLRDIGGIVVIDFIDMVLESNR

SEQ ID NO: 213921 - protein, 20 aa, Mycobacterium bovis
RLRGGQTLIGFLAPRNADNS

SEQ ID NO: 213922 - protein, 19 aa, Mycobacterium bovis
RLSAFKVPHRFAVVDRLPR

SEQ ID NO: 213923 - protein, 20 aa, Mycobacterium bovis
RLSDPFITIDAFQVVAGVLF

SEQ ID NO: 213924 - protein, 18 aa, Mycobacterium bovis
RLTLPAKFRDALAGGLMV

SEQ ID NO: 213925 - protein, 19 aa, Mycobacterium bovis
RLVAPVFDPKKAVVFDDRW

SEQ ID NO: 213926 - protein, 19 aa, Mycobacterium bovis
RLYVGAGLAPMLDAAAAWD

SEQ ID NO: 213927 - protein, 17 aa, Mycobacterium bovis
RMEIDWTGCRDFDELIV

SEQ ID NO: 213928 - protein, 18 aa, Mycobacterium bovis
RMHMPGVSICYGMTETSP

SEQ ID NO: 213929 - protein, 18 aa, Mycobacterium bovis
RMKFEGGVHRVQRVPVTE

SEQ ID NO: 213930 - protein, 24 aa, Mycobacterium bovis
RMLTLPATFGLYVERAWPRHRRLS

SEQ ID NO: 213931 - protein, 20 aa, Mycobacterium bovis
RMRQEITEVIALQERLGLDV

SEQ ID NO: 213932 - protein, 21 aa, Mycobacterium bovis
RNPRWWGARPRLDSITYLVLD

SEQ ID NO: 213933 - protein, 21 aa, Mycobacterium bovis
RNVEIPDHFRIYVSQKLARLE

SEQ ID NO: 213934 - protein, 20 aa, Mycobacterium bovis
RPADCLRPLQIHALISEVLK

SEQ ID NO: 213935 - protein, 19 aa, Mycobacterium bovis
RPAGTSIRILFAFDPARQA

SEQ ID NO: 213936 - protein, 19 aa, Mycobacterium bovis
RPAGWWVRRRLHEVAVHRA

SEQ ID NO: 213937 - protein, 19 aa, Mycobacterium bovis
RPALTINFCVGFVRQQVNQ

SEQ ID NO: 213938 - protein, 21 aa, Mycobacterium bovis
RPDELHLGFNFRLARTEFDAA

SEQ ID NO: 213939 - protein, 25 aa, Mycobacterium bovis
RPDFATGLMPLRWGTGFMLGSAKYG

SEQ ID NO: 213940 - protein, 23 aa, Mycobacterium bovis
RPDLDVDLVYRFIRDTTWVSVRW

SEQ ID NO: 213941 - protein, 18 aa, Mycobacterium bovis
RPDLRRWLPLDVYRPLKS

SEQ ID NO: 213942 - protein, 21 aa, Mycobacterium bovis
RPGGRLGLVWNTRDERLGWVR

SEQ ID NO: 213943 - protein, 19 aa, Mycobacterium bovis
RPIADVCPVEWARMANRSV

SEQ ID NO: 213944 - protein, 19 aa, Mycobacterium bovis
RPITELGMVKSIDTGPDGS

SEQ ID NO: 213945 - protein, 20 aa, Mycobacterium bovis
RPKHYWSIYQKMIVKGRDFD

SEQ ID NO: 213946 - protein, 21 aa, Mycobacterium bovis
RPLRGCYRIAVLSLKGGVGKT

SEQ ID NO: 213947 - protein, 23 aa, Mycobacterium bovis
RPLRIAHAWSFTFDAAWQPLVAL

SEQ ID NO: 213948 - protein, 17 aa, Mycobacterium bovis
RPLRPSFVDGLRNEIQI

SEQ ID NO: 213949 - protein, 25 aa, Mycobacterium bovis
RPNRLAVCLDLDWRPQFRVDLIPSY

SEQ ID NO: 213950 - protein, 24 aa, Mycobacterium bovis
RPPARLVGWTARFLGMVRPGDEVD

SEQ ID NO: 213951 - protein, 25 aa, Mycobacterium bovis
RPQLAVTFRNGWQWATVEGRAQLVG

SEQ ID NO: 213952 - protein, 19 aa, Mycobacterium bovis
RPSEVARLGYLAGIVATML

SEQ ID NO: 213953 - protein, 19 aa, Mycobacterium bovis
RPTELCFVPRIWDMVFAEF

SEQ ID NO: 213954 - protein, 18 aa, Mycobacterium bovis
RPTLSWPRNLPIDGEPAE

SEQ ID NO: 213955 - protein, 18 aa, Mycobacterium bovis
RPVDAYADFDSCQSWTER

SEQ ID NO: 213956 - protein, 17 aa, Mycobacterium bovis
RPWVPVVSLVKGLEQGT

SEQ ID NO: 213957 - protein, 17 aa, Mycobacterium bovis
RQILGHRAMIVAGGSNR

SEQ ID NO: 213958 - protein, 18 aa, Mycobacterium bovis
RQLVEVPVGFKWFVDGLI

SEQ ID NO: 213959 - protein, 22 aa, Mycobacterium bovis
RQQTLRASIDWSHALLTETEQI

SEQ ID NO: 213960 - protein, 23 aa, Mycobacterium bovis
RQQTLRASMDWSYALLTDTERIL

SEQ ID NO: 213961 - protein, 17 aa, Mycobacterium bovis
RQYSRWALRLRVPFTVP

SEQ ID NO: 213962 - protein, 23 aa, Mycobacterium bovis
RRAGWRAARWLAVVINYRAERWS

SEQ ID NO: 213963 - protein, 18 aa, Mycobacterium bovis
RRDMGVGELLGMVQAGLN

SEQ ID NO: 213964 - protein, 21 aa, Mycobacterium bovis
RREVWRLLASFRVQPATEVIA

SEQ ID NO: 213965 - protein, 25 aa, Mycobacterium bovis
RRFLERRLRETFGFDGSPIRVNVRV

SEQ ID NO: 213966 - protein, 22 aa, Mycobacterium bovis
RRGHRKLVRFQARRAIGPIRPT

SEQ ID NO: 213967 - protein, 19 aa, Mycobacterium bovis
RRGRRGRGRGRGEQGGSDG

SEQ ID NO: 213968 - protein, 18 aa, Mycobacterium bovis
RRGSMQWFSPELQQYAPA

SEQ ID NO: 213969 - protein, 21 aa, Mycobacterium bovis
RRLAIECLRQLAAVAPAVFAD

SEQ ID NO: 213970 - protein, 19 aa, Mycobacterium bovis
RRLELLGDREYLRWLRRSV

SEQ ID NO: 213971 - protein, 18 aa, Mycobacterium bovis
RRLIPPWVTLGSRLAALP

SEQ ID NO: 213972 - protein, 18 aa, Mycobacterium bovis
RRLKASGIDTVFTLSGGH

SEQ ID NO: 213973 - protein, 21 aa, Mycobacterium bovis
RRPDLLVSLLTYWQRHPSLSY

SEQ ID NO: 213974 - protein, 17 aa, Mycobacterium bovis
RRPPAFPEDIWVPERDP

SEQ ID NO: 213975 - protein, 18 aa, Mycobacterium bovis
RRRCAPLGAGRCLLGSGS

SEQ ID NO: 213976 - protein, 18 aa, Mycobacterium bovis
RRRQWLPAAEVIGELVRL

SEQ ID NO: 213977 - protein, 17 aa, Mycobacterium bovis
RRSIKFPTFMAGIDAVR

SEQ ID NO: 213978 - protein, 18 aa, Mycobacterium bovis
RRTHGWPAAMGILREMGM

SEQ ID NO: 213979 - protein, 18 aa, Mycobacterium bovis
RRTLRLPWGNGIVSLTPA

SEQ ID NO: 213980 - protein, 17 aa, Mycobacterium bovis
RRVEFWPTVAIRSALES

SEQ ID NO: 213981 - protein, 25 aa, Mycobacterium bovis
RRVGRPRIRLAYRLTPRRVLGQRRA

SEQ ID NO: 213982 - protein, 21 aa, Mycobacterium bovis
RRVSLPDGRYVFTTRVIISAR

SEQ ID NO: 213983 - protein, 19 aa, Mycobacterium bovis
RRYRFRAGIAKVDFVLSDE

SEQ ID NO: 213984 - protein, 22 aa, Mycobacterium bovis
RSACIKAMIEKVVDRMYAEIDD

SEQ ID NO: 213985 - protein, 19 aa, Mycobacterium bovis
RSDFPVLWPVGTRWADNDM

SEQ ID NO: 213986 - protein, 20 aa, Mycobacterium bovis
RSEWLEPRWMVGIDPESDGL

SEQ ID NO: 213987 - protein, 18 aa, Mycobacterium bovis
RSGDVWLLNGFKWFASNC

SEQ ID NO: 213988 - protein, 19 aa, Mycobacterium bovis
RSGLFEVLAAGGAGGTGGL

SEQ ID NO: 213989 - protein, 19 aa, Mycobacterium bovis
RSGMTIGIAGWGSRRKPMA

SEQ ID NO: 213990 - protein, 24 aa, Mycobacterium bovis
RSLALEHPEIWGGIIDLDDSMPAE

SEQ ID NO: 213991 - protein, 18 aa, Mycobacterium bovis
RSPISISTGVLWRDPTAG

SEQ ID NO: 213992 - protein, 18 aa, Mycobacterium bovis
RSRFGFLAIHGGGLEQVT

SEQ ID NO: 213993 - protein, 26 aa, Mycobacterium bovis
RSSRYPGGLALRFARVVRYRADKDPA

SEQ ID NO: 213994 - protein, 22 aa, Mycobacterium bovis
RSTTLALRWLVGYSRQRREKTM

SEQ ID NO: 213995 - protein, 21 aa, Mycobacterium bovis
RSVDIPARFVLGQALELPQPG

SEQ ID NO: 213996 - protein, 22 aa, Mycobacterium bovis
RSYNCLKREGVHTVGELVARTE

SEQ ID NO: 213997 - protein, 19 aa, Mycobacterium bovis
RTDEQWRWLAHTLTVELLK

SEQ ID NO: 213998 - protein, 18 aa, Mycobacterium bovis
RTERFWVGLSVYRPGGTA

SEQ ID NO: 213999 - protein, 18 aa, Mycobacterium bovis
RTGVFSLDARQWFQSFPA

SEQ ID NO: 214000 - protein, 23 aa, Mycobacterium bovis
RTIVELCALWAVHLHFDPSPEPW

SEQ ID NO: 214001 - protein, 17 aa, Mycobacterium bovis
RTKRWPDVLAQFPEATQ

SEQ ID NO: 214002 - protein, 18 aa, Mycobacterium bovis
RTLAVAVYNHYKRIQAGE

SEQ ID NO: 214003 - protein, 21 aa, Mycobacterium bovis
RTLRVAWSLADLAGRTSPGID

SEQ ID NO: 214004 - protein, 18 aa, Mycobacterium bovis
RTMRGYKVERRFGWDTHG

SEQ ID NO: 214005 - protein, 22 aa, Mycobacterium bovis
RTNACDRRRFGLSLTIHEDACR

SEQ ID NO: 214006 - protein, 23 aa, Mycobacterium bovis
RTRAIARLGSFFSDRRMAALRAA

SEQ ID NO: 214007 - protein, 23 aa, Mycobacterium bovis
RTSAVKAFTAWAVRRGLLAGDPA

SEQ ID NO: 214008 - protein, 19 aa, Mycobacterium bovis
RVAALRRCVPMVGQIKDPT

SEQ ID NO: 214009 - protein, 17 aa, Mycobacterium bovis
RVADAWIKAQAYRLQTF

SEQ ID NO: 214010 - protein, 17 aa, Mycobacterium bovis
RVDFPWLGTVVQAYLRR

SEQ ID NO: 214011 - protein, 20 aa, Mycobacterium bovis
RVGRRFARLAPIVATHRKLT

SEQ ID NO: 214012 - protein, 20 aa, Mycobacterium bovis
RVHLDACDRWSVGLSGGPDS

SEQ ID NO: 214013 - protein, 21 aa, Mycobacterium bovis
RVKCALLGWMAFKDALAQASE

SEQ ID NO: 214014 - protein, 17 aa, Mycobacterium bovis
RVKRPQIAIATWIVPSI

SEQ ID NO: 214015 - protein, 17 aa, Mycobacterium bovis
RVLLCLPDSPDLVQLLL

SEQ ID NO: 214016 - protein, 18 aa, Mycobacterium bovis
RVLLRFGLHQALRLGKPL

SEQ ID NO: 214017 - protein, 27 aa, Mycobacterium bovis
RVNGRIPLPVDWRWPWGEALAVLENTA

SEQ ID NO: 214018 - protein, 18 aa, Mycobacterium bovis
RVPDEFGLSRYLAAGLAA

SEQ ID NO: 214019 - protein, 19 aa, Mycobacterium bovis
RVRTWLLAVSNVFGQNAPA

SEQ ID NO: 214020 - protein, 19 aa, Mycobacterium bovis
RVSRRLVAMLARRGYGQTL

SEQ ID NO: 214021 - protein, 17 aa, Mycobacterium bovis
RVVRAHVPLSEMFGYVG

SEQ ID NO: 214022 - protein, 23 aa, Mycobacterium bovis
RVVTKCFLLWAGVVGAISLEVFG

SEQ ID NO: 214023 - protein, 24 aa, Mycobacterium bovis
RVYRFGGSLHLDWWYDTRRIPAAT

SEQ ID NO: 214024 - protein, 21 aa, Mycobacterium bovis
RWADSFGGLVFDATGITEPAG

SEQ ID NO: 214025 - protein, 26 aa, Mycobacterium bovis
RWAYYPWRRMVVAILGPRGFRAVRLD

SEQ ID NO: 214026 - protein, 19 aa, Mycobacterium bovis
RWDTDWFWCSRSFGAQNPR

SEQ ID NO: 214027 - protein, 21 aa, Mycobacterium bovis
RWSALLVGAWWPARPDAPMAG

SEQ ID NO: 214028 - protein, 18 aa, Mycobacterium bovis
RYDLAVQEIFVFTPKGDV

SEQ ID NO: 214029 - protein, 25 aa, Mycobacterium bovis
RYDLVLSFHCKQRFPAALIDGVRCV

SEQ ID NO: 214030 - protein, 23 aa, Mycobacterium bovis
RYIAKYTICPAIAHGMDHLIGSV

SEQ ID NO: 214031 - protein, 19 aa, Mycobacterium bovis
RYLALEWLDRMDLVNGKLI

SEQ ID NO: 214032 - protein, 17 aa, Mycobacterium bovis
RYLDILRPLGFRPALGF

SEQ ID NO: 214033 - protein, 26 aa, Mycobacterium bovis
RYLTALMPMVWRACEREDFVVEVQAM

SEQ ID NO: 214034 - protein, 19 aa, Mycobacterium bovis
RYRGLRAPHKIKLGVSGCA

SEQ ID NO: 214035 - protein, 19 aa, Mycobacterium bovis
RYTMPLGEIIFDFFDALKS

SEQ ID NO: 214036 - protein, 17 aa, Mycobacterium bovis
SAAFQAAHARFVAAAAK

SEQ ID NO: 214037 - protein, 18 aa, Mycobacterium bovis
SAAGYALWCNGIEDFAEL

SEQ ID NO: 214038 - protein, 25 aa, Mycobacterium bovis
SAAHKARWGVCLARTDPDAPKHKGI

SEQ ID NO: 214039 - protein, 21 aa, Mycobacterium bovis
SAAVSRLFGAYGQQFQALNAR

SEQ ID NO: 214040 - protein, 22 aa, Mycobacterium bovis
SAFGGGNAFGGRGGDGGDGGDG

SEQ ID NO: 214041 - protein, 18 aa, Mycobacterium bovis
SAGLRPGADVALALDAAA

SEQ ID NO: 214042 - protein, 17 aa, Mycobacterium bovis
SAHFVWVRDTLRLGGKF

SEQ ID NO: 214043 - protein, 25 aa, Mycobacterium bovis
SALKALEGDAKWVASVEELMNAVDE

SEQ ID NO: 214044 - protein, 19 aa, Mycobacterium bovis
SAMRVCGGAAFSKHLPIER

SEQ ID NO: 214045 - protein, 22 aa, Mycobacterium bovis
SAPMLAAAVAWDGLAAELGSAA

SEQ ID NO: 214046 - protein, 19 aa, Mycobacterium bovis
SAPMTLRWLTDRFAGKPLT

SEQ ID NO: 214047 - protein, 21 aa, Mycobacterium bovis
SAQFPRPAPRPSYSALSSRQW

SEQ ID NO: 214048 - protein, 19 aa, Mycobacterium bovis
SARWPAARFAVRNVAVQGP

SEQ ID NO: 214049 - protein, 18 aa, Mycobacterium bovis
SASLSFSSLSGWARLGLR

SEQ ID NO: 214050 - protein, 18 aa, Mycobacterium bovis
SAVPRALQGLALPTASQS

SEQ ID NO: 214051 - protein, 20 aa, Mycobacterium bovis
SAYPRVLDFAAFRSIADEVG

SEQ ID NO: 214052 - protein, 18 aa, Mycobacterium bovis
SCRWALAAANLWQGNLEA

SEQ ID NO: 214053 - protein, 18 aa, Mycobacterium bovis
SDDGRWRIVGNIPRGMFV

SEQ ID NO: 214054 - protein, 19 aa, Mycobacterium bovis
SDEWTDWRWNRILIEGSNC

SEQ ID NO: 214055 - protein, 20 aa, Mycobacterium bovis
SDFIICYRLSMADYVAEGQS

SEQ ID NO: 214056 - protein, 22 aa, Mycobacterium bovis
SDIKNLLPMLAVFKPTVVVSVP

SEQ ID NO: 214057 - protein, 17 aa, Mycobacterium bovis
SDIRAGAGLVLAGLVAD

SEQ ID NO: 214058 - protein, 21 aa, Mycobacterium bovis
SDPLLAVPFSYPASLPTPFGP

SEQ ID NO: 214059 - protein, 23 aa, Mycobacterium bovis
SEIYPVLCGSAFKNKGVQPMLDA

SEQ ID NO: 214060 - protein, 17 aa, Mycobacterium bovis
SERRLWLAVLRAQAELG

SEQ ID NO: 214061 - protein, 20 aa, Mycobacterium bovis
SFGFKYGLPMDADMVMDVRF

SEQ ID NO: 214062 - protein, 18 aa, Mycobacterium bovis
SFTIPGFQIRVLLGPAAV

SEQ ID NO: 214063 - protein, 19 aa, Mycobacterium bovis
SGAFAHRYGFRHSVVARPP

SEQ ID NO: 214064 - protein, 23 aa, Mycobacterium bovis
SGEQRLSGFLLWQSAYSEMWFTE

SEQ ID NO: 214065 - protein, 26 aa, Mycobacterium bovis
SGFERFPAWMWRNTVVRDFVEWLRTR

SEQ ID NO: 214066 - protein, 23 aa, Mycobacterium bovis
SGGDGGNGGWLFGSGASGGNGGQ

SEQ ID NO: 214067 - protein, 17 aa, Mycobacterium bovis
SGGHLFSIYDGCREEGI

SEQ ID NO: 214068 - protein, 25 aa, Mycobacterium bovis
SGGIRGPIGLGFRVPCFVISPYSRG

SEQ ID NO: 214069 - protein, 25 aa, Mycobacterium bovis
SGGKGGTGGWLWGSGGAGGAGGSGG

SEQ ID NO: 214070 - protein, 18 aa, Mycobacterium bovis
SGGLACFGEAIPAQAIAQ

SEQ ID NO: 214071 - protein, 20 aa, Mycobacterium bovis
SGGLPAFTLFAGGLTIPTNA

SEQ ID NO: 214072 - protein, 20 aa, Mycobacterium bovis
SGGMCQRALIAIGLAGRPRL

SEQ ID NO: 214073 - protein, 22 aa, Mycobacterium bovis
SGKYRRVLALAWEKQSESNAMW

SEQ ID NO: 214074 - protein, 21 aa, Mycobacterium bovis
SGLPFGTCLDAAYLHPCGSDE

SEQ ID NO: 214075 - protein, 18 aa, Mycobacterium bovis
SGPLRPAAAQVFAAVQAA

SEQ ID NO: 214076 - protein, 30 aa, Mycobacterium bovis
SGPTSEIWVKPSFFPGIRIAPSSGGGATST

SEQ ID NO: 214077 - protein, 18 aa, Mycobacterium bovis
SGQVGWLARDRWAVPLVH

SEQ ID NO: 214078 - protein, 17 aa, Mycobacterium bovis
SGTVFALDLSWGGAGGN

SEQ ID NO: 214079 - protein, 22 aa, Mycobacterium bovis
SGVMWACVFMRTGARRVHFGEI

SEQ ID NO: 214080 - protein, 19 aa, Mycobacterium bovis
SGVPPSVWGGLAAARFQDV

SEQ ID NO: 214081 - protein, 17 aa, Mycobacterium bovis
SGWSLTAQDVFNNVART

SEQ ID NO: 214082 - protein, 25 aa, Mycobacterium bovis
SGWWRAPLRWTLRGSLALRSHLMVR

SEQ ID NO: 214083 - protein, 24 aa, Mycobacterium bovis
SHGRVSVGVGFGWNTDELVDHGVP

SEQ ID NO: 214084 - protein, 20 aa, Mycobacterium bovis
SIFLMCLPDRVLAYGDCAII

SEQ ID NO: 214085 - protein, 25 aa, Mycobacterium bovis
SIPIIDLRPAPGFFNATTGPSSGFL

SEQ ID NO: 214086 - protein, 17 aa, Mycobacterium bovis
SKFPYRWWWVALTDEAF

SEQ ID NO: 214087 - protein, 18 aa, Mycobacterium bovis
SKLRTGGLLLNHCITRHD

SEQ ID NO: 214088 - protein, 21 aa, Mycobacterium bovis
SKMNRFFLRGALVARLLSQSA

SEQ ID NO: 214089 - protein, 17 aa, Mycobacterium bovis
SKPCAWLAEGLVRYLPA

SEQ ID NO: 214090 - protein, 26 aa, Mycobacterium bovis
SKPLVRLRVPFTLSRNEIDDVERGSK

SEQ ID NO: 214091 - protein, 19 aa, Mycobacterium bovis
SKTVIGLNMLRLWDDRRTL

SEQ ID NO: 214092 - protein, 17 aa, Mycobacterium bovis
SLAEVGIGFCFAPRFHP

SEQ ID NO: 214093 - protein, 18 aa, Mycobacterium bovis
SLARLAIRDDIYGALRSL

SEQ ID NO: 214094 - protein, 25 aa, Mycobacterium bovis
SLDVPRITILDAHFTGAFGPVVVPP

SEQ ID NO: 214095 - protein, 24 aa, Mycobacterium bovis
SLEEVLIRAGIPYKVVGGVRFYER

SEQ ID NO: 214096 - protein, 17 aa, Mycobacterium bovis
SLLPRYLTTRVYAALLE

SEQ ID NO: 214097 - protein, 18 aa, Mycobacterium bovis
SLLRSCPRLTILTTSTEA

SEQ ID NO: 214098 - protein, 21 aa, Mycobacterium bovis
SLPAKRWLAQRGFDPVYGARP

SEQ ID NO: 214099 - protein, 24 aa, Mycobacterium bovis
SLYHFAWDEFCDWYLELAKTQLAQ

SEQ ID NO: 214100 - protein, 24 aa, Mycobacterium bovis
SMVKRLPLARALRTAQRHDYLGHY

SEQ ID NO: 214101 - protein, 21 aa, Mycobacterium bovis
SNEFFKLWLDPSMTYSCAYFE

SEQ ID NO: 214102 - protein, 23 aa, Mycobacterium bovis
SNGILWRGNYEGLFSYSYSLDVP

SEQ ID NO: 214103 - protein, 25 aa, Mycobacterium bovis
SNGLLWRGDHEGLFSLFYSLDVPRI

SEQ ID NO: 214104 - protein, 18 aa, Mycobacterium bovis
SNYVYRPASLDQWRMLMG

SEQ ID NO: 214105 - protein, 23 aa, Mycobacterium bovis
SPAELACALGLFPPTAEQAAVIA

SEQ ID NO: 214106 - protein, 20 aa, Mycobacterium bovis
SPGYPCYRNILSALGCEVVE

SEQ ID NO: 214107 - protein, 23 aa, Mycobacterium bovis
SPKETWLRLLLINAGFPRPSTQI

SEQ ID NO: 214108 - protein, 23 aa, Mycobacterium bovis
SPKETWLRLLLIRAGFPRPQTQI

SEQ ID NO: 214109 - protein, 21 aa, Mycobacterium bovis
SPLSDFFIKWMSRINTWMYRR

SEQ ID NO: 214110 - protein, 25 aa, Mycobacterium bovis
SPWGTWEWIGPPALGAVLPARGMAK

SEQ ID NO: 214111 - protein, 18 aa, Mycobacterium bovis
SQAIARLFSDYATHYQSL

SEQ ID NO: 214112 - protein, 24 aa, Mycobacterium bovis
SQALRPAMFSTFLMWVLADLFTFL

SEQ ID NO: 214113 - protein, 18 aa, Mycobacterium bovis
SQANFVWLPLGSRTQDFV

SEQ ID NO: 214114 - protein, 22 aa, Mycobacterium bovis
SRARLLGLRLRRLRYLRTAAAR

SEQ ID NO: 214115 - protein, 23 aa, Mycobacterium bovis
SRDGLLRFCRYMEALAAYKKYLD

SEQ ID NO: 214116 - protein, 23 aa, Mycobacterium bovis
SRGGDGGVGGWLYGDGGGGGDGG

SEQ ID NO: 214117 - protein, 18 aa, Mycobacterium bovis
SRGLIGWRTDFLTETRGS

SEQ ID NO: 214118 - protein, 20 aa, Mycobacterium bovis
SRIDPVLARSWLLVNGAHGD

SEQ ID NO: 214119 - protein, 19 aa, Mycobacterium bovis
SRKAFGGDGGVGGDGASAL

SEQ ID NO: 214120 - protein, 18 aa, Mycobacterium bovis
SRLWRLLLAPGRGIGRLI

SEQ ID NO: 214121 - protein, 19 aa, Mycobacterium bovis
SRMAIAMARAGGMGVLHRN

SEQ ID NO: 214122 - protein, 17 aa, Mycobacterium bovis
SRRFGVQVEDGFGSTEN

SEQ ID NO: 214123 - protein, 20 aa, Mycobacterium bovis
SRRIKLAWFLLNAARYMPAQ

SEQ ID NO: 214124 - protein, 19 aa, Mycobacterium bovis
SRSALGWIIDRYRVTTDKA

SEQ ID NO: 214125 - protein, 21 aa, Mycobacterium bovis
SRTITFLKIDPAPGIGNSTTN

SEQ ID NO: 214126 - protein, 18 aa, Mycobacterium bovis
SRVFFDWFDAMGVDDIPA

SEQ ID NO: 214127 - protein, 17 aa, Mycobacterium bovis
SRVLFTWDIGPTWRPET

SEQ ID NO: 214128 - protein, 20 aa, Mycobacterium bovis
SSCLPEGVPSNWTIFFGAED

SEQ ID NO: 214129 - protein, 20 aa, Mycobacterium bovis
SSFRYAAPAGRNWTTADLAG

SEQ ID NO: 214130 - protein, 20 aa, Mycobacterium bovis
SSKLGGLWTAVSPHLSPLSN

SEQ ID NO: 214131 - protein, 20 aa, Mycobacterium bovis
SSLVRRAGCPVAVIHSDDAV

SEQ ID NO: 214132 - protein, 18 aa, Mycobacterium bovis
SSLVTGWARLHGYPLGIL

SEQ ID NO: 214133 - protein, 25 aa, Mycobacterium bovis
SSSGFKVRPSFSFFAVGPDGMPGGE

SEQ ID NO: 214134 - protein, 17 aa, Mycobacterium bovis
SSVPILGPYEDLIANTV

SEQ ID NO: 214135 - protein, 19 aa, Mycobacterium bovis
STAVAALFGAHGQAYQALS

SEQ ID NO: 214136 - protein, 18 aa, Mycobacterium bovis
STAVAALFSSHAQAYQAA

SEQ ID NO: 214137 - protein, 18 aa, Mycobacterium bovis
STIFPFRRLFMVAEVGGA

SEQ ID NO: 214138 - protein, 22 aa, Mycobacterium bovis
STNARMLIQFGFIERLAVAGDR

SEQ ID NO: 214139 - protein, 22 aa, Mycobacterium bovis
STRTRFSFELGIAQLGGHAVVV

SEQ ID NO: 214140 - protein, 24 aa, Mycobacterium bovis
SVCMFKPPFAWREYLLQCWFVARV

SEQ ID NO: 214141 - protein, 21 aa, Mycobacterium bovis
SVEVAELWSTFMQKWIAYTAA

SEQ ID NO: 214142 - protein, 20 aa, Mycobacterium bovis
SVNMFAPWIRRIFIATDSTP

SEQ ID NO: 214143 - protein, 18 aa, Mycobacterium bovis
SVVGRLSVPASWSTAAPA

SEQ ID NO: 214144 - protein, 17 aa, Mycobacterium bovis
SVWCFATASAREWWGLV

SEQ ID NO: 214145 - protein, 22 aa, Mycobacterium bovis
SWCGYCLRLKTALTANRIAYDE

SEQ ID NO: 214146 - protein, 22 aa, Mycobacterium bovis
SWHGRFPFDWGVSAHPKVDNKT

SEQ ID NO: 214147 - protein, 21 aa, Mycobacterium bovis
SWTEPKGGYFISLDVLPGTAR

SEQ ID NO: 214148 - protein, 17 aa, Mycobacterium bovis
SYFATGMAQFFASIAQQ

SEQ ID NO: 214149 - protein, 20 aa, Mycobacterium bovis
SYGSRCVRPPILYGDVSRPR

SEQ ID NO: 214150 - protein, 17 aa, Mycobacterium bovis
TAGAGGRGGDGGKGADP

SEQ ID NO: 214151 - protein, 24 aa, Mycobacterium bovis
TAHFCSMCGPKFCSMRITQDVREY

SEQ ID NO: 214152 - protein, 18 aa, Mycobacterium bovis
TALALHHLVCTRFRSDAL

SEQ ID NO: 214153 - protein, 18 aa, Mycobacterium bovis
TALLRLVGRYGIGEDDVD

SEQ ID NO: 214154 - protein, 18 aa, Mycobacterium bovis
TALPRLLAALQHAGVTVH

SEQ ID NO: 214155 - protein, 19 aa, Mycobacterium bovis
TALPRRHKLVLSRGPYGYH

SEQ ID NO: 214156 - protein, 27 aa, Mycobacterium bovis
TALVAALCRQLRGELSLAVLTNDIYTT

SEQ ID NO: 214157 - protein, 19 aa, Mycobacterium bovis
TARAYRAAAEFVPRIGALI

SEQ ID NO: 214158 - protein, 17 aa, Mycobacterium bovis
TARSWAWLSGRDYVTPD

SEQ ID NO: 214159 - protein, 17 aa, Mycobacterium bovis
TAVMMGVYFNEYQSMLA

SEQ ID NO: 214160 - protein, 18 aa, Mycobacterium bovis
TCCRTCGAWQTGFPRRSK

SEQ ID NO: 214161 - protein, 22 aa, Mycobacterium bovis
TCHFVRPGWRLPRRTAESALRA

SEQ ID NO: 214162 - protein, 17 aa, Mycobacterium bovis
TDGRWDPGKDFAMVTAR

SEQ ID NO: 214163 - protein, 18 aa, Mycobacterium bovis
TDHPAVWNHPVVDPHTVE

SEQ ID NO: 214164 - protein, 25 aa, Mycobacterium bovis
TDSFYRPKRPGSYPIVLATYEIVCS

SEQ ID NO: 214165 - protein, 19 aa, Mycobacterium bovis
TDVAILFRLGCRSVGESRE

SEQ ID NO: 214166 - protein, 21 aa, Mycobacterium bovis
TDVRAAWDWLAHVCGLAAEHM

SEQ ID NO: 214167 - protein, 19 aa, Mycobacterium bovis
TDWRWNRILIEGSNCRDII

SEQ ID NO: 214168 - protein, 17 aa, Mycobacterium bovis
TEFPYVFCDATFCKVRV

SEQ ID NO: 214169 - protein, 24 aa, Mycobacterium bovis
TEHRPEILLSFGFVPKVETRIGLI

SEQ ID NO: 214170 - protein, 20 aa, Mycobacterium bovis
TELRLRYGACVNVERRSASA

SEQ ID NO: 214171 - protein, 22 aa, Mycobacterium bovis
TENPAGSVLIEFGHTKVLCTAS

SEQ ID NO: 214172 - protein, 17 aa, Mycobacterium bovis
TESRMAIAMARAGGMGV

SEQ ID NO: 214173 - protein, 22 aa, Mycobacterium bovis
TETRLPFCWRGVSLHAGGAGRV

SEQ ID NO: 214174 - protein, 20 aa, Mycobacterium bovis
TFAAFPWRWVGGDGCIVRLV

SEQ ID NO: 214175 - protein, 19 aa, Mycobacterium bovis
TFLDREGWDSLTINALATQ

SEQ ID NO: 214176 - protein, 19 aa, Mycobacterium bovis
TFRKLRGGFDLILNTVSAN

SEQ ID NO: 214177 - protein, 20 aa, Mycobacterium bovis
TFRRRSCCLFYRVPAGGKCG

SEQ ID NO: 214178 - protein, 20 aa, Mycobacterium bovis
TFTGRSWPLADVRLLAPILA

SEQ ID NO: 214179 - protein, 24 aa, Mycobacterium bovis
TGADGGAGGWLFGNGGNGGHGATG

SEQ ID NO: 214180 - protein, 24 aa, Mycobacterium bovis
TGDDGGAGGWLFGNGGNGGAGAAG

SEQ ID NO: 214181 - protein, 24 aa, Mycobacterium bovis
TGEEFSWRAAELFDAIGSEAITVA

SEQ ID NO: 214182 - protein, 25 aa, Mycobacterium bovis
TGEVLSVPVGDGFLGRVVNPLGQPI

SEQ ID NO: 214183 - protein, 23 aa, Mycobacterium bovis
TGGNGALLFGFGGAGGAGGHGGA

SEQ ID NO: 214184 - protein, 24 aa, Mycobacterium bovis
TGHMPVRRLDLIWISARNAARREL

SEQ ID NO: 214185 - protein, 21 aa, Mycobacterium bovis
TGLRPPRPGNFVMSFLDASIA

SEQ ID NO: 214186 - protein, 18 aa, Mycobacterium bovis
TGQPAAVVPWDFDGDGLP

SEQ ID NO: 214187 - protein, 24 aa, Mycobacterium bovis
TGQPGGPGGLLWGNGGNGGSGVAG

SEQ ID NO: 214188 - protein, 26 aa, Mycobacterium bovis
TGSAAFRIVVGSVRIPPVSVIVEQII

SEQ ID NO: 214189 - protein, 18 aa, Mycobacterium bovis
TGVPVQWSAVFAGSGGRR

SEQ ID NO: 214190 - protein, 18 aa, Mycobacterium bovis
THHRWLRALAVFGGMGLR

SEQ ID NO: 214191 - protein, 18 aa, Mycobacterium bovis
THRPSWPAGIAVGKTVVS

SEQ ID NO: 214192 - protein, 27 aa, Mycobacterium bovis
TIAEVVNGFGWRGPLGVTYPGVVTHGV

SEQ ID NO: 214193 - protein, 17 aa, Mycobacterium bovis
TIAHGFMTLALLPRLQH

SEQ ID NO: 214194 - protein, 26 aa, Mycobacterium bovis
TIKRWFPGFMTFRFLECGLLTMVSNP

SEQ ID NO: 214195 - protein, 26 aa, Mycobacterium bovis
TIPEIPYRYDLSVPIDIPITGTVVAT

SEQ ID NO: 214196 - protein, 19 aa, Mycobacterium bovis
TISELWLRLLESYRDSFYL

SEQ ID NO: 214197 - protein, 18 aa, Mycobacterium bovis
TKLSCPIYAFIGDKDWIA

SEQ ID NO: 214198 - protein, 18 aa, Mycobacterium bovis
TKLYKAMNARGWKTKEPG

SEQ ID NO: 214199 - protein, 23 aa, Mycobacterium bovis
TKSLRAGKVFVDWSQNSGSKTTI

SEQ ID NO: 214200 - protein, 18 aa, Mycobacterium bovis
TLDFPRQVDVLGLAAKAG

SEQ ID NO: 214201 - protein, 17 aa, Mycobacterium bovis
TLHAALQLARRGSGVGV

SEQ ID NO: 214202 - protein, 19 aa, Mycobacterium bovis
TLLGRPLIGNGADGAPGTG

SEQ ID NO: 214203 - protein, 19 aa, Mycobacterium bovis
TLLGRPLIGNGTNGAPGTG

SEQ ID NO: 214204 - protein, 24 aa, Mycobacterium bovis
TLSFFRLALRLRRERNEFDGDVDW

SEQ ID NO: 214205 - protein, 18 aa, Mycobacterium bovis
TMKVSWRLYAYVSKDADR

SEQ ID NO: 214206 - protein, 17 aa, Mycobacterium bovis
TMPSGPGPFGLPIPNPN

SEQ ID NO: 214207 - protein, 18 aa, Mycobacterium bovis
TMRNRLRLAATHAVRTSA

SEQ ID NO: 214208 - protein, 18 aa, Mycobacterium bovis
TNPARWALLYGSPVPGYH

SEQ ID NO: 214209 - protein, 20 aa, Mycobacterium bovis
TNPGTLMWWIARSLELLQDF

SEQ ID NO: 214210 - protein, 20 aa, Mycobacterium bovis
TNRSTIRWTLHQMVASGVVS

SEQ ID NO: 214211 - protein, 21 aa, Mycobacterium bovis
TNTFPSWPLAHPFRRIAHNGE

SEQ ID NO: 214212 - protein, 22 aa, Mycobacterium bovis
TPAQVLLRWNLQLGNAVVVRSA

SEQ ID NO: 214213 - protein, 17 aa, Mycobacterium bovis
TPDGVWSRMKFEGGVHR

SEQ ID NO: 214214 - protein, 18 aa, Mycobacterium bovis
TPESWLLIDFEGEPGQPL

SEQ ID NO: 214215 - protein, 19 aa, Mycobacterium bovis
TPLKMCWVPGYSDYYPEAP

SEQ ID NO: 214216 - protein, 18 aa, Mycobacterium bovis
TPPPHWRPDVLLVAVGAM

SEQ ID NO: 214217 - protein, 23 aa, Mycobacterium bovis
TPRCGLCPLDWCAWRHAGYPPSD

SEQ ID NO: 214218 - protein, 25 aa, Mycobacterium bovis
TPRRYGVRWHYRLPVWSDFVEVHWS

SEQ ID NO: 214219 - protein, 24 aa, Mycobacterium bovis
TQAAAFHERFIQALSTAAGAYGSA

SEQ ID NO: 214220 - protein, 22 aa, Mycobacterium bovis
TQALFGRPLIGNGADGSPGTGQ

SEQ ID NO: 214221 - protein, 17 aa, Mycobacterium bovis
TQCCYTMRTIFDVKPDS

SEQ ID NO: 214222 - protein, 21 aa, Mycobacterium bovis
TQLPLGFMVEFDRAGVLVEAE

SEQ ID NO: 214223 - protein, 17 aa, Mycobacterium bovis
TQWTRWRQPVIGMPSTP

SEQ ID NO: 214224 - protein, 18 aa, Mycobacterium bovis
TREFLVWAVNDAIERGEL

SEQ ID NO: 214225 - protein, 17 aa, Mycobacterium bovis
TRFGQRLRLRPFDLGAP

SEQ ID NO: 214226 - protein, 18 aa, Mycobacterium bovis
TRKSFSIAGTRVVDAIKL

SEQ ID NO: 214227 - protein, 17 aa, Mycobacterium bovis
TRLAAAIMRERKRGAIV

SEQ ID NO: 214228 - protein, 20 aa, Mycobacterium bovis
TRLGALAARLWLPLLAAEGS

SEQ ID NO: 214229 - protein, 19 aa, Mycobacterium bovis
TRLHWYVPRSIRWIDRLKG

SEQ ID NO: 214230 - protein, 18 aa, Mycobacterium bovis
TRRPSVCNAAETLLVDAA

SEQ ID NO: 214231 - protein, 17 aa, Mycobacterium bovis
TRSCPRLTDSIEHAVAE

SEQ ID NO: 214232 - protein, 18 aa, Mycobacterium bovis
TRSSAGFGAPRYGAKPIV

SEQ ID NO: 214233 - protein, 17 aa, Mycobacterium bovis
TRVPEFLERLGVGAPEA

SEQ ID NO: 214234 - protein, 17 aa, Mycobacterium bovis
TRWHPVSSLPPMAFDHG

SEQ ID NO: 214235 - protein, 22 aa, Mycobacterium bovis
TSPLLAPINEFFLANTGRPLIG

SEQ ID NO: 214236 - protein, 24 aa, Mycobacterium bovis
TSRPCPTCRGVGVVIPDPCQQCMG

SEQ ID NO: 214237 - protein, 17 aa, Mycobacterium bovis
TSWDGIVVVCPPRANDE

SEQ ID NO: 214238 - protein, 22 aa, Mycobacterium bovis
TSWLKSRHSFSFGDHYDPDNTH

SEQ ID NO: 214239 - protein, 17 aa, Mycobacterium bovis
TTECWRQWINIGNFPDH

SEQ ID NO: 214240 - protein, 18 aa, Mycobacterium bovis
TTPPIKWPTVIRHPKTGQ

SEQ ID NO: 214241 - protein, 17 aa, Mycobacterium bovis
TTQRFGVPMGFGGPHAG

SEQ ID NO: 214242 - protein, 21 aa, Mycobacterium bovis
TTSICPWKGLAHYYNVVVDGP

SEQ ID NO: 214243 - protein, 17 aa, Mycobacterium bovis
TVADMMIYLGWSMAGRG

SEQ ID NO: 214244 - protein, 19 aa, Mycobacterium bovis
TVIDPRWVLPVSDGVRELA

SEQ ID NO: 214245 - protein, 18 aa, Mycobacterium bovis
TWQWESLISKSTRLVAVN

SEQ ID NO: 214246 - protein, 17 aa, Mycobacterium bovis
VAACATAAVSVEEGVDK

SEQ ID NO: 214247 - protein, 24 aa, Mycobacterium bovis
VAACLKWEGGYVWACKNYDGDVQS

SEQ ID NO: 214248 - protein, 19 aa, Mycobacterium bovis
VAAGMPFPLFVKAVAGGGG

SEQ ID NO: 214249 - protein, 18 aa, Mycobacterium bovis
VAEYWPEFGANGKSEVTV

SEQ ID NO: 214250 - protein, 22 aa, Mycobacterium bovis
VAFGPQCRRGMFGSGRARTRAS

SEQ ID NO: 214251 - protein, 17 aa, Mycobacterium bovis
VAGCVFRYIAYHGRSRE

SEQ ID NO: 214252 - protein, 18 aa, Mycobacterium bovis
VAGRMMGRLGWYVESMLS

SEQ ID NO: 214253 - protein, 26 aa, Mycobacterium bovis
VAILLPAHWQTAAVLFGVWWIGAQAI

SEQ ID NO: 214254 - protein, 24 aa, Mycobacterium bovis
VAKQALKIAREWSVERVQWGKPVG

SEQ ID NO: 214255 - protein, 21 aa, Mycobacterium bovis
VAPWLDLVRKLGVLAGVLSDE

SEQ ID NO: 214256 - protein, 17 aa, Mycobacterium bovis
VAPYLGWLISATAQAEQ

SEQ ID NO: 214257 - protein, 23 aa, Mycobacterium bovis
VARGDFRAALVVGDRLDTDIEGA

SEQ ID NO: 214258 - protein, 18 aa, Mycobacterium bovis
VARRRARVVVPFQPRLLM

SEQ ID NO: 214259 - protein, 18 aa, Mycobacterium bovis
VAYLTAWHSLCEVGRLSP

SEQ ID NO: 214260 - protein, 18 aa, Mycobacterium bovis
VCANVICPRARTAMTADV

SEQ ID NO: 214261 - protein, 18 aa, Mycobacterium bovis
VCGGGDWRRAGIPARSAQ

SEQ ID NO: 214262 - protein, 20 aa, Mycobacterium bovis
VCGYHCWAEFFVAGLGWLPA

SEQ ID NO: 214263 - protein, 17 aa, Mycobacterium bovis
VCLGLPGSLPVLNRAAV

SEQ ID NO: 214264 - protein, 23 aa, Mycobacterium bovis
VCYDIRFPALYTELARRGAQLIA

SEQ ID NO: 214265 - protein, 18 aa, Mycobacterium bovis
VDAAKGVPDWAARLPDEL

SEQ ID NO: 214266 - protein, 24 aa, Mycobacterium bovis
VDAAWRPDTVWRYRLGSGESSERV

SEQ ID NO: 214267 - protein, 23 aa, Mycobacterium bovis
VDEPFMLPAHIDFAALKVKFDGG

SEQ ID NO: 214268 - protein, 18 aa, Mycobacterium bovis
VDGAHLWHPYSSIGREAV

SEQ ID NO: 214269 - protein, 18 aa, Mycobacterium bovis
VDGRPRRAAVSSFGISGT

SEQ ID NO: 214270 - protein, 17 aa, Mycobacterium bovis
VDHFRYFAAAIRAQEGA

SEQ ID NO: 214271 - protein, 18 aa, Mycobacterium bovis
VDIAFTWDHFFPLYGDPD

SEQ ID NO: 214272 - protein, 21 aa, Mycobacterium bovis
VDIPIHIPINIDAGVVTLQGF

SEQ ID NO: 214273 - protein, 17 aa, Mycobacterium bovis
VDLLKPRKAQPLLPGIG

SEQ ID NO: 214274 - protein, 23 aa, Mycobacterium bovis
VDLRDDWPAALIAAGFDGTQPTA

SEQ ID NO: 214275 - protein, 17 aa, Mycobacterium bovis
VDLWGADGAEGWTADPI

SEQ ID NO: 214276 - protein, 25 aa, Mycobacterium bovis
VDPGKRVVFTWGWEDHGDPPPGGST

SEQ ID NO: 214277 - protein, 17 aa, Mycobacterium bovis
VDRIWRAARHWYRAGMH

SEQ ID NO: 214278 - protein, 23 aa, Mycobacterium bovis
VDTDLRWRIVTALATAGAIDADG

SEQ ID NO: 214279 - protein, 20 aa, Mycobacterium bovis
VDVVCPLGWPATPARLPFTL

SEQ ID NO: 214280 - protein, 24 aa, Mycobacterium bovis
VDVWKGWADRAGWVPWSADSAPMV

SEQ ID NO: 214281 - protein, 26 aa, Mycobacterium bovis
VEAVWKPRERWGLGIDNIEYFRPTGE

SEQ ID NO: 214282 - protein, 21 aa, Mycobacterium bovis
VEFWAFDLLYLDGRALLGTRY

SEQ ID NO: 214283 - protein, 18 aa, Mycobacterium bovis
VEGLRMTWGRAVILEAMR

SEQ ID NO: 214284 - protein, 17 aa, Mycobacterium bovis
VEIARFWVGLAKLDDSR

SEQ ID NO: 214285 - protein, 26 aa, Mycobacterium bovis
VELPAWYRPNPGLARDLAFIAFSSAD

SEQ ID NO: 214286 - protein, 23 aa, Mycobacterium bovis
VERMHRACLILTFGGGTNEVQRD

SEQ ID NO: 214287 - protein, 18 aa, Mycobacterium bovis
VERTWLDGWLLRAGHGAV

SEQ ID NO: 214288 - protein, 21 aa, Mycobacterium bovis
VETCWRKAIQMDYETDTDTEL

SEQ ID NO: 214289 - protein, 22 aa, Mycobacterium bovis
VETRGRFGTFISRFDPTDAAMA

SEQ ID NO: 214290 - protein, 22 aa, Mycobacterium bovis
VEVALRSARRFGAPVIVHVVTR

SEQ ID NO: 214291 - protein, 21 aa, Mycobacterium bovis
VEVLRLSALRGLFSAVIEDAV

SEQ ID NO: 214292 - protein, 21 aa, Mycobacterium bovis
VEVPVGFKWFVDGLIGATLGF

SEQ ID NO: 214293 - protein, 18 aa, Mycobacterium bovis
VFCDATFCKVRVGAHVVS

SEQ ID NO: 214294 - protein, 17 aa, Mycobacterium bovis
VFETLAWGRRHVVMGAN

SEQ ID NO: 214295 - protein, 17 aa, Mycobacterium bovis
VFICGPGPFMQAARDAL

SEQ ID NO: 214296 - protein, 18 aa, Mycobacterium bovis
VFISARWQADFRADVPVL

SEQ ID NO: 214297 - protein, 19 aa, Mycobacterium bovis
VFMPTEPQAATGTAGSAGD

SEQ ID NO: 214298 - protein, 19 aa, Mycobacterium bovis
VFPGGCFFAAAAADVDSQP

SEQ ID NO: 214299 - protein, 22 aa, Mycobacterium bovis
VFPRYHPRWAWWLTSVPVLREF

SEQ ID NO: 214300 - protein, 17 aa, Mycobacterium bovis
VFVALSWTKHPPPQTYD

SEQ ID NO: 214301 - protein, 19 aa, Mycobacterium bovis
VFWPIPRVYSGLVRIDRYE

SEQ ID NO: 214302 - protein, 22 aa, Mycobacterium bovis
VGAAARGGRRLVIAMMYGLVKE

SEQ ID NO: 214303 - protein, 18 aa, Mycobacterium bovis
VGALLCLLAKLSGGKAVA

SEQ ID NO: 214304 - protein, 22 aa, Mycobacterium bovis
VGDGTCYWKRMGNPDGALIDNA

SEQ ID NO: 214305 - protein, 25 aa, Mycobacterium bovis
VGDKWRLAEVLAWQAYVGFAGEGDP

SEQ ID NO: 214306 - protein, 21 aa, Mycobacterium bovis
VGERVLAGYGFRTDQRAHAEI

SEQ ID NO: 214307 - protein, 20 aa, Mycobacterium bovis
VGFRWWTRCRALELGLTGYA

SEQ ID NO: 214308 - protein, 23 aa, Mycobacterium bovis
VGGAGGAGWLVGNGGAGGFGGVG

SEQ ID NO: 214309 - protein, 20 aa, Mycobacterium bovis
VGGARRCAAQSWSLDRIKSV

SEQ ID NO: 214310 - protein, 23 aa, Mycobacterium bovis
VGGPSTWRMGGAINCGKAQPGQV

SEQ ID NO: 214311 - protein, 17 aa, Mycobacterium bovis
VGGTDVVVWLGTLSTLS

SEQ ID NO: 214312 - protein, 18 aa, Mycobacterium bovis
VGHIPGAVKIDWHTDLND

SEQ ID NO: 214313 - protein, 17 aa, Mycobacterium bovis
VGHPFWFSRTVFGELAR

SEQ ID NO: 214314 - protein, 19 aa, Mycobacterium bovis
VGILCLEFLVHAWDFAIAT

SEQ ID NO: 214315 - protein, 21 aa, Mycobacterium bovis
VGLPMRCVFALTAMGFLPQSA

SEQ ID NO: 214316 - protein, 22 aa, Mycobacterium bovis
VGLRARAKAAFAEREGVNLTFL

SEQ ID NO: 214317 - protein, 18 aa, Mycobacterium bovis
VGLSRGWSLIKSVRLGNA

SEQ ID NO: 214318 - protein, 17 aa, Mycobacterium bovis
VGNIPRGMFVGGRRGSS

SEQ ID NO: 214319 - protein, 18 aa, Mycobacterium bovis
VGQLVKWARESIGRTEKI

SEQ ID NO: 214320 - protein, 17 aa, Mycobacterium bovis
VGVPKAFYQLDGQTLIE

SEQ ID NO: 214321 - protein, 18 aa, Mycobacterium bovis
VHAPRLSPAPALLALPAA

SEQ ID NO: 214322 - protein, 27 aa, Mycobacterium bovis
VHGFRFPEITGDIFLIGIPFNAATLDA

SEQ ID NO: 214323 - protein, 18 aa, Mycobacterium bovis
VHGLPLYHVHGLVLGLLG

SEQ ID NO: 214324 - protein, 23 aa, Mycobacterium bovis
VHLLECGLLRGWLIPPADIKAAR

SEQ ID NO: 214325 - protein, 17 aa, Mycobacterium bovis
VHLRGHFLLTRNAAAYW

SEQ ID NO: 214326 - protein, 18 aa, Mycobacterium bovis
VIATEFELVMPFVERAQS

SEQ ID NO: 214327 - protein, 17 aa, Mycobacterium bovis
VICCPAFGAAAKVGTFN

SEQ ID NO: 214328 - protein, 20 aa, Mycobacterium bovis
VIDMPLPISLGVNIPIDIPI

SEQ ID NO: 214329 - protein, 18 aa, Mycobacterium bovis
VIRRSRRGGRGWVVPAGG

SEQ ID NO: 214330 - protein, 21 aa, Mycobacterium bovis
VKALGGRGVFGVELMINGDEV

SEQ ID NO: 214331 - protein, 19 aa, Mycobacterium bovis
VKISLMRRIKQSFDPAGIL

SEQ ID NO: 214332 - protein, 17 aa, Mycobacterium bovis
VKTPAQVLLRWNLQLGN

SEQ ID NO: 214333 - protein, 19 aa, Mycobacterium bovis
VLGNWTGIPVFKLTEAETT

SEQ ID NO: 214334 - protein, 18 aa, Mycobacterium bovis
VLIALGWPNHVHHAAAQR

SEQ ID NO: 214335 - protein, 22 aa, Mycobacterium bovis
VLKQAAAFHGEFTRALAAAGAA

SEQ ID NO: 214336 - protein, 19 aa, Mycobacterium bovis
VLLHLAAEGWARWSGTVCE

SEQ ID NO: 214337 - protein, 19 aa, Mycobacterium bovis
VLTEYGWRAAGELRKGDRV

SEQ ID NO: 214338 - protein, 17 aa, Mycobacterium bovis
VLVGGLGGRGVVAGASY

SEQ ID NO: 214339 - protein, 22 aa, Mycobacterium bovis
VLVHPRPRLSVMAVGGELVDIS

SEQ ID NO: 214340 - protein, 23 aa, Mycobacterium bovis
VMARGIEIGHIFQLGSKYTDAFT

SEQ ID NO: 214341 - protein, 17 aa, Mycobacterium bovis
VMVRPLIRLSLGKRHPM

SEQ ID NO: 214342 - protein, 23 aa, Mycobacterium bovis
VNDCGRYGLADCAGRVLVGEPTD

SEQ ID NO: 214343 - protein, 20 aa, Mycobacterium bovis
VNGFCVGGGIGLVGNSDVIV

SEQ ID NO: 214344 - protein, 17 aa, Mycobacterium bovis
VNLTFLPFFAKAVIDAL

SEQ ID NO: 214345 - protein, 20 aa, Mycobacterium bovis
VNQRWLGGMLTNFSTVHKRL

SEQ ID NO: 214346 - protein, 22 aa, Mycobacterium bovis
VNSWSAAFARYGRTVGQVLLTA

SEQ ID NO: 214347 - protein, 18 aa, Mycobacterium bovis
VNTGTGWAYGGNGGNGGD

SEQ ID NO: 214348 - protein, 19 aa, Mycobacterium bovis
VPAERLWVNPDCGLKTRNV

SEQ ID NO: 214349 - protein, 17 aa, Mycobacterium bovis
VPFYHCFGMVMGNLAAT

SEQ ID NO: 214350 - protein, 18 aa, Mycobacterium bovis
VPHSWNLPPAVRQVAAMF

SEQ ID NO: 214351 - protein, 18 aa, Mycobacterium bovis
VPLILRLDPKIGLPDIRA

SEQ ID NO: 214352 - protein, 23 aa, Mycobacterium bovis
VPLVGGLWFRFLHSVKAGIKDSL

SEQ ID NO: 214353 - protein, 22 aa, Mycobacterium bovis
VPMQRIRPSLDWLIKNVGPHAL

SEQ ID NO: 214354 - protein, 18 aa, Mycobacterium bovis
VPPFTWWRGLRARELLEN

SEQ ID NO: 214355 - protein, 23 aa, Mycobacterium bovis
VPPGRLGWGWARFAFTSWKTLGW

SEQ ID NO: 214356 - protein, 19 aa, Mycobacterium bovis
VPTCPGWSLGQLFRHVGRG

SEQ ID NO: 214357 - protein, 22 aa, Mycobacterium bovis
VQEVKLGLARPVWIDDRDFDIT

SEQ ID NO: 214358 - protein, 21 aa, Mycobacterium bovis
VQIGKFRLVFLTGPKQGEDDG

SEQ ID NO: 214359 - protein, 19 aa, Mycobacterium bovis
VQLILKFIPGMRERHFGHI

SEQ ID NO: 214360 - protein, 24 aa, Mycobacterium bovis
VQRPAGRARSRWFSDYLRTVTQRD

SEQ ID NO: 214361 - protein, 17 aa, Mycobacterium bovis
VRASGLLPRWEQTQRFI

SEQ ID NO: 214362 - protein, 17 aa, Mycobacterium bovis
VRFGVLVIRCALCTDTV

SEQ ID NO: 214363 - protein, 17 aa, Mycobacterium bovis
VRFPAPVPVGSRVRATS

SEQ ID NO: 214364 - protein, 17 aa, Mycobacterium bovis
VRILFAFDPARQAIMLA

SEQ ID NO: 214365 - protein, 17 aa, Mycobacterium bovis
VRLAELFIEAGLPAGVF

SEQ ID NO: 214366 - protein, 22 aa, Mycobacterium bovis
VRLEGPAVFRWAAFKMGDVGRR

SEQ ID NO: 214367 - protein, 18 aa, Mycobacterium bovis
VRLMRWGLIPSWIKAGPG

SEQ ID NO: 214368 - protein, 23 aa, Mycobacterium bovis
VRPEPFGALLYHFGTRKLSFLKN

SEQ ID NO: 214369 - protein, 18 aa, Mycobacterium bovis
VRRGEVIGLLGPNGAGKT

SEQ ID NO: 214370 - protein, 26 aa, Mycobacterium bovis
VRSGVAFDILRRWLLARGYDVAFIRN

SEQ ID NO: 214371 - protein, 23 aa, Mycobacterium bovis
VRTFARRRIDAILADVAPADGPD

SEQ ID NO: 214372 - protein, 17 aa, Mycobacterium bovis
VRVVEAFADRPDQPLRE

SEQ ID NO: 214373 - protein, 23 aa, Mycobacterium bovis
VRYFIDRLAGWYVITSSDRMSRE

SEQ ID NO: 214374 - protein, 20 aa, Mycobacterium bovis
VRYRVGELIPVYRSQRALLQ

SEQ ID NO: 214375 - protein, 20 aa, Mycobacterium bovis
VSAAIAALFSGHAQAYQALS

SEQ ID NO: 214376 - protein, 20 aa, Mycobacterium bovis
VSAAIASLFAAHGQAYQAVS

SEQ ID NO: 214377 - protein, 19 aa, Mycobacterium bovis
VSAAMAALFSGHAQAYQAL

SEQ ID NO: 214378 - protein, 19 aa, Mycobacterium bovis
VSAAVAALFSGHAQTYQAL

SEQ ID NO: 214379 - protein, 20 aa, Mycobacterium bovis
VSAAVASLFSGHAQAYQTLG

SEQ ID NO: 214380 - protein, 19 aa, Mycobacterium bovis
VSAGIAALFGAQAQSYQAV

SEQ ID NO: 214381 - protein, 28 aa, Mycobacterium bovis
VSASAQTLLSRPLIGNGANATTPGGNGG

SEQ ID NO: 214382 - protein, 23 aa, Mycobacterium bovis
VSCVKPAGALYAFPRLDPEVYDI

SEQ ID NO: 214383 - protein, 17 aa, Mycobacterium bovis
VSGPLLAGGYWNLPDET

SEQ ID NO: 214384 - protein, 24 aa, Mycobacterium bovis
VSHYDVYPAFGFRFDLKKSGVSVT

SEQ ID NO: 214385 - protein, 19 aa, Mycobacterium bovis
VSLAELFRRSGLDVRAADD

SEQ ID NO: 214386 - protein, 19 aa, Mycobacterium bovis
VSLRLPVRAPFAFEGVFGH

SEQ ID NO: 214387 - protein, 22 aa, Mycobacterium bovis
VSPDLVRRLCWEWEDISQSSPD

SEQ ID NO: 214388 - protein, 22 aa, Mycobacterium bovis
VSPSLRFGLAFCEASGPRLVRH

SEQ ID NO: 214389 - protein, 25 aa, Mycobacterium bovis
VSQGRFRFGVGVGWLREEVANHGVD

SEQ ID NO: 214390 - protein, 20 aa, Mycobacterium bovis
VSTAVAALFGAHGQAYQALS

SEQ ID NO: 214391 - protein, 17 aa, Mycobacterium bovis
VTCDARLAATLPPGLGD

SEQ ID NO: 214392 - protein, 18 aa, Mycobacterium bovis
VTCGIGFADLSSFTALTQ

SEQ ID NO: 214393 - protein, 19 aa, Mycobacterium bovis
VTFSRGWLPFLPTSDPPAH

SEQ ID NO: 214394 - protein, 18 aa, Mycobacterium bovis
VTGWPATVSHDFDAELPA

SEQ ID NO: 214395 - protein, 19 aa, Mycobacterium bovis
VTLCKRLAAVTGLRLPETV

SEQ ID NO: 214396 - protein, 21 aa, Mycobacterium bovis
VTLGEEFPRLMVYRGPRRKGV

SEQ ID NO: 214397 - protein, 24 aa, Mycobacterium bovis
VTLVIRGSCLLRHCDDTICERFTR

SEQ ID NO: 214398 - protein, 19 aa, Mycobacterium bovis
VTNATKLPGLRGWRRPQGE

SEQ ID NO: 214399 - protein, 17 aa, Mycobacterium bovis
VTVEVPVGGILAPLQPF

SEQ ID NO: 214400 - protein, 17 aa, Mycobacterium bovis
VVAELRAGLPPTLAVAG

SEQ ID NO: 214401 - protein, 17 aa, Mycobacterium bovis
VVCLSRLVPRKGQDTLV

SEQ ID NO: 214402 - protein, 18 aa, Mycobacterium bovis
VVFKELRVLGALGVDATA

SEQ ID NO: 214403 - protein, 17 aa, Mycobacterium bovis
VVFRPLYAVGGQELGYL

SEQ ID NO: 214404 - protein, 20 aa, Mycobacterium bovis
VVGAYRFLQRVWRLVVDEHT

SEQ ID NO: 214405 - protein, 19 aa, Mycobacterium bovis
VVLGDAWELLKFFNDDQYV

SEQ ID NO: 214406 - protein, 17 aa, Mycobacterium bovis
VVPLDPTSTFALITQPD

SEQ ID NO: 214407 - protein, 18 aa, Mycobacterium bovis
VVRLRFGLTDGQPRTLDE

SEQ ID NO: 214408 - protein, 22 aa, Mycobacterium bovis
VVRRMRLQPGRMFLVDTAQGRI

SEQ ID NO: 214409 - protein, 17 aa, Mycobacterium bovis
VVSPGFIGAPLALAALG

SEQ ID NO: 214410 - protein, 24 aa, Mycobacterium bovis
VVSRARLQLAIAWANILLQRPAPA

SEQ ID NO: 214411 - protein, 24 aa, Mycobacterium bovis
VVVSGRWPFCSGINHADIMFAGCF

SEQ ID NO: 214412 - protein, 19 aa, Mycobacterium bovis
VWLRGRRATSHWLTLPALK

SEQ ID NO: 214413 - protein, 19 aa, Mycobacterium bovis
VWVHPEWRGIGLGTAGTAT

SEQ ID NO: 214414 - protein, 22 aa, Mycobacterium bovis
VYDAAAAWARRFLDGPPHALAA

SEQ ID NO: 214415 - protein, 24 aa, Mycobacterium bovis
VYFELRLADAWVWDMYRPARFVKQ

SEQ ID NO: 214416 - protein, 17 aa, Mycobacterium bovis
VYPPCSAFEAWFVSAAL

SEQ ID NO: 214417 - protein, 25 aa, Mycobacterium bovis
VYSDGRYSYQLSIYVIRVEQGTAVA

SEQ ID NO: 214418 - protein, 21 aa, Mycobacterium bovis
VYYRRALMLAACFGRGSEYPQ

SEQ ID NO: 214419 - protein, 19 aa, Mycobacterium bovis
WAAEIARLAPLAIQHAKRV

SEQ ID NO: 214420 - protein, 25 aa, Mycobacterium bovis
WAARARWANPAAWRLPGDDVTALRG

SEQ ID NO: 214421 - protein, 18 aa, Mycobacterium bovis
WAGPPPQWWAQRFGIEPD

SEQ ID NO: 214422 - protein, 21 aa, Mycobacterium bovis
WAGSLKRHGEWIVPTRLALVR

SEQ ID NO: 214423 - protein, 31 aa, Mycobacterium bovis
WALMGMPCGKYLVVMLELWLPLVAAAGDLDK

SEQ ID NO: 214424 - protein, 17 aa, Mycobacterium bovis
WASLPLKLFAGGNAKFW

SEQ ID NO: 214425 - protein, 23 aa, Mycobacterium bovis
WASWCGPCRAFAPTFAESSEKHP

SEQ ID NO: 214426 - protein, 18 aa, Mycobacterium bovis
WCIADRRIGVITGEVGAG

SEQ ID NO: 214427 - protein, 24 aa, Mycobacterium bovis
WCVISIRSDDEWRRATSVFGQPEL

SEQ ID NO: 214428 - protein, 17 aa, Mycobacterium bovis
WDAVLAVNLLAPLRLTE

SEQ ID NO: 214429 - protein, 19 aa, Mycobacterium bovis
WDLLPGYLIFRSIIPNRPP

SEQ ID NO: 214430 - protein, 17 aa, Mycobacterium bovis
WDPGKDFAMVTARETGP

SEQ ID NO: 214431 - protein, 19 aa, Mycobacterium bovis
WEDKRLGIIIAGFDRRRIP

SEQ ID NO: 214432 - protein, 20 aa, Mycobacterium bovis
WEEVPGCDPAVFTMATVPSR

SEQ ID NO: 214433 - protein, 20 aa, Mycobacterium bovis
WEGRAVGLAQRWGSRNPIPW

SEQ ID NO: 214434 - protein, 21 aa, Mycobacterium bovis
WEPFTRMAFRFNECSTRAVGA

SEQ ID NO: 214435 - protein, 18 aa, Mycobacterium bovis
WERRAIAVFGHRPYIGVS

SEQ ID NO: 214436 - protein, 19 aa, Mycobacterium bovis
WEYDWPASRWRQHLNAQLE

SEQ ID NO: 214437 - protein, 17 aa, Mycobacterium bovis
WFRYAGGGKWNWQRDFF

SEQ ID NO: 214438 - protein, 21 aa, Mycobacterium bovis
WGAEFPFCYEDRLLSTLAAMI

SEQ ID NO: 214439 - protein, 17 aa, Mycobacterium bovis
WGAEVYHALKSVLKKEG

SEQ ID NO: 214440 - protein, 20 aa, Mycobacterium bovis
WGAPVAWTFAWLHPDRCAGV

SEQ ID NO: 214441 - protein, 17 aa, Mycobacterium bovis
WGATMMRAVEKYDVNVV

SEQ ID NO: 214442 - protein, 17 aa, Mycobacterium bovis
WGGMVRYAARRGVRVIG

SEQ ID NO: 214443 - protein, 20 aa, Mycobacterium bovis
WGGTPSWECALAGLDQECGA

SEQ ID NO: 214444 - protein, 17 aa, Mycobacterium bovis
WGGYRIAPEIVEFWQGR

SEQ ID NO: 214445 - protein, 23 aa, Mycobacterium bovis
WGREVIGIAAGVVRFIGVNGYRW

SEQ ID NO: 214446 - protein, 18 aa, Mycobacterium bovis
WHPGRCAQVFVGESSVGH

SEQ ID NO: 214447 - protein, 17 aa, Mycobacterium bovis
WHPVSSLPPMAFDHGPM

SEQ ID NO: 214448 - protein, 21 aa, Mycobacterium bovis
WIPRLATMGVIASYCLTEPGA

SEQ ID NO: 214449 - protein, 17 aa, Mycobacterium bovis
WKAEWGVADPREARGAL

SEQ ID NO: 214450 - protein, 22 aa, Mycobacterium bovis
WKDGEALFLRCNIWREAAENVA

SEQ ID NO: 214451 - protein, 22 aa, Mycobacterium bovis
WKQFGKSLIHWDEWTTNPNEAL

SEQ ID NO: 214452 - protein, 17 aa, Mycobacterium bovis
WLEPGQWWALVRVGCAG

SEQ ID NO: 214453 - protein, 17 aa, Mycobacterium bovis
WLGAHGFGRLLQHTVVV

SEQ ID NO: 214454 - protein, 17 aa, Mycobacterium bovis
WLMPGQRAFQIATQLAL

SEQ ID NO: 214455 - protein, 19 aa, Mycobacterium bovis
WLNAEWRLVSDHIRAIVAL

SEQ ID NO: 214456 - protein, 24 aa, Mycobacterium bovis
WLRARGLKIFRWWAGPSVVVTTRR

SEQ ID NO: 214457 - protein, 24 aa, Mycobacterium bovis
WLRRKHGLSSLGWDLCRIFTDGDY

SEQ ID NO: 214458 - protein, 23 aa, Mycobacterium bovis
WLSVKRLAGWLAAAGYCGRAPRP

SEQ ID NO: 214459 - protein, 20 aa, Mycobacterium bovis
WLVGNGGLDWAVKRTADSSQ

SEQ ID NO: 214460 - protein, 19 aa, Mycobacterium bovis
WMGRVHRFLGLQVGVILAT

SEQ ID NO: 214461 - protein, 28 aa, Mycobacterium bovis
WMRPMFRGLRHWRVLRLLRTVGMHHALG

SEQ ID NO: 214462 - protein, 18 aa, Mycobacterium bovis
WNPKMKRFIFTDRNGIYI

SEQ ID NO: 214463 - protein, 17 aa, Mycobacterium bovis
WPAKLRLLDGFRQRENL

SEQ ID NO: 214464 - protein, 19 aa, Mycobacterium bovis
WPDKPGRYFTVRAGSLVAW

SEQ ID NO: 214465 - protein, 21 aa, Mycobacterium bovis
WPEPLRTAALAGRGAARPTAQ

SEQ ID NO: 214466 - protein, 18 aa, Mycobacterium bovis
WPLADVRLLAPILASKVV

SEQ ID NO: 214467 - protein, 22 aa, Mycobacterium bovis
WPNLAAELQLAFQQLLVGDYNA

SEQ ID NO: 214468 - protein, 18 aa, Mycobacterium bovis
WPSKAELVLAAFIEGIRQ

SEQ ID NO: 214469 - protein, 17 aa, Mycobacterium bovis
WPTLDGMFAPHASDVVF

SEQ ID NO: 214470 - protein, 19 aa, Mycobacterium bovis
WPTVADWVRWISGDGTKPE

SEQ ID NO: 214471 - protein, 17 aa, Mycobacterium bovis
WQFHHVIDVAPTILEAA

SEQ ID NO: 214472 - protein, 20 aa, Mycobacterium bovis
WQGWEELFELARFVGVSRPG

SEQ ID NO: 214473 - protein, 25 aa, Mycobacterium bovis
WRARGRLQEGLAWFAAALADHDAHP

SEQ ID NO: 214474 - protein, 18 aa, Mycobacterium bovis
WRATLIVRESACLDVADR

SEQ ID NO: 214475 - protein, 23 aa, Mycobacterium bovis
WREVYRLRQPVLLIWGREDRVNP

SEQ ID NO: 214476 - protein, 18 aa, Mycobacterium bovis
WRGERRFVERLSRATIDV

SEQ ID NO: 214477 - protein, 19 aa, Mycobacterium bovis
WRKADAALGRPVVSNQVHF

SEQ ID NO: 214478 - protein, 17 aa, Mycobacterium bovis
WRLGPAITELATHVDDP

SEQ ID NO: 214479 - protein, 17 aa, Mycobacterium bovis
WRLSGLGLRVIAHDPYR

SEQ ID NO: 214480 - protein, 20 aa, Mycobacterium bovis
WRNDQWYTARLCPAPLRPEE

SEQ ID NO: 214481 - protein, 20 aa, Mycobacterium bovis
WRRAGLTASRFVACPFGGSG

SEQ ID NO: 214482 - protein, 19 aa, Mycobacterium bovis
WSDWLPRQRWYAGRNRELA

SEQ ID NO: 214483 - protein, 17 aa, Mycobacterium bovis
WSETCYRYTGAHRDALS

SEQ ID NO: 214484 - protein, 25 aa, Mycobacterium bovis
WSPDSDLKGFDGFDGGSGGAGGDGG

SEQ ID NO: 214485 - protein, 19 aa, Mycobacterium bovis
WTLTPRIVSLDVEYFGVMW

SEQ ID NO: 214486 - protein, 18 aa, Mycobacterium bovis
WTQWIFLQIYNAWFDTTA

SEQ ID NO: 214487 - protein, 18 aa, Mycobacterium bovis
WVARLAVDFRQRFKKDVV

SEQ ID NO: 214488 - protein, 25 aa, Mycobacterium bovis
WVRDTLRLGGKFPLKAGMLTSLGFG

SEQ ID NO: 214489 - protein, 20 aa, Mycobacterium bovis
WWLQRRLLLCGIRATCPAVD

SEQ ID NO: 214490 - protein, 17 aa, Mycobacterium bovis
WWTSPFVLAHGVPPDTL

SEQ ID NO: 214491 - protein, 19 aa, Mycobacterium bovis
WYTARLCPAPLRPEERQTT

SEQ ID NO: 214492 - protein, 18 aa, Mycobacterium bovis
YAAEMAHIIGCEPAEVLR

SEQ ID NO: 214493 - protein, 22 aa, Mycobacterium bovis
YAMPDVHWGYGFPIGGVAATDV

SEQ ID NO: 214494 - protein, 19 aa, Mycobacterium bovis
YANRFGYNVVRDFTGHGIG

SEQ ID NO: 214495 - protein, 18 aa, Mycobacterium bovis
YARVCVDLLKPRKAQPLL

SEQ ID NO: 214496 - protein, 18 aa, Mycobacterium bovis
YAVPRLLARNGLSLQDFD

SEQ ID NO: 214497 - protein, 30 aa, Mycobacterium bovis
YDCRSTRALRDWLLMRAWEAGVTPIGAQPV

SEQ ID NO: 214498 - protein, 18 aa, Mycobacterium bovis
YDDLRPGLRMNIIANPGI

SEQ ID NO: 214499 - protein, 17 aa, Mycobacterium bovis
YDVSHLELPLPADGSTM

SEQ ID NO: 214500 - protein, 18 aa, Mycobacterium bovis
YEFWREFLASLKARGLTG

SEQ ID NO: 214501 - protein, 17 aa, Mycobacterium bovis
YEKLEGVPLTFAGKINR

SEQ ID NO: 214502 - protein, 24 aa, Mycobacterium bovis
YELARDALREWLRRGGKPARLIEI

SEQ ID NO: 214503 - protein, 17 aa, Mycobacterium bovis
YEMFPRSTGGWDDDGNP

SEQ ID NO: 214504 - protein, 17 aa, Mycobacterium bovis
YERKEIRDIVAYLRVLD

SEQ ID NO: 214505 - protein, 22 aa, Mycobacterium bovis
YESFSRCFGCGRIYWPGSHHAR

SEQ ID NO: 214506 - protein, 17 aa, Mycobacterium bovis
YFMDWPNAFQVLAGDFV

SEQ ID NO: 214507 - protein, 19 aa, Mycobacterium bovis
YFTGTGLKGWINRWFYSVS

SEQ ID NO: 214508 - protein, 17 aa, Mycobacterium bovis
YGGPCYARIDAPADREQ

SEQ ID NO: 214509 - protein, 17 aa, Mycobacterium bovis
YGGVWLHSWLDRDLGIS

SEQ ID NO: 214510 - protein, 24 aa, Mycobacterium bovis
YGLAGLRIGYAIGHPDVITALDKV

SEQ ID NO: 214511 - protein, 20 aa, Mycobacterium bovis
YGLRLSWNFLARSTAGLWEW

SEQ ID NO: 214512 - protein, 17 aa, Mycobacterium bovis
YGTLPWHPDLWLDSEDA

SEQ ID NO: 214513 - protein, 17 aa, Mycobacterium bovis
YGYKWPTLDGMFAPHAS

SEQ ID NO: 214514 - protein, 18 aa, Mycobacterium bovis
YHKIHLYDAFGFTESRTV

SEQ ID NO: 214515 - protein, 19 aa, Mycobacterium bovis
YHPPMRTFLGVPVRVRDES

SEQ ID NO: 214516 - protein, 17 aa, Mycobacterium bovis
YISALALLAKREQWAEF

SEQ ID NO: 214517 - protein, 20 aa, Mycobacterium bovis
YKEFYKHVAHAWDDPLEIIA

SEQ ID NO: 214518 - protein, 19 aa, Mycobacterium bovis
YKLLRSEWLEPRWMVGIDP

SEQ ID NO: 214519 - protein, 21 aa, Mycobacterium bovis
YKSCFLAMVRRFYELGVKELN

SEQ ID NO: 214520 - protein, 18 aa, Mycobacterium bovis
YLAAKGWQPEGVSLAELF

SEQ ID NO: 214521 - protein, 18 aa, Mycobacterium bovis
YLADYAIGATLAYPERVE

SEQ ID NO: 214522 - protein, 17 aa, Mycobacterium bovis
YLFRCLSCGVHLAYADF

SEQ ID NO: 214523 - protein, 18 aa, Mycobacterium bovis
YLGAWGIVDCFERGADVV

SEQ ID NO: 214524 - protein, 18 aa, Mycobacterium bovis
YLIRGVIGPDEFHSGYPG

SEQ ID NO: 214525 - protein, 18 aa, Mycobacterium bovis
YLPLVVRRRIWFLAKSEY

SEQ ID NO: 214526 - protein, 25 aa, Mycobacterium bovis
YLVGPIAWTLGFPIVPMLAPGSTDV

SEQ ID NO: 214527 - protein, 22 aa, Mycobacterium bovis
YPGHAIWWLARGLEFFQDGEQF

SEQ ID NO: 214528 - protein, 19 aa, Mycobacterium bovis
YPGHIARMFGLVYGGESRD

SEQ ID NO: 214529 - protein, 21 aa, Mycobacterium bovis
YPGRFLLGIGVGHAEMISEYR

SEQ ID NO: 214530 - protein, 20 aa, Mycobacterium bovis
YPQDRLDFILADCDAKLVLR

SEQ ID NO: 214531 - protein, 18 aa, Mycobacterium bovis
YQYRPEPPFVLGAEIAGV

SEQ ID NO: 214532 - protein, 20 aa, Mycobacterium bovis
YRAAAEFVPRIGALIDTVHR

SEQ ID NO: 214533 - protein, 17 aa, Mycobacterium bovis
YRAAGYWSGRTLDTVLS

SEQ ID NO: 214534 - protein, 17 aa, Mycobacterium bovis
YRCGEAWSTLVHHRPSG

SEQ ID NO: 214535 - protein, 18 aa, Mycobacterium bovis
YREYSLRPPKGVLLYGPP

SEQ ID NO: 214536 - protein, 25 aa, Mycobacterium bovis
YRGCYGLSVAALMKWHLPRLEVLVD

SEQ ID NO: 214537 - protein, 17 aa, Mycobacterium bovis
YRITPVFVEVREGQSTR

SEQ ID NO: 214538 - protein, 20 aa, Mycobacterium bovis
YRLAAQLGMPPWRVQKAQKQ

SEQ ID NO: 214539 - protein, 17 aa, Mycobacterium bovis
YRLLMSWGVRPGLVLGH

SEQ ID NO: 214540 - protein, 18 aa, Mycobacterium bovis
YRPFYLRNLLDAVQGRNL

SEQ ID NO: 214541 - protein, 21 aa, Mycobacterium bovis
YRSVIDFYRQVFGWRTEQISD

SEQ ID NO: 214542 - protein, 21 aa, Mycobacterium bovis
YRVGQNVAWQRWTEIAFGLTT

SEQ ID NO: 214543 - protein, 20 aa, Mycobacterium bovis
YRVLPYCWRDETPLSNHELR

SEQ ID NO: 214544 - protein, 19 aa, Mycobacterium bovis
YSEIFAHSFARPTAIADGL

SEQ ID NO: 214545 - protein, 30 aa, Mycobacterium bovis
YSNGFFWRGDYQGLGGFAYQSAVSEIPWSY

SEQ ID NO: 214546 - protein, 29 aa, Mycobacterium bovis
YSNGFFWRGDYQGLIGFSGTLTIPAAGLD

SEQ ID NO: 214547 - protein, 26 aa, Mycobacterium bovis
YSNGFFWRGDYQGLIGLSTTITIPEI

SEQ ID NO: 214548 - protein, 26 aa, Mycobacterium bovis
YSNGILWRGDYQGLIGYSYALTIPEI

SEQ ID NO: 214549 - protein, 20 aa, Mycobacterium bovis
YSNGLLWRGGYEGLVGVRVG

SEQ ID NO: 214550 - protein, 23 aa, Mycobacterium bovis
YSNGVLWRGDYQGLIGADIALEI

SEQ ID NO: 214551 - protein, 17 aa, Mycobacterium bovis
YSPRFLWMWPNARISVM

SEQ ID NO: 214552 - protein, 18 aa, Mycobacterium bovis
YTGLKLGGVYGFYPRFTG

SEQ ID NO: 214553 - protein, 24 aa, Mycobacterium bovis
YVDLVCSWGPMILGHAHPAVVEAV

SEQ ID NO: 214554 - protein, 17 aa, Mycobacterium bovis
YVLPRLVPVAGDSAGGV

SEQ ID NO: 214555 - protein, 18 aa, Mycobacterium bovis
YWGGVCLNVGCIPSKALL

SEQ ID NO: 214556 - protein, 22 aa, Mycobacterium bovis
YYADFEGVLAFLQRKMSQTESE

SEQ ID NO: 214557 - protein, 19 aa, Mycobacterium bovis
YYAMTGWRLGWLLVPTVLR

SEQ ID NO: 214558 - protein, 38 aa, Mycobacterium bovis
AAGADEVSARIAALFGMYGLEYQAISAQVAAYHQQFVQ

SEQ ID NO: 214559 - protein, 18 aa, Mycobacterium bovis
AALRAVPAERLWVNPDCG

SEQ ID NO: 214560 - protein, 24 aa, Mycobacterium bovis
AAQPIWWVVRAIEFSKDFETFVQE

SEQ ID NO: 214561 - protein, 20 aa, Mycobacterium bovis
AARCPLCPGPTGLSSEVPAP

SEQ ID NO: 214562 - protein, 19 aa, Mycobacterium bovis
AATGRPLIGNGANGAPGTG

SEQ ID NO: 214563 - protein, 17 aa, Mycobacterium bovis
AAVQGWCIGGAVDLISA

SEQ ID NO: 214564 - protein, 23 aa, Mycobacterium bovis
AAYWPRYGLGMGETYESVTVETK

SEQ ID NO: 214565 - protein, 20 aa, Mycobacterium bovis
ACARLGIMHSVVFGGFTAAA

SEQ ID NO: 214566 - protein, 24 aa, Mycobacterium bovis
ADEVSTQIAALFGAHARSYQTLST

SEQ ID NO: 214567 - protein, 17 aa, Mycobacterium bovis
ADFRLTDAAVWERFYGS

SEQ ID NO: 214568 - protein, 17 aa, Mycobacterium bovis
ADLGAPVYFCDSRSPWQ

SEQ ID NO: 214569 - protein, 19 aa, Mycobacterium bovis
ADLTRRALLRWGAGAGAGA

SEQ ID NO: 214570 - protein, 22 aa, Mycobacterium bovis
AEYLRWAVGAFRLATSGVSDAT

SEQ ID NO: 214571 - protein, 17 aa, Mycobacterium bovis
AFPAWLAPVQVVGIPVA

SEQ ID NO: 214572 - protein, 19 aa, Mycobacterium bovis
AFRRTIKWRTGCEGRISHL

SEQ ID NO: 214573 - protein, 17 aa, Mycobacterium bovis
AGAPIRVGAFLAEDHAL

SEQ ID NO: 214574 - protein, 18 aa, Mycobacterium bovis
AGDARPPFWQNLAELGWL

SEQ ID NO: 214575 - protein, 17 aa, Mycobacterium bovis
AGGDGGLLFGSGGNGAP

SEQ ID NO: 214576 - protein, 17 aa, Mycobacterium bovis
AGGLLFGYGGAGGAGGY

SEQ ID NO: 214577 - protein, 24 aa, Mycobacterium bovis
AGGTGGNAAWLLGGGGTGGAGGIG

SEQ ID NO: 214578 - protein, 17 aa, Mycobacterium bovis
AGLGWGMFPEKLAASPL

SEQ ID NO: 214579 - protein, 17 aa, Mycobacterium bovis
AGMSLGIMADLAVGVHP

SEQ ID NO: 214580 - protein, 18 aa, Mycobacterium bovis
AGPEPMAAAATAWDGLAM

SEQ ID NO: 214581 - protein, 17 aa, Mycobacterium bovis
AGPRYGFRPTVMARPPF

SEQ ID NO: 214582 - protein, 20 aa, Mycobacterium bovis
AIAAGLRWSAAVPPLHKGDA

SEQ ID NO: 214583 - protein, 19 aa, Mycobacterium bovis
ALGLLYRWVEHAFGGREHA

SEQ ID NO: 214584 - protein, 17 aa, Mycobacterium bovis
ALHWFPGSHLLHVSQLD

SEQ ID NO: 214585 - protein, 18 aa, Mycobacterium bovis
ALLARRRMDLYGATVEDF

SEQ ID NO: 214586 - protein, 19 aa, Mycobacterium bovis
ALLGRPLIGHGADGAPGTG

SEQ ID NO: 214587 - protein, 24 aa, Mycobacterium bovis
ANGNNRSSGSFLAAGGTGGAAGDG

SEQ ID NO: 214588 - protein, 29 aa, Mycobacterium bovis
APGGNGGNAGWLYGRGGVGGAGGIGGGTG

SEQ ID NO: 214589 - protein, 17 aa, Mycobacterium bovis
APLPAFWVNIARKKILH

SEQ ID NO: 214590 - protein, 26 aa, Mycobacterium bovis
AQHPWPPRVATLPHWPLIYAGALEGL

SEQ ID NO: 214591 - protein, 18 aa, Mycobacterium bovis
AQRQGIKILGPVGVAART

SEQ ID NO: 214592 - protein, 23 aa, Mycobacterium bovis
AQVAAYHQQFVQTLRTGAASYML

SEQ ID NO: 214593 - protein, 23 aa, Mycobacterium bovis
ARAAAFHERFVQALATGGGAYAA

SEQ ID NO: 214594 - protein, 17 aa, Mycobacterium bovis
ARFGAWYEMFPRSTGGW

SEQ ID NO: 214595 - protein, 19 aa, Mycobacterium bovis
ARFLSVVLRRIRGMRSDTR

SEQ ID NO: 214596 - protein, 20 aa, Mycobacterium bovis
ARIFPPGSHIPIPFIEYTMP

SEQ ID NO: 214597 - protein, 17 aa, Mycobacterium bovis
ARIGVLSQVPWLWAKFI

SEQ ID NO: 214598 - protein, 17 aa, Mycobacterium bovis
ARLGYPLDRSHTAAVIW

SEQ ID NO: 214599 - protein, 21 aa, Mycobacterium bovis
ARPPFWQNLAELGWLGLHIDE

SEQ ID NO: 214600 - protein, 17 aa, Mycobacterium bovis
ASGELRATMALTEPGGG

SEQ ID NO: 214601 - protein, 26 aa, Mycobacterium bovis
ASVAWDRLAAELAVAASSFGSVTSGL

SEQ ID NO: 214602 - protein, 17 aa, Mycobacterium bovis
ATFGVAYLTAWHSLCEV

SEQ ID NO: 214603 - protein, 24 aa, Mycobacterium bovis
ATPLRPGIWRAYADHRMAMAGAII

SEQ ID NO: 214604 - protein, 17 aa, Mycobacterium bovis
AVHQCQWPKAVWAVIDN

SEQ ID NO: 214605 - protein, 22 aa, Mycobacterium bovis
AVLREFPSYIAFRERTKAKQPV

SEQ ID NO: 214606 - protein, 18 aa, Mycobacterium bovis
AVRAWRSADDFPCTEHMA

SEQ ID NO: 214607 - protein, 20 aa, Mycobacterium bovis
AYRWFRAGLLSVMARRVGRL

SEQ ID NO: 214608 - protein, 19 aa, Mycobacterium bovis
CAALPRILRDNGYVTGAFG

SEQ ID NO: 214609 - protein, 19 aa, Mycobacterium bovis
CFRCPQCTERLRASDDLLL

SEQ ID NO: 214610 - protein, 19 aa, Mycobacterium bovis
CSDPAKLAGWWAEQFDGTT

SEQ ID NO: 214611 - protein, 17 aa, Mycobacterium bovis
DEISVLVPDDFVGAVLG

SEQ ID NO: 214612 - protein, 17 aa, Mycobacterium bovis
DELRSLLRFVLDLLADY

SEQ ID NO: 214613 - protein, 23 aa, Mycobacterium bovis
DFVKLAEALGCVGLRCEREEDVV

SEQ ID NO: 214614 - protein, 30 aa, Mycobacterium bovis
DGGDGGDGGWGRPGGQGGFGSTSGAHGKAG

SEQ ID NO: 214615 - protein, 29 aa, Mycobacterium bovis
DGGKGGFADEFTGGFAQGGRGGFGGNGNT

SEQ ID NO: 214616 - protein, 20 aa, Mycobacterium bovis
DGGNAGMFFGSGGAGGAGGF

SEQ ID NO: 214617 - protein, 18 aa, Mycobacterium bovis
DIGYRIAHHADLTTPPPI

SEQ ID NO: 214618 - protein, 25 aa, Mycobacterium bovis
DQLSELWKAISPHLSPLSNIVSMLN

SEQ ID NO: 214619 - protein, 18 aa, Mycobacterium bovis
DWNALNLFTGWVDVGLTD

SEQ ID NO: 214620 - protein, 19 aa, Mycobacterium bovis
EEYWWAAEQMLTWPDPDKP

SEQ ID NO: 214621 - protein, 20 aa, Mycobacterium bovis
ELGQPLPLFIKWDDADYGLR

SEQ ID NO: 214622 - protein, 27 aa, Mycobacterium bovis
EPGETRFALVLSRLFWDAAIFHRACEA

SEQ ID NO: 214623 - protein, 19 aa, Mycobacterium bovis
EPMCKRLVMSGGFYRAIQR

SEQ ID NO: 214624 - protein, 19 aa, Mycobacterium bovis
ERKVNALKFIAFVTNPTNT

SEQ ID NO: 214625 - protein, 17 aa, Mycobacterium bovis
ERQYYWFGEPIDTTEFM

SEQ ID NO: 214626 - protein, 21 aa, Mycobacterium bovis
EVVSAAAGDLANVGSTISAAN

SEQ ID NO: 214627 - protein, 26 aa, Mycobacterium bovis
FDQLSELWKAISPHLSPLSNIVSMLN

SEQ ID NO: 214628 - protein, 19 aa, Mycobacterium bovis
FFKRCFNIMPADGRMTVQS

SEQ ID NO: 214629 - protein, 19 aa, Mycobacterium bovis
FPLPLGDPSVRCGGDLLSM

SEQ ID NO: 214630 - protein, 17 aa, Mycobacterium bovis
FWSEMPEVFHALDADRE

SEQ ID NO: 214631 - protein, 17 aa, Mycobacterium bovis
FYVWRAFARYSPVLPAG

SEQ ID NO: 214632 - protein, 20 aa, Mycobacterium bovis
GAGMNSLDPLLAAQDGGQGG

SEQ ID NO: 214633 - protein, 25 aa, Mycobacterium bovis
GAGYADMTAIFLGSSGTPGEDGGNG

SEQ ID NO: 214634 - protein, 19 aa, Mycobacterium bovis
GAVSFRFGDRTQINGVARD

SEQ ID NO: 214635 - protein, 17 aa, Mycobacterium bovis
GDGGLLFGSGGNGAPGA

SEQ ID NO: 214636 - protein, 20 aa, Mycobacterium bovis
GDLRTGMMGVWIGAIQNMYP

SEQ ID NO: 214637 - protein, 19 aa, Mycobacterium bovis
GDVSADFGGVGFGGQGGNG

SEQ ID NO: 214638 - protein, 23 aa, Mycobacterium bovis
GESRLRLLGFERVELEPGQTRRV

SEQ ID NO: 214639 - protein, 23 aa, Mycobacterium bovis
GGAGGAGGWLFGNGGAGGNGGIG

SEQ ID NO: 214640 - protein, 22 aa, Mycobacterium bovis
GGAGGLIGWAGAAGGTGAGGTG

SEQ ID NO: 214641 - protein, 19 aa, Mycobacterium bovis
GGAGGWLFGNGGAGGVGGA

SEQ ID NO: 214642 - protein, 17 aa, Mycobacterium bovis
GGALGVLGGMGGDGGDG

SEQ ID NO: 214643 - protein, 17 aa, Mycobacterium bovis
GGLFLNWVDRVIGPGDP

SEQ ID NO: 214644 - protein, 21 aa, Mycobacterium bovis
GGNGGRGGWLLGNGGAGGVGG

SEQ ID NO: 214645 - protein, 24 aa, Mycobacterium bovis
GGSGGFGAPPPRSIGGGDGGDGGR

SEQ ID NO: 214646 - protein, 24 aa, Mycobacterium bovis
GLGGAGRDGGAPGGDGGDGGTGGS

SEQ ID NO: 214647 - protein, 22 aa, Mycobacterium bovis
GLPSRLRLGVCVTDAGRRNPAV

SEQ ID NO: 214648 - protein, 19 aa, Mycobacterium bovis
GLSSPVILGIGIGGAGGDG

SEQ ID NO: 214649 - protein, 18 aa, Mycobacterium bovis
GLTEAIAAYSTRLKITPT

SEQ ID NO: 214650 - protein, 19 aa, Mycobacterium bovis
GLVLGWRCSWCPSGTRGNG

SEQ ID NO: 214651 - protein, 18 aa, Mycobacterium bovis
GQITGLRSGFGSAGGAGG

SEQ ID NO: 214652 - protein, 18 aa, Mycobacterium bovis
GRVKQLLLKIGWPAEDLA

SEQ ID NO: 214653 - protein, 18 aa, Mycobacterium bovis
GSCPLWVVHDAFAQPERI

SEQ ID NO: 214654 - protein, 25 aa, Mycobacterium bovis
GTGADGGAGGWLFGNGGNGGSGATG

SEQ ID NO: 214655 - protein, 18 aa, Mycobacterium bovis
GTGGFGFAAGGQGGVGGS

SEQ ID NO: 214656 - protein, 22 aa, Mycobacterium bovis
GVFEGIAVLGLGFGGAAGAGGA

SEQ ID NO: 214657 - protein, 22 aa, Mycobacterium bovis
GVRTNTWWLPAMQSLYETDYGP

SEQ ID NO: 214658 - protein, 19 aa, Mycobacterium bovis
GWGVPGLSWLPGEDPDPFG

SEQ ID NO: 214659 - protein, 18 aa, Mycobacterium bovis
GYDLTRWLATKGMELTWR

SEQ ID NO: 214660 - protein, 17 aa, Mycobacterium bovis
GYPTACFVSINRHKSVA

SEQ ID NO: 214661 - protein, 17 aa, Mycobacterium bovis
HCRTCGRGMAPPGSGTW

SEQ ID NO: 214662 - protein, 24 aa, Mycobacterium bovis
HLDIPRAPVTLNYLFGSQPGGPLK

SEQ ID NO: 214663 - protein, 22 aa, Mycobacterium bovis
HPDFLRLFYLLSMERSQDPAVA

SEQ ID NO: 214664 - protein, 17 aa, Mycobacterium bovis
HRIRFGATVVSARFDDG

SEQ ID NO: 214665 - protein, 21 aa, Mycobacterium bovis
IASPPVKWPCFYGIDFPSPAE

SEQ ID NO: 214666 - protein, 17 aa, Mycobacterium bovis
IGVLFKRIFDRPARRPV

SEQ ID NO: 214667 - protein, 17 aa, Mycobacterium bovis
IGVLSQVPWLWAKFIGH

SEQ ID NO: 214668 - protein, 17 aa, Mycobacterium bovis
IKILGPVGVAARTAATV

SEQ ID NO: 214669 - protein, 19 aa, Mycobacterium bovis
IPGDGVGKAPHGGAGGSGG

SEQ ID NO: 214670 - protein, 17 aa, Mycobacterium bovis
ISAQVAAYHQQFVQTLR

SEQ ID NO: 214671 - protein, 17 aa, Mycobacterium bovis
ISFADGRVIVWSEELGE

SEQ ID NO: 214672 - protein, 18 aa, Mycobacterium bovis
IVPHTWLWAMPMSGPTGG

SEQ ID NO: 214673 - protein, 18 aa, Mycobacterium bovis
IVSIEAFEHFGHENYDDF

SEQ ID NO: 214674 - protein, 17 aa, Mycobacterium bovis
IWCFPKFDVPLPTAVRW

SEQ ID NO: 214675 - protein, 19 aa, Mycobacterium bovis
IWWQRAVAVWPDYASYQTK

SEQ ID NO: 214676 - protein, 17 aa, Mycobacterium bovis
KASEVVEPWSLRLSHPE

SEQ ID NO: 214677 - protein, 18 aa, Mycobacterium bovis
KPGMTLLDIGCGWGTTMR

SEQ ID NO: 214678 - protein, 17 aa, Mycobacterium bovis
KSTGFARDLADYIQEQG

SEQ ID NO: 214679 - protein, 18 aa, Mycobacterium bovis
KVVICLVNGWAAGGGHSL

SEQ ID NO: 214680 - protein, 17 aa, Mycobacterium bovis
LADQAVRQWGFMQGLKQ

SEQ ID NO: 214681 - protein, 20 aa, Mycobacterium bovis
LAGTVLRFVPPLAALGSVPV

SEQ ID NO: 214682 - protein, 22 aa, Mycobacterium bovis
LALQFGWRLFAPMLRSATGIDE

SEQ ID NO: 214683 - protein, 23 aa, Mycobacterium bovis
LDIYRIGQNVAWRRWTDIAFGLT

SEQ ID NO: 214684 - protein, 21 aa, Mycobacterium bovis
LDRYLPVLADLRMRYLDDGDW

SEQ ID NO: 214685 - protein, 28 aa, Mycobacterium bovis
LGLTWPGWKPGWPWARCCVGSATTKSTT

SEQ ID NO: 214686 - protein, 23 aa, Mycobacterium bovis
LILRRPRAGLSYEALLETVEQRL

SEQ ID NO: 214687 - protein, 19 aa, Mycobacterium bovis
LIRMQRFWISLYFPLTMRS

SEQ ID NO: 214688 - protein, 18 aa, Mycobacterium bovis
LLEYHWGPDWVVWDAAKT

SEQ ID NO: 214689 - protein, 19 aa, Mycobacterium bovis
LLNRLWPLVSLRCNFFTPT

SEQ ID NO: 214690 - protein, 17 aa, Mycobacterium bovis
LLPVTTFDVRRAPAALR

SEQ ID NO: 214691 - protein, 17 aa, Mycobacterium bovis
LLRACAKLGVRLVHSTP

SEQ ID NO: 214692 - protein, 18 aa, Mycobacterium bovis
LLRFCLERGYQLRVIEQM

SEQ ID NO: 214693 - protein, 20 aa, Mycobacterium bovis
LPAPLTLFGHCMGAIVAFEF

SEQ ID NO: 214694 - protein, 20 aa, Mycobacterium bovis
LPFPLSSAILPRFFYTKEIG

SEQ ID NO: 214695 - protein, 22 aa, Mycobacterium bovis
LPLPQRRFGGVVGRTMAESVGD

SEQ ID NO: 214696 - protein, 17 aa, Mycobacterium bovis
LPSAIYHRFGRVHTYAK

SEQ ID NO: 214697 - protein, 18 aa, Mycobacterium bovis
LPTAVRWAMRIPGGKAVH

SEQ ID NO: 214698 - protein, 17 aa, Mycobacterium bovis
LPTRVLLISAHDEPAIV

SEQ ID NO: 214699 - protein, 17 aa, Mycobacterium bovis
LPWGNGIVSLTPAPDHV

SEQ ID NO: 214700 - protein, 18 aa, Mycobacterium bovis
LPYFSIGMGNNFIQSAKT

SEQ ID NO: 214701 - protein, 18 aa, Mycobacterium bovis
LRADACFVIGFGILRHIR

SEQ ID NO: 214702 - protein, 19 aa, Mycobacterium bovis
LRAVGDWLVRPGAQLQAVG

SEQ ID NO: 214703 - protein, 17 aa, Mycobacterium bovis
LRLLPVTTFDVRRAPAA

SEQ ID NO: 214704 - protein, 18 aa, Mycobacterium bovis
LRPGAIIRDLNLLRPIYA

SEQ ID NO: 214705 - protein, 18 aa, Mycobacterium bovis
LRSLLRFVLDLLADYGLT

SEQ ID NO: 214706 - protein, 19 aa, Mycobacterium bovis
LRYFWSRVIADTGWQLLDS

SEQ ID NO: 214707 - protein, 18 aa, Mycobacterium bovis
LSCGSALGFSLGRMALLV

SEQ ID NO: 214708 - protein, 23 aa, Mycobacterium bovis
LSLPRRLQIEFSQVIQKIAEGTA

SEQ ID NO: 214709 - protein, 21 aa, Mycobacterium bovis
LSVVVAESWRASALAEMIQEA

SEQ ID NO: 214710 - protein, 19 aa, Mycobacterium bovis
LSYKTGWYGSALVVADRWF

SEQ ID NO: 214711 - protein, 17 aa, Mycobacterium bovis
LTGRPLIGDGANGIDGT

SEQ ID NO: 214712 - protein, 17 aa, Mycobacterium bovis
LVEFRWELAVGDDPLSE

SEQ ID NO: 214713 - protein, 18 aa, Mycobacterium bovis
LVEWSHPLGHRWRWEFES

SEQ ID NO: 214714 - protein, 19 aa, Mycobacterium bovis
LYWQCWKLDSPIIARITDT

SEQ ID NO: 214715 - protein, 18 aa, Mycobacterium bovis
MGGMPCIRGLRIPVATVV

SEQ ID NO: 214716 - protein, 18 aa, Mycobacterium bovis
MLPHNAVEYFVSYYDYYQ

SEQ ID NO: 214717 - protein, 17 aa, Mycobacterium bovis
MRWGLIPSWIKAGPGGA

SEQ ID NO: 214718 - protein, 25 aa, Mycobacterium bovis
MSAQAAAFHARFVQALAGAMGAYAA

SEQ ID NO: 214719 - protein, 20 aa, Mycobacterium bovis
NGGDAGWLIGNGGAGGSGAK

SEQ ID NO: 214720 - protein, 19 aa, Mycobacterium bovis
NGGDGGWLIGNGGAGGSGA

SEQ ID NO: 214721 - protein, 23 aa, Mycobacterium bovis
NGGLGGDGFTYLADFDGEPGGDG

SEQ ID NO: 214722 - protein, 17 aa, Mycobacterium bovis
NGPRYWLMNAIEKAPQG

SEQ ID NO: 214723 - protein, 18 aa, Mycobacterium bovis
NLVEYGFRLPSACDNRPL

SEQ ID NO: 214724 - protein, 23 aa, Mycobacterium bovis
NTQPWRWRVCPTSLELFSRPDMQ

SEQ ID NO: 214725 - protein, 19 aa, Mycobacterium bovis
PAAAARLGSRLSIHDQPNL

SEQ ID NO: 214726 - protein, 17 aa, Mycobacterium bovis
PAVLGAPAWKPPHPLSD

SEQ ID NO: 214727 - protein, 23 aa, Mycobacterium bovis
PDSPEALPLLFGHIGEGNLHLNV

SEQ ID NO: 214728 - protein, 19 aa, Mycobacterium bovis
PELCALSWMVYSLPGAPVL

SEQ ID NO: 214729 - protein, 22 aa, Mycobacterium bovis
PFWDRLRFPAALDRVQVPVLLV

SEQ ID NO: 214730 - protein, 17 aa, Mycobacterium bovis
PFYHDMGLMLGIILPMI

SEQ ID NO: 214731 - protein, 17 aa, Mycobacterium bovis
PGDLAWQPPLWRALVTT

SEQ ID NO: 214732 - protein, 21 aa, Mycobacterium bovis
PGFADSLLRGWQAKKRTSTRI

SEQ ID NO: 214733 - protein, 18 aa, Mycobacterium bovis
PGRWGRTAVCARLSSADQ

SEQ ID NO: 214734 - protein, 18 aa, Mycobacterium bovis
PGSDALALGQPGGNGGQG

SEQ ID NO: 214735 - protein, 20 aa, Mycobacterium bovis
PGSHIPIPFIEYTMPQQVDS

SEQ ID NO: 214736 - protein, 24 aa, Mycobacterium bovis
PKLRQGSYFPGWLLQRRKRAERAL

SEQ ID NO: 214737 - protein, 23 aa, Mycobacterium bovis
PLPSTRQRLGWALRDLPSRLGKI

SEQ ID NO: 214738 - protein, 24 aa, Mycobacterium bovis
PMEFVSFKGGWQLSRQTAEMLLAM

SEQ ID NO: 214739 - protein, 20 aa, Mycobacterium bovis
PQCTERLRASDDLLLVGGMR

SEQ ID NO: 214740 - protein, 18 aa, Mycobacterium bovis
PSDSVAIALRVGVPIYVE

SEQ ID NO: 214741 - protein, 17 aa, Mycobacterium bovis
PSMRGVPFTFVRVDRAG

SEQ ID NO: 214742 - protein, 22 aa, Mycobacterium bovis
PTLIRMFMKWGREIPDSHDLSS

SEQ ID NO: 214743 - protein, 26 aa, Mycobacterium bovis
PTQTLLGRPLIGDGANATTPGGAGGD

SEQ ID NO: 214744 - protein, 24 aa, Mycobacterium bovis
PTRAAICRFATWWVVLERHGNLVR

SEQ ID NO: 214745 - protein, 20 aa, Mycobacterium bovis
PTTARLTGRWLRGRLPTLND

SEQ ID NO: 214746 - protein, 18 aa, Mycobacterium bovis
PYAHGWVTWFPPDAPPGT

SEQ ID NO: 214747 - protein, 17 aa, Mycobacterium bovis
PYPKLLLADRDSIFEYT

SEQ ID NO: 214748 - protein, 18 aa, Mycobacterium bovis
PYWYVYEHNLWPSREDAL

SEQ ID NO: 214749 - protein, 22 aa, Mycobacterium bovis
QAAAFHSRFVQALTTAAASYAS

SEQ ID NO: 214750 - protein, 21 aa, Mycobacterium bovis
QALLGRPLIGNGANGADGTGA

SEQ ID NO: 214751 - protein, 27 aa, Mycobacterium bovis
QLHCKIMWCPSVSLSIWANAWLAGKAA

SEQ ID NO: 214752 - protein, 20 aa, Mycobacterium bovis
QMPGGIYAPMMHPWSTGKDV

SEQ ID NO: 214753 - protein, 19 aa, Mycobacterium bovis
QRPNPFPAMSIRNNVVAGL

SEQ ID NO: 214754 - protein, 20 aa, Mycobacterium bovis
QTLLGRPLIGNGADGSTPGQ

SEQ ID NO: 214755 - protein, 19 aa, Mycobacterium bovis
QWLGIDCIWLPPFYDSPLR

SEQ ID NO: 214756 - protein, 17 aa, Mycobacterium bovis
RAAMKWCRKAQELGTLD

SEQ ID NO: 214757 - protein, 23 aa, Mycobacterium bovis
RAEGRYALMPGIIGALAASGTPL

SEQ ID NO: 214758 - protein, 18 aa, Mycobacterium bovis
RARLWPRSMTTLSTHDTK

SEQ ID NO: 214759 - protein, 17 aa, Mycobacterium bovis
REIGCKLVSFGSGAHFC

SEQ ID NO: 214760 - protein, 19 aa, Mycobacterium bovis
RFADRFARFNLQERVIRPS

SEQ ID NO: 214761 - protein, 20 aa, Mycobacterium bovis
RFAERFGRFNFAAAALRPAY

SEQ ID NO: 214762 - protein, 18 aa, Mycobacterium bovis
RFGLAAPLPRAGTQMRAF

SEQ ID NO: 214763 - protein, 25 aa, Mycobacterium bovis
RFIRDTTWVSVRWYRPGGPLTAQQV

SEQ ID NO: 214764 - protein, 18 aa, Mycobacterium bovis
RFTAKLSYRGRAFATVPI

SEQ ID NO: 214765 - protein, 21 aa, Mycobacterium bovis
RGVIPRDHIKAVLDAADVLIW

SEQ ID NO: 214766 - protein, 19 aa, Mycobacterium bovis
RHGLCGYRRFFSITSLAGL

SEQ ID NO: 214767 - protein, 17 aa, Mycobacterium bovis
RHILDVKTAIAWARANV

SEQ ID NO: 214768 - protein, 17 aa, Mycobacterium bovis
RIAQAVVVAATRNYGVP

SEQ ID NO: 214769 - protein, 17 aa, Mycobacterium bovis
RLLRLGLQSLRLWREGS

SEQ ID NO: 214770 - protein, 23 aa, Mycobacterium bovis
RLPRIAGPCGMVIFGVTGDLARK

SEQ ID NO: 214771 - protein, 17 aa, Mycobacterium bovis
RLQEVWLRRQIAEVKSK

SEQ ID NO: 214772 - protein, 17 aa, Mycobacterium bovis
RLRTLLCTEAIAAADLM

SEQ ID NO: 214773 - protein, 19 aa, Mycobacterium bovis
RLVMSGGFYRAIQRDDVEL

SEQ ID NO: 214774 - protein, 20 aa, Mycobacterium bovis
RPGGGGWGWGVEPPGAAVAE

SEQ ID NO: 214775 - protein, 19 aa, Mycobacterium bovis
RPGQKLRIVKYLAYGWSSL

SEQ ID NO: 214776 - protein, 18 aa, Mycobacterium bovis
RPRSCAALPRILRDNGYV

SEQ ID NO: 214777 - protein, 22 aa, Mycobacterium bovis
RTRKAGAVGLVMAEPLTYFFSD

SEQ ID NO: 214778 - protein, 20 aa, Mycobacterium bovis
RVIRTLRRLGIRSVAVYSDP

SEQ ID NO: 214779 - protein, 18 aa, Mycobacterium bovis
RWLPGPRELRAWTLAAGS

SEQ ID NO: 214780 - protein, 18 aa, Mycobacterium bovis
RWRGKKALLLQGRLWQGN

SEQ ID NO: 214781 - protein, 20 aa, Mycobacterium bovis
RYGLRHRIRFGATVVSARFD

SEQ ID NO: 214782 - protein, 18 aa, Mycobacterium bovis
RYIVISAYVPKHWQKLCY

SEQ ID NO: 214783 - protein, 18 aa, Mycobacterium bovis
RYLCMLAEILRFHRAAAR

SEQ ID NO: 214784 - protein, 17 aa, Mycobacterium bovis
RYLKVPCVIEFWDENGG

SEQ ID NO: 214785 - protein, 17 aa, Mycobacterium bovis
RYLPIWIGQSEAAAIAL

SEQ ID NO: 214786 - protein, 19 aa, Mycobacterium bovis
SAILPRFFYTKEIGKRLNA

SEQ ID NO: 214787 - protein, 18 aa, Mycobacterium bovis
SEVVEPWSLRLSHPELLY

SEQ ID NO: 214788 - protein, 18 aa, Mycobacterium bovis
SMGGITIAAWSDRYRHKV

SEQ ID NO: 214789 - protein, 18 aa, Mycobacterium bovis
SRIYTDFTYRSGSTTIST

SEQ ID NO: 214790 - protein, 19 aa, Mycobacterium bovis
STAIAALFGAHGQAYQALS

SEQ ID NO: 214791 - protein, 18 aa, Mycobacterium bovis
SVDCARYWLDADKPISKS

SEQ ID NO: 214792 - protein, 18 aa, Mycobacterium bovis
TDVAARWPVPGPRDDKYT

SEQ ID NO: 214793 - protein, 22 aa, Mycobacterium bovis
TGQAGGNGGWLWGNGGNSGSGA

SEQ ID NO: 214794 - protein, 19 aa, Mycobacterium bovis
TIRLPVHLVEQVNKLARIK

SEQ ID NO: 214795 - protein, 17 aa, Mycobacterium bovis
TLKKLSGLRARNGLLTA

SEQ ID NO: 214796 - protein, 17 aa, Mycobacterium bovis
TLKRHCVRVIPWEITGR

SEQ ID NO: 214797 - protein, 23 aa, Mycobacterium bovis
TLPPEINSALIFGGAGSEPMSAA

SEQ ID NO: 214798 - protein, 17 aa, Mycobacterium bovis
TLWRMSVSIAGAVCTAA

SEQ ID NO: 214799 - protein, 22 aa, Mycobacterium bovis
TPEQWWPFIGNLSLDQSIAQGV

SEQ ID NO: 214800 - protein, 26 aa, Mycobacterium bovis
TPGGNGGDGGWLFGSGGNGAPGAAGQ

SEQ ID NO: 214801 - protein, 24 aa, Mycobacterium bovis
VCSEILPRWGVQTVFVDGDDLSQW

SEQ ID NO: 214802 - protein, 21 aa, Mycobacterium bovis
VGYAACHWCHVMAHESFDDDE

SEQ ID NO: 214803 - protein, 21 aa, Mycobacterium bovis
VKAIAAFSRWYAGEIDLHNPP

SEQ ID NO: 214804 - protein, 19 aa, Mycobacterium bovis
VLAIWPDWVRRWPTPSATA

SEQ ID NO: 214805 - protein, 18 aa, Mycobacterium bovis
VLGAPAWKPPHPLSDSIT

SEQ ID NO: 214806 - protein, 17 aa, Mycobacterium bovis
VLSQVPWLWAKFIGHAQ

SEQ ID NO: 214807 - protein, 18 aa, Mycobacterium bovis
VPRPERQYYWFGEPIDTT

SEQ ID NO: 214808 - protein, 22 aa, Mycobacterium bovis
VQRYEVVDLLSLLADKSLVVTE

SEQ ID NO: 214809 - protein, 22 aa, Mycobacterium bovis
VQSVLLPRLLDWMSYAPDPDGG

SEQ ID NO: 214810 - protein, 25 aa, Mycobacterium bovis
VQTLRTGAASYMLAEATNVEQNLLN

SEQ ID NO: 214811 - protein, 18 aa, Mycobacterium bovis
VREACLWSAGLAGSGIRR

SEQ ID NO: 214812 - protein, 24 aa, Mycobacterium bovis
VSPLLDPINEFFLANTGRPLIGNG

SEQ ID NO: 214813 - protein, 21 aa, Mycobacterium bovis
VSWPNPNDWWLVRLLGSITPT

SEQ ID NO: 214814 - protein, 17 aa, Mycobacterium bovis
VVCAALASAARQAGIDV

SEQ ID NO: 214815 - protein, 18 aa, Mycobacterium bovis
VVEALKFHLRDLAVTFRF

SEQ ID NO: 214816 - protein, 17 aa, Mycobacterium bovis
WALVGGFAVSARSEPRF

SEQ ID NO: 214817 - protein, 17 aa, Mycobacterium bovis
WGLIPSWIKAGPGGAPD

SEQ ID NO: 214818 - protein, 18 aa, Mycobacterium bovis
WKVFLNLLRTRFETDKDK

SEQ ID NO: 214819 - protein, 17 aa, Mycobacterium bovis
WPFAPAKHRAMLANLHP

SEQ ID NO: 214820 - protein, 17 aa, Mycobacterium bovis
WQGFCYTAFVTDVCTRK

SEQ ID NO: 214821 - protein, 18 aa, Mycobacterium bovis
WRIKLPHVEAAKFDAALQ

SEQ ID NO: 214822 - protein, 17 aa, Mycobacterium bovis
WSAPRLHLVDLQYSDVR

SEQ ID NO: 214823 - protein, 19 aa, Mycobacterium bovis
WVIAYRWFRAGLLPVPAQR

SEQ ID NO: 214824 - protein, 20 aa, Mycobacterium bovis
YDILFFWVARMMMFGTFVGD

SEQ ID NO: 214825 - protein, 18 aa, Mycobacterium bovis
YPQWDRFAAVRDRLDPDR

SEQ ID NO: 214826 - protein, 21 aa, Mycobacterium bovis
YPSAVAKARFVRVSPRKARRV

SEQ ID NO: 214827 - protein, 17 aa, Mycobacterium bovis
YVPKHWQKLCYLIGRPD

SEQ ID NO: 214828 - protein, 26 aa, Mycobacterium bovis
AADEVSTQIAALFGAHARSYQTLSTQ

SEQ ID NO: 214829 - protein, 39 aa, Mycobacterium bovis
AAGADEVSARIAALFGMYGLEYQAISAQVAAYHQQFVQT

SEQ ID NO: 214830 - protein, 17 aa, Mycobacterium bovis
AALRAVPAERLWVNPDC

SEQ ID NO: 214831 - protein, 17 aa, Mycobacterium bovis
AAPSWRKGPRHIAGRGP

SEQ ID NO: 214832 - protein, 18 aa, Mycobacterium bovis
AAPSWRKGPRHIAGRGPR

SEQ ID NO: 214833 - protein, 18 aa, Mycobacterium bovis
AATGRPLIGNGANGAPGT

SEQ ID NO: 214834 - protein, 25 aa, Mycobacterium bovis
AELAPRVVATVPQLVQLAPHAVQMS

SEQ ID NO: 214835 - protein, 19 aa, Mycobacterium bovis
AENRAELMILIATNLLGQN

SEQ ID NO: 214836 - protein, 21 aa, Mycobacterium bovis
AEWKIFLNLLRTRFETDKDKW

SEQ ID NO: 214837 - protein, 17 aa, Mycobacterium bovis
AFRLLGHVDVVFSNAGI

SEQ ID NO: 214838 - protein, 17 aa, Mycobacterium bovis
AFSAVKPSLAWAETYPG

SEQ ID NO: 214839 - protein, 23 aa, Mycobacterium bovis
AGANGLNSGAMLPGGGTVGNPGT

SEQ ID NO: 214840 - protein, 18 aa, Mycobacterium bovis
AGAPIRVGAFLAEDHALR

SEQ ID NO: 214841 - protein, 17 aa, Mycobacterium bovis
AGGAGWSPDSDLKGFDG

SEQ ID NO: 214842 - protein, 18 aa, Mycobacterium bovis
AGGGAFVHIVTATSTGGS

SEQ ID NO: 214843 - protein, 20 aa, Mycobacterium bovis
AGGNGGWLWGNGGNGGVGGT

SEQ ID NO: 214844 - protein, 21 aa, Mycobacterium bovis
AGGPGGAAFGLGNGGNGGNGG

SEQ ID NO: 214845 - protein, 20 aa, Mycobacterium bovis
AGLVFPQPPAPIAVSGTDSV

SEQ ID NO: 214846 - protein, 19 aa, Mycobacterium bovis
AGPEPMAAAATAWDGLAME

SEQ ID NO: 214847 - protein, 19 aa, Mycobacterium bovis
AGTVLRFVPPLAALGSVPV

SEQ ID NO: 214848 - protein, 20 aa, Mycobacterium bovis
AHGKAGFGAPGGDGGDGGNG

SEQ ID NO: 214849 - protein, 20 aa, Mycobacterium bovis
AHGKAGFSAPGGDGGDGGNG

SEQ ID NO: 214850 - protein, 23 aa, Mycobacterium bovis
AKLWTIADLGGWGSVDPQLFDKA

SEQ ID NO: 214851 - protein, 18 aa, Mycobacterium bovis
ALGLLYRWVEHAFGGREH

SEQ ID NO: 214852 - protein, 17 aa, Mycobacterium bovis
ALIGVGADEMWDIRNRG

SEQ ID NO: 214853 - protein, 18 aa, Mycobacterium bovis
ALPPRFQASAAFAANLST

SEQ ID NO: 214854 - protein, 17 aa, Mycobacterium bovis
ANLERWAPLLPEGATLV

SEQ ID NO: 214855 - protein, 28 aa, Mycobacterium bovis
APGGNGGNAGWLYGRGGVGGAGGIGGGT

SEQ ID NO: 214856 - protein, 24 aa, Mycobacterium bovis
APTLIRMFMKWGREIPDSHDLSSL

SEQ ID NO: 214857 - protein, 27 aa, Mycobacterium bovis
AQHPWPPRVATLPHWPLIYAGALEGLD

SEQ ID NO: 214858 - protein, 27 aa, Mycobacterium bovis
AQTPRQNPMWSAARVVMAARAAAALAS

SEQ ID NO: 214859 - protein, 21 aa, Mycobacterium bovis
ARASFSYGLNAKWPVYLSTKN

SEQ ID NO: 214860 - protein, 19 aa, Mycobacterium bovis
ARCPLCPGPTGLSSEVPAP

SEQ ID NO: 214861 - protein, 17 aa, Mycobacterium bovis
ARLAELLVRYRVGVQAV

SEQ ID NO: 214862 - protein, 18 aa, Mycobacterium bovis
ARLGYPLDRSHTAAVIWG

SEQ ID NO: 214863 - protein, 20 aa, Mycobacterium bovis
ARVSFSYGLNAKWPVYLSTK

SEQ ID NO: 214864 - protein, 21 aa, Mycobacterium bovis
ASAPLRLAASAAVTAGTAGAE

SEQ ID NO: 214865 - protein, 17 aa, Mycobacterium bovis
ASDAAACALDLQRTSLA

SEQ ID NO: 214866 - protein, 17 aa, Mycobacterium bovis
ASWRRGRPGTPKQRPPT

SEQ ID NO: 214867 - protein, 23 aa, Mycobacterium bovis
ATAFPWRRQSALVQWYVETSGSP

SEQ ID NO: 214868 - protein, 17 aa, Mycobacterium bovis
ATCKRCGDAVPYIILPN

SEQ ID NO: 214869 - protein, 23 aa, Mycobacterium bovis
ATPLRPGIWRAYADHRMAMAGAI

SEQ ID NO: 214870 - protein, 23 aa, Mycobacterium bovis
AVLREFPSYIAFRERTKAKQPVD

SEQ ID NO: 214871 - protein, 26 aa, Mycobacterium bovis
AVPNYRGSCWIPFSIELEGDAASFVG

SEQ ID NO: 214872 - protein, 17 aa, Mycobacterium bovis
AVRAWRSADDFPCTEHM

SEQ ID NO: 214873 - protein, 19 aa, Mycobacterium bovis
AYDRAWWFARFVAAAYGTA

SEQ ID NO: 214874 - protein, 17 aa, Mycobacterium bovis
CARCARCARGWHDQGRH

SEQ ID NO: 214875 - protein, 18 aa, Mycobacterium bovis
CATYPVLAVQAWAAFHDM

SEQ ID NO: 214876 - protein, 24 aa, Mycobacterium bovis
CFRCPQCTERLRASDDLLLVGGMR

SEQ ID NO: 214877 - protein, 25 aa, Mycobacterium bovis
CGKYKRVRFKGIICERCGVEVTRAK

SEQ ID NO: 214878 - protein, 17 aa, Mycobacterium bovis
CKACHGVAILADNIEPI

SEQ ID NO: 214879 - protein, 17 aa, Mycobacterium bovis
CNRTSCAQRAFPYLGGR

SEQ ID NO: 214880 - protein, 25 aa, Mycobacterium bovis
DADQPGATGGTGFAGGAGGAGGAGG

SEQ ID NO: 214881 - protein, 17 aa, Mycobacterium bovis
DDQVCLVVEVFRMLADA

SEQ ID NO: 214882 - protein, 17 aa, Mycobacterium bovis
DFVKLAEALGCVGLRCE

SEQ ID NO: 214883 - protein, 19 aa, Mycobacterium bovis
DGGGGISLGGQGGNGGFGG

SEQ ID NO: 214884 - protein, 29 aa, Mycobacterium bovis
DLIDYPAGAAFSWWPTMLLPPGSHQDNMT

SEQ ID NO: 214885 - protein, 17 aa, Mycobacterium bovis
DLVRRYAPKLALIVTSH

SEQ ID NO: 214886 - protein, 17 aa, Mycobacterium bovis
DNPDRWAPPYAEAGAYN

SEQ ID NO: 214887 - protein, 20 aa, Mycobacterium bovis
DRYLPVLADLRMRYLDDGDW

SEQ ID NO: 214888 - protein, 25 aa, Mycobacterium bovis
DTGSFRWASVRGYRLAARLVEIGVD

SEQ ID NO: 214889 - protein, 17 aa, Mycobacterium bovis
DVAARWPVPGPRDDKYT

SEQ ID NO: 214890 - protein, 20 aa, Mycobacterium bovis
EFPLPLGDPSVRCGGDLLSM

SEQ ID NO: 214891 - protein, 20 aa, Mycobacterium bovis
EFRCARCGVPYTDALPEMPE

SEQ ID NO: 214892 - protein, 17 aa, Mycobacterium bovis
EGSLRFGDKVVLGRDNV

SEQ ID NO: 214893 - protein, 20 aa, Mycobacterium bovis
ELLNRLWPLVSLRCNFFTPT

SEQ ID NO: 214894 - protein, 18 aa, Mycobacterium bovis
ELPTRVLLISAHDEPAIV

SEQ ID NO: 214895 - protein, 20 aa, Mycobacterium bovis
ELYKRLPGDLSILTPSPASD

SEQ ID NO: 214896 - protein, 26 aa, Mycobacterium bovis
EPGETRFALVLSRLFWDAAIFHRACE

SEQ ID NO: 214897 - protein, 22 aa, Mycobacterium bovis
EPGIYFPGRWGARIEDIVIVTE

SEQ ID NO: 214898 - protein, 17 aa, Mycobacterium bovis
EPTRWGLPVDQLRYPVF

SEQ ID NO: 214899 - protein, 18 aa, Mycobacterium bovis
ERGHPNWSKAFGYLPGPN

SEQ ID NO: 214900 - protein, 19 aa, Mycobacterium bovis
EVVEALKFHLRDLAVTFRF

SEQ ID NO: 214901 - protein, 20 aa, Mycobacterium bovis
EVVSAAAGDLANVGSTISAA

SEQ ID NO: 214902 - protein, 21 aa, Mycobacterium bovis
EYLRWAVGAFRLATSGVSDAT

SEQ ID NO: 214903 - protein, 18 aa, Mycobacterium bovis
EYWWAAEQMLTWPDPDKP

SEQ ID NO: 214904 - protein, 17 aa, Mycobacterium bovis
FADSLLRGWQAKKRTST

SEQ ID NO: 214905 - protein, 19 aa, Mycobacterium bovis
FAERFGRFNFAAAALRPAY

SEQ ID NO: 214906 - protein, 19 aa, Mycobacterium bovis
FALLARRRMDLYGATVEDF

SEQ ID NO: 214907 - protein, 18 aa, Mycobacterium bovis
FASTGLGGPGGAGGPGGA

SEQ ID NO: 214908 - protein, 20 aa, Mycobacterium bovis
FEGIAVLGLGFGGAAGAGGA

SEQ ID NO: 214909 - protein, 17 aa, Mycobacterium bovis
FFKRCFNIMPADGRMTV

SEQ ID NO: 214910 - protein, 19 aa, Mycobacterium bovis
FGLTEAIAAYSTRLKITPT

SEQ ID NO: 214911 - protein, 17 aa, Mycobacterium bovis
FHFQRWAEFEGFVYDQK

SEQ ID NO: 214912 - protein, 20 aa, Mycobacterium bovis
FLFYSGFYLPMYWSSRGKLT

SEQ ID NO: 214913 - protein, 18 aa, Mycobacterium bovis
FNYLDLVRYLAVGNLNPS

SEQ ID NO: 214914 - protein, 17 aa, Mycobacterium bovis
FQASAAFAANLSTINTL

SEQ ID NO: 214915 - protein, 21 aa, Mycobacterium bovis
FQRPNPFPAMSIRNNVVAGLK

SEQ ID NO: 214916 - protein, 18 aa, Mycobacterium bovis
FRRTIKWRTGCEGRISHL

SEQ ID NO: 214917 - protein, 17 aa, Mycobacterium bovis
FWDEVFRELSIPYLPVR

SEQ ID NO: 214918 - protein, 18 aa, Mycobacterium bovis
FWSEMPEVFHALDADREV

SEQ ID NO: 214919 - protein, 17 aa, Mycobacterium bovis
GAGDFASGVGGVGGAGG

SEQ ID NO: 214920 - protein, 18 aa, Mycobacterium bovis
GAGGDGGLLFGSGGNGAP

SEQ ID NO: 214921 - protein, 18 aa, Mycobacterium bovis
GAGGILFGAGGAGGAGGA

SEQ ID NO: 214922 - protein, 21 aa, Mycobacterium bovis
GAGGLIGWAGAAGGTGAGGTG

SEQ ID NO: 214923 - protein, 22 aa, Mycobacterium bovis
GAGGSGFFGGKGGFGGDGGQGG

SEQ ID NO: 214924 - protein, 25 aa, Mycobacterium bovis
GAGGTGGNAAWLLGGGGTGGAGGIG

SEQ ID NO: 214925 - protein, 18 aa, Mycobacterium bovis
GAIPAMKGATGADGTAPT

SEQ ID NO: 214926 - protein, 18 aa, Mycobacterium bovis
GAMARLGVWSGDGLQLDL

SEQ ID NO: 214927 - protein, 25 aa, Mycobacterium bovis
GANGNNRSSGSFLAAGGTGGAAGDG

SEQ ID NO: 214928 - protein, 17 aa, Mycobacterium bovis
GCSICWHGPAGTPTMSV

SEQ ID NO: 214929 - protein, 21 aa, Mycobacterium bovis
GDAEPGVPPGAGGAGGAGTTG

SEQ ID NO: 214930 - protein, 18 aa, Mycobacterium bovis
GDDTAIWRRIRVVPFEVV

SEQ ID NO: 214931 - protein, 30 aa, Mycobacterium bovis
GDGGKGGFADEFTGGFAQGGRGGFGGNGNT

SEQ ID NO: 214932 - protein, 17 aa, Mycobacterium bovis
GDLRTGMMGVWIGAIQN

SEQ ID NO: 214933 - protein, 18 aa, Mycobacterium bovis
GEAAATLASRGLTAQTPR

SEQ ID NO: 214934 - protein, 19 aa, Mycobacterium bovis
GELFAYRWSRCGGREEWVM

SEQ ID NO: 214935 - protein, 17 aa, Mycobacterium bovis
GELLRLARVLGIAATRD

SEQ ID NO: 214936 - protein, 22 aa, Mycobacterium bovis
GESRLRLLGFERVELEPGQTRR

SEQ ID NO: 214937 - protein, 18 aa, Mycobacterium bovis
GGAGERGADGAGPNANGA

SEQ ID NO: 214938 - protein, 18 aa, Mycobacterium bovis
GGAGGWLFGNGGAGGNGG

SEQ ID NO: 214939 - protein, 18 aa, Mycobacterium bovis
GGAGMINGGLGGFGGAGG

SEQ ID NO: 214940 - protein, 31 aa, Mycobacterium bovis
GGGGRRAAPVLARGPMVWRPATTGRSAAATA

SEQ ID NO: 214941 - protein, 17 aa, Mycobacterium bovis
GGHGGSAAKLFGDGGAG

SEQ ID NO: 214942 - protein, 21 aa, Mycobacterium bovis
GGKGGMGGIAGDGGPGGDGGN

SEQ ID NO: 214943 - protein, 18 aa, Mycobacterium bovis
GGSAGWLSGNGGTGGGGG

SEQ ID NO: 214944 - protein, 24 aa, Mycobacterium bovis
GGVGGRGGDGVFAGAGGQGGLGGQ

SEQ ID NO: 214945 - protein, 22 aa, Mycobacterium bovis
GIGGAGGFGGFRGGEGGAGGAG

SEQ ID NO: 214946 - protein, 20 aa, Mycobacterium bovis
GIGGEGRTGGNGGSGGDGGG

SEQ ID NO: 214947 - protein, 17 aa, Mycobacterium bovis
GILPFSVASVVSGFANI

SEQ ID NO: 214948 - protein, 19 aa, Mycobacterium bovis
GLGDPRVGGSGGDGGTGGS

SEQ ID NO: 214949 - protein, 23 aa, Mycobacterium bovis
GLPSRLRLGVCVTDAGRRNPAVT

SEQ ID NO: 214950 - protein, 19 aa, Mycobacterium bovis
GLSSPVILGIGIGGAGGNG

SEQ ID NO: 214951 - protein, 24 aa, Mycobacterium bovis
GNFLSRSGAVGVLGIGPNNGFPGT

SEQ ID NO: 214952 - protein, 17 aa, Mycobacterium bovis
GNTGNWNIGIGITGNGQ

SEQ ID NO: 214953 - protein, 17 aa, Mycobacterium bovis
GPTRDWECYCGKYKRAP

SEQ ID NO: 214954 - protein, 17 aa, Mycobacterium bovis
GPTRDWECYCGKYKRVP

SEQ ID NO: 214955 - protein, 17 aa, Mycobacterium bovis
GPTRDWECYCGKYKRVR

SEQ ID NO: 214956 - protein, 18 aa, Mycobacterium bovis
GQITGLRSGFGGAGGAGG

SEQ ID NO: 214957 - protein, 17 aa, Mycobacterium bovis
GQMVPVLLDTGSTGLVM

SEQ ID NO: 214958 - protein, 19 aa, Mycobacterium bovis
GREIGCKLVSFGSGAHFCL

SEQ ID NO: 214959 - protein, 17 aa, Mycobacterium bovis
GSCPLWVVHDAFAQPER

SEQ ID NO: 214960 - protein, 17 aa, Mycobacterium bovis
GSDALALGQPGGNGGQG

SEQ ID NO: 214961 - protein, 25 aa, Mycobacterium bovis
GSGAPGGHGGWLFGGGGTGGSGVSG

SEQ ID NO: 214962 - protein, 17 aa, Mycobacterium bovis
GSVIARLTGMHWWGPAS

SEQ ID NO: 214963 - protein, 21 aa, Mycobacterium bovis
GTATAALLMQATAGRVATAAT

SEQ ID NO: 214964 - protein, 25 aa, Mycobacterium bovis
GTDKRASGVIPRYGVRLTVMSRPPA

SEQ ID NO: 214965 - protein, 20 aa, Mycobacterium bovis
GVAGVSFGNAVGGDGGNGGN

SEQ ID NO: 214966 - protein, 23 aa, Mycobacterium bovis
GVRTNTWWLPAMQSLYETDYGPV

SEQ ID NO: 214967 - protein, 19 aa, Mycobacterium bovis
GYDLTRWLATKGMELTWRS

SEQ ID NO: 214968 - protein, 19 aa, Mycobacterium bovis
HDIGYRIAHHADLTTPPPI

SEQ ID NO: 214969 - protein, 20 aa, Mycobacterium bovis
HGGSAAKLFGDGGAGGAGGM

SEQ ID NO: 214970 - protein, 22 aa, Mycobacterium bovis
HPDFLRLFYLLSMERSQDPVVA

SEQ ID NO: 214971 - protein, 19 aa, Mycobacterium bovis
HPDLFWALRGGGGGNFGVT

SEQ ID NO: 214972 - protein, 18 aa, Mycobacterium bovis
IAAVQGWCIGGAVDLISA

SEQ ID NO: 214973 - protein, 22 aa, Mycobacterium bovis
IASPPVKWPCFYGIDFPSPAEL

SEQ ID NO: 214974 - protein, 17 aa, Mycobacterium bovis
IAYRWFRAGLLPVPAQR

SEQ ID NO: 214975 - protein, 19 aa, Mycobacterium bovis
IERYRAATLMARVRAAKGM

SEQ ID NO: 214976 - protein, 18 aa, Mycobacterium bovis
IGVLFKRIFDRPARRPVR

SEQ ID NO: 214977 - protein, 17 aa, Mycobacterium bovis
IPGAVKIDWHTDLNDPR

SEQ ID NO: 214978 - protein, 25 aa, Mycobacterium bovis
ISAQVAAYHQQFVQTLRTGAASYML

SEQ ID NO: 214979 - protein, 17 aa, Mycobacterium bovis
ISIPSCRPGWCGPITAS

SEQ ID NO: 214980 - protein, 17 aa, Mycobacterium bovis
IVKYLAYGWSSLRSRPA

SEQ ID NO: 214981 - protein, 19 aa, Mycobacterium bovis
KAIAAFSRWYAGEIDLHNP

SEQ ID NO: 214982 - protein, 17 aa, Mycobacterium bovis
KPGMTLLDIGCGWGTTM

SEQ ID NO: 214983 - protein, 24 aa, Mycobacterium bovis
KPPKVVSQRGWRHWVHALTRINLG

SEQ ID NO: 214984 - protein, 20 aa, Mycobacterium bovis
KPSRVPVWFMRQAGRSLPEY

SEQ ID NO: 214985 - protein, 17 aa, Mycobacterium bovis
KRCFNIMPADGRMTVQS

SEQ ID NO: 214986 - protein, 20 aa, Mycobacterium bovis
KRFADRFARFNLQERVIRPS

SEQ ID NO: 214987 - protein, 19 aa, Mycobacterium bovis
KRRMFDLLVRMGYKEIEVG

SEQ ID NO: 214988 - protein, 24 aa, Mycobacterium bovis
LADEAFRLLGHFDVVFSNAGIVVG

SEQ ID NO: 214989 - protein, 18 aa, Mycobacterium bovis
LADQAVRQWGFMQGLKQK

SEQ ID NO: 214990 - protein, 21 aa, Mycobacterium bovis
LALQFGWRLFAPMLRSATGID

SEQ ID NO: 214991 - protein, 18 aa, Mycobacterium bovis
LAPWGARCCWTRRTGSGR

SEQ ID NO: 214992 - protein, 18 aa, Mycobacterium bovis
LARFGAWYEMFPRSTGGW

SEQ ID NO: 214993 - protein, 23 aa, Mycobacterium bovis
LDIPRVPVTLNYLFGSQPGGPLK

SEQ ID NO: 214994 - protein, 24 aa, Mycobacterium bovis
LDIYRIGQNVAWRRWTDIAFGLTS

SEQ ID NO: 214995 - protein, 17 aa, Mycobacterium bovis
LDRKNCWTIAEHRGDTT

SEQ ID NO: 214996 - protein, 17 aa, Mycobacterium bovis
LEPMAGKIIHCGAAGAG

SEQ ID NO: 214997 - protein, 19 aa, Mycobacterium bovis
LFYSGFYLPMYWSSRGKLT

SEQ ID NO: 214998 - protein, 20 aa, Mycobacterium bovis
LILRRPRAGLSYEALLETVE

SEQ ID NO: 214999 - protein, 19 aa, Mycobacterium bovis
LLEYHWGPDWVVWDAAKTA

SEQ ID NO: 215000 - protein, 20 aa, Mycobacterium bovis
LMPASSAARCAARIVGGPRL

SEQ ID NO: 215001 - protein, 18 aa, Mycobacterium bovis
LNGPRYWLMNAIEKAPQG

SEQ ID NO: 215002 - protein, 17 aa, Mycobacterium bovis
LPGPRLLHDMAFTENYV

SEQ ID NO: 215003 - protein, 22 aa, Mycobacterium bovis
LPPEINSALMFAGAGPGPMLAA

SEQ ID NO: 215004 - protein, 17 aa, Mycobacterium bovis
LPVGLAVTAAVVAPRRF

SEQ ID NO: 215005 - protein, 18 aa, Mycobacterium bovis
LPWGNGIVSLTPAPDHVR

SEQ ID NO: 215006 - protein, 18 aa, Mycobacterium bovis
LPYFSIGMGNNFIQAAKT

SEQ ID NO: 215007 - protein, 17 aa, Mycobacterium bovis
LQSVLYLRFREWFLPAM

SEQ ID NO: 215008 - protein, 20 aa, Mycobacterium bovis
LQWLGIDCIWLPPFYDSPLR

SEQ ID NO: 215009 - protein, 18 aa, Mycobacterium bovis
LRAVGDWLVRPGAQLQAV

SEQ ID NO: 215010 - protein, 17 aa, Mycobacterium bovis
LRAVLVPHALRLREAAL

SEQ ID NO: 215011 - protein, 17 aa, Mycobacterium bovis
LRFCLERGYQLRVIEQM

SEQ ID NO: 215012 - protein, 17 aa, Mycobacterium bovis
LRPGGLFAVEHDDTTSS

SEQ ID NO: 215013 - protein, 18 aa, Mycobacterium bovis
LRTGMMGVWIGAIQNMYP

SEQ ID NO: 215014 - protein, 22 aa, Mycobacterium bovis
LRWGEYRAGGLARARWGLLEPP

SEQ ID NO: 215015 - protein, 17 aa, Mycobacterium bovis
LRYGRIPARVSGPDPVP

SEQ ID NO: 215016 - protein, 20 aa, Mycobacterium bovis
LSFRWSCRMGICGSSGMTIN

SEQ ID NO: 215017 - protein, 22 aa, Mycobacterium bovis
LSLPRRLQIEFSQVIQKIAEGT

SEQ ID NO: 215018 - protein, 20 aa, Mycobacterium bovis
LSYKTGWYGSALVVADRWFP

SEQ ID NO: 215019 - protein, 19 aa, Mycobacterium bovis
LTRMQRFWISLYFPLTMRS

SEQ ID NO: 215020 - protein, 22 aa, Mycobacterium bovis
LVPEYIGNLLLYFQPDATVTML

SEQ ID NO: 215021 - protein, 17 aa, Mycobacterium bovis
LVSFGSGAHFCLGAHLA

SEQ ID NO: 215022 - protein, 20 aa, Mycobacterium bovis
MALLGRPLIGHGADGAPGTG

SEQ ID NO: 215023 - protein, 17 aa, Mycobacterium bovis
MGGITIAAWSDRYRHKV

SEQ ID NO: 215024 - protein, 17 aa, Mycobacterium bovis
MLPHNAVEYFVSYYDYY

SEQ ID NO: 215025 - protein, 20 aa, Mycobacterium bovis
MPLTWATRTLSWWSVTPRTT

SEQ ID NO: 215026 - protein, 19 aa, Mycobacterium bovis
MRWGLIPSWIKAGPGGAPD

SEQ ID NO: 215027 - protein, 26 aa, Mycobacterium bovis
MSAQAAAFHARFVQALAGAMGAYAAA

SEQ ID NO: 215028 - protein, 19 aa, Mycobacterium bovis
MSVDCARYWLDADKPISKS

SEQ ID NO: 215029 - protein, 18 aa, Mycobacterium bovis
MVEAAICDGDWVVVRQQN

SEQ ID NO: 215030 - protein, 17 aa, Mycobacterium bovis
NGGDAEPGVPPGAGGAG

SEQ ID NO: 215031 - protein, 19 aa, Mycobacterium bovis
NGGDAGWLIGNGGAGGSGA

SEQ ID NO: 215032 - protein, 24 aa, Mycobacterium bovis
NGGGALNQAGFFGTGGKGGNGGNG

SEQ ID NO: 215033 - protein, 28 aa, Mycobacterium bovis
NGGIGGKGGDAFATFAKAGNGGAGGNGG

SEQ ID NO: 215034 - protein, 23 aa, Mycobacterium bovis
NGGKGGTGLMPGINGTGGAGGSR

SEQ ID NO: 215035 - protein, 27 aa, Mycobacterium bovis
NGGLGGDGFTYLADLTESLAATEVTAA

SEQ ID NO: 215036 - protein, 18 aa, Mycobacterium bovis
NLRIARVLYDFVNNEALP

SEQ ID NO: 215037 - protein, 17 aa, Mycobacterium bovis
NLVEYGFRLPSACDNRP

SEQ ID NO: 215038 - protein, 20 aa, Mycobacterium bovis
NPDYLPGALLPPSIHATADA

SEQ ID NO: 215039 - protein, 17 aa, Mycobacterium bovis
PALPVGLAVTAAVVAPR

SEQ ID NO: 215040 - protein, 20 aa, Mycobacterium bovis
PEINSALMFAGAGPGPMLAA

SEQ ID NO: 215041 - protein, 23 aa, Mycobacterium bovis
PFWDRLRFPAALDRVQVPVLLVG

SEQ ID NO: 215042 - protein, 17 aa, Mycobacterium bovis
PGDFFPVPCCFPSCRSI

SEQ ID NO: 215043 - protein, 18 aa, Mycobacterium bovis
PGDGVGKAPHGGAGGSGG

SEQ ID NO: 215044 - protein, 21 aa, Mycobacterium bovis
PGRWGRTAVCARLSSADQKVD

SEQ ID NO: 215045 - protein, 17 aa, Mycobacterium bovis
PGSIALALGGPVTGGVT

SEQ ID NO: 215046 - protein, 21 aa, Mycobacterium bovis
PHARLPLPLARDEIRYLGTTF

SEQ ID NO: 215047 - protein, 19 aa, Mycobacterium bovis
PKVVICLVNGWAAGGGHSL

SEQ ID NO: 215048 - protein, 22 aa, Mycobacterium bovis
PLPSTRQRLGWALRDLPSRLGK

SEQ ID NO: 215049 - protein, 18 aa, Mycobacterium bovis
PPFWQNLAELGWLGLHID

SEQ ID NO: 215050 - protein, 17 aa, Mycobacterium bovis
PTGEWSAAVSRLAAAEA

SEQ ID NO: 215051 - protein, 17 aa, Mycobacterium bovis
PVGRLSVPPSWAVAAPA

SEQ ID NO: 215052 - protein, 20 aa, Mycobacterium bovis
QALLGRPLIGNGANGADGTG

SEQ ID NO: 215053 - protein, 19 aa, Mycobacterium bovis
QAVTGRPLIGNGANGAPGS

SEQ ID NO: 215054 - protein, 17 aa, Mycobacterium bovis
QFSCWRIKLPHVEAAKF

SEQ ID NO: 215055 - protein, 19 aa, Mycobacterium bovis
QQQCTDWAKALFRAVGPQR

SEQ ID NO: 215056 - protein, 17 aa, Mycobacterium bovis
QRPGRRRVLTIANQKGG

SEQ ID NO: 215057 - protein, 24 aa, Mycobacterium bovis
QTLRTGAASYMLAEATNVEQNLLN

SEQ ID NO: 215058 - protein, 22 aa, Mycobacterium bovis
RAEGRYALMPGIIGALAASGTP

SEQ ID NO: 215059 - protein, 17 aa, Mycobacterium bovis
RAHRGIVAVNELPDLAE

SEQ ID NO: 215060 - protein, 19 aa, Mycobacterium bovis
RAPFKGIICERCGVEVTRA

SEQ ID NO: 215061 - protein, 18 aa, Mycobacterium bovis
RARKLPDWPTGPLPKVRV

SEQ ID NO: 215062 - protein, 18 aa, Mycobacterium bovis
RDFARASFSYGLNAKWPV

SEQ ID NO: 215063 - protein, 24 aa, Mycobacterium bovis
RDFARASFSYGLNAKWPVYLSTKN

SEQ ID NO: 215064 - protein, 17 aa, Mycobacterium bovis
REACLWSAGLAGSGIRR

SEQ ID NO: 215065 - protein, 24 aa, Mycobacterium bovis
RFIRDTTWVSVRWYRPGGPLTAQQ

SEQ ID NO: 215066 - protein, 22 aa, Mycobacterium bovis
RFNKPGTFPLRFQTEVRDGCPS

SEQ ID NO: 215067 - protein, 18 aa, Mycobacterium bovis
RGRLGLLELRGFEMPPHL

SEQ ID NO: 215068 - protein, 22 aa, Mycobacterium bovis
RGVIPRDHIKAVLDAADVLIWM

SEQ ID NO: 215069 - protein, 18 aa, Mycobacterium bovis
RIAQAVVVAATRNYGVPD

SEQ ID NO: 215070 - protein, 17 aa, Mycobacterium bovis
RIRVVPFEVVIPADEQD

SEQ ID NO: 215071 - protein, 17 aa, Mycobacterium bovis
RIYTDFTYRSGSTTIST

SEQ ID NO: 215072 - protein, 20 aa, Mycobacterium bovis
RKRRMFDLLVRMGYKEIEVG

SEQ ID NO: 215073 - protein, 21 aa, Mycobacterium bovis
RKRRMFDLLVRMGYKEIEVGF

SEQ ID NO: 215074 - protein, 18 aa, Mycobacterium bovis
RKVLELAAALSDDFERAG

SEQ ID NO: 215075 - protein, 19 aa, Mycobacterium bovis
RMHLLRLASEFGLTPAAEQ

SEQ ID NO: 215076 - protein, 17 aa, Mycobacterium bovis
RMTWRSCRAGDFIDICN

SEQ ID NO: 215077 - protein, 26 aa, Mycobacterium bovis
RNPERVWGWYLWRHYLVANVEPNDGH

SEQ ID NO: 215078 - protein, 18 aa, Mycobacterium bovis
RPEFKAMFLDDLLNGSRK

SEQ ID NO: 215079 - protein, 17 aa, Mycobacterium bovis
RPGAIIRDLNLLRPIYA

SEQ ID NO: 215080 - protein, 20 aa, Mycobacterium bovis
RPGQKLRIVKYLAYGWSSLR

SEQ ID NO: 215081 - protein, 18 aa, Mycobacterium bovis
RPLVPAMFSAVLSRLRRT

SEQ ID NO: 215082 - protein, 19 aa, Mycobacterium bovis
RPLVPAMFSAVLSRLRRTH

SEQ ID NO: 215083 - protein, 19 aa, Mycobacterium bovis
RPSDSVAIALRVGVPIYVE

SEQ ID NO: 215084 - protein, 22 aa, Mycobacterium bovis
RPSGLPGLRHKYSLDIAPGNFV

SEQ ID NO: 215085 - protein, 19 aa, Mycobacterium bovis
RRFTAKLSYRGRAFATVPI

SEQ ID NO: 215086 - protein, 25 aa, Mycobacterium bovis
RRPTGQRGFFAWFRVGSDVLVRNAF

SEQ ID NO: 215087 - protein, 24 aa, Mycobacterium bovis
RSPAYCFTLPFAHQALMPINVVAT

SEQ ID NO: 215088 - protein, 19 aa, Mycobacterium bovis
RTGNVCLVTLGLNLFSRGV

SEQ ID NO: 215089 - protein, 20 aa, Mycobacterium bovis
RTGNVCLVTLGLNLFSRGVD

SEQ ID NO: 215090 - protein, 21 aa, Mycobacterium bovis
RTRKAGAVGLVMAEPLTYFFS

SEQ ID NO: 215091 - protein, 18 aa, Mycobacterium bovis
RVAHCIYAGLATDTGSFR

SEQ ID NO: 215092 - protein, 17 aa, Mycobacterium bovis
RVKQLLLKIGWPAEDLA

SEQ ID NO: 215093 - protein, 17 aa, Mycobacterium bovis
RVLRNLGLVVGDRAGRS

SEQ ID NO: 215094 - protein, 18 aa, Mycobacterium bovis
RWAFGIGCAAGPGLDPRR

SEQ ID NO: 215095 - protein, 21 aa, Mycobacterium bovis
RWSAVLVGAWWPAPSAALRAA

SEQ ID NO: 215096 - protein, 18 aa, Mycobacterium bovis
RYFWSRVIADTGWQLLDS

SEQ ID NO: 215097 - protein, 20 aa, Mycobacterium bovis
SALNRPAMRFERPVLAIAAT

SEQ ID NO: 215098 - protein, 25 aa, Mycobacterium bovis
SARAAAFHERFVQALATGGGAYAAA

SEQ ID NO: 215099 - protein, 17 aa, Mycobacterium bovis
SDWLTARLVDLDSGDIE

SEQ ID NO: 215100 - protein, 17 aa, Mycobacterium bovis
SEVVEPWSLRLSHPELL

SEQ ID NO: 215101 - protein, 18 aa, Mycobacterium bovis
SGGANFNGGTGGTGGTGG

SEQ ID NO: 215102 - protein, 18 aa, Mycobacterium bovis
SKLGGLWKTVSPHLSPIS

SEQ ID NO: 215103 - protein, 19 aa, Mycobacterium bovis
SKLGGLWKTVSPHLSPISN

SEQ ID NO: 215104 - protein, 19 aa, Mycobacterium bovis
SLWRSSFSWWWKVLVRGWP

SEQ ID NO: 215105 - protein, 19 aa, Mycobacterium bovis
SRAVSWWSVHEHVAPVLDA

SEQ ID NO: 215106 - protein, 18 aa, Mycobacterium bovis
SRIPMWVEETLRYDTSSQ

SEQ ID NO: 215107 - protein, 24 aa, Mycobacterium bovis
SVLPPEINSALMFAGAGPGPMLAA

SEQ ID NO: 215108 - protein, 17 aa, Mycobacterium bovis
SVVRAFFNVVPFAVRAR

SEQ ID NO: 215109 - protein, 19 aa, Mycobacterium bovis
SVVVAESWRASALAEMIQE

SEQ ID NO: 215110 - protein, 17 aa, Mycobacterium bovis
TAIAALFGSHGQHYQAI

SEQ ID NO: 215111 - protein, 18 aa, Mycobacterium bovis
TAPLTLFGHCMGAIVAFE

SEQ ID NO: 215112 - protein, 21 aa, Mycobacterium bovis
TAYRWFRAGLLSVMARRVGRL

SEQ ID NO: 215113 - protein, 21 aa, Mycobacterium bovis
TDMPGRFVVAAAMVRHLLTDP

SEQ ID NO: 215114 - protein, 17 aa, Mycobacterium bovis
TGGFGFAAGGQGGVGGS

SEQ ID NO: 215115 - protein, 18 aa, Mycobacterium bovis
TGNVCLVTLGLNLFSRGV

SEQ ID NO: 215116 - protein, 19 aa, Mycobacterium bovis
THCNLDCPICFADSGHQPD

SEQ ID NO: 215117 - protein, 18 aa, Mycobacterium bovis
TIRLPVHLVEQVNKLARI

SEQ ID NO: 215118 - protein, 17 aa, Mycobacterium bovis
TLFRRFGSRAGLMMVLL

SEQ ID NO: 215119 - protein, 19 aa, Mycobacterium bovis
TLLGRPLIGNGADGSTPGQ

SEQ ID NO: 215120 - protein, 22 aa, Mycobacterium bovis
TLPPEINSALIFGGAGSEPMSA

SEQ ID NO: 215121 - protein, 18 aa, Mycobacterium bovis
TNVAPAYRSSVSASVSAS

SEQ ID NO: 215122 - protein, 20 aa, Mycobacterium bovis
TPEQWWPFIGNLSLDQSIAQ

SEQ ID NO: 215123 - protein, 25 aa, Mycobacterium bovis
TPGGNGGDGGWLFGSGGNGAPGAAG

SEQ ID NO: 215124 - protein, 17 aa, Mycobacterium bovis
TPRMRIGIHTGRPQRLA

SEQ ID NO: 215125 - protein, 24 aa, Mycobacterium bovis
TQAAAFHSRFVQALTTAAASYASV

SEQ ID NO: 215126 - protein, 24 aa, Mycobacterium bovis
TQTLLGRPLIGDGANATTPGGAGG

SEQ ID NO: 215127 - protein, 24 aa, Mycobacterium bovis
TRTLKGWADRGVRVIGLDAGGGTA

SEQ ID NO: 215128 - protein, 19 aa, Mycobacterium bovis
TTARLTGRWLRGRLPTLND

SEQ ID NO: 215129 - protein, 17 aa, Mycobacterium bovis
TVARQEPGLSWAAGLRD

SEQ ID NO: 215130 - protein, 18 aa, Mycobacterium bovis
TVVCAALASAARQAGIDV

SEQ ID NO: 215131 - protein, 24 aa, Mycobacterium bovis
VAAYQERFVLALSQAGSTYAVAEA

SEQ ID NO: 215132 - protein, 17 aa, Mycobacterium bovis
VAPYVAWMRATAIQAEQ

SEQ ID NO: 215133 - protein, 20 aa, Mycobacterium bovis
VATAATAAWVGPGETVAPPV

SEQ ID NO: 215134 - protein, 22 aa, Mycobacterium bovis
VAVRRISMSFVNVAPQLVSTAA

SEQ ID NO: 215135 - protein, 23 aa, Mycobacterium bovis
VAVRRISMSFVNVAPQLVSTAAA

SEQ ID NO: 215136 - protein, 17 aa, Mycobacterium bovis
VEWSHPLGHRWRWEFES

SEQ ID NO: 215137 - protein, 22 aa, Mycobacterium bovis
VGGNGGRGGWLLGNGGAGGVGG

SEQ ID NO: 215138 - protein, 18 aa, Mycobacterium bovis
VGLAVTAAVVAPRRFTKT

SEQ ID NO: 215139 - protein, 17 aa, Mycobacterium bovis
VGPTILRHWSHPATVLV

SEQ ID NO: 215140 - protein, 22 aa, Mycobacterium bovis
VGYAACHWCHVMAHESFDDDEV

SEQ ID NO: 215141 - protein, 19 aa, Mycobacterium bovis
VIRTLRRLGIRSVAVYSDP

SEQ ID NO: 215142 - protein, 19 aa, Mycobacterium bovis
VKFACAWTYIALDPAVVQS

SEQ ID NO: 215143 - protein, 21 aa, Mycobacterium bovis
VKLAEALGCVGLRCEREEDVV

SEQ ID NO: 215144 - protein, 20 aa, Mycobacterium bovis
VLAIWPDWVRRWPTPSATAT

SEQ ID NO: 215145 - protein, 19 aa, Mycobacterium bovis
VMGGMPCIRGLRIPVATVV

SEQ ID NO: 215146 - protein, 19 aa, Mycobacterium bovis
VPCCFPSCRSITYLLTDGE

SEQ ID NO: 215147 - protein, 17 aa, Mycobacterium bovis
VPFKGIICERCGVEVTR

SEQ ID NO: 215148 - protein, 17 aa, Mycobacterium bovis
VPHTWLWAMPMSGPTGG

SEQ ID NO: 215149 - protein, 17 aa, Mycobacterium bovis
VPPTWQGSIPISMASSA

SEQ ID NO: 215150 - protein, 21 aa, Mycobacterium bovis
VPRRCCRPGCPHYAVATLTFV

SEQ ID NO: 215151 - protein, 18 aa, Mycobacterium bovis
VQAQKLWAQAGFRPVDPA

SEQ ID NO: 215152 - protein, 22 aa, Mycobacterium bovis
VQRYEVVDLLSLLADKSLVVTD

SEQ ID NO: 215153 - protein, 23 aa, Mycobacterium bovis
VQSVLLPRLLDWMSYAPDPDGGL

SEQ ID NO: 215154 - protein, 17 aa, Mycobacterium bovis
VSCAGLVIGSWPDPPGL

SEQ ID NO: 215155 - protein, 20 aa, Mycobacterium bovis
VSTAIAALFGSHGQHYQAIS

SEQ ID NO: 215156 - protein, 25 aa, Mycobacterium bovis
VVCSEILPRWGVQTVFVDGDDLSQW

SEQ ID NO: 215157 - protein, 18 aa, Mycobacterium bovis
VVVMPWDRHIAAGTEISL

SEQ ID NO: 215158 - protein, 17 aa, Mycobacterium bovis
WGVPGLSWLPGEDPDPF

SEQ ID NO: 215159 - protein, 17 aa, Mycobacterium bovis
WLPGPRELRAWTLAAGS

SEQ ID NO: 215160 - protein, 17 aa, Mycobacterium bovis
WLTARLVDLDSGDIETL

SEQ ID NO: 215161 - protein, 17 aa, Mycobacterium bovis
WPFIGNLSLDQSIAQGV

SEQ ID NO: 215162 - protein, 17 aa, Mycobacterium bovis
WRALGWIGPEAAEAAAA

SEQ ID NO: 215163 - protein, 17 aa, Mycobacterium bovis
WRGKKALLLQGRLWQGN

SEQ ID NO: 215164 - protein, 17 aa, Mycobacterium bovis
WTLLILREAFFGVRRFG

SEQ ID NO: 215165 - protein, 17 aa, Mycobacterium bovis
WVIAYRWFRAGLLPVPA

SEQ ID NO: 215166 - protein, 18 aa, Mycobacterium bovis
WWQRAVAVWPDYASYQTK

SEQ ID NO: 215167 - protein, 21 aa, Mycobacterium bovis
YDILFFWVARMMMFGTFVGDD

SEQ ID NO: 215168 - protein, 18 aa, Mycobacterium bovis
YFSLSLWSAYNVMLMHTV

SEQ ID NO: 215169 - protein, 17 aa, Mycobacterium bovis
YRGVGQGSLQFAITSPD

SEQ ID NO: 215170 - protein, 21 aa, Mycobacterium bovis
YYQRFGFRVTREIALPDAGPP

SEQ ID NO: 215171 - protein, 24 aa, Mycobacterium bovis
EDGAGWLAFFRDLVARGLSGVALV

SEQ ID NO: 215172 - protein, 26 aa, Mycobacterium bovis
RQGSYFPDWLLQRRKRAERALTSVVA

SEQ ID NO: 215173 - protein, 28 aa, Mycobacterium bovis
ARTDLLAFTAFPKQIWRQIWSNNPQERL

SEQ ID NO: 215174 - protein, 22 aa, Mycobacterium bovis
GATLPAAAWQRCRTHYAANLMA

SEQ ID NO: 215175 - protein, 18 aa, Mycobacterium bovis
LLSTFIAALMGAEADALC

SEQ ID NO: 215176 - protein, 24 aa, Mycobacterium bovis
TPKPSWPWVRTLLHSIYDQPDAES

SEQ ID NO: 215177 - protein, 23 aa, Mycobacterium bovis
TRPLDAGPYTFLAADALVLKVRE

SEQ ID NO: 215178 - protein, 20 aa, Mycobacterium bovis
VVGIFPDRASIIRLVGAVLA

SEQ ID NO: 215179 - protein, 18 aa, Mycobacterium bovis
GDCLAPPRPVLRAALSPG

SEQ ID NO: 215180 - protein, 21 aa, Mycobacterium bovis
TIPGFAINPFGLDVPLSGGTN

SEQ ID NO: 215181 - protein, 36 aa, Mycobacterium bovis
AAAEAAATSPLLAPINEFFLANTGRPLIGNGANGAP

SEQ ID NO: 215182 - protein, 31 aa, Mycobacterium bovis
AGPFDNWPLGWGFDHFWGFPSGAAGQYDPII

SEQ ID NO: 215183 - protein, 22 aa, Mycobacterium bovis
AKPLALYHTKRLASPAQRIMLY

SEQ ID NO: 215184 - protein, 20 aa, Mycobacterium bovis
ALAAHRRAHGLPAISLGWGL

SEQ ID NO: 215185 - protein, 21 aa, Mycobacterium bovis
ARAPVAPGLALPRLVRSRIVK

SEQ ID NO: 215186 - protein, 22 aa, Mycobacterium bovis
ARYAQRVMDWLHPDGDLTDTER

SEQ ID NO: 215187 - protein, 23 aa, Mycobacterium bovis
AVEVGRRVIFMVTGVLPTEDEIS

SEQ ID NO: 215188 - protein, 17 aa, Mycobacterium bovis
DDPFTVPNLVWASFLRL

SEQ ID NO: 215189 - protein, 17 aa, Mycobacterium bovis
FARGLVRKTYLARAPVA

SEQ ID NO: 215190 - protein, 20 aa, Mycobacterium bovis
IASELILPIAVAVQNRITVN

SEQ ID NO: 215191 - protein, 21 aa, Mycobacterium bovis
LGIPIMGDPLYPNVISVAAHD

SEQ ID NO: 215192 - protein, 37 aa, Mycobacterium bovis
LSLTTLAPHLVKPLPFLFPLTKRWWERPYIAAGIFLY

SEQ ID NO: 215193 - protein, 19 aa, Mycobacterium bovis
LVLQRLSDARRLGHPVLAV

SEQ ID NO: 215194 - protein, 24 aa, Mycobacterium bovis
NPDRTRLPLPQRRFGGVVGRTMAE

SEQ ID NO: 215195 - protein, 24 aa, Mycobacterium bovis
QNATKPWMLYYATGATHAPHHVFK

SEQ ID NO: 215196 - protein, 23 aa, Mycobacterium bovis
RLDRLTAGVLLFTTRREVRGSYQ

SEQ ID NO: 215197 - protein, 19 aa, Mycobacterium bovis
RNCFADMAKVAIALGDSAR

SEQ ID NO: 215198 - protein, 25 aa, Mycobacterium bovis
RRFSDHRLILEGIAWRFRTGSPWRD

SEQ ID NO: 215199 - protein, 25 aa, Mycobacterium bovis
RSVFEHRAVVVGGDRDRLLAGLDEL

SEQ ID NO: 215200 - protein, 21 aa, Mycobacterium bovis
RWWERPYIAAGIFLYDRLGGA

SEQ ID NO: 215201 - protein, 33 aa, Mycobacterium bovis
SEVFDLTPLTLPTPAQLALRRSVIRRAGAVIDA

SEQ ID NO: 215202 - protein, 17 aa, Mycobacterium bovis
SFLDALAAHRRAHGLPA

SEQ ID NO: 215203 - protein, 25 aa, Mycobacterium bovis
SVAARTIMLPLRTNARAKMSEMRHG

SEQ ID NO: 215204 - protein, 24 aa, Mycobacterium bovis
VVPRREAGWAGPVVPWVVSAKSES

SEQ ID NO: 215205 - protein, 31 aa, Mycobacterium bovis
WGAGVGLAIGLFSPALLASAALGAATGALAG

SEQ ID NO: 215206 - protein, 23 aa, Mycobacterium bovis
AALRELTLLLIYEATRDAPCEPV

SEQ ID NO: 215207 - protein, 23 aa, Mycobacterium bovis
AAYESFLQFRPWGFDLAEVAVPT

SEQ ID NO: 215208 - protein, 22 aa, Mycobacterium bovis
AELAIRFRDKGVVGFDIAGAEA

SEQ ID NO: 215209 - protein, 23 aa, Mycobacterium bovis
DAMAVGLAAWRLGAGRSRPGARV

SEQ ID NO: 215210 - protein, 26 aa, Mycobacterium bovis
DEQMSALLMAIVWRGMDRGEIARWTA

SEQ ID NO: 215211 - protein, 20 aa, Mycobacterium bovis
DRYTLWAPRWRDAGDEWEAF

SEQ ID NO: 215212 - protein, 17 aa, Mycobacterium bovis
DTEWLPPPHLDHGQPRI

SEQ ID NO: 215213 - protein, 24 aa, Mycobacterium bovis
DVAVVLGSGWLPAVAALGSPTTVL

SEQ ID NO: 215214 - protein, 31 aa, Mycobacterium bovis
DVCREEMQRLGREPLLPALEAELPLGSTDMG

SEQ ID NO: 215215 - protein, 17 aa, Mycobacterium bovis
EVRNCFADMAKVAIALG

SEQ ID NO: 215216 - protein, 17 aa, Mycobacterium bovis
FRLIAIDRPGYGRSTFQ

SEQ ID NO: 215217 - protein, 32 aa, Mycobacterium bovis
GERILTWRQLYDLDALPDHLIVVGSGVTGAEF

SEQ ID NO: 215218 - protein, 24 aa, Mycobacterium bovis
GFQLGRLAAILRDKRIPLELCPSS

SEQ ID NO: 215219 - protein, 30 aa, Mycobacterium bovis
GGTGGAGMNSLDPLLAAQDGGQGGTGGTGG

SEQ ID NO: 215220 - protein, 18 aa, Mycobacterium bovis
GMDRGEIARWTAAMLASG

SEQ ID NO: 215221 - protein, 24 aa, Mycobacterium bovis
GNVTQVLPGIHPVIGLDAGAATVH

SEQ ID NO: 215222 - protein, 24 aa, Mycobacterium bovis
HGLATQLMDWLHPDGNFSDQERAR

SEQ ID NO: 215223 - protein, 25 aa, Mycobacterium bovis
HLVKTFWGWRDQQLPDGTLILTSPS

SEQ ID NO: 215224 - protein, 18 aa, Mycobacterium bovis
HTAILLGAALALASVPEL

SEQ ID NO: 215225 - protein, 18 aa, Mycobacterium bovis
ITLPLVPVVAACGGAVPQ

SEQ ID NO: 215226 - protein, 26 aa, Mycobacterium bovis
KRFEVAAHEFLLFPTVAHSHAERVRP

SEQ ID NO: 215227 - protein, 33 aa, Mycobacterium bovis
LEELVRQAISALLLPLAIEHTLQYRRGVPPVVN

SEQ ID NO: 215228 - protein, 24 aa, Mycobacterium bovis
LRELQTRMFACFAAGALAAGCEYE

SEQ ID NO: 215229 - protein, 17 aa, Mycobacterium bovis
LYALRDITGTVESLPLI

SEQ ID NO: 215230 - protein, 17 aa, Mycobacterium bovis
PFDLLARARFRVTVNTD

SEQ ID NO: 215231 - protein, 24 aa, Mycobacterium bovis
PMTARFLSVVLRRIRGMRSDTREE

SEQ ID NO: 215232 - protein, 18 aa, Mycobacterium bovis
PPPHLDHGQPRINRYHHP

SEQ ID NO: 215233 - protein, 37 aa, Mycobacterium bovis
QIMTGTATFYTLRCYLDDRPIFLGRNGRISVFGSERA

SEQ ID NO: 215234 - protein, 17 aa, Mycobacterium bovis
RAPHLGFHIDFDDAKIS

SEQ ID NO: 215235 - protein, 20 aa, Mycobacterium bovis
RHGFVKIFCRRSTGVVIGGV

SEQ ID NO: 215236 - protein, 30 aa, Mycobacterium bovis
RPGEPVVVGEPLFTLYTNAPERFGAARAEL

SEQ ID NO: 215237 - protein, 23 aa, Mycobacterium bovis
RRAHGLPAISLGWGLWDQASAMT

SEQ ID NO: 215238 - protein, 26 aa, Mycobacterium bovis
RSGPRLFGALFAPLGWCAKYTPGLFS

SEQ ID NO: 215239 - protein, 24 aa, Mycobacterium bovis
SAQAQAFHAQFVQALTSGGGAYAA

SEQ ID NO: 215240 - protein, 18 aa, Mycobacterium bovis
SIAEHPFDLLARARFRVT

SEQ ID NO: 215241 - protein, 24 aa, Mycobacterium bovis
SLEMHRLVEAFGYGWSDLARFTVN

SEQ ID NO: 215242 - protein, 21 aa, Mycobacterium bovis
TAMDRFRWLVAAQGGDLSKPL

SEQ ID NO: 215243 - protein, 22 aa, Mycobacterium bovis
TGERADWWWYEPFQPQPPPISN

SEQ ID NO: 215244 - protein, 17 aa, Mycobacterium bovis
TGFRLIAIDRPGYGRST

SEQ ID NO: 215245 - protein, 17 aa, Mycobacterium bovis
TIRLAPKALLHDHLDGG

SEQ ID NO: 215246 - protein, 27 aa, Mycobacterium bovis
TPGSALLFPSLCHFSGGIPAPEADPPY

SEQ ID NO: 215247 - protein, 29 aa, Mycobacterium bovis
TVGSRLTKPPLLVPVLRAGLGMVDEAHAA

SEQ ID NO: 215248 - protein, 22 aa, Mycobacterium bovis
VAIGVLRQQLAPGQMVHGIVTD

SEQ ID NO: 215249 - protein, 19 aa, Mycobacterium bovis
VGIFPDRASIIRLVGAVLA

SEQ ID NO: 215250 - protein, 18 aa, Mycobacterium bovis
VLPQAELPGFVPPTAAGH

SEQ ID NO: 215251 - protein, 19 aa, Mycobacterium bovis
VVLVATGASPRILPSAQPD

SEQ ID NO: 215252 - protein, 25 aa, Mycobacterium bovis
WCAKYTPGLFSTLLAAAVPAADKHL

SEQ ID NO: 215253 - protein, 20 aa, Mycobacterium bovis
YCRTHHLVKTFWGWRDQQLP

SEQ ID NO: 215254 - protein, 29 aa, Mycobacterium bovis
AAAAMVVAAAPYAGWLAAAAARAGGAAVQ

SEQ ID NO: 215255 - protein, 25 aa, Mycobacterium bovis
AAAGFSVLLLPDPAPTPVVAFAVRH

SEQ ID NO: 215256 - protein, 18 aa, Mycobacterium bovis
AAFGMLPVGYYDLRTAES

SEQ ID NO: 215257 - protein, 28 aa, Mycobacterium bovis
AARITTPLLPDDYLHLANPLWSARELRG

SEQ ID NO: 215258 - protein, 24 aa, Mycobacterium bovis
AAYQERFVLALSQAGSTYAVAEAA

SEQ ID NO: 215259 - protein, 24 aa, Mycobacterium bovis
ACTRREPALTLQLPNRDPITGVHF

SEQ ID NO: 215260 - protein, 23 aa, Mycobacterium bovis
ADEFHPELQFDKPYLLAMANAGP

SEQ ID NO: 215261 - protein, 21 aa, Mycobacterium bovis
ADLELAVRCIVFAAAGTAGQR

SEQ ID NO: 215262 - protein, 24 aa, Mycobacterium bovis
ADQLLIVVALADPPPRTGLVDRAL

SEQ ID NO: 215263 - protein, 25 aa, Mycobacterium bovis
ADRHPGWHALRKIAARITTPLLPDD

SEQ ID NO: 215264 - protein, 25 aa, Mycobacterium bovis
AGTGWLPGWRLTFGGEDIGWEGALA

SEQ ID NO: 215265 - protein, 17 aa, Mycobacterium bovis
AIAEGILAAVKRLYLLG

SEQ ID NO: 215266 - protein, 18 aa, Mycobacterium bovis
APNRLWVADLTYVSTWAG

SEQ ID NO: 215267 - protein, 20 aa, Mycobacterium bovis
AQPFGDRLAAVPIDILWSPS

SEQ ID NO: 215268 - protein, 22 aa, Mycobacterium bovis
ARHTGKVVMLMPGSWAAGTVLI

SEQ ID NO: 215269 - protein, 24 aa, Mycobacterium bovis
ATDRFRLAVRELKWSASSPDIEAA

SEQ ID NO: 215270 - protein, 22 aa, Mycobacterium bovis
AVGHLLSAFVAITPLDPSQPDD

SEQ ID NO: 215271 - protein, 17 aa, Mycobacterium bovis
AVMFGDLPPLPTTARFS

SEQ ID NO: 215272 - protein, 34 aa, Mycobacterium bovis
AWESALRVPPYAGPPMWFHGDLSRFNILTAQGRL

SEQ ID NO: 215273 - protein, 23 aa, Mycobacterium bovis
CGPETLRSLYFLSSRVSGGSPHA

SEQ ID NO: 215274 - protein, 18 aa, Mycobacterium bovis
CQFSVGLSRQLYGRTIAS

SEQ ID NO: 215275 - protein, 27 aa, Mycobacterium bovis
DCRVHGRTWDLLRLTRMPTVQVDIGYI

SEQ ID NO: 215276 - protein, 34 aa, Mycobacterium bovis
DDIVAHFFVCSTHDLILFFTTQGRVYRAKAYDLP

SEQ ID NO: 215277 - protein, 24 aa, Mycobacterium bovis
DEFDIGKLRYHKIVLMADADVDGQ

SEQ ID NO: 215278 - protein, 20 aa, Mycobacterium bovis
DGVLVCVAQCRPNTGPTVVH

SEQ ID NO: 215279 - protein, 19 aa, Mycobacterium bovis
DHLHAVVGEWQLLADLSFA

SEQ ID NO: 215280 - protein, 29 aa, Mycobacterium bovis
DIDEIQAQAILDMQLRRLAALERQRIIDD

SEQ ID NO: 215281 - protein, 17 aa, Mycobacterium bovis
DNTLVFYIWGDNGASME

SEQ ID NO: 215282 - protein, 23 aa, Mycobacterium bovis
DPSVDLIIAWNLLSAPARAQFRV

SEQ ID NO: 215283 - protein, 18 aa, Mycobacterium bovis
DQLIRYYVDHQLDVIVRR

SEQ ID NO: 215284 - protein, 20 aa, Mycobacterium bovis
DREELVPMTPFERKIVHDAV

SEQ ID NO: 215285 - protein, 24 aa, Mycobacterium bovis
DRGRWGCVLGGRPDRRITAMRARE

SEQ ID NO: 215286 - protein, 25 aa, Mycobacterium bovis
DSATLFIKPGWGFSFDYQPGQYIGI

SEQ ID NO: 215287 - protein, 29 aa, Mycobacterium bovis
DTLVRMAQPWSLRYPLVDGQGNFGSPGND

SEQ ID NO: 215288 - protein, 17 aa, Mycobacterium bovis
DVVGVLRAVLFAPEDLG

SEQ ID NO: 215289 - protein, 21 aa, Mycobacterium bovis
DVWELYYLPDDFSQAKNLAAE

SEQ ID NO: 215290 - protein, 17 aa, Mycobacterium bovis
EAMLLMRAGREYALKRA

SEQ ID NO: 215291 - protein, 19 aa, Mycobacterium bovis
EDFSWYLEEVPGAMARLGV

SEQ ID NO: 215292 - protein, 17 aa, Mycobacterium bovis
EGGHRILANWLTCCGWT

SEQ ID NO: 215293 - protein, 25 aa, Mycobacterium bovis
ELKARFSRPLAFGTAGLRGHLRGGP

SEQ ID NO: 215294 - protein, 24 aa, Mycobacterium bovis
ERNRVLPLLGGLAVMFGDLPPLPT

SEQ ID NO: 215295 - protein, 19 aa, Mycobacterium bovis
ERSARWLDVVVHDDGLGLP

SEQ ID NO: 215296 - protein, 26 aa, Mycobacterium bovis
ESAARALLLPRRHPGRRSPLWQQRQR

SEQ ID NO: 215297 - protein, 29 aa, Mycobacterium bovis
EVERDLRVIIHGWLAFTFELCRQRIMDPS

SEQ ID NO: 215298 - protein, 28 aa, Mycobacterium bovis
FVLPDPAPPLILFLTAGSGITPVMSMLR

SEQ ID NO: 215299 - protein, 18 aa, Mycobacterium bovis
FVWPRFRRRGLARGLLST

SEQ ID NO: 215300 - protein, 24 aa, Mycobacterium bovis
GDRYAFDQLFRRHHRQLHRLARLT

SEQ ID NO: 215301 - protein, 23 aa, Mycobacterium bovis
GDTPPALRRQLVSQPPDVLITTP

SEQ ID NO: 215302 - protein, 22 aa, Mycobacterium bovis
GDYLEELLDVLDFDGDIDLDVE

SEQ ID NO: 215303 - protein, 24 aa, Mycobacterium bovis
GEAWSLAVALRLAAYQLLRVDGGE

SEQ ID NO: 215304 - protein, 25 aa, Mycobacterium bovis
GGATVLLRTLPLVVAGRNVGAAILI

SEQ ID NO: 215305 - protein, 24 aa, Mycobacterium bovis
GGKVTAWRYIRAAVRAVLACTRRE

SEQ ID NO: 215306 - protein, 23 aa, Mycobacterium bovis
GILAAVKRLYLLGKNDRPTGTFT

SEQ ID NO: 215307 - protein, 27 aa, Mycobacterium bovis
GLKPVHRRVLYAMFDSGFRPDRSHAKS

SEQ ID NO: 215308 - protein, 17 aa, Mycobacterium bovis
GLRIVIEIKRDAVAKVV

SEQ ID NO: 215309 - protein, 27 aa, Mycobacterium bovis
GLVDRALIAAYAGGLTPILCLTKTDLA

SEQ ID NO: 215310 - protein, 22 aa, Mycobacterium bovis
GPFYDGAVFHRVIQGFMIQGGD

SEQ ID NO: 215311 - protein, 27 aa, Mycobacterium bovis
GPMLAAAAAWDGLAAELGLAAESFGLV

SEQ ID NO: 215312 - protein, 23 aa, Mycobacterium bovis
GRQVFKDYVAFPALTSLSPGATY

SEQ ID NO: 215313 - protein, 19 aa, Mycobacterium bovis
GVRVGVETALLGRFFERFA

SEQ ID NO: 215314 - protein, 21 aa, Mycobacterium bovis
HGHTEWLPPPHLDHGQPRTNT

SEQ ID NO: 215315 - protein, 25 aa, Mycobacterium bovis
HKVKSRTFHYPGGLVDFVKHINRTK

SEQ ID NO: 215316 - protein, 23 aa, Mycobacterium bovis
HLETAYRLCATDLLRMLAEGTFP

SEQ ID NO: 215317 - protein, 31 aa, Mycobacterium bovis
HQKTGVWSRLMLDIARWRRRRREELAALADE

SEQ ID NO: 215318 - protein, 18 aa, Mycobacterium bovis
HRLLETWHPLGVVGVITA

SEQ ID NO: 215319 - protein, 17 aa, Mycobacterium bovis
HTAATLRRHLAGRTLTR

SEQ ID NO: 215320 - protein, 24 aa, Mycobacterium bovis
HVETLTGFKWLARADANLPGTLVY

SEQ ID NO: 215321 - protein, 17 aa, Mycobacterium bovis
IAAGIFLYDRLGGAKSV

SEQ ID NO: 215322 - protein, 25 aa, Mycobacterium bovis
IPTVSGWRMLSGDETGWLLGDYILS

SEQ ID NO: 215323 - protein, 32 aa, Mycobacterium bovis
IPVRTLPPYLDLLETLYLIDRIPAWSTNLSKR

SEQ ID NO: 215324 - protein, 20 aa, Mycobacterium bovis
ISEADLLWDLASRLEGRMAA

SEQ ID NO: 215325 - protein, 31 aa, Mycobacterium bovis
IVVPDITIPGIPLSLNALGGVGPIVVPDITI

SEQ ID NO: 215326 - protein, 41 aa, Mycobacterium bovis
KGRENPHILTLSPPILLEKKWLRPTAYMMAKYGMTLCALGI

SEQ ID NO: 215327 - protein, 24 aa, Mycobacterium bovis
KPSPFAASLLFGYVGAFMYEGDTP

SEQ ID NO: 215328 - protein, 29 aa, Mycobacterium bovis
KSGRDSMFQAILPLRGKIINVEKARIDRV

SEQ ID NO: 215329 - protein, 17 aa, Mycobacterium bovis
LAAYQLLRVDGGEPVLL

SEQ ID NO: 215330 - protein, 21 aa, Mycobacterium bovis
LAKCGPWHRGGWDPIPEGLTT

SEQ ID NO: 215331 - protein, 34 aa, Mycobacterium bovis
LDNFDFDYVFVDCPPSLGLLTINALVAAPEVMIP

SEQ ID NO: 215332 - protein, 17 aa, Mycobacterium bovis
LDVVVHDDGLGLPQGFS

SEQ ID NO: 215333 - protein, 37 aa, Mycobacterium bovis
LETWHPLGVVGVITAFNFPVAVWAWNTAVALVCGDTV

SEQ ID NO: 215334 - protein, 23 aa, Mycobacterium bovis
LHPYRVRHLLDRYGSLISDVLAM

SEQ ID NO: 215335 - protein, 18 aa, Mycobacterium bovis
LHRIVVNACLDRLRRAKA

SEQ ID NO: 215336 - protein, 18 aa, Mycobacterium bovis
LHTALRRSPHSERLFCIP

SEQ ID NO: 215337 - protein, 18 aa, Mycobacterium bovis
LITTPESLFLMLTSAARQ

SEQ ID NO: 215338 - protein, 26 aa, Mycobacterium bovis
LLLAGSSRRLAWWTGALTLGVAKIIE

SEQ ID NO: 215339 - protein, 19 aa, Mycobacterium bovis
LTRLAVHQKTGVWSRLMLD

SEQ ID NO: 215340 - protein, 18 aa, Mycobacterium bovis
LVRRLLRAQFPQWADLPI

SEQ ID NO: 215341 - protein, 23 aa, Mycobacterium bovis
MDDLHRHLLSVLIDREWRHGVRV

SEQ ID NO: 215342 - protein, 31 aa, Mycobacterium bovis
MDVGFVVVAPHPYFPRLRLELDKGLGWKAEV

SEQ ID NO: 215343 - protein, 21 aa, Mycobacterium bovis
NIFNVVWNTILAIGFEWGVAL

SEQ ID NO: 215344 - protein, 21 aa, Mycobacterium bovis
NPNLRLLGALPTLYDSRTTHT

SEQ ID NO: 215345 - protein, 20 aa, Mycobacterium bovis
NYLRPPATVVFARRGKQIAR

SEQ ID NO: 215346 - protein, 25 aa, Mycobacterium bovis
PADLVQRRFGPPAPNRLWVADLTYV

SEQ ID NO: 215347 - protein, 25 aa, Mycobacterium bovis
PEINSGRMFFGAGSGPMLAAAAAWD

SEQ ID NO: 215348 - protein, 23 aa, Mycobacterium bovis
PETRERLRRHLEACPGCLRHYGL

SEQ ID NO: 215349 - protein, 17 aa, Mycobacterium bovis
PKGQWYLRQMLGSANFN

SEQ ID NO: 215350 - protein, 23 aa, Mycobacterium bovis
PLDARVLLRRLVVADPTAYGYLV

SEQ ID NO: 215351 - protein, 20 aa, Mycobacterium bovis
PMTPFERKIVHDAVAAVPGV

SEQ ID NO: 215352 - protein, 20 aa, Mycobacterium bovis
PNGVSVYRHVPWRVHKVYSS

SEQ ID NO: 215353 - protein, 26 aa, Mycobacterium bovis
PPDAELTERPDLFPAWDSMSEAQKRL

SEQ ID NO: 215354 - protein, 22 aa, Mycobacterium bovis
QEPTVLPSRFPNLLANGSGGIA

SEQ ID NO: 215355 - protein, 17 aa, Mycobacterium bovis
QPARLPFWRGDDAGRPA

SEQ ID NO: 215356 - protein, 26 aa, Mycobacterium bovis
QRIADLPRLIRLLAARSASELNLSSL

SEQ ID NO: 215357 - protein, 24 aa, Mycobacterium bovis
QYGKTWRTLAKLSLPDKYLRDNAD

SEQ ID NO: 215358 - protein, 23 aa, Mycobacterium bovis
RAGAPEVSGWLDGLRAAKRALVV

SEQ ID NO: 215359 - protein, 19 aa, Mycobacterium bovis
RAGRRLWVYGRAGQGCRRC

SEQ ID NO: 215360 - protein, 24 aa, Mycobacterium bovis
RALAIALIALPYYQDTNPPLAASA

SEQ ID NO: 215361 - protein, 20 aa, Mycobacterium bovis
RASDLIDRYIQRAAGVRRCA

SEQ ID NO: 215362 - protein, 26 aa, Mycobacterium bovis
RDELGDWRVILHSPYGLRVHGPLALA

SEQ ID NO: 215363 - protein, 23 aa, Mycobacterium bovis
RDFRSWACVDLELHPGRTVFVGP

SEQ ID NO: 215364 - protein, 24 aa, Mycobacterium bovis
RGESFGARRRLALSTVGASGATAG

SEQ ID NO: 215365 - protein, 26 aa, Mycobacterium bovis
RGLIFVIQVYRHMLSPLRPASCRFVP

SEQ ID NO: 215366 - protein, 34 aa, Mycobacterium bovis
RIGRSRPLITNMIRLLKLPIPVQRRVAAGVLSAG

SEQ ID NO: 215367 - protein, 21 aa, Mycobacterium bovis
RLREDPPRRLAGFPATVTDIG

SEQ ID NO: 215368 - protein, 20 aa, Mycobacterium bovis
RPQVLDLLHHTPDYGPPGGP

SEQ ID NO: 215369 - protein, 17 aa, Mycobacterium bovis
RQYFGSKVLRTVIPRSV

SEQ ID NO: 215370 - protein, 25 aa, Mycobacterium bovis
RRLVTRARDMLWVNRFRWNRCTTGD

SEQ ID NO: 215371 - protein, 20 aa, Mycobacterium bovis
RRRRREELAALADEVARRVA

SEQ ID NO: 215372 - protein, 24 aa, Mycobacterium bovis
RSPHSERLFCIPATIDLAGAEIEL

SEQ ID NO: 215373 - protein, 21 aa, Mycobacterium bovis
RTLTRCDIRVPRFAAVDLTGE

SEQ ID NO: 215374 - protein, 31 aa, Mycobacterium bovis
RTRVQTFLARRQLFDPALLAQARAIAADGGC

SEQ ID NO: 215375 - protein, 18 aa, Mycobacterium bovis
RVFTSMLAIEDRRYFDAD

SEQ ID NO: 215376 - protein, 20 aa, Mycobacterium bovis
RVHGPLALAVGRRLRDRYGI

SEQ ID NO: 215377 - protein, 19 aa, Mycobacterium bovis
RYLEQLEFGLVREALYERE

SEQ ID NO: 215378 - protein, 20 aa, Mycobacterium bovis
SAAVLVCDLVAALKGQGRSV

SEQ ID NO: 215379 - protein, 20 aa, Mycobacterium bovis
SAFVQLVLSNVFGQNAPAIA

SEQ ID NO: 215380 - protein, 22 aa, Mycobacterium bovis
SCATCDGFFFRDQDIAVIGGGD

SEQ ID NO: 215381 - protein, 24 aa, Mycobacterium bovis
SDTDRQLLAARLLAALAARRDAEL

SEQ ID NO: 215382 - protein, 29 aa, Mycobacterium bovis
SDTTTDPVLAWLYVLDAWEGGLPSARYLG

SEQ ID NO: 215383 - protein, 17 aa, Mycobacterium bovis
SGRLLLAGSSRRLAWWT

SEQ ID NO: 215384 - protein, 26 aa, Mycobacterium bovis
SGTAPILLGALPFDVSRPAALMVPDG

SEQ ID NO: 215385 - protein, 18 aa, Mycobacterium bovis
SMPLIRPNGRMLAIKGER

SEQ ID NO: 215386 - protein, 22 aa, Mycobacterium bovis
SMTFALGCVLVDADNRPTAFDG

SEQ ID NO: 215387 - protein, 19 aa, Mycobacterium bovis
SRAIYKDGWWACARLDKAP

SEQ ID NO: 215388 - protein, 25 aa, Mycobacterium bovis
SSNKPVLVDFWATWCGPCKMVAPVL

SEQ ID NO: 215389 - protein, 31 aa, Mycobacterium bovis
TARNFQVVSIPTLILFKDGQPVKRIVGAKGK

SEQ ID NO: 215390 - protein, 32 aa, Mycobacterium bovis
TATRYHSLTILPKSLPAVLRVTARTSSGVIMA

SEQ ID NO: 215391 - protein, 18 aa, Mycobacterium bovis
TCDFGPQHQPRIALRADM

SEQ ID NO: 215392 - protein, 24 aa, Mycobacterium bovis
TDAYARRILGWRVASTMATSMVLD

SEQ ID NO: 215393 - protein, 17 aa, Mycobacterium bovis
TFTAWRSTPAPVRGALV

SEQ ID NO: 215394 - protein, 21 aa, Mycobacterium bovis
TGTFTFAELLAHELSVERAGR

SEQ ID NO: 215395 - protein, 24 aa, Mycobacterium bovis
TIPGFAINPFGLNVPLSGGTSPVT

SEQ ID NO: 215396 - protein, 20 aa, Mycobacterium bovis
TLVFYIWGDNGASMEGTNTG

SEQ ID NO: 215397 - protein, 25 aa, Mycobacterium bovis
TNIPPHNLRELADAVFWALENHDAD

SEQ ID NO: 215398 - protein, 25 aa, Mycobacterium bovis
TVRRAAPFATLPRSLFEATLDLLSG

SEQ ID NO: 215399 - protein, 27 aa, Mycobacterium bovis
TYVSTWAGFAYVAFVTDAYARRILGWR

SEQ ID NO: 215400 - protein, 18 aa, Mycobacterium bovis
VADLFAAFGMLPVGYYDL

SEQ ID NO: 215401 - protein, 20 aa, Mycobacterium bovis
VAELTQLWWQEAERNRVLPL

SEQ ID NO: 215402 - protein, 34 aa, Mycobacterium bovis
VAMILRTEKSVMFVIPWGSHWIIGTTDTDWNLDL

SEQ ID NO: 215403 - protein, 25 aa, Mycobacterium bovis
VATETFAPILYVLTYDDLDEAIALN

SEQ ID NO: 215404 - protein, 51 aa, Mycobacterium bovis
VDGQHISTLLLTLLFRFMRPLIENGHVFLAQPPLYKLKWQRSDPEFAYSDR

SEQ ID NO: 215405 - protein, 18 aa, Mycobacterium bovis
VDGVPRTLRLDQLIRYYV

SEQ ID NO: 215406 - protein, 18 aa, Mycobacterium bovis
VEDLFVWPRFRRRGLARG

SEQ ID NO: 215407 - protein, 19 aa, Mycobacterium bovis
VFNLVQYLGQLGIEAEVWR

SEQ ID NO: 215408 - protein, 17 aa, Mycobacterium bovis
VHIAKITRREYPNQVLP

SEQ ID NO: 215409 - protein, 23 aa, Mycobacterium bovis
VIKMVLAMRHELLPATLHVDVPS

SEQ ID NO: 215410 - protein, 25 aa, Mycobacterium bovis
VKNNLQTVAALLRLQARRTSNAEGR

SEQ ID NO: 215411 - protein, 24 aa, Mycobacterium bovis
VLAGIGNVYCNELCFVSGVLPTAP

SEQ ID NO: 215412 - protein, 23 aa, Mycobacterium bovis
VLRARKLPDWPTGPLPKVRVAAA

SEQ ID NO: 215413 - protein, 18 aa, Mycobacterium bovis
VLVCPYHHRAHHRGLITI

SEQ ID NO: 215414 - protein, 19 aa, Mycobacterium bovis
VPRTLRLDQLIRYYVDHQL

SEQ ID NO: 215415 - protein, 26 aa, Mycobacterium bovis
VSRALMYHYFPDKRAFFAAVVKDEAD

SEQ ID NO: 215416 - protein, 17 aa, Mycobacterium bovis
VSSWLHRIVVNACLDRL

SEQ ID NO: 215417 - protein, 27 aa, Mycobacterium bovis
VSWSNPNDWWLVRLLGSITPTERTTIV

SEQ ID NO: 215418 - protein, 35 aa, Mycobacterium bovis
VVGEWQLLADLSFADYLMWVRRNDGVLVCVAQCRP

SEQ ID NO: 215419 - protein, 19 aa, Mycobacterium bovis
VVLVDGELAWFLERGGRSL

SEQ ID NO: 215420 - protein, 19 aa, Mycobacterium bovis
WLSMVMLEWGSCGQVATAV

SEQ ID NO: 215421 - protein, 24 aa, Mycobacterium bovis
YAARAQLAPLVFEGTSFGGALMTT

SEQ ID NO: 215422 - protein, 36 aa, Mycobacterium bovis
YAGFRSFRHGTNLKAWLYRILTNTYINSYRKKQRQP

SEQ ID NO: 215423 - protein, 24 aa, Mycobacterium bovis
YGKTNLIEALWYSTTLGSHRVSAD

SEQ ID NO: 215424 - protein, 19 aa, Mycobacterium bovis
YYVDHQLDVIVRRTTYRLR

SEQ ID NO: 215425 - protein, 22 aa, Mycobacterium bovis
AAAAAPYLSWLNAATARAEGAA

SEQ ID NO: 215426 - protein, 22 aa, Mycobacterium bovis
AAAAGELASIRSAINAANAAAA

SEQ ID NO: 215427 - protein, 23 aa, Mycobacterium bovis
AAAAGPTMGILAAGADEVSVAIS

SEQ ID NO: 215428 - protein, 29 aa, Mycobacterium bovis
AAAANPPMIRYPIPPMIHGATQSATWMAL

SEQ ID NO: 215429 - protein, 30 aa, Mycobacterium bovis
AAAAQLSSWSIGLQQALPAAPSALAAAIGL

SEQ ID NO: 215430 - protein, 18 aa, Mycobacterium bovis
AAAAWDGLADELAVAASW

SEQ ID NO: 215431 - protein, 24 aa, Mycobacterium bovis
AAAFKPPLRWGIRMTGHRFFREYP

SEQ ID NO: 215432 - protein, 30 aa, Mycobacterium bovis
AAAGAFAIVNILRILLANPAVWEKTALIVS

SEQ ID NO: 215433 - protein, 27 aa, Mycobacterium bovis
AAAGASGFYAKWLPKLVFGEGQLPTTY

SEQ ID NO: 215434 - protein, 18 aa, Mycobacterium bovis
AAAHWYTYRNRLAEAISV

SEQ ID NO: 215435 - protein, 24 aa, Mycobacterium bovis
AAAKAGITALTLSAARALGRYGVC

SEQ ID NO: 215436 - protein, 24 aa, Mycobacterium bovis
AAALADPLVLDAVLFEGGAFAEFL

SEQ ID NO: 215437 - protein, 18 aa, Mycobacterium bovis
AAALAFYERTRSGHHIGP

SEQ ID NO: 215438 - protein, 23 aa, Mycobacterium bovis
AAALAPRRTTLPGGLRVVTEFLP

SEQ ID NO: 215439 - protein, 19 aa, Mycobacterium bovis
AAALPEYMLPAAYVVLDEI

SEQ ID NO: 215440 - protein, 20 aa, Mycobacterium bovis
AAALSWTLWELAHAPEIQSQ

SEQ ID NO: 215441 - protein, 25 aa, Mycobacterium bovis
AAALVAERLAPGAHRWWQAGHRSSE

SEQ ID NO: 215442 - protein, 39 aa, Mycobacterium bovis
AAAMRVLTGPRWRLGARDLAALWRRALTLSGESPSTASP

SEQ ID NO: 215443 - protein, 25 aa, Mycobacterium bovis
AAANSWLDTFTHWRRAQDLPATSIA

SEQ ID NO: 215444 - protein, 38 aa, Mycobacterium bovis
AAAPLEGLLNIVNTPTQLLLGRPLIGNGANGAPGTGQA

SEQ ID NO: 215445 - protein, 19 aa, Mycobacterium bovis
AAAPYAGFLTTASAQAQLA

SEQ ID NO: 215446 - protein, 26 aa, Mycobacterium bovis
AAAQLRDMLPDWPALAHGPLTLKGFD

SEQ ID NO: 215447 - protein, 25 aa, Mycobacterium bovis
AAARPLAIPVIVLAGQVSLDKSALR

SEQ ID NO: 215448 - protein, 17 aa, Mycobacterium bovis
AAASMSVIEKYLYGYFG

SEQ ID NO: 215449 - protein, 19 aa, Mycobacterium bovis
AAASPYVGWLSTVASQAQL

SEQ ID NO: 215450 - protein, 23 aa, Mycobacterium bovis
AAATPLPVIGVPVPLGRLDGLDS

SEQ ID NO: 215451 - protein, 29 aa, Mycobacterium bovis
AAAVRREIGVPTVFNLLGPLTNPARPRAG

SEQ ID NO: 215452 - protein, 19 aa, Mycobacterium bovis
AAAYDAWYDSPTGRPILAT

SEQ ID NO: 215453 - protein, 33 aa, Mycobacterium bovis
AAAYRQLRYFWSRVIADTGWQLLDSKFAVVARA

SEQ ID NO: 215454 - protein, 25 aa, Mycobacterium bovis
AACGLRRLIPLYAMVETALAPPPSA

SEQ ID NO: 215455 - protein, 28 aa, Mycobacterium bovis
AACLRKTDWLFPQYRELGVYLVRGIPPG

SEQ ID NO: 215456 - protein, 22 aa, Mycobacterium bovis
AACWDARRWLGRPGLDDRASAD

SEQ ID NO: 215457 - protein, 17 aa, Mycobacterium bovis
AADAILVPPGDGPWRLG

SEQ ID NO: 215458 - protein, 25 aa, Mycobacterium bovis
AADAMSYRILLADLAALYDGREPPA

SEQ ID NO: 215459 - protein, 27 aa, Mycobacterium bovis
AADIEVPAPPFWGSRIVKGLAVADYTG

SEQ ID NO: 215460 - protein, 21 aa, Mycobacterium bovis
AADIIARRWGGGGRPLADIAG

SEQ ID NO: 215461 - protein, 19 aa, Mycobacterium bovis
AADLAYFRVLIHSTRNRAL

SEQ ID NO: 215462 - protein, 26 aa, Mycobacterium bovis
AADRLCYSYFRSYGLDVTIVRPFNIF

SEQ ID NO: 215463 - protein, 28 aa, Mycobacterium bovis
AADSAELPLFRYVGGPNAHILPVPMMNI

SEQ ID NO: 215464 - protein, 29 aa, Mycobacterium bovis
AADWSKRPLPSAWLNYAALDVELLIELRA

SEQ ID NO: 215465 - protein, 29 aa, Mycobacterium bovis
AAEAFVAAYMPFLAWLIQASADCVEMAAQ

SEQ ID NO: 215466 - protein, 40 aa, Mycobacterium bovis
AAEATNFGPLQPLFDVINAPTLALLNRPLIGNGADGTAAN

SEQ ID NO: 215467 - protein, 26 aa, Mycobacterium bovis
AAEICDGWLPIFYSPRMAGMYNEWLD

SEQ ID NO: 215468 - protein, 17 aa, Mycobacterium bovis
AAELARRRRARGLRLNH

SEQ ID NO: 215469 - protein, 24 aa, Mycobacterium bovis
AAELAYLTRALKAPTLRGAIEQLA

SEQ ID NO: 215470 - protein, 33 aa, Mycobacterium bovis
AAELLGIPWVELNPHPLYLPSKGLPPIGSGLAA

SEQ ID NO: 215471 - protein, 24 aa, Mycobacterium bovis
AAELMGIQIPRFCDHPLLEPVGAC

SEQ ID NO: 215472 - protein, 17 aa, Mycobacterium bovis
AAELTGHLIFDRPPLGA

SEQ ID NO: 215473 - protein, 20 aa, Mycobacterium bovis
AAEPSPLLRRRSLTTRTEAI

SEQ ID NO: 215474 - protein, 26 aa, Mycobacterium bovis
AAEQLVPFQQALQQLPNLGIGNIGNA

SEQ ID NO: 215475 - protein, 17 aa, Mycobacterium bovis
AAESLVRQLLTQQYHLL

SEQ ID NO: 215476 - protein, 21 aa, Mycobacterium bovis
AAFAMTVPPPAIAANRTLLMT

SEQ ID NO: 215477 - protein, 25 aa, Mycobacterium bovis
AAFEAFARLYPATMLLVDTYDTLRG

SEQ ID NO: 215478 - protein, 18 aa, Mycobacterium bovis
AAFFERSYDILPDDGRML

SEQ ID NO: 215479 - protein, 24 aa, Mycobacterium bovis
AAFHAQVVRTLTVDAGAYASAEAA

SEQ ID NO: 215480 - protein, 24 aa, Mycobacterium bovis
AAFHARFVQALAGAMGAYAAAEAA

SEQ ID NO: 215481 - protein, 30 aa, Mycobacterium bovis
AAFLAGRIGFPAIVGIIADVLHAADQWAVE

SEQ ID NO: 215482 - protein, 21 aa, Mycobacterium bovis
AAGARWILDLGPGDILTRLTA

SEQ ID NO: 215483 - protein, 23 aa, Mycobacterium bovis
AAGGDWFDALALGDRLVLVVGDV

SEQ ID NO: 215484 - protein, 27 aa, Mycobacterium bovis
AAGGLNWASLPLKLFAGGNAKFWDPAD

SEQ ID NO: 215485 - protein, 25 aa, Mycobacterium bovis
AAGHRSPLGRLPLRIGRSKSNDMVL

SEQ ID NO: 215486 - protein, 25 aa, Mycobacterium bovis
AAGIPMPALLRHQQWMLGPSAGSVD

SEQ ID NO: 215487 - protein, 30 aa, Mycobacterium bovis
AAGKPASVATIAWMGYHPPPNPLDTGSAGD

SEQ ID NO: 215488 - protein, 24 aa, Mycobacterium bovis
AAGKRLPVPLFPGFDTLGTLEYIT

SEQ ID NO: 215489 - protein, 26 aa, Mycobacterium bovis
AAGLDSRAYRLPWPDGTTVFELDRPQ

SEQ ID NO: 215490 - protein, 26 aa, Mycobacterium bovis
AAGLDTRAYRLPWPPGTVVYEIDQPA

SEQ ID NO: 215491 - protein, 23 aa, Mycobacterium bovis
AAGLHRIRWWTDEAGDFGLSLAA

SEQ ID NO: 215492 - protein, 30 aa, Mycobacterium bovis
AAGNTMLDLFLLILVELFRRHLSSTEQALP

SEQ ID NO: 215493 - protein, 24 aa, Mycobacterium bovis
AAGPHGRVLATETYFSVGGGFIVT

SEQ ID NO: 215494 - protein, 23 aa, Mycobacterium bovis
AAGPLREWLHKQRTGLPHVTWKY

SEQ ID NO: 215495 - protein, 20 aa, Mycobacterium bovis
AAGRYRVQPSGKGGLRPGVD

SEQ ID NO: 215496 - protein, 25 aa, Mycobacterium bovis
AAGRYVLDRAIFDALRRIDRGAGGE

SEQ ID NO: 215497 - protein, 24 aa, Mycobacterium bovis
AAGSAIPGLPPGLPPGVVANLAAT

SEQ ID NO: 215498 - protein, 21 aa, Mycobacterium bovis
AAGVNPRRYLAELRLDDSDAA

SEQ ID NO: 215499 - protein, 18 aa, Mycobacterium bovis
AAGYAANLVVLDRDLRVT

SEQ ID NO: 215500 - protein, 28 aa, Mycobacterium bovis
AAHCPAYFQLLVKALVLPGLQELEHTAV

SEQ ID NO: 215501 - protein, 19 aa, Mycobacterium bovis
AAHLAGVLSLTDAAGLVAA

SEQ ID NO: 215502 - protein, 18 aa, Mycobacterium bovis
AAHLPRAVRWHRYSLDNG

SEQ ID NO: 215503 - protein, 18 aa, Mycobacterium bovis
AAHPGTSLILLDTASDPR

SEQ ID NO: 215504 - protein, 24 aa, Mycobacterium bovis
AAHQSIVGNRLRLALDSDLCAAVT

SEQ ID NO: 215505 - protein, 18 aa, Mycobacterium bovis
AAIASLFAAHGQAYQAVS

SEQ ID NO: 215506 - protein, 31 aa, Mycobacterium bovis
AAICRFEFAEVYPLLDWAAPYQEMMGPFGTV

SEQ ID NO: 215507 - protein, 17 aa, Mycobacterium bovis
AAIDLLHRLAERLGYTL

SEQ ID NO: 215508 - protein, 25 aa, Mycobacterium bovis
AAIEELIDAVKFTPALTGPHARLGG

SEQ ID NO: 215509 - protein, 28 aa, Mycobacterium bovis
AAIGLVKFDLLGLGMLSALHYAKDLVAE

SEQ ID NO: 215510 - protein, 28 aa, Mycobacterium bovis
AAIPVLLDAIYDPWPTPLAAAVGSAGGR

SEQ ID NO: 215511 - protein, 20 aa, Mycobacterium bovis
AAISAPLRPGSGMPPIGVPV

SEQ ID NO: 215512 - protein, 20 aa, Mycobacterium bovis
AAKIAEMLRWCHEAGIELAT

SEQ ID NO: 215513 - protein, 17 aa, Mycobacterium bovis
AAKIPIVPIVIRNAEIV

SEQ ID NO: 215514 - protein, 23 aa, Mycobacterium bovis
AAKLIAAARKPVLYVGGGVIRGE

SEQ ID NO: 215515 - protein, 27 aa, Mycobacterium bovis
AAKRTGDLIPLCHPLGLDAVSVTITPC

SEQ ID NO: 215516 - protein, 18 aa, Mycobacterium bovis
AALAFEQAYAMTLPPPVV

SEQ ID NO: 215517 - protein, 19 aa, Mycobacterium bovis
AALDRFGPPAGDPAWVVKD

SEQ ID NO: 215518 - protein, 34 aa, Mycobacterium bovis
AALDRGVWLRPFRNLVYAMPPYICTPAEITQITS

SEQ ID NO: 215519 - protein, 22 aa, Mycobacterium bovis
AALESLYEWMWAQDAAAMAGYY

SEQ ID NO: 215520 - protein, 40 aa, Mycobacterium bovis
AALFGSYAQSYQAFGAQLSAFHAQFVQSLTNGARSYVVAE

SEQ ID NO: 215521 - protein, 25 aa, Mycobacterium bovis
AALGDLPLIYPFLVNDPGEGTQAKR

SEQ ID NO: 215522 - protein, 23 aa, Mycobacterium bovis
AALISPLRLRGMSAMLARIKRRL

SEQ ID NO: 215523 - protein, 23 aa, Mycobacterium bovis
AALKLVLEPIFETDFEPVSYGFR

SEQ ID NO: 215524 - protein, 21 aa, Mycobacterium bovis
AALLKLPVANWPALGGMGNAS

SEQ ID NO: 215525 - protein, 17 aa, Mycobacterium bovis
AALLQDWGVLPDLVMGH

SEQ ID NO: 215526 - protein, 20 aa, Mycobacterium bovis
AALNLWSVVTGMAGLPHVYE

SEQ ID NO: 215527 - protein, 17 aa, Mycobacterium bovis
AALPKLPSFSLTSTSIT

SEQ ID NO: 215528 - protein, 21 aa, Mycobacterium bovis
AALPSPPRGFTPAPPPQWDDL

SEQ ID NO: 215529 - protein, 18 aa, Mycobacterium bovis
AALQAQILHIETLAATGR

SEQ ID NO: 215530 - protein, 18 aa, Mycobacterium bovis
AALRAVPAERLWVNPDCG

SEQ ID NO: 215531 - protein, 26 aa, Mycobacterium bovis
AALRDLVARRTPLFEFAIRAAIAEMD

SEQ ID NO: 215532 - protein, 32 aa, Mycobacterium bovis
AALRELNLLTTKPFLYVFNADEAVLTDPARVG

SEQ ID NO: 215533 - protein, 20 aa, Mycobacterium bovis
AALVHHYFGTKQQLFAAAIH

SEQ ID NO: 215534 - protein, 19 aa, Mycobacterium bovis
AALWSDDLLTRVAIEPLDR

SEQ ID NO: 215535 - protein, 28 aa, Mycobacterium bovis
AAMAAAAAPYAGWLGSVAAAAEAVAGQA

SEQ ID NO: 215536 - protein, 27 aa, Mycobacterium bovis
AAMAAAAAPYAGWLSAAAARAAGAAAQ

SEQ ID NO: 215537 - protein, 25 aa, Mycobacterium bovis
AAMGLTIPVLLIRGKLSDVVSSDGA

SEQ ID NO: 215538 - protein, 22 aa, Mycobacterium bovis
AAMLSLPPVAPATGWCTSLRLP

SEQ ID NO: 215539 - protein, 18 aa, Mycobacterium bovis
AAMRLRPGERHWMAFRQL

SEQ ID NO: 215540 - protein, 27 aa, Mycobacterium bovis
AANLKCLCRLHHLLATFCGWRAQQLPD

SEQ ID NO: 215541 - protein, 28 aa, Mycobacterium bovis
AANPLDPHWLLDTLGLTEAARTTYRRLS

SEQ ID NO: 215542 - protein, 17 aa, Mycobacterium bovis
AANQFVVALRRRGHLDD

SEQ ID NO: 215543 - protein, 25 aa, Mycobacterium bovis
AANRIQLLALIATNFFGQNTAAIAA

SEQ ID NO: 215544 - protein, 36 aa, Mycobacterium bovis
AANVEQQLLGAINAPTMALLGRPLIGHGADGAPGTG

SEQ ID NO: 215545 - protein, 20 aa, Mycobacterium bovis
AAPGWLVSPGVRTALPANGF

SEQ ID NO: 215546 - protein, 36 aa, Mycobacterium bovis
AAPLEGVLDVINAPALALLGRPLIGNGANGAPGTGA

SEQ ID NO: 215547 - protein, 19 aa, Mycobacterium bovis
AAPNFAFELAVRKTTDADI

SEQ ID NO: 215548 - protein, 25 aa, Mycobacterium bovis
AAPPARARTPLPVPTPRGERPDDGG

SEQ ID NO: 215549 - protein, 18 aa, Mycobacterium bovis
AAPSLDIGIPWRQYLRVQ

SEQ ID NO: 215550 - protein, 19 aa, Mycobacterium bovis
AAPVLNAELLRRAKHSGLS

SEQ ID NO: 215551 - protein, 26 aa, Mycobacterium bovis
AAQFPFDIIPTLLQGLATLSTQYTQL

SEQ ID NO: 215552 - protein, 37 aa, Mycobacterium bovis
AAQRLGRPLRIAHAWSFTFDAAWQPLVALLDGHAVHI

SEQ ID NO: 215553 - protein, 25 aa, Mycobacterium bovis
AAQVRQWLAAHLPAADLRPAYSNAD

SEQ ID NO: 215554 - protein, 26 aa, Mycobacterium bovis
AAQYRQFVMATLFHKTRSWSNLLKVT

SEQ ID NO: 215555 - protein, 23 aa, Mycobacterium bovis
AARALIAVRGLHRFAAAEGLAEL

SEQ ID NO: 215556 - protein, 19 aa, Mycobacterium bovis
AARALVGPQFRGPGKPFAD

SEQ ID NO: 215557 - protein, 19 aa, Mycobacterium bovis
AARARWANPAAWRLPGDDV

SEQ ID NO: 215558 - protein, 23 aa, Mycobacterium bovis
AARAVWQALPGELWADRFAEAAA

SEQ ID NO: 215559 - protein, 30 aa, Mycobacterium bovis
AARDADYSGFIWFPKLPALDRWLDLYERAA

SEQ ID NO: 215560 - protein, 18 aa, Mycobacterium bovis
AARDLQFELAARFRDEIA

SEQ ID NO: 215561 - protein, 18 aa, Mycobacterium bovis
AARGRLMQALPAGGAMVA

SEQ ID NO: 215562 - protein, 40 aa, Mycobacterium bovis
AARLPAILHQTRYYRSLQLRWPLRMLLGGKPLQHIAADKR

SEQ ID NO: 215563 - protein, 18 aa, Mycobacterium bovis
AARQLGGHIWADGGIRHP

SEQ ID NO: 215564 - protein, 17 aa, Mycobacterium bovis
AARQYGIPTFGTMAHSF

SEQ ID NO: 215565 - protein, 21 aa, Mycobacterium bovis
AARRMVHVPLGRFAEPDEIAA

SEQ ID NO: 215566 - protein, 23 aa, Mycobacterium bovis
AARTPPVCELPPLPAGDAARDEA

SEQ ID NO: 215567 - protein, 20 aa, Mycobacterium bovis
AARVEILGRYWWRIRRRATE

SEQ ID NO: 215568 - protein, 19 aa, Mycobacterium bovis
AARVRMLRSFDPRSGTHAL

SEQ ID NO: 215569 - protein, 27 aa, Mycobacterium bovis
AASAFQSVVWGLTVGSWIGSSAGLMAA

SEQ ID NO: 215570 - protein, 29 aa, Mycobacterium bovis
AASALLKGLTAHYLLKSVYPVKRGDTVLV

SEQ ID NO: 215571 - protein, 23 aa, Mycobacterium bovis
AASDAFFPFPDGLETLAAAGVTA

SEQ ID NO: 215572 - protein, 23 aa, Mycobacterium bovis
AASELLLTVRYQLDTQPRPLVIV

SEQ ID NO: 215573 - protein, 19 aa, Mycobacterium bovis
AASFTRSFARYEPMPESAA

SEQ ID NO: 215574 - protein, 26 aa, Mycobacterium bovis
AASGCVLLPGLPYLGLEHRAAWVEAE

SEQ ID NO: 215575 - protein, 19 aa, Mycobacterium bovis
AASHHARVGRRARAARLLR

SEQ ID NO: 215576 - protein, 34 aa, Mycobacterium bovis
AASITSPLLDAINAPFLAALGRPLIGNGADGAPG

SEQ ID NO: 215577 - protein, 19 aa, Mycobacterium bovis
AASLARHFGARRKAFNWTV

SEQ ID NO: 215578 - protein, 27 aa, Mycobacterium bovis
AASTPGIPVLAWALPQPIADRLNAEFS

SEQ ID NO: 215579 - protein, 18 aa, Mycobacterium bovis
AASWQRLRTAPATVPLAR

SEQ ID NO: 215580 - protein, 26 aa, Mycobacterium bovis
AATGLESTMRFLLSAKSAYVDGQVFS

SEQ ID NO: 215581 - protein, 23 aa, Mycobacterium bovis
AATGRWVPDFLSLPIAVENSLKN

SEQ ID NO: 215582 - protein, 17 aa, Mycobacterium bovis
AATHRAMWALGDYALMA

SEQ ID NO: 215583 - protein, 26 aa, Mycobacterium bovis
AATHRFIAHLPGYQGWQWAVVVASYS

SEQ ID NO: 215584 - protein, 25 aa, Mycobacterium bovis
AATPRIARRRLFDARLALTLRHHGV

SEQ ID NO: 215585 - protein, 25 aa, Mycobacterium bovis
AATRIRLVLVSLGVSSFFVVGVPNI

SEQ ID NO: 215586 - protein, 25 aa, Mycobacterium bovis
AATTGRFALYPYIREYVYDLTGRLA

SEQ ID NO: 215587 - protein, 24 aa, Mycobacterium bovis
AATTTWPAHLRPALTTAGFATELR

SEQ ID NO: 215588 - protein, 21 aa, Mycobacterium bovis
AATVDPFVIAANRSRLVSLAL

SEQ ID NO: 215589 - protein, 18 aa, Mycobacterium bovis
AATVPPPLIAANRASLMQ

SEQ ID NO: 215590 - protein, 20 aa, Mycobacterium bovis
AATVPPPVIAANRAQLMVLI

SEQ ID NO: 215591 - protein, 22 aa, Mycobacterium bovis
AATVPPPVVAANRAELAVLAAT

SEQ ID NO: 215592 - protein, 24 aa, Mycobacterium bovis
AATWLRGVSIVHLPTTLLGMVDAA

SEQ ID NO: 215593 - protein, 28 aa, Mycobacterium bovis
AAVAGYALGGGCELAMMCDVLIAADTAK

SEQ ID NO: 215594 - protein, 19 aa, Mycobacterium bovis
AAVAPYVAWISVTAGQAEQ

SEQ ID NO: 215595 - protein, 23 aa, Mycobacterium bovis
AAVDLALRRLVGSPLSREFLLGL

SEQ ID NO: 215596 - protein, 18 aa, Mycobacterium bovis
AAVEPLVQMLAPLAPHIA

SEQ ID NO: 215597 - protein, 24 aa, Mycobacterium bovis
AAVGSDFIICYRLSMADYVAEGQS

SEQ ID NO: 215598 - protein, 29 aa, Mycobacterium bovis
AAVLFDIDGVLVLSWRAIPGAAETVRQLT

SEQ ID NO: 215599 - protein, 21 aa, Mycobacterium bovis
AAVQLARLWGLEVFATASRGK

SEQ ID NO: 215600 - protein, 25 aa, Mycobacterium bovis
AAVRAWLLSQRRIVTTYAGVERAPL

SEQ ID NO: 215601 - protein, 20 aa, Mycobacterium bovis
AAVRELLYAIGEDPDRDGLV

SEQ ID NO: 215602 - protein, 23 aa, Mycobacterium bovis
AAVSALMPFTQQLKKLAGLSERL

SEQ ID NO: 215603 - protein, 24 aa, Mycobacterium bovis
AAVSFGFGPLLLAGSDPLLAVPFS

SEQ ID NO: 215604 - protein, 22 aa, Mycobacterium bovis
AAVSKYWKIDEIRPAFIHVNPV

SEQ ID NO: 215605 - protein, 18 aa, Mycobacterium bovis
AAVVPPPQIAANRSQLIS

SEQ ID NO: 215606 - protein, 31 aa, Mycobacterium bovis
AAWTGHEGAEARYLWPSMFAQVADEYDRRYG

SEQ ID NO: 215607 - protein, 23 aa, Mycobacterium bovis
AAYEALRKMVVKAPLRAATVSVA

SEQ ID NO: 215608 - protein, 22 aa, Mycobacterium bovis
AAYGHALGIPVYGVCSLDAIGG

SEQ ID NO: 215609 - protein, 28 aa, Mycobacterium bovis
AAYLFTNDYEWDLLLSKTGWSEADVMAQ

SEQ ID NO: 215610 - protein, 26 aa, Mycobacterium bovis
AAYQYVRDFLSFLPSNCFDKPPVVNP

SEQ ID NO: 215611 - protein, 17 aa, Mycobacterium bovis
AAYRIWLEQNKQRWLAF

SEQ ID NO: 215612 - protein, 29 aa, Mycobacterium bovis
ACGAIELGIKWLSLYAFSTENWKRSPEEV

SEQ ID NO: 215613 - protein, 31 aa, Mycobacterium bovis
ACGFDTPYPPARLEKLWLPGPDRLLDCVERV

SEQ ID NO: 215614 - protein, 27 aa, Mycobacterium bovis
ACPSTWPWNLLGWPSINVPAGFTSDGL

SEQ ID NO: 215615 - protein, 28 aa, Mycobacterium bovis
ACQIAGITYRQLDYWARTSLVVPSIRSA

SEQ ID NO: 215616 - protein, 34 aa, Mycobacterium bovis
ACSTLRLTDLLPYVGPDYLVPKPLHSVRSDGSSM

SEQ ID NO: 215617 - protein, 26 aa, Mycobacterium bovis
ACTLRGWLGMWSLRVAQTRAAPHLAR

SEQ ID NO: 215618 - protein, 24 aa, Mycobacterium bovis
ACVEFVFGPLLNNPHRLGKPLRND

SEQ ID NO: 215619 - protein, 27 aa, Mycobacterium bovis
ACVTGIYQLEALLEMVFHRGSKMHDIV

SEQ ID NO: 215620 - protein, 25 aa, Mycobacterium bovis
ACYEAHGTLFFGVPTVWSRVAADQA

SEQ ID NO: 215621 - protein, 23 aa, Mycobacterium bovis
ADAELFIVGAQLGGKPALFIVES

SEQ ID NO: 215622 - protein, 24 aa, Mycobacterium bovis
ADAGVPVIFLHHLGAVLDNWDPRV

SEQ ID NO: 215623 - protein, 23 aa, Mycobacterium bovis
ADAKLIIASAYLPQHEDARAADI

SEQ ID NO: 215624 - protein, 26 aa, Mycobacterium bovis
ADALGIRTVLIPPMAGVLSALGIGLA

SEQ ID NO: 215625 - protein, 23 aa, Mycobacterium bovis
ADALLVDLDPWAGGIDLLVGGET

SEQ ID NO: 215626 - protein, 24 aa, Mycobacterium bovis
ADARLLAGQRRLASAIAGGAPMYQ

SEQ ID NO: 215627 - protein, 29 aa, Mycobacterium bovis
ADASLSHPYLDTVLFLLGVTRGEIEAADA

SEQ ID NO: 215628 - protein, 17 aa, Mycobacterium bovis
ADAVIYAPLLPSVDEVA

SEQ ID NO: 215629 - protein, 27 aa, Mycobacterium bovis
ADDDQFMTLAKMRALRQLWARVAEVVG

SEQ ID NO: 215630 - protein, 22 aa, Mycobacterium bovis
ADDHAELFWALRGGGGGNFGVT

SEQ ID NO: 215631 - protein, 23 aa, Mycobacterium bovis
ADDIRLRRMAVFDVLINNADRKG

SEQ ID NO: 215632 - protein, 24 aa, Mycobacterium bovis
ADEDSLQLLGWTEATATPQVDAAL

SEQ ID NO: 215633 - protein, 27 aa, Mycobacterium bovis
ADEERVVWLADPLIAEDLPDGLPEALN

SEQ ID NO: 215634 - protein, 28 aa, Mycobacterium bovis
ADELDRHLRLPLRDVIWGADADLLDSTE

SEQ ID NO: 215635 - protein, 23 aa, Mycobacterium bovis
ADENLHMIFYRDVSEAAFDLVPN

SEQ ID NO: 215636 - protein, 21 aa, Mycobacterium bovis
ADGALPLLAPMSEVAGRLAAQ

SEQ ID NO: 215637 - protein, 26 aa, Mycobacterium bovis
ADGGGLVIGFLPRGTPWADLYALRAA

SEQ ID NO: 215638 - protein, 38 aa, Mycobacterium bovis
ADGGRDEQLLLLPLTSLRGLRHTLKKLSGLRARNGLLT

SEQ ID NO: 215639 - protein, 24 aa, Mycobacterium bovis
ADGLPVGAYAVLRPPRSTLHRQEC

SEQ ID NO: 215640 - protein, 23 aa, Mycobacterium bovis
ADGPMAGLLARAIVVIGADGNVA

SEQ ID NO: 215641 - protein, 25 aa, Mycobacterium bovis
ADGPPAWLRFFGCNPRHHSLAFLPM

SEQ ID NO: 215642 - protein, 27 aa, Mycobacterium bovis
ADGTKAGFDLALLRAVRAAVTVPVIAS

SEQ ID NO: 215643 - protein, 22 aa, Mycobacterium bovis
ADGVYAAWFTVLGHGPVTGTVV

SEQ ID NO: 215644 - protein, 20 aa, Mycobacterium bovis
ADGWNTFNLTLQGDVKRFRG

SEQ ID NO: 215645 - protein, 28 aa, Mycobacterium bovis
ADHCLDLPGLFVWRRYHPSRPSGKALLY

SEQ ID NO: 215646 - protein, 32 aa, Mycobacterium bovis
ADHLIEIPAVSTLLQPLLSTIPLQVFAASVAR

SEQ ID NO: 215647 - protein, 25 aa, Mycobacterium bovis
ADIADQLARRRLGYGRGARMTFERD

SEQ ID NO: 215648 - protein, 27 aa, Mycobacterium bovis
ADIEFPAPALIYGYGAYEICEDPRFSI

SEQ ID NO: 215649 - protein, 18 aa, Mycobacterium bovis
ADIGWAAAFLASDAASYI

SEQ ID NO: 215650 - protein, 22 aa, Mycobacterium bovis
ADKPAVILYPSGTVISFDELEA

SEQ ID NO: 215651 - protein, 17 aa, Mycobacterium bovis
ADKYLYFTTESPAVHSV

SEQ ID NO: 215652 - protein, 22 aa, Mycobacterium bovis
ADLESREVLLAKLAGAMKGNLA

SEQ ID NO: 215653 - protein, 20 aa, Mycobacterium bovis
ADLRTDWPTPLTAAGFDPQR

SEQ ID NO: 215654 - protein, 17 aa, Mycobacterium bovis
ADLVSCMVALPTQLFRS

SEQ ID NO: 215655 - protein, 22 aa, Mycobacterium bovis
ADNPALLGDLPDIGIDTTELIG

SEQ ID NO: 215656 - protein, 28 aa, Mycobacterium bovis
ADNPVLCDLILIRAALSPKTARLGAQEM

SEQ ID NO: 215657 - protein, 25 aa, Mycobacterium bovis
ADPATLTDLVFAWRACRAVKSNAIV

SEQ ID NO: 215658 - protein, 22 aa, Mycobacterium bovis
ADPLGPYGFSGWVGPEPHGAGL

SEQ ID NO: 215659 - protein, 25 aa, Mycobacterium bovis
ADPPDRPWNLLAGANALMGAAYFHD

SEQ ID NO: 215660 - protein, 22 aa, Mycobacterium bovis
ADPPMIMRDTIFCAIPTDADRE

SEQ ID NO: 215661 - protein, 21 aa, Mycobacterium bovis
ADPQMLRYFASIGISLDSRLR

SEQ ID NO: 215662 - protein, 22 aa, Mycobacterium bovis
ADPRFTVAAIPPRNDPRDAVVA

SEQ ID NO: 215663 - protein, 19 aa, Mycobacterium bovis
ADPYLWLEDVTGAEALDWV

SEQ ID NO: 215664 - protein, 20 aa, Mycobacterium bovis
ADQLSRGPLLSGMFGTFPVA

SEQ ID NO: 215665 - protein, 24 aa, Mycobacterium bovis
ADQMRGVRLMFMQSNGGLAQAGHF

SEQ ID NO: 215666 - protein, 18 aa, Mycobacterium bovis
ADQYAQLSGLRLGKVISI

SEQ ID NO: 215667 - protein, 22 aa, Mycobacterium bovis
ADRAENLRRLSHVATLLADCGH

SEQ ID NO: 215668 - protein, 26 aa, Mycobacterium bovis
ADRDWWAQRIPQLPDPPALPTRAGGE

SEQ ID NO: 215669 - protein, 21 aa, Mycobacterium bovis
ADRFAECPTFPAPPPREILDA

SEQ ID NO: 215670 - protein, 31 aa, Mycobacterium bovis
ADRLIPHRAWIFVYQLYLWDMRFRARHGRRI

SEQ ID NO: 215671 - protein, 22 aa, Mycobacterium bovis
ADRPNRKRVLLAEPRGYCAGVD

SEQ ID NO: 215672 - protein, 25 aa, Mycobacterium bovis
ADRQSMLFSATMPDPIITLARTFMV

SEQ ID NO: 215673 - protein, 19 aa, Mycobacterium bovis
ADRSYRRSFRREFDRIKLG

SEQ ID NO: 215674 - protein, 23 aa, Mycobacterium bovis
ADRYRRLHVIIGDANLAETSTYL

SEQ ID NO: 215675 - protein, 18 aa, Mycobacterium bovis
ADSAACRAAFQALELMVV

SEQ ID NO: 215676 - protein, 31 aa, Mycobacterium bovis
ADSFYLPLVVRRRIWFLAKSEYFTGTGLKGW

SEQ ID NO: 215677 - protein, 23 aa, Mycobacterium bovis
ADTPPIYFGFGSMPIGSLADRVA

SEQ ID NO: 215678 - protein, 24 aa, Mycobacterium bovis
ADTPTLFTGVEWLEAARAAGIDAV

SEQ ID NO: 215679 - protein, 28 aa, Mycobacterium bovis
ADVLFSRYETLLAAGARLFRAQGYPAVN

SEQ ID NO: 215680 - protein, 23 aa, Mycobacterium bovis
ADVMARVIGFHLNRGVLAAARRV

SEQ ID NO: 215681 - protein, 23 aa, Mycobacterium bovis
ADVPFFFKQWGGRTPKAFGRELD

SEQ ID NO: 215682 - protein, 30 aa, Mycobacterium bovis
ADVRIAGPAALFDARFQKLGLHPGGGATWM

SEQ ID NO: 215683 - protein, 20 aa, Mycobacterium bovis
ADVSIIFVPPTFAKDAIIEA

SEQ ID NO: 215684 - protein, 25 aa, Mycobacterium bovis
ADVVRTRIYVTDISRWREVGEVHAQ

SEQ ID NO: 215685 - protein, 26 aa, Mycobacterium bovis
ADWQPRRRGSGRPGFYRPPGRPEVIA

SEQ ID NO: 215686 - protein, 19 aa, Mycobacterium bovis
ADWYSLGLRLIPHLDRRSA

SEQ ID NO: 215687 - protein, 19 aa, Mycobacterium bovis
ADYGFAWRDIARVVGVSVP

SEQ ID NO: 215688 - protein, 17 aa, Mycobacterium bovis
ADYPEVSLGIYASPRQT

SEQ ID NO: 215689 - protein, 37 aa, Mycobacterium bovis
ADYSARGWAMNSLFDGIGPLLADLRTAGVRLAVATSK

SEQ ID NO: 215690 - protein, 27 aa, Mycobacterium bovis
AEAAAVYDLFVKTLGVSAGTYAATEAA

SEQ ID NO: 215691 - protein, 26 aa, Mycobacterium bovis
AEAADLGQRRALTGEPLPPLLTATAK

SEQ ID NO: 215692 - protein, 17 aa, Mycobacterium bovis
AEAAFVFAMIAVDLSRL

SEQ ID NO: 215693 - protein, 37 aa, Mycobacterium bovis
AEAAWRAYQHPTRLHWYVPRSIRWIDRLKGVSPEFVR

SEQ ID NO: 215694 - protein, 23 aa, Mycobacterium bovis
AEADHIASFALPIDDLDLTVRSY

SEQ ID NO: 215695 - protein, 17 aa, Mycobacterium bovis
AEADLARFPADVARVVV

SEQ ID NO: 215696 - protein, 19 aa, Mycobacterium bovis
AEAEYELMWAADVAAMAGY

SEQ ID NO: 215697 - protein, 22 aa, Mycobacterium bovis
AEAFVRTLFDRVTAHGSPTVEF

SEQ ID NO: 215698 - protein, 25 aa, Mycobacterium bovis
AEAGFVIVAIPPAHRVAIEFDPPLP

SEQ ID NO: 215699 - protein, 26 aa, Mycobacterium bovis
AEALVNLVRRLATPAWLSYTINGTRT

SEQ ID NO: 215700 - protein, 20 aa, Mycobacterium bovis
AEALVPITALLPAGADDVSA

SEQ ID NO: 215701 - protein, 26 aa, Mycobacterium bovis
AEAPARAYNPLFIWGESGLGKTHLLH

SEQ ID NO: 215702 - protein, 31 aa, Mycobacterium bovis
AEARRVGRRFARLAPIVATHRKLTSARDDLE

SEQ ID NO: 215703 - protein, 24 aa, Mycobacterium bovis
AEASWLPASLLTPAMLGAHYRLGR

SEQ ID NO: 215704 - protein, 24 aa, Mycobacterium bovis
AEATYEQMWAADVAAMVGYHGGAS

SEQ ID NO: 215705 - protein, 30 aa, Mycobacterium bovis
AECWMHIGIDLFWFALPPEQLDLARVRPEY

SEQ ID NO: 215706 - protein, 21 aa, Mycobacterium bovis
AEDALWRWMTAAALVRPRGAG

SEQ ID NO: 215707 - protein, 27 aa, Mycobacterium bovis
AEDSRLPYLIRLPVGAGLVFATSDVWP

SEQ ID NO: 215708 - protein, 29 aa, Mycobacterium bovis
AEDWDLDALWTALKTLYPVGITADSLTRK

SEQ ID NO: 215709 - protein, 26 aa, Mycobacterium bovis
AEEITDRILLLDGLPNYQRIGSLRIG

SEQ ID NO: 215710 - protein, 25 aa, Mycobacterium bovis
AEELDRHLRLPLRNVLWEGDEALLT

SEQ ID NO: 215711 - protein, 19 aa, Mycobacterium bovis
AEERIEMWLRADGRQRVRV

SEQ ID NO: 215712 - protein, 30 aa, Mycobacterium bovis
AEGGLMPGFGGAPWVGGHWGLGGEGHSGAI

SEQ ID NO: 215713 - protein, 24 aa, Mycobacterium bovis
AEGHATKLLNLRSTLLTLAGGDPM

SEQ ID NO: 215714 - protein, 17 aa, Mycobacterium bovis
AEGLFGYLPPDAQNRLL

SEQ ID NO: 215715 - protein, 20 aa, Mycobacterium bovis
AEGLLLTMDQPYPVAMAKLG

SEQ ID NO: 215716 - protein, 24 aa, Mycobacterium bovis
AEGRLKGILKYYDAPIVSSDIVTD

SEQ ID NO: 215717 - protein, 27 aa, Mycobacterium bovis
AEGSALLREFVGMTLNLPTPEEAAAAE

SEQ ID NO: 215718 - protein, 28 aa, Mycobacterium bovis
AEGTFEYQALLFIPSHAPFDLFDRDAHV

SEQ ID NO: 215719 - protein, 23 aa, Mycobacterium bovis
AEHAELELALADPALHSNPAEAR

SEQ ID NO: 215720 - protein, 27 aa, Mycobacterium bovis
AEHDLLPDVLYTSLLRRAITTAHLALD

SEQ ID NO: 215721 - protein, 25 aa, Mycobacterium bovis
AEHLVRGRFVLVGVTPAVLASLLGE

SEQ ID NO: 215722 - protein, 26 aa, Mycobacterium bovis
AEHQAIIRDVLTASDFWGGAGSAACQ

SEQ ID NO: 215723 - protein, 18 aa, Mycobacterium bovis
AEHQAIISDVLTASDFWG

SEQ ID NO: 215724 - protein, 23 aa, Mycobacterium bovis
AEHRDYRLGLPRAGRWREVLNTD

SEQ ID NO: 215725 - protein, 18 aa, Mycobacterium bovis
AEHRYLMTVIATASNPRF

SEQ ID NO: 215726 - protein, 17 aa, Mycobacterium bovis
AEHTQSYVRACHLVGYQ

SEQ ID NO: 215727 - protein, 29 aa, Mycobacterium bovis
AEIAGRAAVPVLVHPAPRGVLGGLAATVY

SEQ ID NO: 215728 - protein, 18 aa, Mycobacterium bovis
AEILKIITGGRVIWDPEA

SEQ ID NO: 215729 - protein, 17 aa, Mycobacterium bovis
AEIRNRYDGRSLRFAAA

SEQ ID NO: 215730 - protein, 24 aa, Mycobacterium bovis
AEIRRRLKSFTVFRQRGDAFADRL

SEQ ID NO: 215731 - protein, 26 aa, Mycobacterium bovis
AEISSGPYRFVYRKRFHKRCETELTV

SEQ ID NO: 215732 - protein, 25 aa, Mycobacterium bovis
AELARWIAEPLSPTRPGRGSALTDS

SEQ ID NO: 215733 - protein, 47 aa, Mycobacterium bovis
AELEPDFQRAYKELAKQVRLPGFRPGKAPAKLLEARIGREAMLDQIV

SEQ ID NO: 215734 - protein, 26 aa, Mycobacterium bovis
AELFRAIALALERPLDPDRPLWECWI

SEQ ID NO: 215735 - protein, 30 aa, Mycobacterium bovis
AELGRALTPIPFAATVFAIEAILRMGDDEQ

SEQ ID NO: 215736 - protein, 27 aa, Mycobacterium bovis
AELHDVDWVPADRGWIADLARTLNGSA

SEQ ID NO: 215737 - protein, 20 aa, Mycobacterium bovis
AELLDVVLAIVRDQPVQPVA

SEQ ID NO: 215738 - protein, 19 aa, Mycobacterium bovis
AELPTIRAQIARMGTTLAA

SEQ ID NO: 215739 - protein, 23 aa, Mycobacterium bovis
AELVAWLEQLLSDSVLRDQLGAK

SEQ ID NO: 215740 - protein, 33 aa, Mycobacterium bovis
AELVSYVRGVLYFRTKRWPDVLAQFPEATQWRH

SEQ ID NO: 215741 - protein, 23 aa, Mycobacterium bovis
AELWSTFMQKWIAYTAAVIDAER

SEQ ID NO: 215742 - protein, 24 aa, Mycobacterium bovis
AEMARGQYWIHPALPEVVENALLG

SEQ ID NO: 215743 - protein, 25 aa, Mycobacterium bovis
AEMTVALLLAVARHLIPADADVRSG

SEQ ID NO: 215744 - protein, 19 aa, Mycobacterium bovis
AEMVELIEKMLACGAAYVI

SEQ ID NO: 215745 - protein, 24 aa, Mycobacterium bovis
AENDLLGIDLLGNTLIALGSEAQK

SEQ ID NO: 215746 - protein, 32 aa, Mycobacterium bovis
AENNIDFTPIIIPTINITLPTAAITVGGPTTS

SEQ ID NO: 215747 - protein, 28 aa, Mycobacterium bovis
AEPEDFVGALIYLLSDASSFYTGQVMYL

SEQ ID NO: 215748 - protein, 26 aa, Mycobacterium bovis
AEPPDRPIPGPLKWDLTRGVATDTPE

SEQ ID NO: 215749 - protein, 24 aa, Mycobacterium bovis
AEPTADLAMWPPAGAVPVEVADGY

SEQ ID NO: 215750 - protein, 21 aa, Mycobacterium bovis
AEQMKMFLTRLGFGSKVVVTG

SEQ ID NO: 215751 - protein, 29 aa, Mycobacterium bovis
AERALRARFRPILRPQFTLGDGANGLPLA

SEQ ID NO: 215752 - protein, 25 aa, Mycobacterium bovis
AERDYILELLLAHTSAGLPYERCVG

SEQ ID NO: 215753 - protein, 18 aa, Mycobacterium bovis
AERLFAERGFLAVRLEDI

SEQ ID NO: 215754 - protein, 22 aa, Mycobacterium bovis
AERLRARLIERINNLRVGHSLD

SEQ ID NO: 215755 - protein, 32 aa, Mycobacterium bovis
AERMSGTAVFEIFFRKLPPGRSYIMAAGLADV

SEQ ID NO: 215756 - protein, 20 aa, Mycobacterium bovis
AERPALSLSLDEACLLMFAR

SEQ ID NO: 215757 - protein, 26 aa, Mycobacterium bovis
AERYGVPASALLHRAGQRKLIGGQED

SEQ ID NO: 215758 - protein, 24 aa, Mycobacterium bovis
AESDLVDKYLITPAVDVLAGLAES

SEQ ID NO: 215759 - protein, 26 aa, Mycobacterium bovis
AESMDTEWPLPLLDLARIASDRGDAE

SEQ ID NO: 215760 - protein, 23 aa, Mycobacterium bovis
AESPIDWDIAWPAGDLQVNLTPA

SEQ ID NO: 215761 - protein, 24 aa, Mycobacterium bovis
AESPVLIVDYRLIPKHSLGMALDD

SEQ ID NO: 215762 - protein, 19 aa, Mycobacterium bovis
AETLPHRPGVYLFRGPSGE

SEQ ID NO: 215763 - protein, 22 aa, Mycobacterium bovis
AETPWIHRCATVLAVRSYLLRI

SEQ ID NO: 215764 - protein, 30 aa, Mycobacterium bovis; identical to SEQ ID NO: 123773

SEQ ID NO: 215765 - protein, 19 aa, Mycobacterium bovis
AEVLAFTAFPKAHWQKIWS

SEQ ID NO: 215766 - protein, 25 aa, Mycobacterium bovis
AEVNGQVFIVYGPQVTLVSPPHMER

SEQ ID NO: 215767 - protein, 20 aa, Mycobacterium bovis
AEVVALRRAGGLATGAIVVV

SEQ ID NO: 215768 - protein, 30 aa, Mycobacterium bovis
AEVWRRGSVIGSWLLDLTAIALRESPDLAE

SEQ ID NO: 215769 - protein, 19 aa, Mycobacterium bovis
AEWLVRQGVPFRSAHEAAG

SEQ ID NO: 215770 - protein, 18 aa, Mycobacterium bovis
AEWMNRPHLAAAWEYDWP

SEQ ID NO: 215771 - protein, 23 aa, Mycobacterium bovis
AEYADIWHSFTAGDSYLAKSAVL

SEQ ID NO: 215772 - protein, 31 aa, Mycobacterium bovis
AFAEREGVNLTFLPFFAKAVIDALKIHPNIN

SEQ ID NO: 215773 - protein, 17 aa, Mycobacterium bovis
AFAKTPPTVVMLAGLQG

SEQ ID NO: 215774 - protein, 17 aa, Mycobacterium bovis
AFATMGCLYPNRVFLGV

SEQ ID NO: 215775 - protein, 19 aa, Mycobacterium bovis
AFDGLRLAGRRVRRPELTL

SEQ ID NO: 215776 - protein, 24 aa, Mycobacterium bovis
AFDIAQFGWVGDAFPLSSLTQIYA

SEQ ID NO: 215777 - protein, 22 aa, Mycobacterium bovis
AFDILLAAYSLAATLWQIANPP

SEQ ID NO: 215778 - protein, 27 aa, Mycobacterium bovis
AFDRIDERLVVVGLDNTVTYKNGDPTI

SEQ ID NO: 215779 - protein, 26 aa, Mycobacterium bovis
AFDVRSGIIPISRWQYGIVATEHGCR

SEQ ID NO: 215780 - protein, 20 aa, Mycobacterium bovis
AFEGPPPWNIGEPQPELATL

SEQ ID NO: 215781 - protein, 24 aa, Mycobacterium bovis
AFEIDLRRLLYREAQQRGIYALGA

SEQ ID NO: 215782 - protein, 24 aa, Mycobacterium bovis
AFENNGIRALDLMSSPGSGKTTVL

SEQ ID NO: 215783 - protein, 29 aa, Mycobacterium bovis
AFETSWLDPFTEFRFPRIGTAVFDGIEIE

SEQ ID NO: 215784 - protein, 19 aa, Mycobacterium bovis
AFGRLLAVDIPALNLRRQL

SEQ ID NO: 215785 - protein, 24 aa, Mycobacterium bovis
AFGVELQFWVYEETVIRCPVENSL

SEQ ID NO: 215786 - protein, 25 aa, Mycobacterium bovis
AFHAWVQQFYGAELLFDLGDLPGAA

SEQ ID NO: 215787 - protein, 20 aa, Mycobacterium bovis
AFHERFVQALATGGGAYAAA

SEQ ID NO: 215788 - protein, 19 aa, Mycobacterium bovis
AFHQQIVQTLTSTAGAYAS

SEQ ID NO: 215789 - protein, 24 aa, Mycobacterium bovis
AFHTEFMAPALDGFAAAAANIATA

SEQ ID NO: 215790 - protein, 27 aa, Mycobacterium bovis
AFIGRLLELAPFRKIVYSSDGFGPAEL

SEQ ID NO: 215791 - protein, 54 aa, Mycobacterium bovis
AFITGNYSNGLFLSGDYQGLVGLNLVIDMPLPISLGVNIPIDIPITASAGNITL

SEQ ID NO: 215792 - protein, 30 aa, Mycobacterium bovis
AFITGSMNNGLLWRADRQGLLAANYTITIE

SEQ ID NO: 215793 - protein, 33 aa, Mycobacterium bovis
AFNIYRTGEHIGWRFWMGIAFELTSDPQELREL

SEQ ID NO: 215794 - protein, 25 aa, Mycobacterium bovis
AFNTPALNIHQIPLGFQVPGSIDAI

SEQ ID NO: 215795 - protein, 29 aa, Mycobacterium bovis
AFPDALLTRGRYQYRPEPPFVLGAEIAGV

SEQ ID NO: 215796 - protein, 25 aa, Mycobacterium bovis
AFQRIKEPFSRWASLLIHAGEPGAG

SEQ ID NO: 215797 - protein, 22 aa, Mycobacterium bovis
AFRYVMMVLRHIPRSIFRKLPI

SEQ ID NO: 215798 - protein, 27 aa, Mycobacterium bovis
AFSDDLTLLPVASIPVPGPVGVLDALA

SEQ ID NO: 215799 - protein, 17 aa, Mycobacterium bovis
AFTLPELIGLTAGADVV

SEQ ID NO: 215800 - protein, 26 aa, Mycobacterium bovis
AFVNALPVFIASDPVWAKKFTDAGVP

SEQ ID NO: 215801 - protein, 22 aa, Mycobacterium bovis
AFYERLRELFAARKSITTFGPY

SEQ ID NO: 215802 - protein, 27 aa, Mycobacterium bovis
AGAAEALRWAMMRGEPLVVLADALAEA

SEQ ID NO: 215803 - protein, 19 aa, Mycobacterium bovis
AGAALAPGLRGPVLVLGGP

SEQ ID NO: 215804 - protein, 40 aa, Mycobacterium bovis
AGAAVDFAVLYPTGRLINAPLPTWNHRRLLLDDTTRRIAH

SEQ ID NO: 215805 - protein, 21 aa, Mycobacterium bovis
AGAFVNWEGRYRTFEPALRGS

SEQ ID NO: 215806 - protein, 27 aa, Mycobacterium bovis
AGAGPISIPIIDLRPAPGFFNATTGPS

SEQ ID NO: 215807 - protein, 25 aa, Mycobacterium bovis
AGAHADAYLWIKRPGESDGTCGRGE

SEQ ID NO: 215808 - protein, 27 aa, Mycobacterium bovis
AGAHLRNMAFYNFGLRLLKRARDADRA

SEQ ID NO: 215809 - protein, 34 aa, Mycobacterium bovis
AGALARHPLAGRRTDPQLAAFYHRLMTTQRHCHT

SEQ ID NO: 215810 - protein, 19 aa, Mycobacterium bovis
AGALLFTCNGRGRRMFGVA

SEQ ID NO: 215811 - protein, 25 aa, Mycobacterium bovis
AGARDFQRFLIGKLKDIREVVATAS

SEQ ID NO: 215812 - protein, 22 aa, Mycobacterium bovis
AGARFRVRVRLTGHLDPIDGNY

SEQ ID NO: 215813 - protein, 26 aa, Mycobacterium bovis
AGASNVMIGSWFAGTYESPGDLMRDR

SEQ ID NO: 215814 - protein, 24 aa, Mycobacterium bovis
AGAVMVPRLPPSQARVLLMAALAA

SEQ ID NO: 215815 - protein, 30 aa, Mycobacterium bovis
AGAYLVGWDPLLQSGLGEPTLTWLDSLAPN

SEQ ID NO: 215816 - protein, 20 aa, Mycobacterium bovis
AGCFVLPIEDSLQSIFATLG

SEQ ID NO: 215817 - protein, 30 aa, Mycobacterium bovis
AGDHAAICWPLLVGMAKAKYYLLTCEPLSG

SEQ ID NO: 215818 - protein, 25 aa, Mycobacterium bovis
AGDIAWLTRPLIDSYHTVWFELHEE

SEQ ID NO: 215819 - protein, 24 aa, Mycobacterium bovis
AGDPVALRAFRRGAAALAAMIASV

SEQ ID NO: 215820 - protein, 29 aa, Mycobacterium bovis
AGDQAGFPLGWVHDVVWAPRPIGGPDAAG

SEQ ID NO: 215821 - protein, 24 aa, Mycobacterium bovis
AGDTAAMRPFLLVASFVNPHDIVL

SEQ ID NO: 215822 - protein, 23 aa, Mycobacterium bovis
AGELLLKPPRSGLPVIEVLDTEL

SEQ ID NO: 215823 - protein, 22 aa, Mycobacterium bovis
AGENLFRPLLMRVTSEGVGKGI

SEQ ID NO: 215824 - protein, 18 aa, Mycobacterium bovis
AGEPLLQPLRTLFEPIML

SEQ ID NO: 215825 - protein, 25 aa, Mycobacterium bovis
AGETGLRPDFPRPALLSGAGDAVEF

SEQ ID NO: 215826 - protein, 17 aa, Mycobacterium bovis
AGFDPARPTAFSAEGLL

SEQ ID NO: 215827 - protein, 17 aa, Mycobacterium bovis
AGFLTARPGVCLTTSGP

SEQ ID NO: 215828 - protein, 28 aa, Mycobacterium bovis
AGFSHFTLLLVHALRQQFSRVRVFAFID

SEQ ID NO: 215829 - protein, 21 aa, Mycobacterium bovis
AGGAGGILWGNGGNGGSGAPG

SEQ ID NO: 215830 - protein, 22 aa, Mycobacterium bovis
AGGAGGLLFGSGGAGGPGGVGN

SEQ ID NO: 215831 - protein, 26 aa, Mycobacterium bovis
AGGAGGSGGFLSGAAGVSGADGIGGA

SEQ ID NO: 215832 - protein, 26 aa, Mycobacterium bovis
AGGAGRGLFLGLGGDGGAGGTSNNNG

SEQ ID NO: 215833 - protein, 19 aa, Mycobacterium bovis
AGGAWQGPASAAMANAAGP

SEQ ID NO: 215834 - protein, 23 aa, Mycobacterium bovis
AGGDGGLFFGVGGAGGAGGTGTN

SEQ ID NO: 215835 - protein, 29 aa, Mycobacterium bovis
AGGDIPFYEPGLRKLLTDNLAAGRLRFTT

SEQ ID NO: 215836 - protein, 19 aa, Mycobacterium bovis
AGGLGGFRGAGGTGGAGGD

SEQ ID NO: 215837 - protein, 24 aa, Mycobacterium bovis
AGGNALMFGIGGNGGAGGAASGVG

SEQ ID NO: 215838 - protein, 23 aa, Mycobacterium bovis
AGGNGGLLFGSAGAGGAGGSGAN

SEQ ID NO: 215839 - protein, 28 aa, Mycobacterium bovis
AGGNGGNGGWLFGAGGTGGIGGTGAPGA

SEQ ID NO: 215840 - protein, 23 aa, Mycobacterium bovis
AGGNGGWLYGNGGPGGAAGLGTA

SEQ ID NO: 215841 - protein, 25 aa, Mycobacterium bovis
AGGRPLPLYCASLRTAEPRLLERLG

SEQ ID NO: 215842 - protein, 17 aa, Mycobacterium bovis
AGGRRIAVPPRGTRPTT

SEQ ID NO: 215843 - protein, 24 aa, Mycobacterium bovis
AGGRRRLILIHAPSGFGKSTLAAQ

SEQ ID NO: 215844 - protein, 25 aa, Mycobacterium bovis
AGGRSGLFEVLAAGGAGGTGGLSVN

SEQ ID NO: 215845 - protein, 23 aa, Mycobacterium bovis
AGGSGGLLFGSGGAGGIGGAGGV

SEQ ID NO: 215846 - protein, 22 aa, Mycobacterium bovis
AGGSVQWVLGNLGAIPTVSIDY

SEQ ID NO: 215847 - protein, 27 aa, Mycobacterium bovis
AGGVGGRGGWLLGNGGTGGAGGAAGAT

SEQ ID NO: 215848 - protein, 17 aa, Mycobacterium bovis
AGHIYAVIGLKDTTTGD

SEQ ID NO: 215849 - protein, 33 aa, Mycobacterium bovis
AGHKFGGPPGVGALLLRRDVTCVPLMHGGGQER

SEQ ID NO: 215850 - protein, 21 aa, Mycobacterium bovis
AGHNFPLACPGLLGAMTVGAT

SEQ ID NO: 215851 - protein, 24 aa, Mycobacterium bovis
AGHQVRWTILLDGAVRISVGCQSG

SEQ ID NO: 215852 - protein, 20 aa, Mycobacterium bovis
AGHRWPSFATQTLWRFFAAH

SEQ ID NO: 215853 - protein, 21 aa, Mycobacterium bovis
AGHSYGHSLLLAGRKVNLEFV

SEQ ID NO: 215854 - protein, 24 aa, Mycobacterium bovis
AGIEPMFAIAFTRAIVGRHLLEVN

SEQ ID NO: 215855 - protein, 34 aa, Mycobacterium bovis
AGIGNMLTGLLLGLPTVIYPLGAFDPGQLLDVLE

SEQ ID NO: 215856 - protein, 21 aa, Mycobacterium bovis
AGIKPIIGVEAYIAPGSRFDT

SEQ ID NO: 215857 - protein, 21 aa, Mycobacterium bovis
AGIQVTVRYFAAARAAAGAGS

SEQ ID NO: 215858 - protein, 18 aa, Mycobacterium bovis
AGIRAQLLERFGMFGIRM

SEQ ID NO: 215859 - protein, 27 aa, Mycobacterium bovis
AGISRPTFYFYFPSKEAVLLTLLDRVV

SEQ ID NO: 215860 - protein, 25 aa, Mycobacterium bovis
AGITCAVLIPQGKIAMGKLAQAVMH

SEQ ID NO: 215861 - protein, 25 aa, Mycobacterium bovis
AGKDLPVVGFIWEVLGRIGIGRKDA

SEQ ID NO: 215862 - protein, 17 aa, Mycobacterium bovis
AGKRLAPHALEWDAAKH

SEQ ID NO: 215863 - protein, 49 aa, Mycobacterium bovis
AGKTGMDVCLWLLRNDVCPDKLTWIMPRDSWLIDRATLQPGPTFVRQFR

SEQ ID NO: 215864 - protein, 21 aa, Mycobacterium bovis
AGLCIVLPGPFQRFAERRRAR

SEQ ID NO: 215865 - protein, 23 aa, Mycobacterium bovis
AGLDARAYRLNWPAGTVVYEIDQ

SEQ ID NO: 215866 - protein, 24 aa, Mycobacterium bovis
AGLDARAYRLPWPAGTVVYEIDQP

SEQ ID NO: 215867 - protein, 24 aa, Mycobacterium bovis
AGLDCRAYRLDWQPGTTVFEIDVP

SEQ ID NO: 215868 - protein, 20 aa, Mycobacterium bovis
AGLDRAALPALRHVVRVPVE

SEQ ID NO: 215869 - protein, 25 aa, Mycobacterium bovis
AGLIDALRWLAANVPIYAVNVLLST

SEQ ID NO: 215870 - protein, 17 aa, Mycobacterium bovis
AGLIGTIGIRVGGADLP

SEQ ID NO: 215871 - protein, 28 aa, Mycobacterium bovis
AGLKGLHEFFTPVLRNLGRCGRVVVVGG

SEQ ID NO: 215872 - protein, 23 aa, Mycobacterium bovis
AGLLEAAGYRRATDGSEADVVVF

SEQ ID NO: 215873 - protein, 20 aa, Mycobacterium bovis
AGLPSLMVLTGVNSAWDAVY

SEQ ID NO: 215874 - protein, 19 aa, Mycobacterium bovis
AGLPVLGAKGAEYPLLPDE

SEQ ID NO: 215875 - protein, 25 aa, Mycobacterium bovis
AGLRAGIPTLILWVTSDQPIWAAQI

SEQ ID NO: 215876 - protein, 27 aa, Mycobacterium bovis
AGLRSLLAYQWAHPGKQLLFMGQEFGQ

SEQ ID NO: 215877 - protein, 22 aa, Mycobacterium bovis
AGLTASRFVACPFGGSGARMYR

SEQ ID NO: 215878 - protein, 17 aa, Mycobacterium bovis
AGLVIPAARRVSEAGGF

SEQ ID NO: 215879 - protein, 27 aa, Mycobacterium bovis
AGLVRSHFGARRKAFNWGLAQVKADLD

SEQ ID NO: 215880 - protein, 32 aa, Mycobacterium bovis
AGMMWREVYRLRQPVLLIWGREDRVNPLDGAL

SEQ ID NO: 215881 - protein, 25 aa, Mycobacterium bovis
AGMPERLRLPTARPYPPVADQRGAS

SEQ ID NO: 215882 - protein, 18 aa, Mycobacterium bovis
AGNADFAIAIRTALMRNG

SEQ ID NO: 215883 - protein, 18 aa, Mycobacterium bovis
AGNGLRYNRFHTTALCSP

SEQ ID NO: 215884 - protein, 36 aa, Mycobacterium bovis
AGNHVRVYVPFGTRWYGYFLRRLAERPANLAFFLRA

SEQ ID NO: 215885 - protein, 22 aa, Mycobacterium bovis
AGNIARLSWLAAGYPEEVPGVT

SEQ ID NO: 215886 - protein, 20 aa, Mycobacterium bovis
AGNITAYWKGYTEYHQLGLI

SEQ ID NO: 215887 - protein, 40 aa, Mycobacterium bovis
AGPASRVAILLPAHWQTAAVLFGVWWIGAQAILDDSPADV

SEQ ID NO: 215888 - protein, 25 aa, Mycobacterium bovis
AGPCGMPILDDAAAWFIGRTASRSD

SEQ ID NO: 215889 - protein, 21 aa, Mycobacterium bovis
AGPDRSLIRAQSWDIDLPNQF

SEQ ID NO: 215890 - protein, 26 aa, Mycobacterium bovis
AGPEHTYRVPLPAPGEPKRAILDSYT

SEQ ID NO: 215891 - protein, 20 aa, Mycobacterium bovis
AGPGLYRSFSSKQAILDALI

SEQ ID NO: 215892 - protein, 18 aa, Mycobacterium bovis
AGPRYGFRPTVMARPPFA

SEQ ID NO: 215893 - protein, 23 aa, Mycobacterium bovis
AGPVHFDIPLREPLVPDPEPLGA

SEQ ID NO: 215894 - protein, 23 aa, Mycobacterium bovis
AGPWTEGLLFALGGPIYAGTNEI

SEQ ID NO: 215895 - protein, 27 aa, Mycobacterium bovis
AGQIGYSLLFRLASGSLLGPDRPIELR

SEQ ID NO: 215896 - protein, 20 aa, Mycobacterium bovis
AGQILWAPSPTWDPRARGWW

SEQ ID NO: 215897 - protein, 30 aa, Mycobacterium bovis
AGRGLRCIAPTWPLGAHPKPLRPGADQTIG

SEQ ID NO: 215898 - protein, 17 aa, Mycobacterium bovis
AGRLDEFAHWAKSLTQR

SEQ ID NO: 215899 - protein, 18 aa, Mycobacterium bovis
AGRLMFYGQGAGGAPTAS

SEQ ID NO: 215900 - protein, 23 aa, Mycobacterium bovis
AGRPYLVEGVGEDFWPAAYDPSV

SEQ ID NO: 215901 - protein, 28 aa, Mycobacterium bovis
AGRSYRLYKPVGLPSSAPLVVMLHGGFG

SEQ ID NO: 215902 - protein, 26 aa, Mycobacterium bovis
AGRVKRPQIAIATWIVPSIVAFGTDN

SEQ ID NO: 215903 - protein, 23 aa, Mycobacterium bovis
AGSALGTTIFGGSGGVGGSGGDG

SEQ ID NO: 215904 - protein, 32 aa, Mycobacterium bovis
AGSDRIRFTPYQKLVILDIPDALLDDLIAGLD

SEQ ID NO: 215905 - protein, 28 aa, Mycobacterium bovis
AGSEQFLDPLIFARRRLIAAGTTRGRLD

SEQ ID NO: 215906 - protein, 24 aa, Mycobacterium bovis
AGSGVLYRLHLDLASLSIAEFYAD

SEQ ID NO: 215907 - protein, 35 aa, Mycobacterium bovis
AGSILCDPWVNPAYFASWFPFPDNSGLDWGALGEC

SEQ ID NO: 215908 - protein, 27 aa, Mycobacterium bovis
AGSLNRPGYLRFDFNWQGPLTDDQRTQ

SEQ ID NO: 215909 - protein, 25 aa, Mycobacterium bovis
AGSRAAPLLRLPDVRALLDAQLAGR

SEQ ID NO: 215910 - protein, 17 aa, Mycobacterium bovis
AGSSRKAFGGDGGVGGD

SEQ ID NO: 215911 - protein, 18 aa, Mycobacterium bovis
AGSTAMPQMLRGRTQRTD

SEQ ID NO: 215912 - protein, 24 aa, Mycobacterium bovis
AGTAELIRIALTTKLKPFTYVSTA

SEQ ID NO: 215913 - protein, 22 aa, Mycobacterium bovis
AGTFPWVLAITMPYSDAAQRGA

SEQ ID NO: 215914 - protein, 27 aa, Mycobacterium bovis
AGTGALLAWLTARPLGSRAYAWRMMRD

SEQ ID NO: 215915 - protein, 18 aa, Mycobacterium bovis
AGTLTYAALAAAGDMVSL

SEQ ID NO: 215916 - protein, 44 aa, Mycobacterium bovis
AGTNGFAGFGGSAGGGGWVGAVNFGPISVQGFGLFGHGGDGGNG

SEQ ID NO: 215917 - protein, 18 aa, Mycobacterium bovis
AGTPPPPHYPQHHPRQPL

SEQ ID NO: 215918 - protein, 22 aa, Mycobacterium bovis
AGTTANWIFLLARTDPSAAKHR

SEQ ID NO: 215919 - protein, 20 aa, Mycobacterium bovis
AGTVYRHFPTKEALFQAVIA

SEQ ID NO: 215920 - protein, 33 aa, Mycobacterium bovis
AGVAKYPARVKCALLGWMAFKDALAQASEAFEE

SEQ ID NO: 215921 - protein, 24 aa, Mycobacterium bovis
AGVFKRHRQIDRPCLLGYIDKCSA

SEQ ID NO: 215922 - protein, 45 aa, Mycobacterium bovis
AGVHLGYKCSIRKPWWSTPSLWMPDLFMLRQIHFAPRLTVNAAAA

SEQ ID NO: 215923 - protein, 25 aa, Mycobacterium bovis
AGVKFSMVLPSFVNTELIAGTGGIK

SEQ ID NO: 215924 - protein, 23 aa, Mycobacterium bovis
AGVLGWGRLWELTDEQWETVIGV

SEQ ID NO: 215925 - protein, 33 aa, Mycobacterium bovis; identical to SEQ ID NO: 196419

SEQ ID NO: 215926 - protein, 27 aa, Mycobacterium bovis
AGVNAVNPGLATPVTPAANGGNGLNLV

SEQ ID NO: 215927 - protein, 19 aa, Mycobacterium bovis
AGVPDLRRLFPTGFDEQRR

SEQ ID NO: 215928 - protein, 25 aa, Mycobacterium bovis
AGVPKTLIQHLIRWVISAGEFGEKV

SEQ ID NO: 215929 - protein, 40 aa, Mycobacterium bovis
AGVTGENRLKIARLLALIDMLSDRFIGEPASWLEMPIQAG

SEQ ID NO: 215930 - protein, 23 aa, Mycobacterium bovis
AGVVLLAGAAFVELALRAADQVD

SEQ ID NO: 215931 - protein, 26 aa, Mycobacterium bovis
AGVVRFIGVNGYRWMIRCVVNGPQET

SEQ ID NO: 215932 - protein, 26 aa, Mycobacterium bovis
AGVVSPGFIGAPLALAALGQMARGGT

SEQ ID NO: 215933 - protein, 31 aa, Mycobacterium bovis
AGVWARALAEKVILKAWPATSPMGAPDIVAQ

SEQ ID NO: 215934 - protein, 19 aa, Mycobacterium bovis
AGWLLHAEGILRPGSVEPG

SEQ ID NO: 215935 - protein, 24 aa, Mycobacterium bovis
AGWLLLCCGAMLDGAREALSIAES

SEQ ID NO: 215936 - protein, 24 aa, Mycobacterium bovis
AGWPNYDAVASIAWLGYDAPDGLK

SEQ ID NO: 215937 - protein, 26 aa, Mycobacterium bovis
AGYEKWRIRFASTAWTSTWRRWCIPA

SEQ ID NO: 215938 - protein, 20 aa, Mycobacterium bovis
AGYPALVAPLTFLAIAGRRV

SEQ ID NO: 215939 - protein, 24 aa, Mycobacterium bovis
AGYRAVHVWLRLPAGRVEIQIRTI

SEQ ID NO: 215940 - protein, 24 aa, Mycobacterium bovis
AGYVRKNSLWPATFGLACCAIEMM

SEQ ID NO: 215941 - protein, 19 aa, Mycobacterium bovis
AHAAVVYGYFPAVSEGNDI

SEQ ID NO: 215942 - protein, 23 aa, Mycobacterium bovis
AHALTAIKRVLPGLGYRLTSRGV

SEQ ID NO: 215943 - protein, 23 aa, Mycobacterium bovis
AHAPGQLDFLGYGAQRALDAEVP

SEQ ID NO: 215944 - protein, 18 aa, Mycobacterium bovis
AHAQIYQAVSAQAAAIHE

SEQ ID NO: 215945 - protein, 19 aa, Mycobacterium bovis
AHATAWYGLNDLAQIKAGD

SEQ ID NO: 215946 - protein, 19 aa, Mycobacterium bovis
AHAVLVDHLIPPMARAETY

SEQ ID NO: 215947 - protein, 20 aa, Mycobacterium bovis
AHCHMHTNPHLLIFGAAKSG

SEQ ID NO: 215948 - protein, 25 aa, Mycobacterium bovis
AHDEGWLAEHMLILKLISPENKAYY

SEQ ID NO: 215949 - protein, 36 aa, Mycobacterium bovis
AHDRLGGPGSWLLAVPPYHIAGLAVLVRSVIAGSVP

SEQ ID NO: 215950 - protein, 27 aa, Mycobacterium bovis
AHESVDWDLKSLRWAWNRAKDDVAPWW

SEQ ID NO: 215951 - protein, 22 aa, Mycobacterium bovis
AHFAAHAAMYQSVSARAAAIHD

SEQ ID NO: 215952 - protein, 21 aa, Mycobacterium bovis
AHGELLTLRPFGCADGVVARA

SEQ ID NO: 215953 - protein, 18 aa, Mycobacterium bovis
AHGIGVVGLLNVQYALKD

SEQ ID NO: 215954 - protein, 20 aa, Mycobacterium bovis
AHGQLPNMRAIVGFAAETGD

SEQ ID NO: 215955 - protein, 18 aa, Mycobacterium bovis
AHGRGVFVLAATSNPEGA

SEQ ID NO: 215956 - protein, 23 aa, Mycobacterium bovis
AHHEGRVVFVRYALPGERVRARV

SEQ ID NO: 215957 - protein, 25 aa, Mycobacterium bovis
AHLDVNIPIDIPITGSFTDLVVDNF

SEQ ID NO: 215958 - protein, 25 aa, Mycobacterium bovis
AHLEALGPAMRRALAAAGLKQPDIV

SEQ ID NO: 215959 - protein, 18 aa, Mycobacterium bovis
AHLLAGQLAPGARVLIVG

SEQ ID NO: 215960 - protein, 19 aa, Mycobacterium bovis
AHNVAFDYAFLAAEAEIAE

SEQ ID NO: 215961 - protein, 19 aa, Mycobacterium bovis
AHQARILLAKNPAGWQEAL

SEQ ID NO: 215962 - protein, 24 aa, Mycobacterium bovis
AHQGLHMWLAEYPQPRPPRETWES

SEQ ID NO: 215963 - protein, 22 aa, Mycobacterium bovis
AHRAGHLGAMYPWQSGSDGSEV

SEQ ID NO: 215964 - protein, 25 aa, Mycobacterium bovis
AHSISPWGTWEWIGPPALGAVLPAR

SEQ ID NO: 215965 - protein, 17 aa, Mycobacterium bovis
AHTLGLHGPAMTFDTAC

SEQ ID NO: 215966 - protein, 19 aa, Mycobacterium bovis
AHVDLYFEAAVAGAIPVIR

SEQ ID NO: 215967 - protein, 31 aa, Mycobacterium bovis
AHVIAAFDTELFGHWWYEGPTWLQRVLRALP

SEQ ID NO: 215968 - protein, 22 aa, Mycobacterium bovis
AHVRAWGPRAPFEVLLGKPRAG

SEQ ID NO: 215969 - protein, 28 aa, Mycobacterium bovis
AIAEGGWVLPYLPKPWGRAASPVEQIII

SEQ ID NO: 215970 - protein, 25 aa, Mycobacterium bovis
AIAIDERALAQRPAWLAAAEALTTE

SEQ ID NO: 215971 - protein, 22 aa, Mycobacterium bovis
AIAIDPQQRLLLETSWEAMEHA

SEQ ID NO: 215972 - protein, 19 aa, Mycobacterium bovis
AIALAQFYDVPMVSTIHAT

SEQ ID NO: 215973 - protein, 26 aa, Mycobacterium bovis
AIAQTWWSERFIAVLEDIGLGNRLQR

SEQ ID NO: 215974 - protein, 17 aa, Mycobacterium bovis
AIAVQWCRSWPGCTAVA

SEQ ID NO: 215975 - protein, 19 aa, Mycobacterium bovis
AICDIGELEWLYSARSATD

SEQ ID NO: 215976 - protein, 20 aa, Mycobacterium bovis
AIDLQRYGLTWKWPDVDCAH

SEQ ID NO: 215977 - protein, 17 aa, Mycobacterium bovis
AIDPIGLSGFTLPQVNI

SEQ ID NO: 215978 - protein, 17 aa, Mycobacterium bovis
AIEQLPIPYTAVATDLL

SEQ ID NO: 215979 - protein, 18 aa, Mycobacterium bovis
AIGAVLSMHFAKQAARFF

SEQ ID NO: 215980 - protein, 25 aa, Mycobacterium bovis
AIGCPLINIHHSFLPAFTGAAPYQR

SEQ ID NO: 215981 - protein, 22 aa, Mycobacterium bovis
AIGMEFGYVLKNYGVDVTIVEF

SEQ ID NO: 215982 - protein, 17 aa, Mycobacterium bovis
AIGPLVDALAEHAARLR

SEQ ID NO: 215983 - protein, 18 aa, Mycobacterium bovis
AIGRAFMKKVWLRDSRNP

SEQ ID NO: 215984 - protein, 24 aa, Mycobacterium bovis
AIGVALGITRQAAFQRFGPHSTAS

SEQ ID NO: 215985 - protein, 22 aa, Mycobacterium bovis
AIHEMFVNTLQMSSGSYAATEA

SEQ ID NO: 215986 - protein, 21 aa, Mycobacterium bovis
AIHEMFVNTLVASSGSYAATE

SEQ ID NO: 215987 - protein, 18 aa, Mycobacterium bovis
AIHLSRVPGADLLEVCQR

SEQ ID NO: 215988 - protein, 17 aa, Mycobacterium bovis
AIIAACPSTWPWNLLGW

SEQ ID NO: 215989 - protein, 20 aa, Mycobacterium bovis
AIIANRVSFAFGLRGPSVTI

SEQ ID NO: 215990 - protein, 19 aa, Mycobacterium bovis
AIIRPRRARWVVRMLTSLL

SEQ ID NO: 215991 - protein, 17 aa, Mycobacterium bovis
AIKDLAALATALQELTT

SEQ ID NO: 215992 - protein, 18 aa, Mycobacterium bovis
AILIRKVDWVDEITRVHA

SEQ ID NO: 215993 - protein, 28 aa, Mycobacterium bovis
AILNGRRDLFRPAVFRSLWGRVEDAISA

SEQ ID NO: 215994 - protein, 19 aa, Mycobacterium bovis
AILQSWLDERLAAMAGTQE

SEQ ID NO: 215995 - protein, 21 aa, Mycobacterium bovis
AIMEEVLLPVMYDIPSRDDVA

SEQ ID NO: 215996 - protein, 18 aa, Mycobacterium bovis
AIPVVSFRLAGDRGYTEF

SEQ ID NO: 215997 - protein, 18 aa, Mycobacterium bovis
AIQRKLYQACRRWPKLMR

SEQ ID NO: 215998 - protein, 25 aa, Mycobacterium bovis
AIRESLDSLGPIFSELRDTGRELLE

SEQ ID NO: 215999 - protein, 23 aa, Mycobacterium bovis
AIRHAVAWARPGDVVLIAGKGHE

SEQ ID NO: 216000 - protein, 19 aa, Mycobacterium bovis
AIRIPATASVGPFDVTFVN

SEQ ID NO: 216001 - protein, 19 aa, Mycobacterium bovis
AIRTPGLLPNAKLVVDHFH

SEQ ID NO: 216002 - protein, 17 aa, Mycobacterium bovis
AISLLQTLPIDTLKIDK

SEQ ID NO: 216003 - protein, 19 aa, Mycobacterium bovis
AITEFVVSPLFGSPPAAEL

SEQ ID NO: 216004 - protein, 26 aa, Mycobacterium bovis
AITGRRYLDMFTFVASSALGMNPPAL

SEQ ID NO: 216005 - protein, 20 aa, Mycobacterium bovis
AITLFPGGLTFPATSLLNLD

SEQ ID NO: 216006 - protein, 26 aa, Mycobacterium bovis
AITNTARPWHIGLYGNAGGLGPTQGH

SEQ ID NO: 216007 - protein, 20 aa, Mycobacterium bovis
AIVDAFVTTPWSKAQRHQRR

SEQ ID NO: 216008 - protein, 20 aa, Mycobacterium bovis
AIVEFPPAGTLSGIAKRELR

SEQ ID NO: 216009 - protein, 19 aa, Mycobacterium bovis
AIVNIPFLGQRIKPPYVAA

SEQ ID NO: 216010 - protein, 25 aa, Mycobacterium bovis
AIVNVSSVLAWLPLGMSYGVSKAAM

SEQ ID NO: 216011 - protein, 21 aa, Mycobacterium bovis
AIVQIAARRPTTGHWQIVVIE

SEQ ID NO: 216012 - protein, 36 aa, Mycobacterium bovis
AKAFARLGIRCFGFSPLRLPPDLDFTSLFHGVDERV

SEQ ID NO: 216013 - protein, 18 aa, Mycobacterium bovis
AKALWLRSRRRGVLAGYS

SEQ ID NO: 216014 - protein, 18 aa, Mycobacterium bovis
AKAMAVVMLALPGVVFLY

SEQ ID NO: 216015 - protein, 23 aa, Mycobacterium bovis
AKAYAPFADLIWMETGTPDLEAA

SEQ ID NO: 216016 - protein, 29 aa, Mycobacterium bovis
AKAYSAAWGVPFYAVNHLGGHLAADVYEH

SEQ ID NO: 216017 - protein, 20 aa, Mycobacterium bovis
AKDLTGLRQRWALVGGFAVS

SEQ ID NO: 216018 - protein, 22 aa, Mycobacterium bovis
AKDRGLWNLFLSAESGLTNLEY

SEQ ID NO: 216019 - protein, 24 aa, Mycobacterium bovis
AKHAVFDRLVYRKLRAALGGNCRA

SEQ ID NO: 216020 - protein, 34 aa, Mycobacterium bovis
AKIPTGTVVSWLPLYHDMGLILGICAPLVARRRA

SEQ ID NO: 216021 - protein, 29 aa, Mycobacterium bovis
AKKPEETRYWYYALLGFGLNRYRAGSGQP

SEQ ID NO: 216022 - protein, 27 aa, Mycobacterium bovis
AKKRPEFGKLTPLYPNQRLRLETSTER

SEQ ID NO: 216023 - protein, 17 aa, Mycobacterium bovis
AKMDDWLDASRALLTRI

SEQ ID NO: 216024 - protein, 20 aa, Mycobacterium bovis
AKNDFGLVAIDTLLARMEND

SEQ ID NO: 216025 - protein, 26 aa, Mycobacterium bovis
AKPAQVALAWLISLPGVVAIPGASSV

SEQ ID NO: 216026 - protein, 20 aa, Mycobacterium bovis
AKPPFVSRSVLVTGGNRGIG

SEQ ID NO: 216027 - protein, 34 aa, Mycobacterium bovis
AKPTLMLLDGNSLAFRAFYALPAENFKTRGGLTT

SEQ ID NO: 216028 - protein, 30 aa, Mycobacterium bovis
AKQAGLAYGLIYWYFDSKDDLFHALMAGEE

SEQ ID NO: 216029 - protein, 24 aa, Mycobacterium bovis
AKQALTEAVLWPLQHPDTFARLGV

SEQ ID NO: 216030 - protein, 19 aa, Mycobacterium bovis
AKRGFDPVLGARPLRRTIQ

SEQ ID NO: 216031 - protein, 26 aa, Mycobacterium bovis
AKRQATLNRLLFPSPTKEFNEHREAY

SEQ ID NO: 216032 - protein, 29 aa, Mycobacterium bovis
AKTSWDLRKFLWAPRLGCYGIQRIHPLRN

SEQ ID NO: 216033 - protein, 18 aa, Mycobacterium bovis
AKVARGLVMAVRRAVRQQ

SEQ ID NO: 216034 - protein, 17 aa, Mycobacterium bovis
AKVDVLVSYLPVGSEEA

SEQ ID NO: 216035 - protein, 30 aa, Mycobacterium bovis
AKVERPDLVIGWWAAPTILEHGTPEQIERF

SEQ ID NO: 216036 - protein, 36 aa, Mycobacterium bovis
AKVLPASADEVSVAVAALFGTHAQEYQTVSAQVATF

SEQ ID NO: 216037 - protein, 41 aa, Mycobacterium bovis
AKVSGSRFYFLTGRGALLQLGLLQLALKLAVDNGFVPTIPP

SEQ ID NO: 216038 - protein, 28 aa, Mycobacterium bovis
AKVTEVRLFLRRVPALAFLPNRRPAEPN

SEQ ID NO: 216039 - protein, 28 aa, Mycobacterium bovis
AKVVDPSWFNWPALPVAMADTIVPDFPL

SEQ ID NO: 216040 - protein, 23 aa, Mycobacterium bovis
AKWVVRVVLSLMYWPAENDEAER

SEQ ID NO: 216041 - protein, 24 aa, Mycobacterium bovis
AKYPDRLTVLHWLESLQGLPSASA

SEQ ID NO: 216042 - protein, 21 aa, Mycobacterium bovis
ALAAQLRSYWARPLPATIVMR

SEQ ID NO: 216043 - protein, 26 aa, Mycobacterium bovis
ALAARAAPLVAILWGRDASTLKPMLA

SEQ ID NO: 216044 - protein, 29 aa, Mycobacterium bovis
ALADPRRVPVWLPYIRGERTPFHEPDRRA

SEQ ID NO: 216045 - protein, 25 aa, Mycobacterium bovis
ALADTGLLAPHWPAPYGRGASPAEQ

SEQ ID NO: 216046 - protein, 31 aa, Mycobacterium bovis
ALAEYSLDLFALLPLGELWVAAARMRQVDQL

SEQ ID NO: 216047 - protein, 30 aa, Mycobacterium bovis
ALAGKSGFGGFGGLLLGADGYNAPESTSPW

SEQ ID NO: 216048 - protein, 26 aa, Mycobacterium bovis
ALAGLTPLRHWRSALATALAAPANST

SEQ ID NO: 216049 - protein, 26 aa, Mycobacterium bovis
ALALDDVVKFLLPRGSTRKAAKGAAS

SEQ ID NO: 216050 - protein, 19 aa, Mycobacterium bovis
ALALGTQGAWTGSQWLMVE

SEQ ID NO: 216051 - protein, 22 aa, Mycobacterium bovis
ALALPYPGVLPQGPPPPKAFGT

SEQ ID NO: 216052 - protein, 19 aa, Mycobacterium bovis
ALALYHTKRLASPAQRIML

SEQ ID NO: 216053 - protein, 19 aa, Mycobacterium bovis
ALALYRSVGFQRVGLRRRY

SEQ ID NO: 216054 - protein, 26 aa, Mycobacterium bovis
ALAPDRPFFVYFAPGATHAPHHVPRE

SEQ ID NO: 216055 - protein, 17 aa, Mycobacterium bovis
ALAPRPGQRLWDVGAGS

SEQ ID NO: 216056 - protein, 24 aa, Mycobacterium bovis
ALAPVRFFNPIAMRFAQKATREDI

SEQ ID NO: 216057 - protein, 18 aa, Mycobacterium bovis
ALAQHRANLGLKARIIGI

SEQ ID NO: 216058 - protein, 33 aa, Mycobacterium bovis
ALARPLVILLHGFGSFWWSWRHQLCGLTGARVV

SEQ ID NO: 216059 - protein, 26 aa, Mycobacterium bovis
ALATLVVNAIRKTLKAVAVKGPYFGD

SEQ ID NO: 216060 - protein, 26 aa, Mycobacterium bovis
ALATPRRHLSYKTGWYGSSLVVADRW

SEQ ID NO: 216061 - protein, 24 aa, Mycobacterium bovis
ALAVDPEVLLLDEPFGALDAKVRE

SEQ ID NO: 216062 - protein, 18 aa, Mycobacterium bovis
ALAVRGLGSCWIGSTIFA

SEQ ID NO: 216063 - protein, 20 aa, Mycobacterium bovis
ALDALPYLIDNRYPHSPRLI

SEQ ID NO: 216064 - protein, 23 aa, Mycobacterium bovis
ALDALRIPIAYLAELFTAGDTEV

SEQ ID NO: 216065 - protein, 18 aa, Mycobacterium bovis
ALDAYRRLKTSLAEDLGV

SEQ ID NO: 216066 - protein, 17 aa, Mycobacterium bovis
ALDDCHDGYRWLRLLGY

SEQ ID NO: 216067 - protein, 25 aa, Mycobacterium bovis
ALDDKFLHDMLAEELRYSVIREVLP

SEQ ID NO: 216068 - protein, 17 aa, Mycobacterium bovis
ALDLARRYPVGKAVAAI

SEQ ID NO: 216069 - protein, 27 aa, Mycobacterium bovis
ALDLLNAPTQALLGRPLVGNGANGAPG

SEQ ID NO: 216070 - protein, 24 aa, Mycobacterium bovis
ALDMYFNLANYRNNWKRLGFTDDE

SEQ ID NO: 216071 - protein, 20 aa, Mycobacterium bovis
ALDRVQVPVLLVGGWQDIFL

SEQ ID NO: 216072 - protein, 21 aa, Mycobacterium bovis
ALDTLALLEGRWLHVVETLDR

SEQ ID NO: 216073 - protein, 18 aa, Mycobacterium bovis
ALDTRPLFEPVLAGLGEG

SEQ ID NO: 216074 - protein, 17 aa, Mycobacterium bovis
ALEIMLRIWTEDEPWEH

SEQ ID NO: 216075 - protein, 35 aa, Mycobacterium bovis
ALEQNLLAVINAPAQALFGRPLIGNGANGTAASPN

SEQ ID NO: 216076 - protein, 27 aa, Mycobacterium bovis
ALERLETLLALIEGWVQTVVTAALGER

SEQ ID NO: 216077 - protein, 18 aa, Mycobacterium bovis
ALERTFPLALSALIQEAI

SEQ ID NO: 216078 - protein, 27 aa, Mycobacterium bovis
ALESVLTVLTLRDGVIPPTLNYETPDP

SEQ ID NO: 216079 - protein, 17 aa, Mycobacterium bovis
ALFDREFTFGWDELLSK

SEQ ID NO: 216080 - protein, 24 aa, Mycobacterium bovis
ALFRVRPVLPDPVGLLRCAGGADL

SEQ ID NO: 216081 - protein, 21 aa, Mycobacterium bovis
ALFSQLVAGPIRRIIDGADEV

SEQ ID NO: 216082 - protein, 17 aa, Mycobacterium bovis
ALGAPPQRRQWWIDRVK

SEQ ID NO: 216083 - protein, 24 aa, Mycobacterium bovis
ALGDYEWILAFEAPELDRIVDLMR

SEQ ID NO: 216084 - protein, 29 aa, Mycobacterium bovis
ALGFPTRMFTVLFALGRLPGWIAHWREMH

SEQ ID NO: 216085 - protein, 25 aa, Mycobacterium bovis
ALGGKGGSGGLIGRAGSDGGVGAGG

SEQ ID NO: 216086 - protein, 20 aa, Mycobacterium bovis
ALGLATFYNGLAQEKLLSRE

SEQ ID NO: 216087 - protein, 26 aa, Mycobacterium bovis
ALGLDVLPAEWLAVPLAGGGIVRRMP

SEQ ID NO: 216088 - protein, 25 aa, Mycobacterium bovis
ALGLRPTLAALKTGARLALANKESL

SEQ ID NO: 216089 - protein, 27 aa, Mycobacterium bovis
ALGTPRRHLSYKTGWYGSALVVADRWF

SEQ ID NO: 216090 - protein, 25 aa, Mycobacterium bovis
ALGTPRRHLSYKTGWYGSQLVVADR

SEQ ID NO: 216091 - protein, 21 aa, Mycobacterium bovis
ALHALGPQWVLVKGGHLRSSD

SEQ ID NO: 216092 - protein, 20 aa, Mycobacterium bovis
ALHERAVLIELLDDEPDPVT

SEQ ID NO: 216093 - protein, 23 aa, Mycobacterium bovis
ALHHVLAQYPRVDPALLLNCMLL

SEQ ID NO: 216094 - protein, 27 aa, Mycobacterium bovis
ALHSCSPDLPWDLLQRSRISAVSVDAS

SEQ ID NO: 216095 - protein, 23 aa, Mycobacterium bovis
ALIDVAHWASEFPWCGQAAEVLR

SEQ ID NO: 216096 - protein, 18 aa, Mycobacterium bovis
ALIEGLALKPRKAFSPIR

SEQ ID NO: 216097 - protein, 17 aa, Mycobacterium bovis
ALIELCGLLGYDARRDT

SEQ ID NO: 216098 - protein, 18 aa, Mycobacterium bovis
ALIHQHVLFTGSPPDREQ

SEQ ID NO: 216099 - protein, 35 aa, Mycobacterium bovis
ALKGAHFIELCDKRKIPLLFLQNIAGFMVGRDYEA

SEQ ID NO: 216100 - protein, 17 aa, Mycobacterium bovis
ALKVKFDGGTLPPMFVD

SEQ ID NO: 216101 - protein, 26 aa, Mycobacterium bovis
ALLAADAGVPVLLAPAADAATALADA

SEQ ID NO: 216102 - protein, 31 aa, Mycobacterium bovis
ALLAALPPERQARALPSRLAPLTANTITDRA

SEQ ID NO: 216103 - protein, 17 aa, Mycobacterium bovis
ALLEPTWWEGDRPPAAE

SEQ ID NO: 216104 - protein, 26 aa, Mycobacterium bovis
ALLEVRDLLFARLLQYRAFKHVAEMF

SEQ ID NO: 216105 - protein, 28 aa, Mycobacterium bovis
ALLFTAGLWSVWKSYRSAPPLLSCTVIT

SEQ ID NO: 216106 - protein, 20 aa, Mycobacterium bovis
ALLGDARWLASIATPGRDEV

SEQ ID NO: 216107 - protein, 19 aa, Mycobacterium bovis
ALLGPINAGLVIPPVPGFG

SEQ ID NO: 216108 - protein, 26 aa, Mycobacterium bovis
ALLLASCLQPLWRARGRLQEGLAWFA

SEQ ID NO: 216109 - protein, 23 aa, Mycobacterium bovis
ALLPAAAEPVASLILSELRTAVA

SEQ ID NO: 216110 - protein, 36 aa, Mycobacterium bovis
ALLQVGETMPRRAPALTAPLLVLHGTDDRLIPIEGS

SEQ ID NO: 216111 - protein, 20 aa, Mycobacterium bovis
ALLSGLPVRRLWGIGPVAEE

SEQ ID NO: 216112 - protein, 28 aa, Mycobacterium bovis
ALMCSAATMYTPERVTFFCIGGATMAQI

SEQ ID NO: 216113 - protein, 23 aa, Mycobacterium bovis
ALMRPRIASRVLGKWARTRLSGQ

SEQ ID NO: 216114 - protein, 29 aa, Mycobacterium bovis
ALNCEIVPWCRFARKNYFYPDMPKNYQIS

SEQ ID NO: 216115 - protein, 21 aa, Mycobacterium bovis
ALNDDTRPRKLRPGDSLLVDT

SEQ ID NO: 216116 - protein, 25 aa, Mycobacterium bovis
ALNETRTGDLWLFRGRSRPDRAIQT

SEQ ID NO: 216117 - protein, 17 aa, Mycobacterium bovis
ALNLASWRRLKRLLDDL

SEQ ID NO: 216118 - protein, 27 aa, Mycobacterium bovis
ALNPDTFYWAHATFFMLVIKVAEYFCG

SEQ ID NO: 216119 - protein, 20 aa, Mycobacterium bovis
ALNPHQIDDLMMGCGLPGGE

SEQ ID NO: 216120 - protein, 27 aa, Mycobacterium bovis
ALPEPARRLAAVARLRLLCRGSGITDV

SEQ ID NO: 216121 - protein, 17 aa, Mycobacterium bovis
ALPPPTGVFPRYQPPQP

SEQ ID NO: 216122 - protein, 17 aa, Mycobacterium bovis
ALPPTEPRVLQIRALVL

SEQ ID NO: 216123 - protein, 18 aa, Mycobacterium bovis
ALPPYRYSQRELTDSFVS

SEQ ID NO: 216124 - protein, 22 aa, Mycobacterium bovis
ALQAGRIAVPLPVPHAGAHDER

SEQ ID NO: 216125 - protein, 30 aa, Mycobacterium bovis
ALQALTIPSFIPEDFTFLDAIFAGYATVGV

SEQ ID NO: 216126 - protein, 32 aa, Mycobacterium bovis
ALRADGITAPVLAWLHPPGIDFGPALLADVQV

SEQ ID NO: 216127 - protein, 21 aa, Mycobacterium bovis
ALRAGGFKHRAKVEICWVASD

SEQ ID NO: 216128 - protein, 27 aa, Mycobacterium bovis
ALRAYLISRGALPGAPLIAMVPVSLRD

SEQ ID NO: 216129 - protein, 27 aa, Mycobacterium bovis
ALRAYWELPAMMLQFLRTGSGATRPAL

SEQ ID NO: 216130 - protein, 18 aa, Mycobacterium bovis
ALREAALASLRLLAADIG

SEQ ID NO: 216131 - protein, 36 aa, Mycobacterium bovis
ALRELLPLRRADQAEYLRWAVGAFRLATSGVSDATQ

SEQ ID NO: 216132 - protein, 17 aa, Mycobacterium bovis
ALRESMTALLWQAQERY

SEQ ID NO: 216133 - protein, 18 aa, Mycobacterium bovis
ALRGLRLSYFGDGANNMA

SEQ ID NO: 216134 - protein, 25 aa, Mycobacterium bovis
ALRHPMLRVQFLPDGTQRIPPAAGS

SEQ ID NO: 216135 - protein, 25 aa, Mycobacterium bovis
ALRQDGMLALARLQRKMRLVESPYR

SEQ ID NO: 216136 - protein, 17 aa, Mycobacterium bovis
ALRQVLGPNAVQAGSLN

SEQ ID NO: 216137 - protein, 25 aa, Mycobacterium bovis
ALRRFLLEHGVLPEAPLVATVPVSV

SEQ ID NO: 216138 - protein, 17 aa, Mycobacterium bovis
ALRRKFSASQFLADVRR

SEQ ID NO: 216139 - protein, 30 aa, Mycobacterium bovis
ALRTVPGLRALLRLGIYWAQEALAYGMTKR

SEQ ID NO: 216140 - protein, 22 aa, Mycobacterium bovis
ALRVVILHRPGAELRRLTPRNT

SEQ ID NO: 216141 - protein, 22 aa, Mycobacterium bovis
ALRYYLIERNALPDRPLIAMVP

SEQ ID NO: 216142 - protein, 31 aa, Mycobacterium bovis
ALSAQAAAFHQQFVRALSSAAGSYAAAEAAN

SEQ ID NO: 216143 - protein, 21 aa, Mycobacterium bovis
ALSLRLIEPPPSLSRPRREPA

SEQ ID NO: 216144 - protein, 32 aa, Mycobacterium bovis
ALTAVAMLVAIFRARPSPFYIMDEVEAALDDV

SEQ ID NO: 216145 - protein, 26 aa, Mycobacterium bovis
ALTIVPSYNIHLFLEGIQQALKGDPM

SEQ ID NO: 216146 - protein, 26 aa, Mycobacterium bovis
ALTMSDLRFLKFLRESIFPGGELPSE

SEQ ID NO: 216147 - protein, 22 aa, Mycobacterium bovis
ALVACFVGPVPAGWRTIGRVLD

SEQ ID NO: 216148 - protein, 32 aa, Mycobacterium bovis
ALVCDVPLLDMKRYHLLLAGASWMAEYGDPDN

SEQ ID NO: 216149 - protein, 17 aa, Mycobacterium bovis
ALVGPCWPAVFAAIGSA

SEQ ID NO: 216150 - protein, 25 aa, Mycobacterium bovis
ALVLADALVRARLHGLRTNRELLVN

SEQ ID NO: 216151 - protein, 28 aa, Mycobacterium bovis
ALVLARVARLVFGAWEPKTGAVGSLWDV

SEQ ID NO: 216152 - protein, 17 aa, Mycobacterium bovis
ALVRKLGPDFLVELLEI

SEQ ID NO: 216153 - protein, 24 aa, Mycobacterium bovis
ALVSLVLDWHRPVKIFVETKHPVR

SEQ ID NO: 216154 - protein, 21 aa, Mycobacterium bovis
ALWAATFLRRRGAAADAVLLN

SEQ ID NO: 216155 - protein, 25 aa, Mycobacterium bovis
AMAAAATPYVGWLAATAALAKETAT

SEQ ID NO: 216156 - protein, 34 aa, Mycobacterium bovis
AMAGIPRLQFAHADLLVRAFGTLQGLLAASAGDL

SEQ ID NO: 216157 - protein, 28 aa, Mycobacterium bovis
AMAPENVSPLVVWLGSAESRDVTGKVFE

SEQ ID NO: 216158 - protein, 22 aa, Mycobacterium bovis
AMARADVVLLVGARLNWLLGNG

SEQ ID NO: 216159 - protein, 27 aa, Mycobacterium bovis
AMARRFDTIARLWDVIGDTGIGFCLDT

SEQ ID NO: 216160 - protein, 26 aa, Mycobacterium bovis
AMARTCVDAGWLLSLSGTVSFRNARE

SEQ ID NO: 216161 - protein, 24 aa, Mycobacterium bovis
AMDPQQRLMLEVSWEALEHAGIDP

SEQ ID NO: 216162 - protein, 17 aa, Mycobacterium bovis
AMIARRYMHLSGATSRD

SEQ ID NO: 216163 - protein, 26 aa, Mycobacterium bovis
AMLGQPVSMLIPRVVGFRLTGEIQPG

SEQ ID NO: 216164 - protein, 18 aa, Mycobacterium bovis
AMLPGHAVVLHPGPMVRG

SEQ ID NO: 216165 - protein, 19 aa, Mycobacterium bovis
AMLRRIRLTPAGPDTADTA

SEQ ID NO: 216166 - protein, 26 aa, Mycobacterium bovis
AMMAVATQYLAWLSTAAAQAEQAAAQ

SEQ ID NO: 216167 - protein, 26 aa, Mycobacterium bovis
AMMFQQLPTAGLPFHFQRWAEFEGFV

SEQ ID NO: 216168 - protein, 19 aa, Mycobacterium bovis
AMNMGMDGAWGQWVNRWTA

SEQ ID NO: 216169 - protein, 26 aa, Mycobacterium bovis
AMPILPQQALLYRLCGDRNPLHSDPE

SEQ ID NO: 216170 - protein, 18 aa, Mycobacterium bovis
AMPQMLRGRTQRTDPDVA

SEQ ID NO: 216171 - protein, 17 aa, Mycobacterium bovis
AMPVLKVLHDEARLVRL

SEQ ID NO: 216172 - protein, 26 aa, Mycobacterium bovis
AMQFAYQFPQLVDRLILVSAGGVTKD

SEQ ID NO: 216173 - protein, 18 aa, Mycobacterium bovis
AMRELLLAHRDPGIPVVI

SEQ ID NO: 216174 - protein, 25 aa, Mycobacterium bovis
AMRVPGIVFASRSLLPRDEGDMALM

SEQ ID NO: 216175 - protein, 23 aa, Mycobacterium bovis
AMSKFEVLTAMAFAAFADAPVDV

SEQ ID NO: 216176 - protein, 20 aa, Mycobacterium bovis
AMSLAPLAYTLFQRTMRHDP

SEQ ID NO: 216177 - protein, 22 aa, Mycobacterium bovis
AMVIDLLLKRAASLGIQIRYET

SEQ ID NO: 216178 - protein, 26 aa, Mycobacterium bovis
AMWDRPIAMIVNDWFGIGPDGTRCQG

SEQ ID NO: 216179 - protein, 18 aa, Mycobacterium bovis
ANAATMHALLNPGDTILG

SEQ ID NO: 216180 - protein, 24 aa, Mycobacterium bovis
ANAAVLHALMSPGERLLGLDLANG

SEQ ID NO: 216181 - protein, 37 aa, Mycobacterium bovis
ANAGPNMLAAVNAPAQALLGRPLIGNGANGAPGTGQA

SEQ ID NO: 216182 - protein, 30 aa, Mycobacterium bovis
ANASIPTPQPVLPRPMFGAAAATAAATSVH

SEQ ID NO: 216183 - protein, 23 aa, Mycobacterium bovis
ANDQFAGELLAWLRDRLSHFKCP

SEQ ID NO: 216184 - protein, 27 aa, Mycobacterium bovis
ANDWPSPPTHFVITLGVRGARYVGADG

SEQ ID NO: 216185 - protein, 21 aa, Mycobacterium bovis
ANFLSILDEGRIAIAALATGA

SEQ ID NO: 216186 - protein, 25 aa, Mycobacterium bovis
ANGGNGLNLVGVPGTAGGGADGANG

SEQ ID NO: 216187 - protein, 32 aa, Mycobacterium bovis
ANGSEPWRIPDVNALPPIKHTFAKPGEPFQPY

SEQ ID NO: 216188 - protein, 23 aa, Mycobacterium bovis
ANHEYLGPVLWSPAGKPPTWWDS

SEQ ID NO: 216189 - protein, 20 aa, Mycobacterium bovis
ANHSVWFHRQVNFDDWVLYS

SEQ ID NO: 216190 - protein, 27 aa, Mycobacterium bovis
ANHTTGWVRMDFVVPSRGLIGWRTDFL

SEQ ID NO: 216191 - protein, 25 aa, Mycobacterium bovis
ANIAPWLRAAHRYGAKVKWAEVDIE

SEQ ID NO: 216192 - protein, 21 aa, Mycobacterium bovis
ANKIFIEKAVDLGVQALAGAL

SEQ ID NO: 216193 - protein, 19 aa, Mycobacterium bovis
ANKLPGQPLVRIAGFGYNE

SEQ ID NO: 216194 - protein, 21 aa, Mycobacterium bovis
ANLAELRRSLTGSATYAVAKN

SEQ ID NO: 216195 - protein, 23 aa, Mycobacterium bovis
ANLGLAFYRPDYGLDLGPDNKPT

SEQ ID NO: 216196 - protein, 34 aa, Mycobacterium bovis
ANMDDARWDAVLAVNLLAPLRLTEGLVGNGSIGE

SEQ ID NO: 216197 - protein, 24 aa, Mycobacterium bovis
ANNFTRLLDHVAPLGYPEVHQMTK

SEQ ID NO: 216198 - protein, 24 aa, Mycobacterium bovis
ANPDLVYGLITDLPTLASLAEEVV

SEQ ID NO: 216199 - protein, 20 aa, Mycobacterium bovis
ANPVALPRITVDEPAISVTI

SEQ ID NO: 216200 - protein, 17 aa, Mycobacterium bovis
ANRANLVYWAAANLRDP

SEQ ID NO: 216201 - protein, 17 aa, Mycobacterium bovis
ANRARLAAAIGLPGNRV

SEQ ID NO: 216202 - protein, 24 aa, Mycobacterium bovis
ANRELKHLLINDLPIERQAQDVSW

SEQ ID NO: 216203 - protein, 19 aa, Mycobacterium bovis
ANRELTAELALALGAAAAR

SEQ ID NO: 216204 - protein, 26 aa, Mycobacterium bovis
ANRRAALAALLSQLPRSDLETLRKAL

SEQ ID NO: 216205 - protein, 19 aa, Mycobacterium bovis
ANSAPWLPIERAAALDGGA

SEQ ID NO: 216206 - protein, 25 aa, Mycobacterium bovis
ANSDGRLLELTLHPGVMTGYAHGEL

SEQ ID NO: 216207 - protein, 20 aa, Mycobacterium bovis
ANSLLLRRLQAERPGDAVLS

SEQ ID NO: 216208 - protein, 25 aa, Mycobacterium bovis
ANSVRFVDALLLAGGSAYGLAAADG

SEQ ID NO: 216209 - protein, 24 aa, Mycobacterium bovis
ANSWVDVFAHWRRAQGLPVSAIAW

SEQ ID NO: 216210 - protein, 23 aa, Mycobacterium bovis
ANTLYVPPEPFFADQQWSHITDW

SEQ ID NO: 216211 - protein, 19 aa, Mycobacterium bovis
ANVPITRRGGLSFDLRRIN

SEQ ID NO: 216212 - protein, 24 aa, Mycobacterium bovis
ANVRGAWLVCRAAGRVLLEQGQGG

SEQ ID NO: 216213 - protein, 17 aa, Mycobacterium bovis
ANYFAAATVLPYRQFHD

SEQ ID NO: 216214 - protein, 24 aa, Mycobacterium bovis
APAADLSVWPPLGAAPVDVDGAYQ

SEQ ID NO: 216215 - protein, 23 aa, Mycobacterium bovis
APADLITEYGPHVALPPTELEMA

SEQ ID NO: 216216 - protein, 26 aa, Mycobacterium bovis
APAGRGFWFPPTVLTPKRGDRTVTDE

SEQ ID NO: 216217 - protein, 21 aa, Mycobacterium bovis
APAHDWLTLTGGAIGYGIPAA

SEQ ID NO: 216218 - protein, 30 aa, Mycobacterium bovis
APALSDAELYLFFHLLFSAGAETTRNSIAG

SEQ ID NO: 216219 - protein, 18 aa, Mycobacterium bovis
APAMHTEMWLHPATVDNV

SEQ ID NO: 216220 - protein, 24 aa, Mycobacterium bovis
APANAFVMSFLGAVSTLNGSLVRP

SEQ ID NO: 216221 - protein, 29 aa, Mycobacterium bovis
APAPHHTRPTRFVWLQTPAIRARLLDRMK

SEQ ID NO: 216222 - protein, 18 aa, Mycobacterium bovis
APAPKAPPAPAPALAHLR

SEQ ID NO: 216223 - protein, 17 aa, Mycobacterium bovis
APDVLRYVMGFGGTPDS

SEQ ID NO: 216224 - protein, 26 aa, Mycobacterium bovis
APEHVHTYRITPLALWNARAAGHDAE

SEQ ID NO: 216225 - protein, 42 aa, Mycobacterium bovis
APESTSPWHNLQQDILSFINEPTEALTGRPLIGNGDSGTPGT

SEQ ID NO: 216226 - protein, 24 aa, Mycobacterium bovis
APGASYYVLVFAKGAFPAELEVKP

SEQ ID NO: 216227 - protein, 25 aa, Mycobacterium bovis
APGGLPLSGLLRGVGDEPELTDFDE

SEQ ID NO: 216228 - protein, 17 aa, Mycobacterium bovis
APGLRGPVLVLGGPGTG

SEQ ID NO: 216229 - protein, 26 aa, Mycobacterium bovis
APGQPGPVAALFLDLDRLKAINDYLG

SEQ ID NO: 216230 - protein, 24 aa, Mycobacterium bovis
APGSYATGIAFLPQSSKDAAAACA

SEQ ID NO: 216231 - protein, 26 aa, Mycobacterium bovis
APHDELMHFVQKYGIAKWFNEIRGRT

SEQ ID NO: 216232 - protein, 25 aa, Mycobacterium bovis
APHHRWPRHILDVKTAIAWARANVD

SEQ ID NO: 216233 - protein, 18 aa, Mycobacterium bovis
APIQQMIDFMAARTAFFD

SEQ ID NO: 216234 - protein, 19 aa, Mycobacterium bovis
APIVGYSPIIGEKPLRGMA

SEQ ID NO: 216235 - protein, 26 aa, Mycobacterium bovis
APKLDPALLDLGVPVLGICYGFQAMA

SEQ ID NO: 216236 - protein, 35 aa, Mycobacterium bovis
APKRLGSFMDSRLWRLLLAPGRGIGRLITGVMGLA

SEQ ID NO: 216237 - protein, 21 aa, Mycobacterium bovis
APKYRAYMRRQQGMSWNTIEH

SEQ ID NO: 216238 - protein, 18 aa, Mycobacterium bovis
APLALAMALGRVPAPLRP

SEQ ID NO: 216239 - protein, 24 aa, Mycobacterium bovis
APLAQQGCIPLAIHPAMTFTGSDE

SEQ ID NO: 216240 - protein, 21 aa, Mycobacterium bovis
APLDRRLLLGMLAELPAGAGV

SEQ ID NO: 216241 - protein, 18 aa, Mycobacterium bovis
APLFPLVVVVHADVELRV

SEQ ID NO: 216242 - protein, 20 aa, Mycobacterium bovis
APLRGGYIADITPLGGGATG

SEQ ID NO: 216243 - protein, 20 aa, Mycobacterium bovis
APLTFVTILAKYVQLDFFRH

SEQ ID NO: 216244 - protein, 19 aa, Mycobacterium bovis
APLVGELADTLGRTIDVAL

SEQ ID NO: 216245 - protein, 19 aa, Mycobacterium bovis
APMEPADPLRPLLEHTRGL

SEQ ID NO: 216246 - protein, 17 aa, Mycobacterium bovis
APMTTAVRPPAADLVSE

SEQ ID NO: 216247 - protein, 17 aa, Mycobacterium bovis
APNPLYYWRTQQDAELD

SEQ ID NO: 216248 - protein, 33 aa, Mycobacterium bovis
APPDTTIVSWLPFYHDMGLVLGIIAPILGGYRS

SEQ ID NO: 216249 - protein, 18 aa, Mycobacterium bovis
APPFFVLHGEKDPMVPSA

SEQ ID NO: 216250 - protein, 17 aa, Mycobacterium bovis
APPPIAHSTVLVAPVSP

SEQ ID NO: 216251 - protein, 25 aa, Mycobacterium bovis
APPPLDVMAALREPGIGVIAEVKRA

SEQ ID NO: 216252 - protein, 22 aa, Mycobacterium bovis
APRATISELRYPATAFTDAIDA

SEQ ID NO: 216253 - protein, 23 aa, Mycobacterium bovis
APRLLLEVVCARLLLPSASDAES

SEQ ID NO: 216254 - protein, 24 aa, Mycobacterium bovis
APSASWMLEYYPIRELRQLPDGSC

SEQ ID NO: 216255 - protein, 23 aa, Mycobacterium bovis
APSEILPFTVLLSSLGVTHLTPE

SEQ ID NO: 216256 - protein, 18 aa, Mycobacterium bovis
APSRSLPLLECWTALAAL

SEQ ID NO: 216257 - protein, 27 aa, Mycobacterium bovis
APTGAQWDTALVYWQRLRTDVGAVFDT

SEQ ID NO: 216258 - protein, 29 aa, Mycobacterium bovis
APTMALVDVLSPLLIMTAVATAPSATTLP

SEQ ID NO: 216259 - protein, 25 aa, Mycobacterium bovis
APTPVAWTRMRAPRSLMAAIGAEAI

SEQ ID NO: 216260 - protein, 24 aa, Mycobacterium bovis
APVAVPWVLAARSPQALTNQAGRL

SEQ ID NO: 216261 - protein, 18 aa, Mycobacterium bovis
APVLSLRMPKVARSLLDY

SEQ ID NO: 216262 - protein, 26 aa, Mycobacterium bovis
APVVAPPWEPPPLPSTRQRLGWALRD

SEQ ID NO: 216263 - protein, 20 aa, Mycobacterium bovis
APWLVETTLLRRRAAGKLGE

SEQ ID NO: 216264 - protein, 24 aa, Mycobacterium bovis
APYLGFQLGSMWYISLDYINHQTS

SEQ ID NO: 216265 - protein, 19 aa, Mycobacterium bovis
APYVTPLVRKLASENNIDL

SEQ ID NO: 216266 - protein, 28 aa, Mycobacterium bovis
AQAAAVPVVFLTAWYGLADLAEIKAGES

SEQ ID NO: 216267 - protein, 17 aa, Mycobacterium bovis
AQAAPAKYPAGFFGVFT

SEQ ID NO: 216268 - protein, 24 aa, Mycobacterium bovis
AQAGALPALFSGLARRPRRRQIDD

SEQ ID NO: 216269 - protein, 26 aa, Mycobacterium bovis
AQAPDGLSCFLLPRVLPDGTRNRMFL

SEQ ID NO: 216270 - protein, 25 aa, Mycobacterium bovis
AQARHELALLPDVPGRRALAALVDY

SEQ ID NO: 216271 - protein, 25 aa, Mycobacterium bovis
AQCRDLLHWRFCRGVPPRATNDTDI

SEQ ID NO: 216272 - protein, 22 aa, Mycobacterium bovis
AQFSVVLPRRDGVEYSVEHAVI

SEQ ID NO: 216273 - protein, 18 aa, Mycobacterium bovis
AQGLPVSAIAWGAWGEVG

SEQ ID NO: 216274 - protein, 26 aa, Mycobacterium bovis
AQGRTPLPFYVWRAFARYSPVLPAGR

SEQ ID NO: 216275 - protein, 24 aa, Mycobacterium bovis
AQGTWRLWLPGCSWPPNVPQRRGQ

SEQ ID NO: 216276 - protein, 19 aa, Mycobacterium bovis
AQHIPLVVFGGKEYGSGSS

SEQ ID NO: 216277 - protein, 25 aa, Mycobacterium bovis
AQHNWAILHALPELVATGIPVLVGA

SEQ ID NO: 216278 - protein, 23 aa, Mycobacterium bovis
AQHRYWDRVLFDAGLSVITWPAK

SEQ ID NO: 216279 - protein, 25 aa, Mycobacterium bovis
AQIATWLGQYPQLLSAALTGVIAHL

SEQ ID NO: 216280 - protein, 25 aa, Mycobacterium bovis
AQLAGLKLLAFRGRFVEIGKRDIYG

SEQ ID NO: 216281 - protein, 24 aa, Mycobacterium bovis
AQLASRMLLQVHDELLFEIAPGER

SEQ ID NO: 216282 - protein, 19 aa, Mycobacterium bovis
AQLDLAYHDIKRGRGIFDL

SEQ ID NO: 216283 - protein, 26 aa, Mycobacterium bovis
AQLEENPYLPPYYHPGLNAPEIRYML

SEQ ID NO: 216284 - protein, 24 aa, Mycobacterium bovis
AQLPVAPMGFIETRYYVSMNVADK

SEQ ID NO: 216285 - protein, 22 aa, Mycobacterium bovis
AQLQNQLGILNGLLGPTGGRVP

SEQ ID NO: 216286 - protein, 29 aa, Mycobacterium bovis
AQLTVTPVMLLLWIRGVRFMYSVDPYLPP

SEQ ID NO: 216287 - protein, 23 aa, Mycobacterium bovis
AQNVRLPWRVDKTDYVLHLIDTP

SEQ ID NO: 216288 - protein, 17 aa, Mycobacterium bovis
AQPGSRLYRNGERGVWK

SEQ ID NO: 216289 - protein, 26 aa, Mycobacterium bovis
AQQDRLGRLILLAQAGALLDRRIAEL

SEQ ID NO: 216290 - protein, 24 aa, Mycobacterium bovis
AQQEPQLVRKIILAGTGPAGGVGI

SEQ ID NO: 216291 - protein, 21 aa, Mycobacterium bovis
AQQWSQLERLLRSGKLPPPEP

SEQ ID NO: 216292 - protein, 22 aa, Mycobacterium bovis
AQRDRFLFKINVGYPSPEEERE

SEQ ID NO: 216293 - protein, 17 aa, Mycobacterium bovis
AQRIRENLLRRNAAVTG

SEQ ID NO: 216294 - protein, 24 aa, Mycobacterium bovis
AQRRDMMWICRDGDRAKNHLLEAN

SEQ ID NO: 216295 - protein, 26 aa, Mycobacterium bovis
AQRRFPLPDVIWTRLFGVRLVKLLYR

SEQ ID NO: 216296 - protein, 24 aa, Mycobacterium bovis
AQRTSAINRLRWLVHELDPERAPA

SEQ ID NO: 216297 - protein, 19 aa, Mycobacterium bovis
AQRTVLCKDPFRAVDERVK

SEQ ID NO: 216298 - protein, 28 aa, Mycobacterium bovis
AQSPKETWLRLLLIRAGFPRPQTQIAVR

SEQ ID NO: 216299 - protein, 20 aa, Mycobacterium bovis
AQSQLPFTGLFSPTDVAVDN

SEQ ID NO: 216300 - protein, 25 aa, Mycobacterium bovis
AQTLAHEFDFRFLVGVLSVLGDKDV

SEQ ID NO: 216301 - protein, 28 aa, Mycobacterium bovis
AQTRISGVLIDLRPYRPPDAARRHNGGK

SEQ ID NO: 216302 - protein, 26 aa, Mycobacterium bovis
AQTVARWLVLYLRRPGGQTQFAAPVW

SEQ ID NO: 216303 - protein, 25 aa, Mycobacterium bovis
AQVLDPQHRLFLQCAWHALEDAGAD

SEQ ID NO: 216304 - protein, 17 aa, Mycobacterium bovis
AQVQRLAARYPLYPELH

SEQ ID NO: 216305 - protein, 17 aa, Mycobacterium bovis
AQVRGWLADNLAGEFAA

SEQ ID NO: 216306 - protein, 19 aa, Mycobacterium bovis
AQVRPIHRPPRKPADRHPH

SEQ ID NO: 216307 - protein, 26 aa, Mycobacterium bovis
AQWDGMPHPTILAAARLLGVDEVWAV

SEQ ID NO: 216308 - protein, 23 aa, Mycobacterium bovis
ARAAMTQWLIEEKGFGAVAAEAD

SEQ ID NO: 216309 - protein, 24 aa, Mycobacterium bovis
ARAEPIFATVAPGVAAAPRTPGRD

SEQ ID NO: 216310 - protein, 29 aa, Mycobacterium bovis
ARAHGADMLLLIVAALEQSVLVSMLDRTE

SEQ ID NO: 216311 - protein, 23 aa, Mycobacterium bovis
ARALAADPPILLMDEPFSAVDPV

SEQ ID NO: 216312 - protein, 19 aa, Mycobacterium bovis
ARALDARLRLVLEVPTLRE

SEQ ID NO: 216313 - protein, 24 aa, Mycobacterium bovis
ARANRLAHWFRQAGLREDDVVAIL

SEQ ID NO: 216314 - protein, 29 aa, Mycobacterium bovis
ARANVSYPTDLGLLAKAMRRIAATGKRIQ

SEQ ID NO: 216315 - protein, 19 aa, Mycobacterium bovis
ARAVPRHPDLRWVDLGRRR

SEQ ID NO: 216316 - protein, 18 aa, Mycobacterium bovis
ARAWQLELVVPILTAALT

SEQ ID NO: 216317 - protein, 18 aa, Mycobacterium bovis
ARAWWVLTAAGIANVRIL

SEQ ID NO: 216318 - protein, 22 aa, Mycobacterium bovis
ARCALAWSVQTAALAREHNNAQ

SEQ ID NO: 216319 - protein, 25 aa, Mycobacterium bovis
ARDFLVPARLHPGSFYALPQSPQLF

SEQ ID NO: 216320 - protein, 24 aa, Mycobacterium bovis
ARDHLAAELARLRQRRDRLEVEVK

SEQ ID NO: 216321 - protein, 27 aa, Mycobacterium bovis
ARDLTAPPVWFIKTIGDAVMLVCPDPA

SEQ ID NO: 216322 - protein, 20 aa, Mycobacterium bovis
ARDRGFYRDELIAEIAQRGG

SEQ ID NO: 216323 - protein, 23 aa, Mycobacterium bovis
ARDRMRERWRIVLVDEFQDTDPM

SEQ ID NO: 216324 - protein, 23 aa, Mycobacterium bovis
ARDSLVKTALFGSDPNWGRVLAA

SEQ ID NO: 216325 - protein, 21 aa, Mycobacterium bovis
ARDVLADRRLFVLTDAAWTEF

SEQ ID NO: 216326 - protein, 18 aa, Mycobacterium bovis
AREDTVVFPALRDVMSAV

SEQ ID NO: 216327 - protein, 36 aa, Mycobacterium bovis
ARELGARFLDTGAMYRIVTLAVLRAGADPSDIAAVE

SEQ ID NO: 216328 - protein, 21 aa, Mycobacterium bovis
AREMTALLRAIVESPLPVVGA

SEQ ID NO: 216329 - protein, 22 aa, Mycobacterium bovis
ARERGWPQFADRLLELAREAEP

SEQ ID NO: 216330 - protein, 25 aa, Mycobacterium bovis
AREVILRLFGPLLDAAPTLGAGLDW

SEQ ID NO: 216331 - protein, 34 aa, Mycobacterium bovis
ARFAKIFDVNLWAPLMWTSLVVTAWMGEHGGAVV

SEQ ID NO: 216332 - protein, 22 aa, Mycobacterium bovis
ARFEFRWNDQFALSLDPDTARE

SEQ ID NO: 216333 - protein, 18 aa, Mycobacterium bovis
ARFGIPESVLGFLRGELG

SEQ ID NO: 216334 - protein, 21 aa, Mycobacterium bovis
ARFGRLPFETLFEPAISYGRN

SEQ ID NO: 216335 - protein, 17 aa, Mycobacterium bovis
ARFLLGVQQLLGLGQFA

SEQ ID NO: 216336 - protein, 19 aa, Mycobacterium bovis
ARFVANALSPAKVVSVSVI

SEQ ID NO: 216337 - protein, 20 aa, Mycobacterium bovis
ARFVRTCDCFNIPIVMLVDV

SEQ ID NO: 216338 - protein, 25 aa, Mycobacterium bovis
ARGAGGAGGAGGWLSGHSGAHGAMG

SEQ ID NO: 216339 - protein, 22 aa, Mycobacterium bovis
ARGGRRLVIAMMYGLVKEGGPT

SEQ ID NO: 216340 - protein, 26 aa, Mycobacterium bovis
ARGKAIIILNPADPPMIMRDTIFCAI

SEQ ID NO: 216341 - protein, 21 aa, Mycobacterium bovis
ARGLVRLRAVLPLIDGGAESP

SEQ ID NO: 216342 - protein, 24 aa, Mycobacterium bovis
ARGPMGLPELTSTKWIAWGAGHTR

SEQ ID NO: 216343 - protein, 18 aa, Mycobacterium bovis
ARGRLMQALPAGGAMFAV

SEQ ID NO: 216344 - protein, 25 aa, Mycobacterium bovis
ARGVTFSRGWLPFLPTSDPPAHTRM

SEQ ID NO: 216345 - protein, 18 aa, Mycobacterium bovis
ARHFGARRKAFNWTVTAL

SEQ ID NO: 216346 - protein, 28 aa, Mycobacterium bovis
ARHGQRGPFEQWLAYWDPDHDFLTSRVT

SEQ ID NO: 216347 - protein, 22 aa, Mycobacterium bovis
ARHPIIMLAEHVADTFIAMGWE

SEQ ID NO: 216348 - protein, 20 aa, Mycobacterium bovis
ARHRAMIQAFVQWRAQSRSE

SEQ ID NO: 216349 - protein, 20 aa, Mycobacterium bovis
ARIAALLHRAAPDTQLVTII

SEQ ID NO: 216350 - protein, 20 aa, Mycobacterium bovis
ARIAGRPAAVLLHLGPGLGN

SEQ ID NO: 216351 - protein, 23 aa, Mycobacterium bovis
ARKHQLLLLADEIYDKILYDDAK

SEQ ID NO: 216352 - protein, 25 aa, Mycobacterium bovis
ARKSFFRVPLIGGTITHPVQGEAAA

SEQ ID NO: 216353 - protein, 23 aa, Mycobacterium bovis
ARLELRVLFEELLSRFGSVRVVE

SEQ ID NO: 216354 - protein, 18 aa, Mycobacterium bovis
ARLFASFEEEPFASASIA

SEQ ID NO: 216355 - protein, 17 aa, Mycobacterium bovis
ARLGHFYRGAGLTIYEG

SEQ ID NO: 216356 - protein, 26 aa, Mycobacterium bovis
ARLGHRLTIAMTRWQALVNWSGTDPV

SEQ ID NO: 216357 - protein, 18 aa, Mycobacterium bovis
ARLLLIVAELPLPMQNVN

SEQ ID NO: 216358 - protein, 19 aa, Mycobacterium bovis
ARLNPLTRPSHITNPAGLA

SEQ ID NO: 216359 - protein, 25 aa, Mycobacterium bovis
ARLQRLLAFVARQEPRLNWAVGVNA

SEQ ID NO: 216360 - protein, 20 aa, Mycobacterium bovis
ARLRALSRRGPIPRPPTLEA

SEQ ID NO: 216361 - protein, 24 aa, Mycobacterium bovis
ARLRPWQQLLHELPRRLGGEHSDS

SEQ ID NO: 216362 - protein, 25 aa, Mycobacterium bovis
ARLVWSGHWTTFSGPDFWVTVVGPA

SEQ ID NO: 216363 - protein, 29 aa, Mycobacterium bovis
ARMLESLDGWPVNFALLGKGNTVNPDALW

SEQ ID NO: 216364 - protein, 21 aa, Mycobacterium bovis
ARMRSLLMPAFTRAALRGYRD

SEQ ID NO: 216365 - protein, 20 aa, Mycobacterium bovis
ARMYRTGDLVCWRADGQLEF

SEQ ID NO: 216366 - protein, 24 aa, Mycobacterium bovis
ARNTFYGMARWQASLEKKQGFLGR

SEQ ID NO: 216367 - protein, 21 aa, Mycobacterium bovis
ARPIGRIDGWGHRTVGLGLRQ

SEQ ID NO: 216368 - protein, 30 aa, Mycobacterium bovis
ARPPARLVGWTARFLGMVRPGDEVDFRVER

SEQ ID NO: 216369 - protein, 24 aa, Mycobacterium bovis
ARQGFTIALVPPSDDPVPPGMHAL

SEQ ID NO: 216370 - protein, 22 aa, Mycobacterium bovis
ARQGPLLVVTATGREADDLAAE

SEQ ID NO: 216371 - protein, 18 aa, Mycobacterium bovis
ARQILGHRAMIVAGGSNR

SEQ ID NO: 216372 - protein, 25 aa, Mycobacterium bovis
ARRFDRSIGYFWTATHQQIYRTLRV

SEQ ID NO: 216373 - protein, 31 aa, Mycobacterium bovis
ARRFGGRWNPPLLFPAIYLADSAQACMVEVE

SEQ ID NO: 216374 - protein, 17 aa, Mycobacterium bovis
ARRGIRCHVLPASTTFE

SEQ ID NO: 216375 - protein, 17 aa, Mycobacterium bovis
ARRLAREEGLLVGISSG

SEQ ID NO: 216376 - protein, 26 aa, Mycobacterium bovis
ARRPDGRLLTHKLLSDNPARYRDAAV

SEQ ID NO: 216377 - protein, 18 aa, Mycobacterium bovis
ARRPPTWLTVETADVATA

SEQ ID NO: 216378 - protein, 24 aa, Mycobacterium bovis
ARRRRARGLRLNHPEAIAVIADHI

SEQ ID NO: 216379 - protein, 24 aa, Mycobacterium bovis
ARRRRLMVDLYKRVLDGVADLGFP

SEQ ID NO: 216380 - protein, 22 aa, Mycobacterium bovis
ARSYREMFAGLYTDPDSVLNTM

SEQ ID NO: 216381 - protein, 22 aa, Mycobacterium bovis
ARTDPMLLAWTVPVVDLDPTAA

SEQ ID NO: 216382 - protein, 25 aa, Mycobacterium bovis
ARTFGMDSWFPSLKIYNRNGQLYTA

SEQ ID NO: 216383 - protein, 28 aa, Mycobacterium bovis
ARTGARPRVLLLPLGPLAEHNIRTTFAT

SEQ ID NO: 216384 - protein, 17 aa, Mycobacterium bovis
ARTLDLWAEALQAHKDE

SEQ ID NO: 216385 - protein, 17 aa, Mycobacterium bovis
ARVGWNRRQLSAVGGRG

SEQ ID NO: 216386 - protein, 18 aa, Mycobacterium bovis
ARVLLMAALAANSPVADV

SEQ ID NO: 216387 - protein, 18 aa, Mycobacterium bovis
ARVSLACALVGRPDLLVL

SEQ ID NO: 216388 - protein, 19 aa, Mycobacterium bovis
ARYPQLFRPILRQTNIGVH

SEQ ID NO: 216389 - protein, 26 aa, Mycobacterium bovis
ARYVWEVPYYPQYYIPLADVRMEFLR

SEQ ID NO: 216390 - protein, 31 aa, Mycobacterium bovis
ASAAAALAPWQQAVPGLLGLLDSAQSSAQAV

SEQ ID NO: 216391 - protein, 25 aa, Mycobacterium bovis
ASAADRRYLLYSPLTKAKVTSEGER

SEQ ID NO: 216392 - protein, 23 aa, Mycobacterium bovis
ASAARLDGYPRQGKTVLFLGRYD

SEQ ID NO: 216393 - protein, 50 aa, Mycobacterium bovis
ASAFEAARAATVHPLLVAANRNAFAQLVMSNWFGLNAPLIAAVEGAYEQM

SEQ ID NO: 216394 - protein, 25 aa, Mycobacterium bovis
ASAFQSVVWGLTVGSWIGSSAGLMV

SEQ ID NO: 216395 - protein, 22 aa, Mycobacterium bovis
ASALPPFTPPVQGTGPAGPAAA

SEQ ID NO: 216396 - protein, 23 aa, Mycobacterium bovis
ASARRLQLNRIPLYQIHQPNPVV

SEQ ID NO: 216397 - protein, 31 aa, Mycobacterium bovis
ASATPLQQIEQALLGVINTPTEALVGRKLIG

SEQ ID NO: 216398 - protein, 24 aa, Mycobacterium bovis
ASDGGLWLAIMSPAALSRIEAIAA

SEQ ID NO: 216399 - protein, 24 aa, Mycobacterium bovis
ASDHVPFYIAARSPMLYVVCKGHS

SEQ ID NO: 216400 - protein, 26 aa, Mycobacterium bovis
ASDPYGDVFLIIDGWPGFVGEFPDLE

SEQ ID NO: 216401 - protein, 19 aa, Mycobacterium bovis
ASEASVTVDWHMPPRARKP

SEQ ID NO: 216402 - protein, 20 aa, Mycobacterium bovis
ASEILVIADLARQKAQSAQY

SEQ ID NO: 216403 - protein, 25 aa, Mycobacterium bovis
ASESAGFKWLAPYTGSAIAQHWMYE

SEQ ID NO: 216404 - protein, 27 aa, Mycobacterium bovis
ASFVDDFVLYWGFLALAQVRSGRRTFG

SEQ ID NO: 216405 - protein, 25 aa, Mycobacterium bovis
ASGAAEWFAGRLPEDWFDGDPTVIV

SEQ ID NO: 216406 - protein, 24 aa, Mycobacterium bovis
ASGALDLALVFNEGPDYAAAGVFT

SEQ ID NO: 216407 - protein, 22 aa, Mycobacterium bovis
ASGFKGPLPMPPSKHIAIVACM

SEQ ID NO: 216408 - protein, 32 aa, Mycobacterium bovis
ASGGFVVPFLHPDLVWDFRLPRVVSINVSGHK

SEQ ID NO: 216409 - protein, 29 aa, Mycobacterium bovis
ASGKQRSRLALWSRRLLGEAITQAQLVLA

SEQ ID NO: 216410 - protein, 26 aa, Mycobacterium bovis
ASGLDSRAWRLPWPDGTVVYELDQPK

SEQ ID NO: 216411 - protein, 25 aa, Mycobacterium bovis
ASGLDSRAYRLAWPAQTVVYEIDQP

SEQ ID NO: 216412 - protein, 25 aa, Mycobacterium bovis
ASGSDIARIRRFAHPVLLERSRAAE

SEQ ID NO: 216413 - protein, 22 aa, Mycobacterium bovis
ASHDPFLPLLLAAEHTSRLELG

SEQ ID NO: 216414 - protein, 24 aa, Mycobacterium bovis
ASINDVPIAESERRYLGARSASEY

SEQ ID NO: 216415 - protein, 23 aa, Mycobacterium bovis
ASKSALMAAWTSLYDASKGDRGD

SEQ ID NO: 216416 - protein, 19 aa, Mycobacterium bovis
ASLFDPDSALRARTAVVCI

SEQ ID NO: 216417 - protein, 26 aa, Mycobacterium bovis
ASLFSGNAQAYQALSAQAAAFHQQFV

SEQ ID NO: 216418 - protein, 20 aa, Mycobacterium bovis
ASLREHTWKRSSFSGTEIFG

SEQ ID NO: 216419 - protein, 24 aa, Mycobacterium bovis
ASMAKALLPIMNPGGSIVGMDFDP

SEQ ID NO: 216420 - protein, 31 aa, Mycobacterium bovis
ASMAMVAAAQPYLAWLTYTAEAAAHAGSQAM

SEQ ID NO: 216421 - protein, 23 aa, Mycobacterium bovis
ASMVAAVTPYVAWLSATAGQAEQ

SEQ ID NO: 216422 - protein, 25 aa, Mycobacterium bovis
ASPAYLGFNLFQHAIARAVIFGTYE

SEQ ID NO: 216423 - protein, 27 aa, Mycobacterium bovis
ASPKETWLRLLLIDAGLPVPTTQIPVV

SEQ ID NO: 216424 - protein, 20 aa, Mycobacterium bovis
ASPRFLLDFSRRFPDAAVVR

SEQ ID NO: 216425 - protein, 23 aa, Mycobacterium bovis
ASPRRALSELLRRGTRNLTGADR

SEQ ID NO: 216426 - protein, 21 aa, Mycobacterium bovis
ASPVHAATLLPFIGRLLAARY

SEQ ID NO: 216427 - protein, 17 aa, Mycobacterium bovis
ASRARFGDVLPFLVKVL

SEQ ID NO: 216428 - protein, 24 aa, Mycobacterium bovis
ASRDIPLRLLYAIEPDDPGYAAHG

SEQ ID NO: 216429 - protein, 17 aa, Mycobacterium bovis
ASRLDGSPLRYNQLDPY

SEQ ID NO: 216430 - protein, 25 aa, Mycobacterium bovis
ASRPPLMKRIVLQTGARLSRRGRRL

SEQ ID NO: 216431 - protein, 22 aa, Mycobacterium bovis
ASRVELPLLSPARARSYCATVR

SEQ ID NO: 216432 - protein, 25 aa, Mycobacterium bovis
ASSVRAIITGYRLSPRDATVAVMPL

SEQ ID NO: 216433 - protein, 26 aa, Mycobacterium bovis
ASTETRLPFCWRGVSLHAGGAGRVRA

SEQ ID NO: 216434 - protein, 20 aa, Mycobacterium bovis
ASTLGLSMPANLSGGGNVGA

SEQ ID NO: 216435 - protein, 25 aa, Mycobacterium bovis
ASTNHILGFPFTSHGLRLGVEASLR

SEQ ID NO: 216436 - protein, 18 aa, Mycobacterium bovis
ASTTYYFSSLDDLIARAV

SEQ ID NO: 216437 - protein, 24 aa, Mycobacterium bovis
ASTVFGVRFPAPLGLAAGFDKDGT

SEQ ID NO: 216438 - protein, 24 aa, Mycobacterium bovis
ASVHRATRPGATLLLSCFSNAMPP

SEQ ID NO: 216439 - protein, 18 aa, Mycobacterium bovis
ASVLSRPVAKIMSTTVAT

SEQ ID NO: 216440 - protein, 30 aa, Mycobacterium bovis
ASWGDVAMMLSLPYQGLGNAAISAVATDEQ

SEQ ID NO: 216441 - protein, 29 aa, Mycobacterium bovis
ASYAINRSLLLDGLRRIGIDRLAPTDGAF

SEQ ID NO: 216442 - protein, 23 aa, Mycobacterium bovis
ASYARQRPGLLAAWLDGDLGELP

SEQ ID NO: 216443 - protein, 28 aa, Mycobacterium bovis
ASYEFLRLLEHRLQLQRLKRTHLLPDPE

SEQ ID NO: 216444 - protein, 17 aa, Mycobacterium bovis
ASYPGFTATAPPGDGQV

SEQ ID NO: 216445 - protein, 27 aa, Mycobacterium bovis
ATAARDVDWWLTFSSAAALLGTPGQGA

SEQ ID NO: 216446 - protein, 27 aa, Mycobacterium bovis
ATADCELDWWLGFSSAASLLGSPGQAA

SEQ ID NO: 216447 - protein, 26 aa, Mycobacterium bovis
ATADQPLDWFCSFSSAAALVGSPGQG

SEQ ID NO: 216448 - protein, 17 aa, Mycobacterium bovis
ATAEALERTFPLALSAL

SEQ ID NO: 216449 - protein, 27 aa, Mycobacterium bovis
ATAGLGPITIPIIDIPAAPGIGNSTTS

SEQ ID NO: 216450 - protein, 25 aa, Mycobacterium bovis
ATAHQPQWATTPAAPAAAPHSTPGG

SEQ ID NO: 216451 - protein, 33 aa, Mycobacterium bovis
ATAKEWHQYWIDNRLQWYIDLGIRRENLRLWEH

SEQ ID NO: 216452 - protein, 22 aa, Mycobacterium bovis
ATATYLVRMLRDIPGLTVTRIA

SEQ ID NO: 216453 - protein, 20 aa, Mycobacterium bovis
ATCCRALGIAVYQRKRPPDL

SEQ ID NO: 216454 - protein, 17 aa, Mycobacterium bovis
ATDAIFGVGHIWRRIRA

SEQ ID NO: 216455 - protein, 23 aa, Mycobacterium bovis
ATDASLRRFVFTSSYATVGRRRG

SEQ ID NO: 216456 - protein, 23 aa, Mycobacterium bovis
ATDLAKIGSTITAANTAAAAVAK

SEQ ID NO: 216457 - protein, 31 aa, Mycobacterium bovis
ATDVSLLPTLQSFLPPPFDAIPNPIEDLDVL

SEQ ID NO: 216458 - protein, 28 aa, Mycobacterium bovis
ATEAAVAHLIPALQQLHDALAAKALDWH

SEQ ID NO: 216459 - protein, 26 aa, Mycobacterium bovis
ATEAEQTFLLRLLGGELRQGAKGGIM

SEQ ID NO: 216460 - protein, 24 aa, Mycobacterium bovis
ATEALLPFEDAPLITNPGGLLEQA

SEQ ID NO: 216461 - protein, 18 aa, Mycobacterium bovis
ATELLLAMVRRLSVADTG

SEQ ID NO: 216462 - protein, 22 aa, Mycobacterium bovis
ATERLLRPIGRVSAAELAQLDE

SEQ ID NO: 216463 - protein, 25 aa, Mycobacterium bovis
ATGARWLCETFPTCLERGAGIPAVE

SEQ ID NO: 216464 - protein, 24 aa, Mycobacterium bovis
ATGGLLLPLGVRSLRAYGPTRNAR

SEQ ID NO: 216465 - protein, 21 aa, Mycobacterium bovis
ATGLNLLAFGGINLSVDGVAV

SEQ ID NO: 216466 - protein, 18 aa, Mycobacterium bovis
ATGLPSMVVLQPATSAVA

SEQ ID NO: 216467 - protein, 19 aa, Mycobacterium bovis
ATGLVVVPVMFDRIMDLPA

SEQ ID NO: 216468 - protein, 22 aa, Mycobacterium bovis
ATGMSMFNLGLGNIGQFNVGFS

SEQ ID NO: 216469 - protein, 32 aa, Mycobacterium bovis
ATGNILRDYLTDLFPILELGTSAKMLSVVPLM

SEQ ID NO: 216470 - protein, 32 aa, Mycobacterium bovis
ATGRIRAMRLALLAEQLPAREALAWGLISAVY

SEQ ID NO: 216471 - protein, 24 aa, Mycobacterium bovis
ATGRTLTFPGFLKAYVETVDELVG

SEQ ID NO: 216472 - protein, 18 aa, Mycobacterium bovis
ATGRYADAWIPIVVVRPS

SEQ ID NO: 216473 - protein, 31 aa, Mycobacterium bovis
ATHLSRLVPQHLMRRLFFTAATVDAATLQHF

SEQ ID NO: 216474 - protein, 21 aa, Mycobacterium bovis
ATIKKVFLELGGKSAFVVLDD

SEQ ID NO: 216475 - protein, 18 aa, Mycobacterium bovis
ATKRRYLGKLSGPLLDRV

SEQ ID NO: 216476 - protein, 23 aa, Mycobacterium bovis
ATKVGLFPRPLPREAAITQVADW

SEQ ID NO: 216477 - protein, 23 aa, Mycobacterium bovis
ATLAGWRTDFLNDMGLVIADSIK

SEQ ID NO: 216478 - protein, 17 aa, Mycobacterium bovis
ATLILPADVCWSDGAHA

SEQ ID NO: 216479 - protein, 21 aa, Mycobacterium bovis
ATMALIADRLVPSGVLHAATD

SEQ ID NO: 216480 - protein, 19 aa, Mycobacterium bovis
ATMGCLYPNRVFLGVGTGE

SEQ ID NO: 216481 - protein, 20 aa, Mycobacterium bovis
ATMHALLNPGDTILGLSLAH

SEQ ID NO: 216482 - protein, 20 aa, Mycobacterium bovis
ATMHPSRYLTLIEGVTAVFL

SEQ ID NO: 216483 - protein, 23 aa, Mycobacterium bovis
ATMPYVLELADHGWRAACRSNPA

SEQ ID NO: 216484 - protein, 29 aa, Mycobacterium bovis
ATNASTPLFFAQAIGRFVRSRRPGETASI

SEQ ID NO: 216485 - protein, 17 aa, Mycobacterium bovis
ATNYVRAHPAMKALVVC

SEQ ID NO: 216486 - protein, 17 aa, Mycobacterium bovis
ATPALVPGVSAPGGLPL

SEQ ID NO: 216487 - protein, 26 aa, Mycobacterium bovis
ATPAVIDAMLLVRLPYHLSSVTQAAA

SEQ ID NO: 216488 - protein, 24 aa, Mycobacterium bovis
ATPDIFVEFSRWRGLSPDGRCKAF

SEQ ID NO: 216489 - protein, 31 aa, Mycobacterium bovis
ATPGGAVIIAGFPFLDLGNVTIGGFNLASGN

SEQ ID NO: 216490 - protein, 29 aa, Mycobacterium bovis
ATQESTLGLIFHWADQRGLPLLDLKDLRA

SEQ ID NO: 216491 - protein, 24 aa, Mycobacterium bovis
ATQPLPVMVFIHGGGYILGSSATP

SEQ ID NO: 216492 - protein, 29 aa, Mycobacterium bovis
ATQRVKANLFYRGLRFHRFPAVGDTLYTR

SEQ ID NO: 216493 - protein, 18 aa, Mycobacterium bovis
ATRGANIALAAALAPLQC

SEQ ID NO: 216494 - protein, 26 aa, Mycobacterium bovis
ATRGYRYGPAFRGLTAMWARGEEIFA

SEQ ID NO: 216495 - protein, 23 aa, Mycobacterium bovis
ATRKSLLEALLNPVPTGDLNLDE

SEQ ID NO: 216496 - protein, 17 aa, Mycobacterium bovis
ATRRPVVAVLNKADLAG

SEQ ID NO: 216497 - protein, 20 aa, Mycobacterium bovis
ATRRQAALVLADALVRARLH

SEQ ID NO: 216498 - protein, 18 aa, Mycobacterium bovis
ATRRYPGTDRPALDRLDL

SEQ ID NO: 216499 - protein, 17 aa, Mycobacterium bovis
ATRSPIGKRNGWLSGLH

SEQ ID NO: 216500 - protein, 21 aa, Mycobacterium bovis
ATRVFRLSRIGAQVTPIGPAG

SEQ ID NO: 216501 - protein, 20 aa, Mycobacterium bovis
ATRWRHGGSPLLRGLIDAGT

SEQ ID NO: 216502 - protein, 27 aa, Mycobacterium bovis
ATSGQPLDWFCLFSSAAALTGSPGQSA

SEQ ID NO: 216503 - protein, 23 aa, Mycobacterium bovis
ATSIDPQQRLLLETSWEAIEHAG

SEQ ID NO: 216504 - protein, 21 aa, Mycobacterium bovis
ATTAWLIERLQRPTLVMAPNK

SEQ ID NO: 216505 - protein, 22 aa, Mycobacterium bovis
ATTTTYFIRTDQLPLVRALVDM

SEQ ID NO: 216506 - protein, 21 aa, Mycobacterium bovis
ATVAVLEGRLAAWAIELDAAA

SEQ ID NO: 216507 - protein, 17 aa, Mycobacterium bovis
ATVIRLSDYPYVVPLID

SEQ ID NO: 216508 - protein, 21 aa, Mycobacterium bovis
ATVPSLRLVGYGGSRAIAADV

SEQ ID NO: 216509 - protein, 20 aa, Mycobacterium bovis
ATVPVLKGQPRRAARKAGYE

SEQ ID NO: 216510 - protein, 19 aa, Mycobacterium bovis
ATVQPAVVAANRGLMQLLA

SEQ ID NO: 216511 - protein, 25 aa, Mycobacterium bovis
ATVQTCIIHLIRNTFRYASRKYWDK

SEQ ID NO: 216512 - protein, 30 aa, Mycobacterium bovis
ATYVTFDLIHRLWLDLGHELHYVQNITDID

SEQ ID NO: 216513 - protein, 25 aa, Mycobacterium bovis
AVADRCSWRRWWPDLRLQVTEDRAD

SEQ ID NO: 216514 - protein, 17 aa, Mycobacterium bovis
AVAIDALRRPERRRGMA

SEQ ID NO: 216515 - protein, 25 aa, Mycobacterium bovis
AVAKRLMHVLGTSAYVPDLLMRAPR

SEQ ID NO: 216516 - protein, 18 aa, Mycobacterium bovis
AVAKVPRGPLAAASAAIA

SEQ ID NO: 216517 - protein, 18 aa, Mycobacterium bovis
AVARFLAHWVHQAGPKIL

SEQ ID NO: 216518 - protein, 26 aa, Mycobacterium bovis
AVARHLLSRRYGAAVLGPHGSKRSLP

SEQ ID NO: 216519 - protein, 23 aa, Mycobacterium bovis
AVASFFAKNFLPLLTSTREVIET

SEQ ID NO: 216520 - protein, 22 aa, Mycobacterium bovis
AVASFYTMYRRRPTGEYLVGVC

SEQ ID NO: 216521 - protein, 29 aa, Mycobacterium bovis
AVAVALPAFALPLRLPAGLAAGPAAVVTA

SEQ ID NO: 216522 - protein, 21 aa, Mycobacterium bovis
AVCELMRIAWRTVGAIVARVW

SEQ ID NO: 216523 - protein, 20 aa, Mycobacterium bovis
AVCELVLMELYQLLRNPTVV

SEQ ID NO: 216524 - protein, 27 aa, Mycobacterium bovis
AVCLRALTTMPIPVIAAVRGLAVGGGC

SEQ ID NO: 216525 - protein, 24 aa, Mycobacterium bovis
AVDAGLDVYWEPAAERLAAHPASG

SEQ ID NO: 216526 - protein, 24 aa, Mycobacterium bovis
AVDANALGAALWRGVELVVASMGG

SEQ ID NO: 216527 - protein, 17 aa, Mycobacterium bovis
AVDAPRLGLPLAQELSA

SEQ ID NO: 216528 - protein, 23 aa, Mycobacterium bovis
AVDGVSFRLPRASTLAIVGESGS

SEQ ID NO: 216529 - protein, 18 aa, Mycobacterium bovis
AVDNGFVPTIPPVLVRPE

SEQ ID NO: 216530 - protein, 20 aa, Mycobacterium bovis
AVDRAILRVSVWELLHAADV

SEQ ID NO: 216531 - protein, 18 aa, Mycobacterium bovis
AVDTDLRWRIVTALATAG

SEQ ID NO: 216532 - protein, 19 aa, Mycobacterium bovis
AVENPQLLRPFVDLIGDEL

SEQ ID NO: 216533 - protein, 29 aa, Mycobacterium bovis
AVESILTVLALRDQVIPPTLNLVNLDPEI

SEQ ID NO: 216534 - protein, 23 aa, Mycobacterium bovis
AVFDTAFFHDLPPAAATYAIDRD

SEQ ID NO: 216535 - protein, 23 aa, Mycobacterium bovis
AVFTTPCVFYVQNNQWAISMPVS

SEQ ID NO: 216536 - protein, 17 aa, Mycobacterium bovis
AVFYQVYPRSFADSNGD

SEQ ID NO: 216537 - protein, 27 aa, Mycobacterium bovis
AVGADVPLLGQIPLDPALVAAGDSGVP

SEQ ID NO: 216538 - protein, 17 aa, Mycobacterium bovis
AVGDAVMGFLGGAGPLA

SEQ ID NO: 216539 - protein, 22 aa, Mycobacterium bovis
AVGGLYVHWIVTGIAPGSGSTA

SEQ ID NO: 216540 - protein, 25 aa, Mycobacterium bovis
AVGHAAWFLHMQGVLVPAAGGVGLV

SEQ ID NO: 216541 - protein, 25 aa, Mycobacterium bovis
AVGRAVRWRLSGLGLRVIAHDPYRD

SEQ ID NO: 216542 - protein, 24 aa, Mycobacterium bovis
AVGVVHSLWQPMAGRFKDYIAQPR

SEQ ID NO: 216543 - protein, 18 aa, Mycobacterium bovis
AVGYRWDPDTREIGAPLL

SEQ ID NO: 216544 - protein, 26 aa, Mycobacterium bovis
AVHHDLHLWLPHPSDELWRALAGFQG

SEQ ID NO: 216545 - protein, 20 aa, Mycobacterium bovis
AVHNGYIPRHLNFHQLTPHA

SEQ ID NO: 216546 - protein, 23 aa, Mycobacterium bovis
AVIARPPILPKPRNPRDDRILLE

SEQ ID NO: 216547 - protein, 29 aa, Mycobacterium bovis
AVIAVHLRGHFLLTRNAAAYWRDKAKDAE

SEQ ID NO: 216548 - protein, 23 aa, Mycobacterium bovis
AVILAPQGIEYVVGFLGALQAGR

SEQ ID NO: 216549 - protein, 19 aa, Mycobacterium bovis
AVILDSDPWRKLSANRDNR

SEQ ID NO: 216550 - protein, 18 aa, Mycobacterium bovis
AVIQRRLIYRGNALRCGY

SEQ ID NO: 216551 - protein, 21 aa, Mycobacterium bovis
AVKLRLGIGYVIQNAGLMPHQ

SEQ ID NO: 216552 - protein, 25 aa, Mycobacterium bovis
AVKRPEDLRFLVRLARQQGERLGRA

SEQ ID NO: 216553 - protein, 29 aa, Mycobacterium bovis
AVLGVIDSITLLPLYFELDGSFPNHEANP

SEQ ID NO: 216554 - protein, 19 aa, Mycobacterium bovis
AVLMLRHGLRFLTACQRRY

SEQ ID NO: 216555 - protein, 26 aa, Mycobacterium bovis
AVLMSPMAFLQRPARWMQLLAKHRAQ

SEQ ID NO: 216556 - protein, 26 aa, Mycobacterium bovis
AVLPEKPELILLDNFAVWQTQTAVQR

SEQ ID NO: 216557 - protein, 19 aa, Mycobacterium bovis
AVLPSHYEPFGLVALEAAA

SEQ ID NO: 216558 - protein, 25 aa, Mycobacterium bovis
AVLPVYDPLFDSKKLRHVLVRHEQG

SEQ ID NO: 216559 - protein, 25 aa, Mycobacterium bovis
AVLRARIWVAQVGRVPLLLLDSDIP

SEQ ID NO: 216560 - protein, 30 aa, Mycobacterium bovis
AVLRPHGQVLVFWDCYRPHDVQVRMFDVVP

SEQ ID NO: 216561 - protein, 18 aa, Mycobacterium bovis
AVLSAGLMLAWCCDLIVA

SEQ ID NO: 216562 - protein, 26 aa, Mycobacterium bovis
AVLSRAQLLELVWGYDFAADTNVVDV

SEQ ID NO: 216563 - protein, 18 aa, Mycobacterium bovis
AVLTALDRLRFAAGNFYV

SEQ ID NO: 216564 - protein, 17 aa, Mycobacterium bovis
AVMRKHRLAERLLVDVI

SEQ ID NO: 216565 - protein, 28 aa, Mycobacterium bovis
AVNVATLPFPGFPTDLQPMAIALASIAD

SEQ ID NO: 216566 - protein, 27 aa, Mycobacterium bovis
AVPAQADWLDPMIALSFAAAASSRVDV

SEQ ID NO: 216567 - protein, 19 aa, Mycobacterium bovis
AVPCKHLAATFYLLAESFD

SEQ ID NO: 216568 - protein, 26 aa, Mycobacterium bovis
AVPDGRKLAWFGPPMSAASMATARLM

SEQ ID NO: 216569 - protein, 17 aa, Mycobacterium bovis
AVPIVGAPMAGGPSTPA

SEQ ID NO: 216570 - protein, 19 aa, Mycobacterium bovis
AVPLDKPLTELGLDSLMAV

SEQ ID NO: 216571 - protein, 19 aa, Mycobacterium bovis
AVPRRPVIRPIPVDDSGFT

SEQ ID NO: 216572 - protein, 18 aa, Mycobacterium bovis
AVPYVAWMRATAASAEQA

SEQ ID NO: 216573 - protein, 36 aa, Mycobacterium bovis
AVQIMTVFVAKGLQFPIVYLPFAFNRNVRSDDILLY

SEQ ID NO: 216574 - protein, 23 aa, Mycobacterium bovis
AVQNFPALVANLPAAIDAAVQQF

SEQ ID NO: 216575 - protein, 30 aa, Mycobacterium bovis
AVQRGHIPRNLHFTRWNPAIDASATRLFVP

SEQ ID NO: 216576 - protein, 24 aa, Mycobacterium bovis
AVRDGMATLNPLAAQIIGQLSSLE

SEQ ID NO: 216577 - protein, 23 aa, Mycobacterium bovis
AVRELMPRTPFIGGLGIVFERYE

SEQ ID NO: 216578 - protein, 19 aa, Mycobacterium bovis
AVRGGILDIFAPTAEHPVR

SEQ ID NO: 216579 - protein, 31 aa, Mycobacterium bovis
AVRIDHIIGLFRLWWIPDGAPPTQGTYVRYD

SEQ ID NO: 216580 - protein, 26 aa, Mycobacterium bovis
AVRIEAMPWQWVGQELPQFSSAPTNH

SEQ ID NO: 216581 - protein, 21 aa, Mycobacterium bovis
AVRPEWPVLVAAIAEWAKRGG

SEQ ID NO: 216582 - protein, 23 aa, Mycobacterium bovis
AVRRRPYTVVLFDEIEKAHPDVF

SEQ ID NO: 216583 - protein, 26 aa, Mycobacterium bovis
AVRRTPLLLDGVAVTAAALVAERLAP

SEQ ID NO: 216584 - protein, 26 aa, Mycobacterium bovis
AVRTRKPLLPPPPQPPGREPVHRRAL

SEQ ID NO: 216585 - protein, 23 aa, Mycobacterium bovis
AVRVRIGGRWRSGTAYLLPDDDP

SEQ ID NO: 216586 - protein, 31 aa, Mycobacterium bovis
AVSEAYFAALLGLPFIAVMPAATSASKIALI

SEQ ID NO: 216587 - protein, 25 aa, Mycobacterium bovis
AVSEQVEQLLLWDRAVRADAYDAVH

SEQ ID NO: 216588 - protein, 25 aa, Mycobacterium bovis
AVSVGDYHIPKMIGWTLVGRPVDDA

SEQ ID NO: 216589 - protein, 25 aa, Mycobacterium bovis
AVTAAPYIGWLYTTAEKTQQTAIQA

SEQ ID NO: 216590 - protein, 25 aa, Mycobacterium bovis
AVTEWFAVDWHREIVDKWRAAGVRM

SEQ ID NO: 216591 - protein, 23 aa, Mycobacterium bovis
AVTIPVMAKVRIGHFVEAQILQT

SEQ ID NO: 216592 - protein, 17 aa, Mycobacterium bovis
AVTKHKTPWILVGEQTV

SEQ ID NO: 216593 - protein, 25 aa, Mycobacterium bovis
AVTPYASATFPWYQLGRQAHVQGPV

SEQ ID NO: 216594 - protein, 27 aa, Mycobacterium bovis
AVTTFNKAFAPYGLPRTAFKPSYGIAE

SEQ ID NO: 216595 - protein, 31 aa, Mycobacterium bovis
AVTTRLRFNFFVLKLPIRPPALVAKQAGSLA

SEQ ID NO: 216596 - protein, 20 aa, Mycobacterium bovis
AVTVFLAPPSWQDLQARLIG

SEQ ID NO: 216597 - protein, 31 aa, Mycobacterium bovis
AVVAANRGLMQLLAATNWFGQNAPALMDVEA

SEQ ID NO: 216598 - protein, 34 aa, Mycobacterium bovis
AVVANLPYNVAVPALLHLLVEFPSIRVVTVMVQA

SEQ ID NO: 216599 - protein, 27 aa, Mycobacterium bovis
AVVINYRAERWSDVVKLLTPMVNDPDL

SEQ ID NO: 216600 - protein, 23 aa, Mycobacterium bovis
AVVPAIVWCSAETQPQGWVRLRG

SEQ ID NO: 216601 - protein, 17 aa, Mycobacterium bovis
AVYECAVPVIAAVNGFC

SEQ ID NO: 216602 - protein, 18 aa, Mycobacterium bovis
AVYPLVIRAGGGSPRDTL

SEQ ID NO: 216603 - protein, 18 aa, Mycobacterium bovis
AWAGQQPGFRGERLVNSM

SEQ ID NO: 216604 - protein, 20 aa, Mycobacterium bovis
AWLLVSILRQFGLAARFVSG

SEQ ID NO: 216605 - protein, 18 aa, Mycobacterium bovis
AWPTAQIAVMGASGAVGF

SEQ ID NO: 216606 - protein, 24 aa, Mycobacterium bovis
AWRDNEWYVARLCPTPLRPQERRT

SEQ ID NO: 216607 - protein, 24 aa, Mycobacterium bovis
AWRNDQWYTARLCPAPLRPEERQT

SEQ ID NO: 216608 - protein, 24 aa, Mycobacterium bovis
AWSAEGLLRYLPPEAQDRLLDNVT

SEQ ID NO: 216609 - protein, 25 aa, Mycobacterium bovis
AYAMEANWALLLLDDDGAGERARTA

SEQ ID NO: 216610 - protein, 23 aa, Mycobacterium bovis
AYEGKIDWAFGELLALGSLVAEG

SEQ ID NO: 216611 - protein, 28 aa, Mycobacterium bovis
AYEVFIHRLRKYLGAYLAVLGHTDVVSF

SEQ ID NO: 216612 - protein, 19 aa, Mycobacterium bovis
AYFDAVLQQQLLPTGRVDY

SEQ ID NO: 216613 - protein, 20 aa, Mycobacterium bovis
AYGGTFRLIDKVFTRWDVQY

SEQ ID NO: 216614 - protein, 18 aa, Mycobacterium bovis
AYGLYPSWRGRGLATRAV

SEQ ID NO: 216615 - protein, 17 aa, Mycobacterium bovis
AYGPTRNARYCYTRLTK

SEQ ID NO: 216616 - protein, 19 aa, Mycobacterium bovis
AYIRPIFGPNNPVAQYTPE

SEQ ID NO: 216617 - protein, 24 aa, Mycobacterium bovis
AYLSTSLFAFWAVDAAYSLDGRRN

SEQ ID NO: 216618 - protein, 27 aa, Mycobacterium bovis
AYNAGLPALKSFVLPGGSPLSALLHVA

SEQ ID NO: 216619 - protein, 34 aa, Mycobacterium bovis
AYNGALDIDLVFSPFFNALPIRRLGLHERAESIA

SEQ ID NO: 216620 - protein, 26 aa, Mycobacterium bovis
AYPLGTAFRPKVWPAVRRIDGAYGDR

SEQ ID NO: 216621 - protein, 23 aa, Mycobacterium bovis
AYPSTLGYKGFPKSCCTSLNEVI

SEQ ID NO: 216622 - protein, 26 aa, Mycobacterium bovis
AYRVSTGLYRYSLLDIIDIADIADID

SEQ ID NO: 216623 - protein, 24 aa, Mycobacterium bovis
CACTTHVPLSPAPSPRPPATSTEG

SEQ ID NO: 216624 - protein, 19 aa, Mycobacterium bovis
CAECHLDAPMVNRALAGAP

SEQ ID NO: 216625 - protein, 24 aa, Mycobacterium bovis
CAGADLKAIARRENPYHPHHGEWG

SEQ ID NO: 216626 - protein, 23 aa, Mycobacterium bovis
CAGEKMMLLFESANFDEAVFCEP

SEQ ID NO: 216627 - protein, 26 aa, Mycobacterium bovis
CAGYVPGIPRLGVPALLMSDAGLGVT

SEQ ID NO: 216628 - protein, 18 aa, Mycobacterium bovis
CALANRLRITKPDAALRI

SEQ ID NO: 216629 - protein, 25 aa, Mycobacterium bovis
CAPAAFRFMSQARHIGKVVLTMPSA

SEQ ID NO: 216630 - protein, 24 aa, Mycobacterium bovis
CAPDDVLPAIAFAVAHTGKPVIVY

SEQ ID NO: 216631 - protein, 20 aa, Mycobacterium bovis
CAQACGLGLLGGPPTPETAL

SEQ ID NO: 216632 - protein, 23 aa, Mycobacterium bovis
CAQQAIRRRAFARALRIAGSPDT

SEQ ID NO: 216633 - protein, 22 aa, Mycobacterium bovis
CARRRAEIFTWQRAAASMLATL

SEQ ID NO: 216634 - protein, 28 aa, Mycobacterium bovis
CASAWLDALVGWRRASGLPAAVINWGPW

SEQ ID NO: 216635 - protein, 18 aa, Mycobacterium bovis
CCARSRILVQRSVYDRFM

SEQ ID NO: 216636 - protein, 25 aa, Mycobacterium bovis
CCQYDPLMSPLVWDLAHIGQQEELW

SEQ ID NO: 216637 - protein, 17 aa, Mycobacterium bovis
CCSKIPDFVSSQWQWQT

SEQ ID NO: 216638 - protein, 18 aa, Mycobacterium bovis
CDAYYWVDNLRHTVRFAA

SEQ ID NO: 216639 - protein, 18 aa, Mycobacterium bovis
CDPPPVQRPHPPLWIGGE

SEQ ID NO: 216640 - protein, 27 aa, Mycobacterium bovis
CDVDDMLWQVPYLPIDPRDVGRTYEAV

SEQ ID NO: 216641 - protein, 23 aa, Mycobacterium bovis
CEAGLLPGALTRNVGLHFICRDV

SEQ ID NO: 216642 - protein, 19 aa, Mycobacterium bovis
CEASLDQQRQWILHMAKLS

SEQ ID NO: 216643 - protein, 21 aa, Mycobacterium bovis
CEDPRFSIARLSLLDRGMVFV

SEQ ID NO: 216644 - protein, 19 aa, Mycobacterium bovis
CEFIDASPSPFHVCATVAG

SEQ ID NO: 216645 - protein, 26 aa, Mycobacterium bovis
CELIDFWRFNVAFARQILEQQPISGP

SEQ ID NO: 216646 - protein, 17 aa, Mycobacterium bovis
CELLSGARVWPGVFLPD

SEQ ID NO: 216647 - protein, 21 aa, Mycobacterium bovis
CERLGLPVFVKPARGGSSIGV

SEQ ID NO: 216648 - protein, 18 aa, Mycobacterium bovis
CETELTVLAPRREQLTGD

SEQ ID NO: 216649 - protein, 18 aa, Mycobacterium bovis
CEYLPGKAIVMQMLVRYV

SEQ ID NO: 216650 - protein, 18 aa, Mycobacterium bovis
CFLVQHRSRLASEKNGVM

SEQ ID NO: 216651 - protein, 24 aa, Mycobacterium bovis
CGARAFIEISAHPALLFAIGQNCE

SEQ ID NO: 216652 - protein, 26 aa, Mycobacterium bovis
CGELGLPYLVLARPPWDPGTAIIAVS

SEQ ID NO: 216653 - protein, 24 aa, Mycobacterium bovis
CGGEYEWTRAKAAYFMIVFSGPIP

SEQ ID NO: 216654 - protein, 26 aa, Mycobacterium bovis
CGKTYLAQTLAKMLNVPFAIADATAL

SEQ ID NO: 216655 - protein, 27 aa, Mycobacterium bovis
CGLAGTVLRFVPPLAALGSVPVTFDGD

SEQ ID NO: 216656 - protein, 19 aa, Mycobacterium bovis
CGLLYVGLAITARGPAVVE

SEQ ID NO: 216657 - protein, 18 aa, Mycobacterium bovis
CGRCRAIARCRSCTGPLS

SEQ ID NO: 216658 - protein, 24 aa, Mycobacterium bovis
CGSTAMIYLMHMAAAVTVAASPPP

SEQ ID NO: 216659 - protein, 20 aa, Mycobacterium bovis
CHGNPTWSFLYRDIIVALRD

SEQ ID NO: 216660 - protein, 19 aa, Mycobacterium bovis
CHPDLHNAFPPLRTRKVVG

SEQ ID NO: 216661 - protein, 17 aa, Mycobacterium bovis
CHRAILSQGIYGFENVG

SEQ ID NO: 216662 - protein, 18 aa, Mycobacterium bovis
CIDVLTQISAVTSALRSV

SEQ ID NO: 216663 - protein, 17 aa, Mycobacterium bovis
CIHPSQIPVVRKAYRPS

SEQ ID NO: 216664 - protein, 17 aa, Mycobacterium bovis
CILSPQHRIRIVFRSPM

SEQ ID NO: 216665 - protein, 17 aa, Mycobacterium bovis
CIRALRANQQAAQRLRG

SEQ ID NO: 216666 - protein, 26 aa, Mycobacterium bovis
CKQTIEPGWLYITAHRRGQAGIVDDG

SEQ ID NO: 216667 - protein, 26 aa, Mycobacterium bovis
CLAEAGWPVRVWAAALPQQTTSAVAG

SEQ ID NO: 216668 - protein, 35 aa, Mycobacterium bovis
CLAGGSLEIFLTPQLPAPLIQIYGETPIADALIEL

SEQ ID NO: 216669 - protein, 23 aa, Mycobacterium bovis
CLDPGRVGLFRHVLRPAFLQAET

SEQ ID NO: 216670 - protein, 23 aa, Mycobacterium bovis
CLDVTRWRRAGWRVFRLGVPRLG

SEQ ID NO: 216671 - protein, 19 aa, Mycobacterium bovis
CLPLNWLRRKHGLSSLGWD

SEQ ID NO: 216672 - protein, 27 aa, Mycobacterium bovis
CLPSDRLLNLLIYIKGYLDGTLTFRRS

SEQ ID NO: 216673 - protein, 19 aa, Mycobacterium bovis
CLRPLRIVVPEGSMLAPTH

SEQ ID NO: 216674 - protein, 19 aa, Mycobacterium bovis
CLTFNGLSKAYRVAGYRAG

SEQ ID NO: 216675 - protein, 19 aa, Mycobacterium bovis
CLVALAILDTVGVSPEQAV

SEQ ID NO: 216676 - protein, 27 aa, Mycobacterium bovis
CMDNGMPILVFNLLTDGNIARAVRGEK

SEQ ID NO: 216677 - protein, 29 aa, Mycobacterium bovis
CMDYICAEAPLFLDTPAILGVPSSLNCYH

SEQ ID NO: 216678 - protein, 22 aa, Mycobacterium bovis
CPLWNVYETFANPGKILVQIAQ

SEQ ID NO: 216679 - protein, 24 aa, Mycobacterium bovis
CPTAARARRLVYAPDLDGRADPGE

SEQ ID NO: 216680 - protein, 22 aa, Mycobacterium bovis
CRFPTVVSPGDLWDLLRDGREA

SEQ ID NO: 216681 - protein, 25 aa, Mycobacterium bovis
CRHNLGYWDGGQWWGAGPGAHGYIG

SEQ ID NO: 216682 - protein, 29 aa, Mycobacterium bovis
CRIVLPEGADPFVLLFSESAGRVLVAVPR

SEQ ID NO: 216683 - protein, 19 aa, Mycobacterium bovis
CRPIGYPYIVTGADGILIT

SEQ ID NO: 216684 - protein, 17 aa, Mycobacterium bovis
CRRALRQIGVLERPVGD

SEQ ID NO: 216685 - protein, 20 aa, Mycobacterium bovis
CRRLDGMPLAIELAAARLRS

SEQ ID NO: 216686 - protein, 18 aa, Mycobacterium bovis
CRRLDGVPLAIELAAART

SEQ ID NO: 216687 - protein, 26 aa, Mycobacterium bovis
CRRWPKLMRRLLLWEVRRRLGRSVDM

SEQ ID NO: 216688 - protein, 22 aa, Mycobacterium bovis
CRTRNLPLIGAPANPGPAPGSG

SEQ ID NO: 216689 - protein, 26 aa, Mycobacterium bovis
CRYADGVGHPFWFSRTVFGELARLHG

SEQ ID NO: 216690 - protein, 24 aa, Mycobacterium bovis
CSASPVAPGWAVPPVAGVMAGAVV

SEQ ID NO: 216691 - protein, 24 aa, Mycobacterium bovis
CSETCVGRLRYLGLVLYDVDQVLQ

SEQ ID NO: 216692 - protein, 24 aa, Mycobacterium bovis
CSGAHIVMIGILPTLMPEHLTDGW

SEQ ID NO: 216693 - protein, 22 aa, Mycobacterium bovis
CSSETLLIVPTPAGVLFTQATA

SEQ ID NO: 216694 - protein, 17 aa, Mycobacterium bovis
CTFVTVPGKLRAQGSST

SEQ ID NO: 216695 - protein, 27 aa, Mycobacterium bovis
CTPQEYVLFLRQTPIFEQMLIDDGILL

SEQ ID NO: 216696 - protein, 23 aa, Mycobacterium bovis
CTSWVQLPLTPQLAEPVHDEAAL

SEQ ID NO: 216697 - protein, 24 aa, Mycobacterium bovis
CTWEHDAHLYLRRAHGIGGFLGGS

SEQ ID NO: 216698 - protein, 17 aa, Mycobacterium bovis
CVGMQILFACGVEFGVQ

SEQ ID NO: 216699 - protein, 17 aa, Mycobacterium bovis
CVHDPLIMRRALEYATG

SEQ ID NO: 216700 - protein, 18 aa, Mycobacterium bovis
CVNIETGVVWWPECSKEA

SEQ ID NO: 216701 - protein, 22 aa, Mycobacterium bovis
CVRATWLKVVPDQLGRSLEFYR

SEQ ID NO: 216702 - protein, 18 aa, Mycobacterium bovis
CVVDTRAWLRDPSPLFRT

SEQ ID NO: 216703 - protein, 20 aa, Mycobacterium bovis
CYGLSVAALMKWHLPRLEVL

SEQ ID NO: 216704 - protein, 21 aa, Mycobacterium bovis
CYPHFRRFLAEVVRVLRPGGY

SEQ ID NO: 216705 - protein, 18 aa, Mycobacterium bovis
CYVRNQVPFFVDYVRRYT

SEQ ID NO: 216706 - protein, 17 aa, Mycobacterium bovis
DAAAKMLAGKPFKKEAA

SEQ ID NO: 216707 - protein, 18 aa, Mycobacterium bovis
DAADLGPRRALTGEPLAP

SEQ ID NO: 216708 - protein, 26 aa, Mycobacterium bovis
DAAGTFVCNHLMYGVLHHLAQKGLPV

SEQ ID NO: 216709 - protein, 30 aa, Mycobacterium bovis
DAAGYIDVVILAYAAKFASAFYGPFREAVS

SEQ ID NO: 216710 - protein, 17 aa, Mycobacterium bovis
DAALIDVVLPLVDGLPD

SEQ ID NO: 216711 - protein, 30 aa, Mycobacterium bovis
DAAQGTRLVPIPGAPPSLAGLAPGCPFAPR

SEQ ID NO: 216712 - protein, 24 aa, Mycobacterium bovis
DAARFLLEGMPVQVAFHNGVPLYI

SEQ ID NO: 216713 - protein, 23 aa, Mycobacterium bovis
DAARLMVGAVRRHRPGSLQRVVF

SEQ ID NO: 216714 - protein, 25 aa, Mycobacterium bovis
DACELLAQFLDPATVRYLREFRFRG

SEQ ID NO: 216715 - protein, 28 aa, Mycobacterium bovis
DADLEHWRWMWDTNVLGTLRVTRALLPK

SEQ ID NO: 216716 - protein, 34 aa, Mycobacterium bovis
DADPDLIIGRYIPNLVPRLFTLDRDFIQEIRDLV

SEQ ID NO: 216717 - protein, 24 aa, Mycobacterium bovis
DADYFCVGPCWPTPTKPGRAAPGL

SEQ ID NO: 216718 - protein, 21 aa, Mycobacterium bovis
DAEFSFLPRFSPGKGLGVIPR

SEQ ID NO: 216719 - protein, 23 aa, Mycobacterium bovis
DAERDWEDFWAATRPVELTATVE

SEQ ID NO: 216720 - protein, 25 aa, Mycobacterium bovis
DAEVLIDLVRRYAPKLALIVTSHQH

SEQ ID NO: 216721 - protein, 25 aa, Mycobacterium bovis
DAEVRAIWNLPPRPRTRPPSDGSSL

SEQ ID NO: 216722 - protein, 22 aa, Mycobacterium bovis
DAFADFLAGFHIIDRHFATAPL

SEQ ID NO: 216723 - protein, 25 aa, Mycobacterium bovis
DAFDIPLVFVVDTPGFLPGVEQEKN

SEQ ID NO: 216724 - protein, 25 aa, Mycobacterium bovis
DAFDYVRELLSYLPPNNSTDAPRYQ

SEQ ID NO: 216725 - protein, 24 aa, Mycobacterium bovis
DAFEHFPPPILKPVILAAKSATLF

SEQ ID NO: 216726 - protein, 19 aa, Mycobacterium bovis
DAFFALFQDPTRTYSCAYF

SEQ ID NO: 216727 - protein, 25 aa, Mycobacterium bovis
DAFGIPLVVVVDVPGYLPGVDQEWG

SEQ ID NO: 216728 - protein, 27 aa, Mycobacterium bovis
DAFLSRSCRWALAAANLWQGNLEAAVG

SEQ ID NO: 216729 - protein, 20 aa, Mycobacterium bovis
DAFRSWRLLVSKYGTQAPGP

SEQ ID NO: 216730 - protein, 17 aa, Mycobacterium bovis
DAGALLPRLHKLVRADC

SEQ ID NO: 216731 - protein, 23 aa, Mycobacterium bovis
DAGEPWTVSKLYYVHGFLRERMQ

SEQ ID NO: 216732 - protein, 26 aa, Mycobacterium bovis
DAGGRGLLVLLDALRSTICGQAPARA

SEQ ID NO: 216733 - protein, 26 aa, Mycobacterium bovis
DAGGTPFRPLFTVLAAQLGSDPDGWE

SEQ ID NO: 216734 - protein, 22 aa, Mycobacterium bovis
DAGRINHAYLFSGPRGCGKTSS

SEQ ID NO: 216735 - protein, 25 aa, Mycobacterium bovis
DAHITGPYRWWTAVGPRLSMVDDGL

SEQ ID NO: 216736 - protein, 22 aa, Mycobacterium bovis
DAHLYCAIAIFGDKVTALQLVW

SEQ ID NO: 216737 - protein, 21 aa, Mycobacterium bovis
DAIDHLLRLCAGPRGRVMSRA

SEQ ID NO: 216738 - protein, 18 aa, Mycobacterium bovis
DAIELFVDRARRVRSDFA

SEQ ID NO: 216739 - protein, 28 aa, Mycobacterium bovis
DAIFGVGHIWRRIRAANLPIALSDRLTL

SEQ ID NO: 216740 - protein, 18 aa, Mycobacterium bovis
DAILFYTDGLIERPGRPL

SEQ ID NO: 216741 - protein, 22 aa, Mycobacterium bovis
DAILVPPGDGPWRLGLGSAGTF

SEQ ID NO: 216742 - protein, 19 aa, Mycobacterium bovis
DAIMVVLALAMKEAGELAC

SEQ ID NO: 216743 - protein, 29 aa, Mycobacterium bovis
DALAVGLQRKDGAAWLAHNRSGAGLFGSI

SEQ ID NO: 216744 - protein, 19 aa, Mycobacterium bovis
DALFLWAETPTRPLHVGAL

SEQ ID NO: 216745 - protein, 29 aa, Mycobacterium bovis
DALGNFLARLVFPNPMRQLRITVGLIADL

SEQ ID NO: 216746 - protein, 23 aa, Mycobacterium bovis
DALITALWEEWPPSGARASIHSY

SEQ ID NO: 216747 - protein, 19 aa, Mycobacterium bovis
DALIWNGSLWHTAAANRTD

SEQ ID NO: 216748 - protein, 24 aa, Mycobacterium bovis
DALKADGIVGVRLNWRHHGEGGEH

SEQ ID NO: 216749 - protein, 20 aa, Mycobacterium bovis
DALRGYQSLLPFAVIADPDR

SEQ ID NO: 216750 - protein, 21 aa, Mycobacterium bovis
DALRRYLRTRHPRVSSALARA

SEQ ID NO: 216751 - protein, 20 aa, Mycobacterium bovis
DAMALVAQPKTDILSEVWVS

SEQ ID NO: 216752 - protein, 19 aa, Mycobacterium bovis
DAMFPARAFDALAAWVRAA

SEQ ID NO: 216753 - protein, 17 aa, Mycobacterium bovis
DAMLPGATGLRAPLACL

SEQ ID NO: 216754 - protein, 19 aa, Mycobacterium bovis
DAMLYAKRPLMSDAMLRVF

SEQ ID NO: 216755 - protein, 23 aa, Mycobacterium bovis
DAMPTFRQVFLAGASGMALERRC

SEQ ID NO: 216756 - protein, 29 aa, Mycobacterium bovis
DAMTQGWFTGLIPITVPIAGSAFGDAARA

SEQ ID NO: 216757 - protein, 19 aa, Mycobacterium bovis
DAPARYAERLYGAAPGTVI

SEQ ID NO: 216758 - protein, 33 aa, Mycobacterium bovis
DAPELVKLRPYFDHPLFVEMFADAITAAAATVR

SEQ ID NO: 216759 - protein, 23 aa, Mycobacterium bovis
DAPRVVLLGIPTRGVTLANRLAG

SEQ ID NO: 216760 - protein, 23 aa, Mycobacterium bovis
DAPVLPTLCRAAAALLGSTAADV

SEQ ID NO: 216761 - protein, 18 aa, Mycobacterium bovis
DAPYLTPHPHRGLANEPY

SEQ ID NO: 216762 - protein, 28 aa, Mycobacterium bovis
DAQFVRRQRAWLRTRASRQPRETPATLP

SEQ ID NO: 216763 - protein, 18 aa, Mycobacterium bovis
DARALYELLKLRVEVFVV

SEQ ID NO: 216764 - protein, 17 aa, Mycobacterium bovis
DARLRLVLEVPTLREVP

SEQ ID NO: 216765 - protein, 23 aa, Mycobacterium bovis
DARRGKMFARLIKNIEVAARVGG

SEQ ID NO: 216766 - protein, 18 aa, Mycobacterium bovis
DASALRDWAHAVVSDLIL

SEQ ID NO: 216767 - protein, 36 aa, Mycobacterium bovis; identical to SEQ ID NO: 113659

SEQ ID NO: 216768 - protein, 23 aa, Mycobacterium bovis
DASGITLVAFLRGDSMNVYTRAD

SEQ ID NO: 216769 - protein, 25 aa, Mycobacterium bovis
DASLLLVVLTRFLPPDDPRVRNTVL

SEQ ID NO: 216770 - protein, 21 aa, Mycobacterium bovis
DASLRLLPRGGRFIEMGKTEF

SEQ ID NO: 216771 - protein, 35 aa, Mycobacterium bovis
DASRASATLIWRRPRWARRLQPAPIADLLTEGHAL

SEQ ID NO: 216772 - protein, 30 aa, Mycobacterium bovis
DATARFGLLPLRWALACLLIDIGTVTFSAQ

SEQ ID NO: 216773 - protein, 24 aa, Mycobacterium bovis
DATELPMLLYDIPGRSAVPIEPDT

SEQ ID NO: 216774 - protein, 21 aa, Mycobacterium bovis
DATLVQIIRWLRPGAVIAIAK

SEQ ID NO: 216775 - protein, 28 aa, Mycobacterium bovis
DATMLFESLLPRYLTTRVYAALLESAAS

SEQ ID NO: 216776 - protein, 28 aa, Mycobacterium bovis
DATRDFAIGLAGIPPSLQSALQALAAGD

SEQ ID NO: 216777 - protein, 18 aa, Mycobacterium bovis
DAVAEMTVALLLAVARHL

SEQ ID NO: 216778 - protein, 26 aa, Mycobacterium bovis
DAVALYVKAMTRLPQLTPPGTAFAYN

SEQ ID NO: 216779 - protein, 25 aa, Mycobacterium bovis
DAVNAPTQTLLGRPLIGNGADGVAG

SEQ ID NO: 216780 - protein, 25 aa, Mycobacterium bovis
DAVPRMRGMLTLFEGVATGAADGYA

SEQ ID NO: 216781 - protein, 21 aa, Mycobacterium bovis
DAVRVFLTPESARQFATRSYR

SEQ ID NO: 216782 - protein, 21 aa, Mycobacterium bovis
DAVSFTLLQDQLQSVLDTLSE

SEQ ID NO: 216783 - protein, 18 aa, Mycobacterium bovis
DAVSLRRILNTPRRGIGD

SEQ ID NO: 216784 - protein, 25 aa, Mycobacterium bovis
DAWEDFLFWLAADRKTARRITRLIG

SEQ ID NO: 216785 - protein, 27 aa, Mycobacterium bovis
DAYTNPGTLMWWIARSLELLQDFQEFA

SEQ ID NO: 216786 - protein, 24 aa, Mycobacterium bovis
DCFLLQKVLDLPAGQLPPEPPIWP

SEQ ID NO: 216787 - protein, 25 aa, Mycobacterium bovis
DCFNIPIVMLVDVPGFLPGTDQEYN

SEQ ID NO: 216788 - protein, 27 aa, Mycobacterium bovis
DCHDGYRWLRLLGYEPEQIVLAGDSAG

SEQ ID NO: 216789 - protein, 26 aa, Mycobacterium bovis
DCPHFDHALAAYYLILPSEVSSNLAR

SEQ ID NO: 216790 - protein, 21 aa, Mycobacterium bovis
DCPPSLGVLTLNGLTAADEAI

SEQ ID NO: 216791 - protein, 24 aa, Mycobacterium bovis
DCTGYIVQLPLPKHLDENAALERV

SEQ ID NO: 216792 - protein, 24 aa, Mycobacterium bovis
DDAAFGRIANALPAAARAAAQERP

SEQ ID NO: 216793 - protein, 23 aa, Mycobacterium bovis
DDAARMWARLRIHLAESGRRVRI

SEQ ID NO: 216794 - protein, 24 aa, Mycobacterium bovis
DDANLVRLTELPAGSPVAVVVRQL

SEQ ID NO: 216795 - protein, 22 aa, Mycobacterium bovis
DDDLLVAVLEEVIYLLDTVGET

SEQ ID NO: 216796 - protein, 24 aa, Mycobacterium bovis
DDEQLVLDLLLSEKILVTQGTGFN

SEQ ID NO: 216797 - protein, 21 aa, Mycobacterium bovis
DDFFALFQDPTRTYSCAYFEP

SEQ ID NO: 216798 - protein, 18 aa, Mycobacterium bovis
DDFPPYDSVFDPVNRVLL

SEQ ID NO: 216799 - protein, 23 aa, Mycobacterium bovis
DDGRMLLHTILTYTQKQMHEMGV

SEQ ID NO: 216800 - protein, 22 aa, Mycobacterium bovis
DDGSWRVFFTDLTQAYSRADLG

SEQ ID NO: 216801 - protein, 22 aa, Mycobacterium bovis
DDIFECAGFAVHFFRRELVARL

SEQ ID NO: 216802 - protein, 30 aa, Mycobacterium bovis
DDLAERVGWRWRLVWYRAVAELLTGDYDSA

SEQ ID NO: 216803 - protein, 17 aa, Mycobacterium bovis
DDLCLPDMLLLLATDVA

SEQ ID NO: 216804 - protein, 23 aa, Mycobacterium bovis
DDLITAHLRGWTLDRLPAVDRAI

SEQ ID NO: 216805 - protein, 18 aa, Mycobacterium bovis
DDLLAELKKKPGIHAVHM

SEQ ID NO: 216806 - protein, 22 aa, Mycobacterium bovis
DDLLRNGVLVDLYPLVRKSIRV

SEQ ID NO: 216807 - protein, 29 aa, Mycobacterium bovis
DDLLTATLLTARCPVLFAPAMHTEMWLHP

SEQ ID NO: 216808 - protein, 18 aa, Mycobacterium bovis
DDLPIIRQPSTHTIFVLG

SEQ ID NO: 216809 - protein, 21 aa, Mycobacterium bovis
DDLQWERRYRRVAAYGQAKLA

SEQ ID NO: 216810 - protein, 24 aa, Mycobacterium bovis
DDLVEIVAKFRPGPRRRLGVLVDH

SEQ ID NO: 216811 - protein, 30 aa, Mycobacterium bovis
DDLVVCGAEPLFLLDYIAVGRIVPERLSAI

SEQ ID NO: 216812 - protein, 20 aa, Mycobacterium bovis
DDPALLLKTAAEIAARPAGP

SEQ ID NO: 216813 - protein, 27 aa, Mycobacterium bovis
DDPHKVAMLGLTFDDVLLLPAASDVVP

SEQ ID NO: 216814 - protein, 21 aa, Mycobacterium bovis
DDPVLHICALAYMSDLTLLGS

SEQ ID NO: 216815 - protein, 22 aa, Mycobacterium bovis
DDRGPVWLFSGQGSQWAAMGAD

SEQ ID NO: 216816 - protein, 24 aa, Mycobacterium bovis
DDRITKARWVYFLTRMRNPTGDTA

SEQ ID NO: 216817 - protein, 24 aa, Mycobacterium bovis
DDVPSDVLRCYLDLVLDGLLARLA

SEQ ID NO: 216818 - protein, 25 aa, Mycobacterium bovis
DDVRASLDRWLARWQPRYPDVRVQS

SEQ ID NO: 216819 - protein, 22 aa, Mycobacterium bovis
DDVTLLAMQRRAPTPPLHITLD

SEQ ID NO: 216820 - protein, 35 aa, Mycobacterium bovis
DDVVRDYLYPIVALRIRGIALPGPLRRLSEGIALL

SEQ ID NO: 216821 - protein, 17 aa, Mycobacterium bovis
DDVVSRVFGRIDPIALS

SEQ ID NO: 216822 - protein, 33 aa, Mycobacterium bovis
DDYLVKPFVLAELVARVKALLRRRGSTATSSSE

SEQ ID NO: 216823 - protein, 24 aa, Mycobacterium bovis
DDYNELVISVPLQLTLPAIETSPA

SEQ ID NO: 216824 - protein, 26 aa, Mycobacterium bovis
DEAAEMMINLFWLGLKGAPVDRLETG

SEQ ID NO: 216825 - protein, 27 aa, Mycobacterium bovis
DEAGFGVLLPSWWDRRRKLGLVLSAYT

SEQ ID NO: 216826 - protein, 26 aa, Mycobacterium bovis
DEALRMDPQQRLLLEVSWEALEHAGI

SEQ ID NO: 216827 - protein, 24 aa, Mycobacterium bovis
DEDTEVRIVSYPGSSLWDMVRPRP

SEQ ID NO: 216828 - protein, 25 aa, Mycobacterium bovis
DEERLAFYRTLYRDHARYGAALWLV

SEQ ID NO: 216829 - protein, 20 aa, Mycobacterium bovis
DEFARRLPFMAAKRAFSEPV

SEQ ID NO: 216830 - protein, 17 aa, Mycobacterium bovis
DEFGFFVVMLAVAGNET

SEQ ID NO: 216831 - protein, 24 aa, Mycobacterium bovis
DEHLARVAALGRIALVLISHRHGD

SEQ ID NO: 216832 - protein, 28 aa, Mycobacterium bovis
DEHPGKWRVVFFWPKDFTFVCPTEIAAF

SEQ ID NO: 216833 - protein, 20 aa, Mycobacterium bovis
DEIAELLLKWKKTPQRPVSL

SEQ ID NO: 216834 - protein, 24 aa, Mycobacterium bovis
DEILADYDTWLRERPREMARTVFI

SEQ ID NO: 216835 - protein, 24 aa, Mycobacterium bovis
DELDALLWRAARPGEPSWPSPFGP

SEQ ID NO: 216836 - protein, 24 aa, Mycobacterium bovis
DELDFLRLAVFDALLVLQADTAPV

SEQ ID NO: 216837 - protein, 21 aa, Mycobacterium bovis
DELEPYCRGGKLSLRVIALVN

SEQ ID NO: 216838 - protein, 24 aa, Mycobacterium bovis
DELRATLLALLGSPHLCSRAFITE

SEQ ID NO: 216839 - protein, 18 aa, Mycobacterium bovis
DELRRRGENIGLTTVYRT

SEQ ID NO: 216840 - protein, 26 aa, Mycobacterium bovis
DELVVVVPPGHKWARRSRVVSARELA

SEQ ID NO: 216841 - protein, 24 aa, Mycobacterium bovis
DEMRGMCLYFDELPVIVLNGSDHP

SEQ ID NO: 216842 - protein, 24 aa, Mycobacterium bovis
DENALAEIADWGPAEDWADWADAA

SEQ ID NO: 216843 - protein, 19 aa, Mycobacterium bovis
DEPAFFPAAVWTACVDDPA

SEQ ID NO: 216844 - protein, 20 aa, Mycobacterium bovis
DEPAVVVWLASGLAAETFQL

SEQ ID NO: 216845 - protein, 33 aa, Mycobacterium bovis
DEPFAALAFKIATHPFFGKLTYIRVYSGTVESG

SEQ ID NO: 216846 - protein, 18 aa, Mycobacterium bovis
DEPFMLPAHIDFAALKVK

SEQ ID NO: 216847 - protein, 18 aa, Mycobacterium bovis
DEPPGTRMRVALSALTMA

SEQ ID NO: 216848 - protein, 17 aa, Mycobacterium bovis
DEQLLGPQRFTPGGLVL

SEQ ID NO: 216849 - protein, 23 aa, Mycobacterium bovis
DEQRKDWIPRLATMGVIASYCLT

SEQ ID NO: 216850 - protein, 21 aa, Mycobacterium bovis
DERARLWPRPVDAYADFDSCQ

SEQ ID NO: 216851 - protein, 25 aa, Mycobacterium bovis
DERDPELMWGLRGGGGNFGIVTEFE

SEQ ID NO: 216852 - protein, 24 aa, Mycobacterium bovis
DERDRLVSERLLTLGWQQRALPEV

SEQ ID NO: 216853 - protein, 31 aa, Mycobacterium bovis
DESRKAIHFQEWWVRYRAQVPTHSFAFVGAE

SEQ ID NO: 216854 - protein, 25 aa, Mycobacterium bovis
DETGMVNVLCTPGVWARHRKLAHTA

SEQ ID NO: 216855 - protein, 25 aa, Mycobacterium bovis
DETLAELGPWRWAPTFAFIDQQAAE

SEQ ID NO: 216856 - protein, 25 aa, Mycobacterium bovis
DETTLGKWWRDMKLARVGGGTDEVL

SEQ ID NO: 216857 - protein, 22 aa, Mycobacterium bovis
DEVKVPVRWWHGDHDHIVPFSH

SEQ ID NO: 216858 - protein, 18 aa, Mycobacterium bovis
DEVLLRVFGKVVELAFLA

SEQ ID NO: 216859 - protein, 26 aa, Mycobacterium bovis
DEVQIGKFRLVFLTGPKQGEDDGSTG

SEQ ID NO: 216860 - protein, 28 aa, Mycobacterium bovis
DEVRHYIIDCALRWMRDFHADGLRLDAV

SEQ ID NO: 216861 - protein, 30 aa, Mycobacterium bovis
DEVWRTIHKHKVNLLFFTGDAMARPLVDAL

SEQ ID NO: 216862 - protein, 26 aa, Mycobacterium bovis
DEWERRAIAVFGHRPYIGVSANIVAA

SEQ ID NO: 216863 - protein, 29 aa, Mycobacterium bovis
DEWESLQETLYWLAQPGIRESIAEADADI

SEQ ID NO: 216864 - protein, 22 aa, Mycobacterium bovis
DEYPLHQLPQPIAWPGSSDRNF

SEQ ID NO: 216865 - protein, 27 aa, Mycobacterium bovis
DFAELRRRHLVPQPPYGHGAAAAAVGA

SEQ ID NO: 216866 - protein, 17 aa, Mycobacterium bovis
DFAKILDAAAKSGANAI

SEQ ID NO: 216867 - protein, 21 aa, Mycobacterium bovis
DFDKPVPRDVLMECLELALQA

SEQ ID NO: 216868 - protein, 21 aa, Mycobacterium bovis
DFFEGVMMPELFMADAMGATG

SEQ ID NO: 216869 - protein, 25 aa, Mycobacterium bovis
DFGKRWVTECLRAAYPLGRGHGPVS

SEQ ID NO: 216870 - protein, 25 aa, Mycobacterium bovis
DFMAARTAFFDEYFLATADAGVRQV

SEQ ID NO: 216871 - protein, 20 aa, Mycobacterium bovis
DFPRLRTLLCTEAIAAADLM

SEQ ID NO: 216872 - protein, 19 aa, Mycobacterium bovis
DFQRLQRELSGTGTDRLDG

SEQ ID NO: 216873 - protein, 17 aa, Mycobacterium bovis
DFSTAVTGGLFFSPTID

SEQ ID NO: 216874 - protein, 18 aa, Mycobacterium bovis
DFTGRLCPAPCEPACVLG

SEQ ID NO: 216875 - protein, 26 aa, Mycobacterium bovis
DFTTAAWRKLLVNALAGFMVLSGRRS

SEQ ID NO: 216876 - protein, 18 aa, Mycobacterium bovis
DFVAVMRRLAAGHGRVDV

SEQ ID NO: 216877 - protein, 26 aa, Mycobacterium bovis
DFVCEQLAAAEPWWQPGAAQGYHMTT

SEQ ID NO: 216878 - protein, 18 aa, Mycobacterium bovis
DFVFLDHDKKAYLPDLQS

SEQ ID NO: 216879 - protein, 27 aa, Mycobacterium bovis
DFVGSVLAVLRRLEGHFTLVFANADDP

SEQ ID NO: 216880 - protein, 21 aa, Mycobacterium bovis
DFVRDLAAPLPMAVIGDMLGV

SEQ ID NO: 216881 - protein, 33 aa, Mycobacterium bovis
DFVSKFIGLGRGYRWLQLFDAAGLPVRDIEQVS

SEQ ID NO: 216882 - protein, 18 aa, Mycobacterium bovis
DFYGTVFGWAFESAGPDY

SEQ ID NO: 216883 - protein, 25 aa, Mycobacterium bovis
DGAAMRPLRHTLSQLRLHELLVEVQ

SEQ ID NO: 216884 - protein, 22 aa, Mycobacterium bovis
DGAAQLLMKRFPDPNAPEAQAI

SEQ ID NO: 216885 - protein, 26 aa, Mycobacterium bovis
DGAAVGPFTYLRPGTALGADGKLGAF

SEQ ID NO: 216886 - protein, 22 aa, Mycobacterium bovis
DGAPGGWLIGNGGAGGSGAANN

SEQ ID NO: 216887 - protein, 24 aa, Mycobacterium bovis
DGARIFEQLAIADPVTAAFLSIHN

SEQ ID NO: 216888 - protein, 22 aa, Mycobacterium bovis
DGAVYQLRRWYEQFYVDVADIK

SEQ ID NO: 216889 - protein, 22 aa, Mycobacterium bovis
DGAYRRTLRLPWGNGIVSLTPA

SEQ ID NO: 216890 - protein, 19 aa, Mycobacterium bovis
DGCRVPIPWSGNIPPFGFS

SEQ ID NO: 216891 - protein, 21 aa, Mycobacterium bovis
DGDIPLLLEMPMVYTGRALTQ

SEQ ID NO: 216892 - protein, 23 aa, Mycobacterium bovis
DGDLLKGVRYYPGGCTTHSIVMR

SEQ ID NO: 216893 - protein, 17 aa, Mycobacterium bovis
DGDPLDALVLLPQPVFP

SEQ ID NO: 216894 - protein, 28 aa, Mycobacterium bovis
DGEFVKFGPSWAWPKPVQPHIPVLVGAA

SEQ ID NO: 216895 - protein, 17 aa, Mycobacterium bovis
DGEGWLTELSTRDLREV

SEQ ID NO: 216896 - protein, 29 aa, Mycobacterium bovis
DGELSAVVMAPMYLGLRVWSRATIGLAYA

SEQ ID NO: 216897 - protein, 21 aa, Mycobacterium bovis
DGERRPGWVGLPLAGVQTRLV

SEQ ID NO: 216898 - protein, 17 aa, Mycobacterium bovis
DGETHTWAYWRAPLQAM

SEQ ID NO: 216899 - protein, 18 aa, Mycobacterium bovis
DGFELAAHRVIGLLRDVV

SEQ ID NO: 216900 - protein, 24 aa, Mycobacterium bovis
DGGGRGIFGQFGAGGAGGAGGVGG

SEQ ID NO: 216901 - protein, 30 aa, Mycobacterium bovis
DGGKGADPGGLFPIPGAGGKGGTGGTGGTA

SEQ ID NO: 216902 - protein, 24 aa, Mycobacterium bovis
DGGLSVHYLGARSPAFIGRLLELA

SEQ ID NO: 216903 - protein, 23 aa, Mycobacterium bovis
DGGNFDWTQGRFPGFTTPDPSYH

SEQ ID NO: 216904 - protein, 22 aa, Mycobacterium bovis
DGGNGGWLFGSGASGGNGGQGG

SEQ ID NO: 216905 - protein, 32 aa, Mycobacterium bovis
DGGRGYMSKIFNDAWMSSYGFLRSRLDGSTEQ

SEQ ID NO: 216906 - protein, 27 aa, Mycobacterium bovis
DGGRIHKLLRIFANPKLPTIGDYYEPW

SEQ ID NO: 216907 - protein, 21 aa, Mycobacterium bovis
DGGVQALRIWGAGATGSRLVT

SEQ ID NO: 216908 - protein, 19 aa, Mycobacterium bovis
DGIDVHLLPFPDLADDDAD

SEQ ID NO: 216909 - protein, 18 aa, Mycobacterium bovis
DGIINAGALIAFEKGRSW

SEQ ID NO: 216910 - protein, 31 aa, Mycobacterium bovis
DGKAKWSAPLGFLAQTPPALTPHGLIVSGGG

SEQ ID NO: 216911 - protein, 25 aa, Mycobacterium bovis
DGKARWYRNRWVRTPAVCAALGEPI

SEQ ID NO: 216912 - protein, 25 aa, Mycobacterium bovis
DGKKYTAPEISARILMKLKRDAEAY

SEQ ID NO: 216913 - protein, 23 aa, Mycobacterium bovis
DGKQWGLEYLFGVLEAGRAGVFR

SEQ ID NO: 216914 - protein, 17 aa, Mycobacterium bovis
DGKVWVSPVDTIVRVRT

SEQ ID NO: 216915 - protein, 21 aa, Mycobacterium bovis
DGLLELLPAGAWLDHTSDHAQ

SEQ ID NO: 216916 - protein, 31 aa, Mycobacterium bovis
DGLVITATPLRPGIWRAYADHRMAMAGAIIG

SEQ ID NO: 216917 - protein, 18 aa, Mycobacterium bovis
DGNLPIAAIERFCQITDP

SEQ ID NO: 216918 - protein, 25 aa, Mycobacterium bovis
DGNTFQQLPFALAPGPPVPTTALRE

SEQ ID NO: 216919 - protein, 23 aa, Mycobacterium bovis
DGPAVLVGSARRGERFVDALSAN

SEQ ID NO: 216920 - protein, 20 aa, Mycobacterium bovis
DGPGPGEVLVKYTAAGLCHS

SEQ ID NO: 216921 - protein, 27 aa, Mycobacterium bovis
DGPVEPGPALVLPLRAADTVAGVLVAL

SEQ ID NO: 216922 - protein, 29 aa, Mycobacterium bovis
DGQRPRDLLLDAYLLRAMGIAGWAPALTE

SEQ ID NO: 216923 - protein, 24 aa, Mycobacterium bovis
DGQRVLVDRIWPHGIRKDDQRVGI

SEQ ID NO: 216924 - protein, 22 aa, Mycobacterium bovis
DGRAPVLRRWYPSTGGTWQAEA

SEQ ID NO: 216925 - protein, 26 aa, Mycobacterium bovis
DGRFVGFADFLIRDGHRYRVADTKLA

SEQ ID NO: 216926 - protein, 27 aa, Mycobacterium bovis
DGRPEARLWALVRRQSLSRFERLAGQW

SEQ ID NO: 216927 - protein, 20 aa, Mycobacterium bovis
DGRSRLLPGLPADRIVALGA

SEQ ID NO: 216928 - protein, 24 aa, Mycobacterium bovis
DGRTYGHPIVLRPVSSEDAMTADW

SEQ ID NO: 216929 - protein, 25 aa, Mycobacterium bovis
DGRVKVWKGIRYAAPPLGDLRFRTP

SEQ ID NO: 216930 - protein, 29 aa, Mycobacterium bovis
DGSSVLIQMMWAMRATGMWTDTRGANMLD

SEQ ID NO: 216931 - protein, 18 aa, Mycobacterium bovis
DGSYIITGGLGGLGLFLA

SEQ ID NO: 216932 - protein, 21 aa, Mycobacterium bovis
DGTAFPRLYGVQTRFFDDFFN

SEQ ID NO: 216933 - protein, 25 aa, Mycobacterium bovis
DGTGWRWRTWHLYPSASGGTVVHTT

SEQ ID NO: 216934 - protein, 25 aa, Mycobacterium bovis
DGTIKIEMNFLPDVYVPCEVCQGAR

SEQ ID NO: 216935 - protein, 24 aa, Mycobacterium bovis
DGTILALHHPPIPSVLDMAVTVEL

SEQ ID NO: 216936 - protein, 21 aa, Mycobacterium bovis
DGTLPHFPLPLGDLSVPHTGK

SEQ ID NO: 216937 - protein, 25 aa, Mycobacterium bovis
DGTPFPTLYYLTHPVLTAAASRLET

SEQ ID NO: 216938 - protein, 26 aa, Mycobacterium bovis
DGVFEGIAVLGLGFGGAAGAGGAATG

SEQ ID NO: 216939 - protein, 22 aa, Mycobacterium bovis
DGVGYPVHKPVTAGWNGYGDFQ

SEQ ID NO: 216940 - protein, 29 aa, Mycobacterium bovis
DGVRLNPLRPLAQLWPPHVPAMLVAGCDP

SEQ ID NO: 216941 - protein, 25 aa, Mycobacterium bovis
DGVRPHAIRVPDAALDAALAGLDCD

SEQ ID NO: 216942 - protein, 25 aa, Mycobacterium bovis
DGVVAGIHLEGPWLSPARCGAHDHT

SEQ ID NO: 216943 - protein, 20 aa, Mycobacterium bovis
DGWQAPGVHLMARCSGPQPA

SEQ ID NO: 216944 - protein, 27 aa, Mycobacterium bovis
DHAMLATGLLALYQLTSEGAWLTAATG

SEQ ID NO: 216945 - protein, 17 aa, Mycobacterium bovis
DHARYGAALWLVAANMA

SEQ ID NO: 216946 - protein, 25 aa, Mycobacterium bovis
DHFANRGFAFYALDLRKCGRSRAPG

SEQ ID NO: 216947 - protein, 25 aa, Mycobacterium bovis
DHGPGFADHFLPVAFDRFTRADTAR

SEQ ID NO: 216948 - protein, 18 aa, Mycobacterium bovis
DHGQPRINRYHHPAKILC

SEQ ID NO: 216949 - protein, 27 aa, Mycobacterium bovis
DHHSRRGLLLLVGRRRRLIKYISQIDV

SEQ ID NO: 216950 - protein, 29 aa, Mycobacterium bovis
DHIVDYYNFFLSGGFLAPPGRAPVLVYGP

SEQ ID NO: 216951 - protein, 17 aa, Mycobacterium bovis
DHLALRQRFGGARLVWS

SEQ ID NO: 216952 - protein, 26 aa, Mycobacterium bovis
DHPDDTWLRLYHQRLPLDMATPVIDG

SEQ ID NO: 216953 - protein, 32 aa, Mycobacterium bovis
DHPGDPWTVPKFYWTVLGLSALISGARALVPD

SEQ ID NO: 216954 - protein, 32 aa, Mycobacterium bovis
DHPHAVRILARAWLYAIWHCWQDGAAYHPANH

SEQ ID NO: 216955 - protein, 26 aa, Mycobacterium bovis
DHPVHRYFLAAKQTEFALGGATGQLR

SEQ ID NO: 216956 - protein, 29 aa, Mycobacterium bovis
DHRDTYDAMFDLWFPAALGARAVITTEDE

SEQ ID NO: 216957 - protein, 21 aa, Mycobacterium bovis
DHRTSPLLVLTENGRRVLQAI

SEQ ID NO: 216958 - protein, 24 aa, Mycobacterium bovis
DHSGPLVTELLTEAGFVVDGVVAV

SEQ ID NO: 216959 - protein, 17 aa, Mycobacterium bovis
DHSLALLEVIRAIVDDI

SEQ ID NO: 216960 - protein, 20 aa, Mycobacterium bovis
DHTIAYYPPAFSTAAQEQLS

SEQ ID NO: 216961 - protein, 22 aa, Mycobacterium bovis
DHVASVFRHEDLASALAATELT

SEQ ID NO: 216962 - protein, 17 aa, Mycobacterium bovis
DHVELSARVAWMSESQL

SEQ ID NO: 216963 - protein, 22 aa, Mycobacterium bovis
DHVIQRLFAVGLTLQGAAPRAR

SEQ ID NO: 216964 - protein, 20 aa, Mycobacterium bovis
DHVMYVWVDALTNYLTGAGF

SEQ ID NO: 216965 - protein, 25 aa, Mycobacterium bovis
DHVPEQAFFLIGGLDDLAKKAESLG

SEQ ID NO: 216966 - protein, 28 aa, Mycobacterium bovis
DHVVALTREVLGAGIPLFGICFGNQILG

SEQ ID NO: 216967 - protein, 24 aa, Mycobacterium bovis
DHVVLVLHDWGSALGFDWANQHRD

SEQ ID NO: 216968 - protein, 30 aa, Mycobacterium bovis
DHYHDWDMLRSNLLQLLIDGTVRPHEPAYD

SEQ ID NO: 216969 - protein, 27 aa, Mycobacterium bovis
DIAEEYYLSFLLDRANRTYLAMCSVEG

SEQ ID NO: 216970 - protein, 24 aa, Mycobacterium bovis
DIAEPLPRTLVWSAAWEMTREAEL

SEQ ID NO: 216971 - protein, 39 aa, Mycobacterium bovis
DIAKQRLVWRLCQRYPRAARRLIRHLNAKQLAAGYPADE

SEQ ID NO: 216972 - protein, 25 aa, Mycobacterium bovis
DIASFTPIFVMSRITGWTAHIMEQA

SEQ ID NO: 216973 - protein, 17 aa, Mycobacterium bovis
DIDPLFGGMPAFERLVA

SEQ ID NO: 216974 - protein, 37 aa, Mycobacterium bovis
DIDSFAPRLSFFWGIGMNFFMEVAKLRAGRLLWSELV

SEQ ID NO: 216975 - protein, 23 aa, Mycobacterium bovis
DIEDPLYVLAGPDEGYVPYYAEY

SEQ ID NO: 216976 - protein, 23 aa, Mycobacterium bovis
DIFARYDVTFSLGDGLRPGSIAD

SEQ ID NO: 216977 - protein, 24 aa, Mycobacterium bovis
DIGAPPQFMDFRFTLHDRWHGEFH

SEQ ID NO: 216978 - protein, 23 aa, Mycobacterium bovis
DIGRLRWQFERIARGVPVAAPWD

SEQ ID NO: 216979 - protein, 23 aa, Mycobacterium bovis
DIHFQPRYIFAAIDAGCAAVRVN

SEQ ID NO: 216980 - protein, 17 aa, Mycobacterium bovis
DIIKGILGEVWEFITNA

SEQ ID NO: 216981 - protein, 25 aa, Mycobacterium bovis
DIKPEHLILIGQIAQDFGLYTKITG

SEQ ID NO: 216982 - protein, 19 aa, Mycobacterium bovis
DILAFERQWWKFAGVKEEA

SEQ ID NO: 216983 - protein, 29 aa, Mycobacterium bovis
DILDRAGAPVLFAAGLFLGADRAAGLDRA

SEQ ID NO: 216984 - protein, 29 aa, Mycobacterium bovis
DILHREEAMARYWRAVPARDYSIANVTAG

SEQ ID NO: 216985 - protein, 19 aa, Mycobacterium bovis
DILVDRMRREFKVEANVGK

SEQ ID NO: 216986 - protein, 25 aa, Mycobacterium bovis
DINLVGTFNVLRLGAERIAKTEPIG

SEQ ID NO: 216987 - protein, 22 aa, Mycobacterium bovis
DIRESIHLRALGRQNPLDEFHR

SEQ ID NO: 216988 - protein, 20 aa, Mycobacterium bovis
DIRGEGYFFGIELVKDQATK

SEQ ID NO: 216989 - protein, 18 aa, Mycobacterium bovis
DIRRKIEIGCYQGLRHRR

SEQ ID NO: 216990 - protein, 19 aa, Mycobacterium bovis
DITVITPVFNTGGEDVLFF

SEQ ID NO: 216991 - protein, 29 aa, Mycobacterium bovis
DITVNVDGFWMLQALLDIRHVAPELRCRP

SEQ ID NO: 216992 - protein, 26 aa, Mycobacterium bovis
DIVSNVGYTALLVAGWRALHTTGPKP

SEQ ID NO: 216993 - protein, 24 aa, Mycobacterium bovis
DKARPVLILTREVVRPHLTNVTVA

SEQ ID NO: 216994 - protein, 18 aa, Mycobacterium bovis
DKDDCAAIGLVKFDLLGL

SEQ ID NO: 216995 - protein, 24 aa, Mycobacterium bovis
DKEGRLILSKKRAQYERAWGTIEA

SEQ ID NO: 216996 - protein, 32 aa, Mycobacterium bovis
DKETLIRYIDRFLIYYIRTADRLQRTAPWVES

SEQ ID NO: 216997 - protein, 17 aa, Mycobacterium bovis
DKGFPNVALLRLRDMAP

SEQ ID NO: 216998 - protein, 32 aa, Mycobacterium bovis
DKISVLMTENRVRHVPVLDGKKLIGIVSIGDV

SEQ ID NO: 216999 - protein, 30 aa, Mycobacterium bovis
DKLRPGPTMISDRKLAWPADLQVGPDGLGN

SEQ ID NO: 217000 - protein, 23 aa, Mycobacterium bovis
DKNPLFLDEQLTRAEFQRITQDL

SEQ ID NO: 217001 - protein, 25 aa, Mycobacterium bovis
DKRMEVALTYIFGIGRTRSNEILAA

SEQ ID NO: 217002 - protein, 24 aa, Mycobacterium bovis
DKSMPLLERAKFLAIFASNLDEFY

SEQ ID NO: 217003 - protein, 28 aa, Mycobacterium bovis
DKTDLRGRFRWWGLYTQREQGYDGTWTG

SEQ ID NO: 217004 - protein, 44 aa, Mycobacterium bovis
DKTGFHLLHTLFQRLLTYSDVMRYDEWFATTLLVDDGRVCGLVA

SEQ ID NO: 217005 - protein, 18 aa, Mycobacterium bovis
DKVPALNPHQIDDLMMGC

SEQ ID NO: 217006 - protein, 27 aa, Mycobacterium bovis
DLAARLKAVWAPQGLIHRGQGRWYPGE

SEQ ID NO: 217007 - protein, 30 aa, Mycobacterium bovis
DLACSGLRFAYDGLIPLPDGVRLREQHRIA

SEQ ID NO: 217008 - protein, 18 aa, Mycobacterium bovis
DLAEVWFGTGRNAQVDAV

SEQ ID NO: 217009 - protein, 26 aa, Mycobacterium bovis
DLAHHRGMWHRTPLPDLFIAETALHH

SEQ ID NO: 217010 - protein, 27 aa, Mycobacterium bovis
DLALFETVYLVHRLPAWSRNLTAKIKK

SEQ ID NO: 217011 - protein, 19 aa, Mycobacterium bovis
DLALNWLCERQLPDGSWGA

SEQ ID NO: 217012 - protein, 20 aa, Mycobacterium bovis
DLAPEWLVAPTVVLTPEVTP

SEQ ID NO: 217013 - protein, 33 aa, Mycobacterium bovis
DLASKLIRVVTIAPGLFDTPLLASLPAEAKASL

SEQ ID NO: 217014 - protein, 23 aa, Mycobacterium bovis
DLASQAWQGPAAAAMAAAAAPYA

SEQ ID NO: 217015 - protein, 17 aa, Mycobacterium bovis
DLAYYLDKRQRGFDLCI

SEQ ID NO: 217016 - protein, 23 aa, Mycobacterium bovis
DLDGELFTFTPMSPANAFSVTAE

SEQ ID NO: 217017 - protein, 27 aa, Mycobacterium bovis
DLDHPPVLLIMGLGAQMLLWRTDFCAR

SEQ ID NO: 217018 - protein, 25 aa, Mycobacterium bovis
DLDIENYWFRRHQVVYQRLAPRCTA

SEQ ID NO: 217019 - protein, 25 aa, Mycobacterium bovis
DLDKPKLVFFFDEAHLLFTDASKAF

SEQ ID NO: 217020 - protein, 25 aa, Mycobacterium bovis
DLDLFKHLHRAGLRRVFIGVETGSY

SEQ ID NO: 217021 - protein, 17 aa, Mycobacterium bovis
DLDPGVISYLWRTARMG

SEQ ID NO: 217022 - protein, 17 aa, Mycobacterium bovis
DLDRFWTRALTGYAQLI

SEQ ID NO: 217023 - protein, 23 aa, Mycobacterium bovis
DLDTIAALSRRASALLDGLDGAN

SEQ ID NO: 217024 - protein, 21 aa, Mycobacterium bovis
DLDVLLLHDGKPADILRPVAD

SEQ ID NO: 217025 - protein, 19 aa, Mycobacterium bovis
DLEMRRPTYVFAAVDHTGA

SEQ ID NO: 217026 - protein, 18 aa, Mycobacterium bovis
DLERRVADFLGFATVFNS

SEQ ID NO: 217027 - protein, 20 aa, Mycobacterium bovis
DLFAAIVVLMQWGDEYLPRP

SEQ ID NO: 217028 - protein, 20 aa, Mycobacterium bovis
DLFGARVDQLPLIWQRLVDG

SEQ ID NO: 217029 - protein, 18 aa, Mycobacterium bovis
DLGDRFGFCIPDLAVWDN

SEQ ID NO: 217030 - protein, 28 aa, Mycobacterium bovis
DLGELPGDLAWQPPLWRALVTTVGADPP

SEQ ID NO: 217031 - protein, 26 aa, Mycobacterium bovis
DLGGLSIALLAYQLSLNGNPAPVIDG

SEQ ID NO: 217032 - protein, 24 aa, Mycobacterium bovis
DLGPGDILTRLTAPVIRGLGIGIV

SEQ ID NO: 217033 - protein, 18 aa, Mycobacterium bovis
DLGVFGLLKRFAKGRIVR

SEQ ID NO: 217034 - protein, 28 aa, Mycobacterium bovis
DLHKANPLYLLDFLRQSGNTPIVLLHCY

SEQ ID NO: 217035 - protein, 18 aa, Mycobacterium bovis
DLHMRLGEGTGAAVALMV

SEQ ID NO: 217036 - protein, 34 aa, Mycobacterium bovis
DLITNLVAPLAPLHGWGLDPYLTPGFTELSSQAG

SEQ ID NO: 217037 - protein, 18 aa, Mycobacterium bovis
DLIVGGSTYDLAAAAALE

SEQ ID NO: 217038 - protein, 19 aa, Mycobacterium bovis
DLLDFFAELTIYTSSACLI

SEQ ID NO: 217039 - protein, 24 aa, Mycobacterium bovis
DLLDLEAIASGYLLHRHERLEQIR

SEQ ID NO: 217040 - protein, 17 aa, Mycobacterium bovis
DLLHLACCQRRGVTRIK

SEQ ID NO: 217041 - protein, 17 aa, Mycobacterium bovis
DLNGNVFALYEPPAPPG

SEQ ID NO: 217042 - protein, 23 aa, Mycobacterium bovis
DLPRRYYRAIAKMADTAWFVIRE

SEQ ID NO: 217043 - protein, 19 aa, Mycobacterium bovis
DLPTPWPQEALDDLLVVLS

SEQ ID NO: 217044 - protein, 20 aa, Mycobacterium bovis
DLQEQFGLSYLFVSHDLSVV

SEQ ID NO: 217045 - protein, 18 aa, Mycobacterium bovis
DLQLARLAIVYPGEHRFP

SEQ ID NO: 217046 - protein, 19 aa, Mycobacterium bovis
DLQWERRYNRVAAYGQAKL

SEQ ID NO: 217047 - protein, 29 aa, Mycobacterium bovis
DLRAQGINLIIHYVDRPGALGKIGTLLGT

SEQ ID NO: 217048 - protein, 17 aa, Mycobacterium bovis
DLRIALVARRHIDLKRV

SEQ ID NO: 217049 - protein, 19 aa, Mycobacterium bovis
DLRPEWVLPRADEIAFGYS

SEQ ID NO: 217050 - protein, 30 aa, Mycobacterium bovis
DLRRTVGWFTTYYPVPLACATGLGALAQLD

SEQ ID NO: 217051 - protein, 32 aa, Mycobacterium bovis
DLRVVAPDAFFQFPTSKYGLALDNWSIRRLSS

SEQ ID NO: 217052 - protein, 29 aa, Mycobacterium bovis
DLSFSRFELLRLLAFSRIGALPITKASDR

SEQ ID NO: 217053 - protein, 17 aa, Mycobacterium bovis
DLSGPARWFLDHARVAL

SEQ ID NO: 217054 - protein, 23 aa, Mycobacterium bovis
DLSTLFEDLALVRPTELCFVPRI

SEQ ID NO: 217055 - protein, 23 aa, Mycobacterium bovis
DLSVRDMTVCILDRPRHAQLIHD

SEQ ID NO: 217056 - protein, 25 aa, Mycobacterium bovis
DLTAWSRAQAAWLWSRRRGVIAGQS

SEQ ID NO: 217057 - protein, 24 aa, Mycobacterium bovis
DLTGLAVLDLYAGSGALGLEALSR

SEQ ID NO: 217058 - protein, 19 aa, Mycobacterium bovis
DLTVPPWAVAGLGSQAELL

SEQ ID NO: 217059 - protein, 19 aa, Mycobacterium bovis
DLVDGAPKPLLEKVAKEAA

SEQ ID NO: 217060 - protein, 25 aa, Mycobacterium bovis
DLVDRHLPAFLRFAGREFIGVQGTQ

SEQ ID NO: 217061 - protein, 18 aa, Mycobacterium bovis
DLVLLDPDGERLVFGMRA

SEQ ID NO: 217062 - protein, 29 aa, Mycobacterium bovis
DLVRAVPLVGGLWFRFLHSVKAGIKDSLS

SEQ ID NO: 217063 - protein, 18 aa, Mycobacterium bovis
DLVRDGVFVGYQLDRAFA

SEQ ID NO: 217064 - protein, 22 aa, Mycobacterium bovis
DLVVALERLGRWCVPGPVTESI

SEQ ID NO: 217065 - protein, 28 aa, Mycobacterium bovis
DLVVDNFTIPIIGFESFAFSFHIHTEPD

SEQ ID NO: 217066 - protein, 24 aa, Mycobacterium bovis
DLVVLARYMQILSPGFLEAIGCPL

SEQ ID NO: 217067 - protein, 18 aa, Mycobacterium bovis
DLVVSPYVRMGGLTTDPV

SEQ ID NO: 217068 - protein, 18 aa, Mycobacterium bovis
DLVVVPLDPALPITEQRV

SEQ ID NO: 217069 - protein, 23 aa, Mycobacterium bovis
DMAKPLWELHLIEGLTGRQFAMY

SEQ ID NO: 217070 - protein, 32 aa, Mycobacterium bovis
DMGGPPIVFQLLWYPSTLWDQSLPSLAENADA

SEQ ID NO: 217071 - protein, 23 aa, Mycobacterium bovis
DMGNGAFWRGDQQGLFSAGYRVH

SEQ ID NO: 217072 - protein, 28 aa, Mycobacterium bovis
DMGPLDFPRLNWAPIEWRNLEDEQEKML

SEQ ID NO: 217073 - protein, 36 aa, Mycobacterium bovis
DMPDMPGEFFALTVDHLFGRIWTRPGLSMRDRRMAV

SEQ ID NO: 217074 - protein, 27 aa, Mycobacterium bovis
DMPTKPAPVLIFVPGGAWVHGSRAIQG

SEQ ID NO: 217075 - protein, 21 aa, Mycobacterium bovis
DMRRRRGLPPIAPHSGLGYAQ

SEQ ID NO: 217076 - protein, 24 aa, Mycobacterium bovis
DMTESMLELLLRELDVHPGDVIEV

SEQ ID NO: 217077 - protein, 22 aa, Mycobacterium bovis
DNALPPLQETLLRAFDLAASTA

SEQ ID NO: 217078 - protein, 26 aa, Mycobacterium bovis
DNAWFIAETIGAGTFPWVLAITMPYS

SEQ ID NO: 217079 - protein, 19 aa, Mycobacterium bovis
DNEPDWVNTIFLSTRFRAW

SEQ ID NO: 217080 - protein, 25 aa, Mycobacterium bovis
DNGPWGAFDMSLGKAMYAGFTLGGL

SEQ ID NO: 217081 - protein, 25 aa, Mycobacterium bovis
DNNEVWFLSHLLESIRRVRPTLAES

SEQ ID NO: 217082 - protein, 30 aa, Mycobacterium bovis
DNPMPGGMYRNQVWFPYPGSNVALCVGMCG

SEQ ID NO: 217083 - protein, 35 aa, Mycobacterium bovis
DNQKQRLLPPTFRGDIFWCQLFSEPGAGSDLASLA

SEQ ID NO: 217084 - protein, 26 aa, Mycobacterium bovis
DNRAWRLYRRLGFTDIIRGYHFAGDP

SEQ ID NO: 217085 - protein, 21 aa, Mycobacterium bovis
DNRAYLVLPPGAGKTMIGLEA

SEQ ID NO: 217086 - protein, 26 aa, Mycobacterium bovis
DNRGSQFYLAMYWAQELAAQTDDQQL

SEQ ID NO: 217087 - protein, 21 aa, Mycobacterium bovis
DNRLPPVHMFGGINLSFGLMG

SEQ ID NO: 217088 - protein, 39 aa, Mycobacterium bovis; identical to SEQ ID NO: 113894

SEQ ID NO: 217089 - protein, 26 aa, Mycobacterium bovis
DNTVGPPLLPPILGGGMPAAPGPALR

SEQ ID NO: 217090 - protein, 30 aa, Mycobacterium bovis
DPAELRLRNLLRPNQFPYQSKTGWVYDSGD

SEQ ID NO: 217091 - protein, 18 aa, Mycobacterium bovis
DPAHLLRRKLVNAGFTRK

SEQ ID NO: 217092 - protein, 23 aa, Mycobacterium bovis
DPALPRNRGAFAELLRACGDIDG

SEQ ID NO: 217093 - protein, 22 aa, Mycobacterium bovis
DPARAARVLGFRAAVDPGEGLR

SEQ ID NO: 217094 - protein, 21 aa, Mycobacterium bovis
DPARPLTVTGGLTFAGGPWSN

SEQ ID NO: 217095 - protein, 25 aa, Mycobacterium bovis
DPATNYDVMFVPQGIGADLIATIEG

SEQ ID NO: 217096 - protein, 25 aa, Mycobacterium bovis
DPATVRYLREFRFRGDIDGYAEGEL

SEQ ID NO: 217097 - protein, 24 aa, Mycobacterium bovis
DPDDVTVRFLLTAGAIGSLFKERA

SEQ ID NO: 217098 - protein, 25 aa, Mycobacterium bovis
DPDELALPFAWQGVSLHATGASAVR

SEQ ID NO: 217099 - protein, 25 aa, Mycobacterium bovis
DPDGGLLAYRRLSEALATESWYLAT

SEQ ID NO: 217100 - protein, 37 aa, Mycobacterium bovis
DPDGLVANLRRRGDRWYWHWDPQFIGGIAAFPPVEVT

SEQ ID NO: 217101 - protein, 17 aa, Mycobacterium bovis
DPDLLVAAVKAAGAPVI

SEQ ID NO: 217102 - protein, 18 aa, Mycobacterium bovis
DPDRLILRKYDPILRRHV

SEQ ID NO: 217103 - protein, 36 aa, Mycobacterium bovis
DPDWQRFHLIGATNTVYFALLARRRMDLYGATVEDF

SEQ ID NO: 217104 - protein, 19 aa, Mycobacterium bovis
DPEFRARRMAQMSQYVVGE

SEQ ID NO: 217105 - protein, 29 aa, Mycobacterium bovis
DPEHYQRYLDILRPLGFRPALGFSRVDTT

SEQ ID NO: 217106 - protein, 20 aa, Mycobacterium bovis
DPGSVSYLFSRKGVVTLEKN

SEQ ID NO: 217107 - protein, 18 aa, Mycobacterium bovis
DPHFFTFLEIPEVLSIVD

SEQ ID NO: 217108 - protein, 29 aa, Mycobacterium bovis
DPHGSIVIRKLFWRNLPDEQPGLAPTALI

SEQ ID NO: 217109 - protein, 18 aa, Mycobacterium bovis
DPIAANYHFAWFRELDSR

SEQ ID NO: 217110 - protein, 17 aa, Mycobacterium bovis
DPLCPFAYQTSVWIRDV

SEQ ID NO: 217111 - protein, 26 aa, Mycobacterium bovis
DPLDALVLLPQPVFPGVLVAARPVGM

SEQ ID NO: 217112 - protein, 20 aa, Mycobacterium bovis
DPLIMRRALEYATGLGVLIA

SEQ ID NO: 217113 - protein, 30 aa, Mycobacterium bovis
DPMDCAELLDWPAKLRLLDGFRQRENLSWS

SEQ ID NO: 217114 - protein, 19 aa, Mycobacterium bovis
DPMTNLNPVWKVGFQVTEA

SEQ ID NO: 217115 - protein, 23 aa, Mycobacterium bovis
DPNWRRILLVCRATETMGTGGSG

SEQ ID NO: 217116 - protein, 18 aa, Mycobacterium bovis
DPPCDDWSPPPIRMGVDV

SEQ ID NO: 217117 - protein, 20 aa, Mycobacterium bovis
DPPGGWPEPLRTAALAGRGA

SEQ ID NO: 217118 - protein, 23 aa, Mycobacterium bovis
DPQGNVIAWASSGHVGFKGSRKS

SEQ ID NO: 217119 - protein, 20 aa, Mycobacterium bovis
DPQHLIDWKGNDWYFRETET

SEQ ID NO: 217120 - protein, 19 aa, Mycobacterium bovis
DPQIAYLSGDRLPPALRGF

SEQ ID NO: 217121 - protein, 32 aa, Mycobacterium bovis
DPQKIFDGVSLALLVGARPRGAGMERSDLLEA

SEQ ID NO: 217122 - protein, 23 aa, Mycobacterium bovis
DPRAWLTTVVSRLGLDKLRSAAH

SEQ ID NO: 217123 - protein, 22 aa, Mycobacterium bovis
DPRIWPNIVASQLDWDLELIGR

SEQ ID NO: 217124 - protein, 19 aa, Mycobacterium bovis
DPRLLIEFCLLATQYDAIA

SEQ ID NO: 217125 - protein, 20 aa, Mycobacterium bovis
DPRLPVFDLIAEPLQANGFG

SEQ ID NO: 217126 - protein, 23 aa, Mycobacterium bovis
DPRLYRAYLLKESLRHVFSVKGE

SEQ ID NO: 217127 - protein, 19 aa, Mycobacterium bovis
DPRNEWLFNDAWGVDVAVS

SEQ ID NO: 217128 - protein, 19 aa, Mycobacterium bovis
DPRPFRAGPHETSALLTSA

SEQ ID NO: 217129 - protein, 24 aa, Mycobacterium bovis
DPRQRLALELTWELLEDAFVVPET

SEQ ID NO: 217130 - protein, 18 aa, Mycobacterium bovis
DPRRRCAPLGAGRCLLGS

SEQ ID NO: 217131 - protein, 20 aa, Mycobacterium bovis
DPRYDSAGVPTFESVREKIE

SEQ ID NO: 217132 - protein, 23 aa, Mycobacterium bovis
DPSGAAFGLWQPLQHHGFEVIGE

SEQ ID NO: 217133 - protein, 26 aa, Mycobacterium bovis
DPSLAALYRPMLLRTTNRHHGMPGHV

SEQ ID NO: 217134 - protein, 21 aa, Mycobacterium bovis
DPTLWPQREALKSALQYPALA

SEQ ID NO: 217135 - protein, 23 aa, Mycobacterium bovis
DPTRRADLIKLLDTFPAGAGARG

SEQ ID NO: 217136 - protein, 18 aa, Mycobacterium bovis
DPVLGARPLRRTIQREIE

SEQ ID NO: 217137 - protein, 32 aa, Mycobacterium bovis
DPVTDELIVVRPIGFEPLQWVRALAAEDPVPS

SEQ ID NO: 217138 - protein, 19 aa, Mycobacterium bovis
DPYHRVYGYPTLYVVDGAA

SEQ ID NO: 217139 - protein, 25 aa, Mycobacterium bovis
DPYLPDLLMCRAEVAPILLGAIADA

SEQ ID NO: 217140 - protein, 27 aa, Mycobacterium bovis
DPYYHAELEWWTSPFVLAHGVPPDTLA

SEQ ID NO: 217141 - protein, 25 aa, Mycobacterium bovis
DQANVWMFSPNRLLEHRKPADLVRD

SEQ ID NO: 217142 - protein, 27 aa, Mycobacterium bovis
DQDFRTFDFLGIRDLTAGKPIIIVMPD

SEQ ID NO: 217143 - protein, 20 aa, Mycobacterium bovis
DQGLSLTLFFKDTATTRDVN

SEQ ID NO: 217144 - protein, 23 aa, Mycobacterium bovis
DQHERPVIFLCRSGNRSIGAAEV

SEQ ID NO: 217145 - protein, 25 aa, Mycobacterium bovis
DQIAPLEMTKWFDTNYHYLVPEIGP

SEQ ID NO: 217146 - protein, 30 aa, Mycobacterium bovis
DQLEELYRRMWVLRLLDMALEQLRIEGLIN

SEQ ID NO: 217147 - protein, 20 aa, Mycobacterium bovis
DQLFKPLIAGQRWIAAGLFD

SEQ ID NO: 217148 - protein, 18 aa, Mycobacterium bovis
DQLGTGGFTGVFVLTAPQ

SEQ ID NO: 217149 - protein, 24 aa, Mycobacterium bovis
DQLIGFFINIVVLRNDLRGNPTLR

SEQ ID NO: 217150 - protein, 27 aa, Mycobacterium bovis
DQLTIAARTKGISIRRAPGPSWYHFTL

SEQ ID NO: 217151 - protein, 22 aa, Mycobacterium bovis
DQMLAYNCSPSFNWKKHLDDAT

SEQ ID NO: 217152 - protein, 29 aa, Mycobacterium bovis
DQPWLADHVVNGVVLFPGAGFVELVIRAG

SEQ ID NO: 217153 - protein, 24 aa, Mycobacterium bovis
DQQVDWTWQLVRDAVLDRVWSNPT

SEQ ID NO: 217154 - protein, 25 aa, Mycobacterium bovis
DQQVLPTYAVICCPAFGAAAKVGTF

SEQ ID NO: 217155 - protein, 29 aa, Mycobacterium bovis
DQRHALLPTLLRYQLPIWPERLLTRNNAA

SEQ ID NO: 217156 - protein, 24 aa, Mycobacterium bovis
DQVVAHILNLLLTGKLRSGDRVDR

SEQ ID NO: 217157 - protein, 18 aa, Mycobacterium bovis
DQWALRRHDFDLRTAAAA

SEQ ID NO: 217158 - protein, 26 aa, Mycobacterium bovis
DRAEKYRALMAKRAPLYRRVATMRVD

SEQ ID NO: 217159 - protein, 28 aa, Mycobacterium bovis
DRAFAAVPAALLRWGVSQFDAEVRPVRV

SEQ ID NO: 217160 - protein, 22 aa, Mycobacterium bovis
DRAIDLFKPLASKATRPEVRGG

SEQ ID NO: 217161 - protein, 27 aa, Mycobacterium bovis
DRAIDYRRDGWWQGLGPYDVVLDALGG

SEQ ID NO: 217162 - protein, 19 aa, Mycobacterium bovis
DRASELRSRRVRELGAEVL

SEQ ID NO: 217163 - protein, 25 aa, Mycobacterium bovis
DRATLRISSQLLANWLRHGVITSAD

SEQ ID NO: 217164 - protein, 27 aa, Mycobacterium bovis
DRAVILAPQGLAYIAAFLGSMQAGAIA

SEQ ID NO: 217165 - protein, 24 aa, Mycobacterium bovis
DRAYKPLNWMSPPCWLTEESGGQA

SEQ ID NO: 217166 - protein, 19 aa, Mycobacterium bovis
DRDDPFWDRLRFPAALDRV

SEQ ID NO: 217167 - protein, 25 aa, Mycobacterium bovis
DRDELLRFEKTLMAIWRAIQSAGET

SEQ ID NO: 217168 - protein, 28 aa, Mycobacterium bovis
DRDGSDAMRWFLMASPILRGGNLIVTEQ

SEQ ID NO: 217169 - protein, 30 aa, Mycobacterium bovis
DRDRRATRLVAEWPPRLNIPDPDPLRLIYF

SEQ ID NO: 217170 - protein, 24 aa, Mycobacterium bovis
DRDRRPGRFLLTGSARLLSAPDMA

SEQ ID NO: 217171 - protein, 31 aa, Mycobacterium bovis
DREGEAIAWHLLETLKPRIPVKRMVFHEITE

SEQ ID NO: 217172 - protein, 18 aa, Mycobacterium bovis
DRETLARQFAIPGTPGLE

SEQ ID NO: 217173 - protein, 19 aa, Mycobacterium bovis
DREVLFCPDQFLGAHVRRV

SEQ ID NO: 217174 - protein, 18 aa, Mycobacterium bovis
DREYQRMRDLGIAILREV

SEQ ID NO: 217175 - protein, 23 aa, Mycobacterium bovis
DRGDRLLVITEKKSWKVKRIRNT

SEQ ID NO: 217176 - protein, 29 aa, Mycobacterium bovis
DRGFFDDLVSPFLGLYRDDNLRPNSSVEK

SEQ ID NO: 217177 - protein, 23 aa, Mycobacterium bovis
DRGNFPVFRKRLRQWMMRITAYA

SEQ ID NO: 217178 - protein, 23 aa, Mycobacterium bovis
DRGRPVALLSPLPQGGPYEQLLA

SEQ ID NO: 217179 - protein, 20 aa, Mycobacterium bovis
DRGTWTPAPVFTMIAQRGRV

SEQ ID NO: 217180 - protein, 23 aa, Mycobacterium bovis
DRHLRYPLRDVIWGHDQDLLNTT

SEQ ID NO: 217181 - protein, 25 aa, Mycobacterium bovis
DRIGARIVLPGRGSLHPGARYRRDG

SEQ ID NO: 217182 - protein, 21 aa, Mycobacterium bovis
DRIRPLRPDNTAYLIYTSGTT

SEQ ID NO: 217183 - protein, 26 aa, Mycobacterium bovis
DRKRPHDWIVWHFTHADNLPGIITAG

SEQ ID NO: 217184 - protein, 22 aa, Mycobacterium bovis
DRKVDDALWKRYSTARDTFNRR

SEQ ID NO: 217185 - protein, 26 aa, Mycobacterium bovis
DRLDRAIPRGVGTAGVWRLPDRNTLQ

SEQ ID NO: 217186 - protein, 27 aa, Mycobacterium bovis
DRLFGSWHYWWQAHLLDCLVDAQLRDP

SEQ ID NO: 217187 - protein, 17 aa, Mycobacterium bovis
DRLLAADDPFTVPNLVW

SEQ ID NO: 217188 - protein, 20 aa, Mycobacterium bovis
DRLRFPAALDRVQVPVLLVG

SEQ ID NO: 217189 - protein, 18 aa, Mycobacterium bovis
DRLRNLAAIKDVAARPTR

SEQ ID NO: 217190 - protein, 30 aa, Mycobacterium bovis
DRLTIHDYFWRWDTDWFWCSRSFGAQNPRL

SEQ ID NO: 217191 - protein, 24 aa, Mycobacterium bovis
DRMAKMLRLAVDEVFQMQSEARAE

SEQ ID NO: 217192 - protein, 32 aa, Mycobacterium bovis
DRPAPPPQEQGLIPGFLMPPSDGSGVTPGTGM

SEQ ID NO: 217193 - protein, 20 aa, Mycobacterium bovis
DRPLRPSFVDGLRNEIQIVV

SEQ ID NO: 217194 - protein, 44 aa, Mycobacterium bovis
DRPQFRHRIAFLPNYDMSMARLLYWGCDVWLNNPLRPLEACGTS

SEQ ID NO: 217195 - protein, 17 aa, Mycobacterium bovis
DRPRAMAKVHHAGVDGV

SEQ ID NO: 217196 - protein, 26 aa, Mycobacterium bovis
DRPVPRLLAMGLLRRIDAETVILPRH

SEQ ID NO: 217197 - protein, 24 aa, Mycobacterium bovis
DRPVYTLSHDILFMGLTGDLFRRT

SEQ ID NO: 217198 - protein, 25 aa, Mycobacterium bovis
DRQPDGRIPIWLPPAKRLPDGLASY

SEQ ID NO: 217199 - protein, 25 aa, Mycobacterium bovis
DRRGKYLWLTLNTAGVHRPTDTALV

SEQ ID NO: 217200 - protein, 22 aa, Mycobacterium bovis
DRRHWHTPCWANRATRGPTRKW

SEQ ID NO: 217201 - protein, 23 aa, Mycobacterium bovis
DRRRSFYRIFFDSGFTPHPGEPG

SEQ ID NO: 217202 - protein, 25 aa, Mycobacterium bovis
DRSIVPVRVIWLPPADRSRAGKVAA

SEQ ID NO: 217203 - protein, 29 aa, Mycobacterium bovis
DRTAHDLHLLLPDPYSFPSNLLIEHLNTD

SEQ ID NO: 217204 - protein, 29 aa, Mycobacterium bovis
DRTARDLHLLLPDPYTFPSNLLIEHPNTD

SEQ ID NO: 217205 - protein, 24 aa, Mycobacterium bovis
DRTDVVFASHHWPTWGREKIVEFL

SEQ ID NO: 217206 - protein, 17 aa, Mycobacterium bovis
DRTLITENRLGLVQAAA

SEQ ID NO: 217207 - protein, 24 aa, Mycobacterium bovis
DRVCYDALWTGRRFVVQDTGGWEP

SEQ ID NO: 217208 - protein, 25 aa, Mycobacterium bovis
DRVGFAWVPLLAFVRLATKVGLFPR

SEQ ID NO: 217209 - protein, 25 aa, Mycobacterium bovis
DRVVTKCFLLWAGVVGAISLEVFGQ

SEQ ID NO: 217210 - protein, 26 aa, Mycobacterium bovis
DRVYFPDMELLYADIPAHKRKSFEAF

SEQ ID NO: 217211 - protein, 21 aa, Mycobacterium bovis
DRWATLDPIPRYRTYLQDQGL

SEQ ID NO: 217212 - protein, 27 aa, Mycobacterium bovis
DRWPDKPGRYFTVRAGSLVAWNAEQSG

SEQ ID NO: 217213 - protein, 17 aa, Mycobacterium bovis
DRWQPGARLLPATDDRC

SEQ ID NO: 217214 - protein, 25 aa, Mycobacterium bovis
DRYDLQVLAPPIPRTVRFAEASASG

SEQ ID NO: 217215 - protein, 20 aa, Mycobacterium bovis
DSALTLVRALTEIWPVEAAD

SEQ ID NO: 217216 - protein, 23 aa, Mycobacterium bovis
DSDEVLVPFVRAIVTSVSLDDGI

SEQ ID NO: 217217 - protein, 27 aa, Mycobacterium bovis
DSDLAAWPATLDRVLAIGGPDASYVPG

SEQ ID NO: 217218 - protein, 24 aa, Mycobacterium bovis
DSEDETFWRGFLTSLKGRGLGGVR

SEQ ID NO: 217219 - protein, 25 aa, Mycobacterium bovis
DSEEAVLALYRYLGRTPSRLLAVAL

SEQ ID NO: 217220 - protein, 27 aa, Mycobacterium bovis
DSIVMLHLALKAFRPGRLPFPVMHVDT

SEQ ID NO: 217221 - protein, 18 aa, Mycobacterium bovis
DSLDWPDYIGQLSVEGSA

SEQ ID NO: 217222 - protein, 17 aa, Mycobacterium bovis
DSLTWDAWRNEDSRWTV

SEQ ID NO: 217223 - protein, 22 aa, Mycobacterium bovis
DSLVLSDLAYTLARRRTHRSVR

SEQ ID NO: 217224 - protein, 19 aa, Mycobacterium bovis
DSMRAGLQALAWIAHQPEA

SEQ ID NO: 217225 - protein, 19 aa, Mycobacterium bovis
DSNQGFRRFTPRARNAVVA

SEQ ID NO: 217226 - protein, 25 aa, Mycobacterium bovis
DSNVYLRDLVLALRWVHDNIAEFGG

SEQ ID NO: 217227 - protein, 22 aa, Mycobacterium bovis
DSPLVRQIFIYGNSARAYPLAV

SEQ ID NO: 217228 - protein, 18 aa, Mycobacterium bovis
DSPPRTIALIGDLTFVHD

SEQ ID NO: 217229 - protein, 27 aa, Mycobacterium bovis
DSPRERPGRLLGFHWTKVHPDHPGLGE

SEQ ID NO: 217230 - protein, 22 aa, Mycobacterium bovis
DSPRHWVAHLNVLRDIQDRTGG

SEQ ID NO: 217231 - protein, 17 aa, Mycobacterium bovis
DSRIQLRDALRAALLAF

SEQ ID NO: 217232 - protein, 25 aa, Mycobacterium bovis
DSRIRVLIAGSWFPRYARNLGTPEP

SEQ ID NO: 217233 - protein, 21 aa, Mycobacterium bovis
DSRLRVLARREFAGMISVAID

SEQ ID NO: 217234 - protein, 23 aa, Mycobacterium bovis
DSVAQLELLLPAMAGLVASLTFN

SEQ ID NO: 217235 - protein, 24 aa, Mycobacterium bovis
DSVITTHGLSWGFDRIFAASANHS

SEQ ID NO: 217236 - protein, 22 aa, Mycobacterium bovis
DSYGMLKLLVSTEDLKLLGVHI

SEQ ID NO: 217237 - protein, 21 aa, Mycobacterium bovis
DTAFTQTLDFAGSGTVGAFPF

SEQ ID NO: 217238 - protein, 30 aa, Mycobacterium bovis
DTAHELINPTFNRPLRPLAPVAHLDFDEPE

SEQ ID NO: 217239 - protein, 21 aa, Mycobacterium bovis
DTAILPNGWRDRLVSWTVESS

SEQ ID NO: 217240 - protein, 34 aa, Mycobacterium bovis
DTALLAPRPALLVRRRLDLVAWATGLPALGPEAL

SEQ ID NO: 217241 - protein, 19 aa, Mycobacterium bovis
DTAWFVIREQNLRFDWMKD

SEQ ID NO: 217242 - protein, 30 aa, Mycobacterium bovis
DTCLDKYARLFAWLGLWERHTDLAVIPVDA

SEQ ID NO: 217243 - protein, 25 aa, Mycobacterium bovis
DTDAALVGALAWAAFTAARRIGTWI

SEQ ID NO: 217244 - protein, 25 aa, Mycobacterium bovis
DTDLAWSRITYWRALLTSAVDQPPH

SEQ ID NO: 217245 - protein, 24 aa, Mycobacterium bovis
DTDQIIPAVFLKRVTRTGFEDGLF

SEQ ID NO: 217246 - protein, 24 aa, Mycobacterium bovis
DTDSELFRRYWPADLHMIGKDIIR

SEQ ID NO: 217247 - protein, 25 aa, Mycobacterium bovis
DTDTVRLYLQETLTFLCYTAEASVA

SEQ ID NO: 217248 - protein, 17 aa, Mycobacterium bovis
DTELLGYYLPKGTNVIA

SEQ ID NO: 217249 - protein, 34 aa, Mycobacterium bovis
DTEPWRGEPLLAYLRKMVFWSMVTPRAADMAVLS

SEQ ID NO: 217250 - protein, 21 aa, Mycobacterium bovis
DTFCPVGPWIVTDLAPFDPAD

SEQ ID NO: 217251 - protein, 28 aa, Mycobacterium bovis
DTKADLPAFAELLARLPWPLNKTTSVNK

SEQ ID NO: 217252 - protein, 25 aa, Mycobacterium bovis
DTKLARSPTVTALLQLAAYADALVH

SEQ ID NO: 217253 - protein, 26 aa, Mycobacterium bovis
DTLEETALWLDLTYAGSRPVVLTGAM

SEQ ID NO: 217254 - protein, 22 aa, Mycobacterium bovis
DTLYSCLPLYHNNALTVAVSSV

SEQ ID NO: 217255 - protein, 25 aa, Mycobacterium bovis
DTNVYYRRALMLAACFGRGSEYPQR

SEQ ID NO: 217256 - protein, 17 aa, Mycobacterium bovis
DTPILVPTGLPSPLPPT

SEQ ID NO: 217257 - protein, 24 aa, Mycobacterium bovis
DTPLARLYGWHRAMRIFDGPDEVH

SEQ ID NO: 217258 - protein, 25 aa, Mycobacterium bovis
DTPVLPPLDVAASAELLLLAVTDSE

SEQ ID NO: 217259 - protein, 18 aa, Mycobacterium bovis
DTPYSGVAAIFRSAVEKG

SEQ ID NO: 217260 - protein, 24 aa, Mycobacterium bovis
DTQPRPLVIVHGPLFQAVKAARAQ

SEQ ID NO: 217261 - protein, 21 aa, Mycobacterium bovis
DTQRQCIELAYYGGLTYVEVS

SEQ ID NO: 217262 - protein, 18 aa, Mycobacterium bovis
DTRIATGPLNTWLTEVTA

SEQ ID NO: 217263 - protein, 18 aa, Mycobacterium bovis
DTRLLSETELWQLAFDVV

SEQ ID NO: 217264 - protein, 25 aa, Mycobacterium bovis
DTSTWPVVFPELPAAPYGGPCRPPQ

SEQ ID NO: 217265 - protein, 17 aa, Mycobacterium bovis
DTTLTHVLGVKASVNDA

SEQ ID NO: 217266 - protein, 24 aa, Mycobacterium bovis
DTTNVVTAWRLLRSVDPHLRTRRV

SEQ ID NO: 217267 - protein, 30 aa, Mycobacterium bovis
DTTRLRYVEPYRAELHRLGRPVFGPSFEVE

SEQ ID NO: 217268 - protein, 18 aa, Mycobacterium bovis
DTTRMRVELGYQPKWTTV

SEQ ID NO: 217269 - protein, 26 aa, Mycobacterium bovis
DTVARLIGPAALKYLLFSGELIGIEE

SEQ ID NO: 217270 - protein, 38 aa, Mycobacterium bovis
DTVVIYGDKSNWWAAYALWVFTLFGHADVRLLNGGRDL

SEQ ID NO: 217271 - protein, 21 aa, Mycobacterium bovis
DTYGAALRFAPPLVITAQEID

SEQ ID NO: 217272 - protein, 22 aa, Mycobacterium bovis
DVAAKRIAWIKLLNAGQTCVAP

SEQ ID NO: 217273 - protein, 18 aa, Mycobacterium bovis
DVAARWPVPGPRDDKYTQ

SEQ ID NO: 217274 - protein, 25 aa, Mycobacterium bovis
DVAELLPELTLAQRWDLTASELARN

SEQ ID NO: 217275 - protein, 23 aa, Mycobacterium bovis
DVAERILLNSKTRRPSVCNAAET

SEQ ID NO: 217276 - protein, 20 aa, Mycobacterium bovis
DVALALLTPIVGQEFLDKYR

SEQ ID NO: 217277 - protein, 24 aa, Mycobacterium bovis
DVALIVGVPMDFRLGFGGVFGSTT

SEQ ID NO: 217278 - protein, 26 aa, Mycobacterium bovis
DVARVFLGSWSGKIIRYSPVPVLVLP

SEQ ID NO: 217279 - protein, 25 aa, Mycobacterium bovis
DVASRLIRLPMWVGLQEVDQSRVVE

SEQ ID NO: 217280 - protein, 31 aa, Mycobacterium bovis
DVATELEFIVFDQPYRQAWASGYRGLTPASD

SEQ ID NO: 217281 - protein, 28 aa, Mycobacterium bovis
DVAVGDWIAMFSMWPIKSTPGLRCQLDC

SEQ ID NO: 217282 - protein, 25 aa, Mycobacterium bovis
DVAVGTLYRYFPSKVHLLVSALGRE

SEQ ID NO: 217283 - protein, 18 aa, Mycobacterium bovis
DVAWMIFAHRVFQELAGL

SEQ ID NO: 217284 - protein, 26 aa, Mycobacterium bovis
DVDDEFFVIVRPAPSGTRLLLSDATA

SEQ ID NO: 217285 - protein, 23 aa, Mycobacterium bovis
DVDEELLLQLKSWRLSTAKEQNV

SEQ ID NO: 217286 - protein, 28 aa, Mycobacterium bovis
DVDKKRPFYFGVLTWYMDRVLELVHDDL

SEQ ID NO: 217287 - protein, 26 aa, Mycobacterium bovis
DVDNPVSALLFFLASSRIFNRRKGVR

SEQ ID NO: 217288 - protein, 37 aa, Mycobacterium bovis
DVDPIDVYRILRVTNPSPYMYLLQVPNSDGAVDFSIV

SEQ ID NO: 217289 - protein, 28 aa, Mycobacterium bovis
DVDTEITRLVPFIEWLRGAYPDQLISVD

SEQ ID NO: 217290 - protein, 18 aa, Mycobacterium bovis
DVELFALAQLIGAAGTLV

SEQ ID NO: 217291 - protein, 24 aa, Mycobacterium bovis
DVELRIPKLRKGSFFPAILEPRRR

SEQ ID NO: 217292 - protein, 24 aa, Mycobacterium bovis
DVFCSVVRRVALPDSFFAVDGQIE

SEQ ID NO: 217293 - protein, 25 aa, Mycobacterium bovis
DVFKEKLIRRDISLKAFEAGEPQAS

SEQ ID NO: 217294 - protein, 19 aa, Mycobacterium bovis
DVFYASRHPDIFSSYPNIT

SEQ ID NO: 217295 - protein, 26 aa, Mycobacterium bovis
DVGDITLGERLILSSGFVAVTVVVRR

SEQ ID NO: 217296 - protein, 25 aa, Mycobacterium bovis
DVGELLRWLGDGNFLLLGYQRCRVA

SEQ ID NO: 217297 - protein, 27 aa, Mycobacterium bovis
DVGGPPLVFQLLWYPTTMADLSLPSFT

SEQ ID NO: 217298 - protein, 25 aa, Mycobacterium bovis
DVGRLPRPLTLDSFADLPTAKRPPV

SEQ ID NO: 217299 - protein, 22 aa, Mycobacterium bovis
DVHLPFQLHVLDMAADRVSHVV

SEQ ID NO: 217300 - protein, 31 aa, Mycobacterium bovis
DVICSKGFPSYFLIVADLISYARSAGIRVGP

SEQ ID NO: 217301 - protein, 19 aa, Mycobacterium bovis
DVIRFWLGLGIDGFRLDAV

SEQ ID NO: 217302 - protein, 41 aa, Mycobacterium bovis
DVKLPRELVLIGKQFLYVERYMKLLAPRWQMMSDPQLTGYF

SEQ ID NO: 217303 - protein, 18 aa, Mycobacterium bovis
DVKPPTWWHSLPTDRPII

SEQ ID NO: 217304 - protein, 26 aa, Mycobacterium bovis
DVLAALRPHFRLRPDPAPRGSAPAEL

SEQ ID NO: 217305 - protein, 17 aa, Mycobacterium bovis
DVLDQAYPPRLAQSWDS

SEQ ID NO: 217306 - protein, 28 aa, Mycobacterium bovis
DVLDRYLPVLADLRMRYLDDGDWDGDIV

SEQ ID NO: 217307 - protein, 19 aa, Mycobacterium bovis
DVLGGLRGWLTAPVIVLSA

SEQ ID NO: 217308 - protein, 25 aa, Mycobacterium bovis
DVLLKVRLRQGLPLARLGAAERERA

SEQ ID NO: 217309 - protein, 18 aa, Mycobacterium bovis
DVLQGQCTFSWPPRMELP

SEQ ID NO: 217310 - protein, 20 aa, Mycobacterium bovis
DVLRAWGKLGYPRRAKRLHE

SEQ ID NO: 217311 - protein, 19 aa, Mycobacterium bovis
DVLVAAAADLEGIGSALAA

SEQ ID NO: 217312 - protein, 17 aa, Mycobacterium bovis
DVLVLRSLTKTWSLAGL

SEQ ID NO: 217313 - protein, 18 aa, Mycobacterium bovis
DVLVQWAMFGRDPRHGTV

SEQ ID NO: 217314 - protein, 22 aa, Mycobacterium bovis
DVMFGPPGRLYTYRSHGIHVCA

SEQ ID NO: 217315 - protein, 18 aa, Mycobacterium bovis
DVMMPGMDGFGVLRRLRA

SEQ ID NO: 217316 - protein, 18 aa, Mycobacterium bovis
DVMPYTFGDNWFADAPAE

SEQ ID NO: 217317 - protein, 25 aa, Mycobacterium bovis
DVMTVVQRLELVRRIGLVIDYDVVE

SEQ ID NO: 217318 - protein, 23 aa, Mycobacterium bovis
DVNVPMPIRVTSSLRHLALVVAD

SEQ ID NO: 217319 - protein, 18 aa, Mycobacterium bovis
DVPVLEVALRLGVGYVGA

SEQ ID NO: 217320 - protein, 28 aa, Mycobacterium bovis
DVQAGLAMLAPIWGYAPLLDIDDATARQ

SEQ ID NO: 217321 - protein, 24 aa, Mycobacterium bovis
DVRMPHHRIVMRQLAFGYTYEELN

SEQ ID NO: 217322 - protein, 20 aa, Mycobacterium bovis
DVRPTVWGAVPRVWEKLKAG

SEQ ID NO: 217323 - protein, 27 aa, Mycobacterium bovis
DVRQYSRWALRLRVPFTVPVEAKSLQL

SEQ ID NO: 217324 - protein, 24 aa, Mycobacterium bovis
DVRRIFEHIPAILVGLEGPDHRFV

SEQ ID NO: 217325 - protein, 17 aa, Mycobacterium bovis
DVRTPFGLWPNVPPQVI

SEQ ID NO: 217326 - protein, 18 aa, Mycobacterium bovis
DVRTVLPPVLSIRNGRRA

SEQ ID NO: 217327 - protein, 25 aa, Mycobacterium bovis
DVSDFGHRLLAYLRAADAGAELLIL

SEQ ID NO: 217328 - protein, 18 aa, Mycobacterium bovis
DVSLRPRSLREFIGQPRV

SEQ ID NO: 217329 - protein, 31 aa, Mycobacterium bovis
DVSLTSVFRATRAALRYFRDAPHGGVIVNNA

SEQ ID NO: 217330 - protein, 25 aa, Mycobacterium bovis
DVTQRVGLPGIWYAGSHGFELTAPD

SEQ ID NO: 217331 - protein, 24 aa, Mycobacterium bovis
DVTSLYKVGLGSVRFLMSVGDLII

SEQ ID NO: 217332 - protein, 40 aa, Mycobacterium bovis
DVTTMFRPKLDALALLHRLSLKSPVRHFVLFSSVSGLLGS

SEQ ID NO: 217333 - protein, 23 aa, Mycobacterium bovis
DVVHLASPALLGYGGLHAARRLG

SEQ ID NO: 217334 - protein, 18 aa, Mycobacterium bovis
DVVILDLGLPDMSGIDVL

SEQ ID NO: 217335 - protein, 18 aa, Mycobacterium bovis
DVVLHFEGDRNGALRMVR

SEQ ID NO: 217336 - protein, 20 aa, Mycobacterium bovis
DVVPLWLAEMDFPTAPAVLD

SEQ ID NO: 217337 - protein, 19 aa, Mycobacterium bovis
DVVVHPRSWLLRQASSGVS

SEQ ID NO: 217338 - protein, 18 aa, Mycobacterium bovis
DVWTPRDRMPVFPVPDGH

SEQ ID NO: 217339 - protein, 18 aa, Mycobacterium bovis
DWKSRWYADKQYAEYVKE

SEQ ID NO: 217340 - protein, 19 aa, Mycobacterium bovis
DWLSVKRLAGWLAAAGYCG

SEQ ID NO: 217341 - protein, 17 aa, Mycobacterium bovis
DWPVDGLPAVDLYAEQK

SEQ ID NO: 217342 - protein, 41 aa, Mycobacterium bovis
DWSPKVFGSWNLHRATLGQPLDWFCLFSSGAALLGSPGQGA

SEQ ID NO: 217343 - protein, 23 aa, Mycobacterium bovis
DWSYGWSLMRIGALLRRTNMSLL

SEQ ID NO: 217344 - protein, 24 aa, Mycobacterium bovis
DWTRLARRMSEISEAPLFIDDSPN

SEQ ID NO: 217345 - protein, 23 aa, Mycobacterium bovis
DWVPTAFPVEFLSLGASGVGVPV

SEQ ID NO: 217346 - protein, 22 aa, Mycobacterium bovis
DYAELLTFHHAERVRMVATSAA

SEQ ID NO: 217347 - protein, 25 aa, Mycobacterium bovis
DYDAWQETVYLLRSPENARRLMEAV

SEQ ID NO: 217348 - protein, 22 aa, Mycobacterium bovis
DYDYDTVFARALEGSARPGDTL

SEQ ID NO: 217349 - protein, 22 aa, Mycobacterium bovis
DYETVRPKILSPHYSEYQVLEG

SEQ ID NO: 217350 - protein, 18 aa, Mycobacterium bovis
DYGYVILPVAVPEGVEPS

SEQ ID NO: 217351 - protein, 18 aa, Mycobacterium bovis
DYHGDRLVLTGRGRLLAD

SEQ ID NO: 217352 - protein, 32 aa, Mycobacterium bovis
DYLARRDAEWMGPLLDAMGLTVGWITADSTPD

SEQ ID NO: 217353 - protein, 20 aa, Mycobacterium bovis
DYLSPFFNETAYCLGVEKLL

SEQ ID NO: 217354 - protein, 26 aa, Mycobacterium bovis
DYNLQFLDHIVAHPTIRWVGSANELN

SEQ ID NO: 217355 - protein, 27 aa, Mycobacterium bovis
DYQSTARFILAYLPRWQEPPQIYGGGG

SEQ ID NO: 217356 - protein, 17 aa, Mycobacterium bovis
DYRPACDVMLALVAQLD

SEQ ID NO: 217357 - protein, 26 aa, Mycobacterium bovis
DYRPLDGFVYAITPFNFTSIAGNLPT

SEQ ID NO: 217358 - protein, 31 aa, Mycobacterium bovis
DYTRTLDILERFYGLVLTDCGTGLLHSAMSA

SEQ ID NO: 217359 - protein, 25 aa, Mycobacterium bovis
DYTTIDIALIRLGAVSVPLQTSAPV

SEQ ID NO: 217360 - protein, 23 aa, Mycobacterium bovis
DYVINGRKWWTSGAADPRCKILI

SEQ ID NO: 217361 - protein, 17 aa, Mycobacterium bovis
DYYLKLAEQIVDAGAHV

SEQ ID NO: 217362 - protein, 18 aa, Mycobacterium bovis
EAAAILSARFGPSVLYGV

SEQ ID NO: 217363 - protein, 23 aa, Mycobacterium bovis
EAACRAFDALAARYDVVVAEGAG

SEQ ID NO: 217364 - protein, 24 aa, Mycobacterium bovis
EAARAWWGNFLAQKANEAGIGLDE

SEQ ID NO: 217365 - protein, 35 aa, Mycobacterium bovis
EAARQVRHYLGREDVFFLHVSLVPYLAPSGELKTK

SEQ ID NO: 217366 - protein, 26 aa, Mycobacterium bovis
EAAVAGAIPVIRPLTQSLAGDTVLRV

SEQ ID NO: 217367 - protein, 22 aa, Mycobacterium bovis
EAAVEHLFAVASGLDSAVIGEQ

SEQ ID NO: 217368 - protein, 32 aa, Mycobacterium bovis
EADEMLDLGFLPDIERILRQIPADRQSMLFSA

SEQ ID NO: 217369 - protein, 21 aa, Mycobacterium bovis
EADIYLALYGSWKDPADEAKY

SEQ ID NO: 217370 - protein, 20 aa, Mycobacterium bovis
EADLNYWRAIMADPPEPLEL

SEQ ID NO: 217371 - protein, 24 aa, Mycobacterium bovis
EADPVLLEIFNNLFMSIAEQMGFR

SEQ ID NO: 217372 - protein, 23 aa, Mycobacterium bovis
EAEGLQVLGWRSVPTDDSSLGAL

SEQ ID NO: 217373 - protein, 34 aa, Mycobacterium bovis
EAEGYPLHSFPGEPPFVRGPYPTMYVNQPWTIRQ

SEQ ID NO: 217374 - protein, 21 aa, Mycobacterium bovis
EAELQRIVASIPVKRLRQAGV

SEQ ID NO: 217375 - protein, 24 aa, Mycobacterium bovis
EAERYLLGSRSALGWIIDRYRVTT

SEQ ID NO: 217376 - protein, 17 aa, Mycobacterium bovis
EAFAAVALASIRELGLN

SEQ ID NO: 217377 - protein, 20 aa, Mycobacterium bovis
EAFELVVVNLYPFSQTVESG

SEQ ID NO: 217378 - protein, 17 aa, Mycobacterium bovis
EAFGRYGAYLSQLNVLP

SEQ ID NO: 217379 - protein, 22 aa, Mycobacterium bovis
EAGFPGLAVAAIRVAPFAAWCA

SEQ ID NO: 217380 - protein, 24 aa, Mycobacterium bovis
EAGKQPVLYVVGRKAQNYYSFRNW

SEQ ID NO: 217381 - protein, 25 aa, Mycobacterium bovis
EAGKVYRLWVVGRLQLWHGYRLGLI

SEQ ID NO: 217382 - protein, 31 aa, Mycobacterium bovis
EAGVPPPRWSISVPVLYALGALGSLRARLTG

SEQ ID NO: 217383 - protein, 21 aa, Mycobacterium bovis
EAHLRRHAPWGAQVTVTRGEV

SEQ ID NO: 217384 - protein, 26 aa, Mycobacterium bovis
EAIGLLKMDFLGLRNLTIIGDAIDNV

SEQ ID NO: 217385 - protein, 20 aa, Mycobacterium bovis
EAILTGWRMLLDEGRLQDGE

SEQ ID NO: 217386 - protein, 23 aa, Mycobacterium bovis
EAKVVSERRLWLAVLRAQAELGV

SEQ ID NO: 217387 - protein, 18 aa, Mycobacterium bovis
EALALTRFHIFSHSWGGM

SEQ ID NO: 217388 - protein, 27 aa, Mycobacterium bovis
EALAYGDMGLALPILAPGGVASALTHW

SEQ ID NO: 217389 - protein, 30 aa, Mycobacterium bovis
EALDRTGLWGRLLPEWEPIRDLPPRDVAHK

SEQ ID NO: 217390 - protein, 26 aa, Mycobacterium bovis
EALGEGWFWPAAAAHPSLPRGALLQI

SEQ ID NO: 217391 - protein, 26 aa, Mycobacterium bovis
EALGGMPMPKAVVWALHEHILGANPA

SEQ ID NO: 217392 - protein, 20 aa, Mycobacterium bovis
EALLAAATDLAAIRSTIRAA

SEQ ID NO: 217393 - protein, 19 aa, Mycobacterium bovis
EALTMAASDLANIGSTINA

SEQ ID NO: 217394 - protein, 19 aa, Mycobacterium bovis
EALVESALWEASLFEEHGF

SEQ ID NO: 217395 - protein, 23 aa, Mycobacterium bovis
EANVVNFRRQLGRLGFGHDSRRS

SEQ ID NO: 217396 - protein, 27 aa, Mycobacterium bovis
EAQISKPMLYLYYGSKEDLFGACLNRE

SEQ ID NO: 217397 - protein, 26 aa, Mycobacterium bovis
EAREGMLAFLQKRPPRWVQPATMRAA

SEQ ID NO: 217398 - protein, 17 aa, Mycobacterium bovis
EARLNLLRVHASFLFEE

SEQ ID NO: 217399 - protein, 23 aa, Mycobacterium bovis
EARLWFSPAPTRAFAPSRIRAAF

SEQ ID NO: 217400 - protein, 24 aa, Mycobacterium bovis
EARPIRIDRFELLAARRRDQLIDI

SEQ ID NO: 217401 - protein, 17 aa, Mycobacterium bovis
EARRGMALAAELCLPLV

SEQ ID NO: 217402 - protein, 30 aa, Mycobacterium bovis
EARRRGIPVVLRPAVLAKLMAGRTTLMVTG

SEQ ID NO: 217403 - protein, 23 aa, Mycobacterium bovis
EARYRRWLAALRGSARLVIGTRS

SEQ ID NO: 217404 - protein, 26 aa, Mycobacterium bovis
EASAVALSLTPFTPSPSAAATPGGAV

SEQ ID NO: 217405 - protein, 30 aa, Mycobacterium bovis
EASLVEKLVPDFLWISTEHTARVSLNALER

SEQ ID NO: 217406 - protein, 27 aa, Mycobacterium bovis
EAVLASTGWHLMMALIARARVAIAQDE

SEQ ID NO: 217407 - protein, 17 aa, Mycobacterium bovis
EAVVAAARWARSELDYI

SEQ ID NO: 217408 - protein, 19 aa, Mycobacterium bovis
EAVWIDLIGKLVPATSVAQ

SEQ ID NO: 217409 - protein, 26 aa, Mycobacterium bovis
EAYADMPLFLFHLLEYMDVDYELDIE

SEQ ID NO: 217410 - protein, 24 aa, Mycobacterium bovis
EAYERLILDVLLGEPSLFPVNAEV

SEQ ID NO: 217411 - protein, 18 aa, Mycobacterium bovis
EAYLGRRWVKLDATIDAP

SEQ ID NO: 217412 - protein, 21 aa, Mycobacterium bovis
EAYQRIFDRLQVRYVIVSAVS

SEQ ID NO: 217413 - protein, 27 aa, Mycobacterium bovis
EAYRGHVFWDALFVAPVLSLRMPKVAR

SEQ ID NO: 217414 - protein, 21 aa, Mycobacterium bovis
ECCAVVAYGALLGGPLLAVPP

SEQ ID NO: 217415 - protein, 21 aa, Mycobacterium bovis
ECHHLLATWGALVSALASVLG

SEQ ID NO: 217416 - protein, 29 aa, Mycobacterium bovis
ECLAAIEAPLVITPWRSVLICDLDDATAD

SEQ ID NO: 217417 - protein, 28 aa, Mycobacterium bovis
ECNPAPSTLLLALLGGFERRGRWNVPKK

SEQ ID NO: 217418 - protein, 19 aa, Mycobacterium bovis
ECWAMQAYGAAYTLQELLT

SEQ ID NO: 217419 - protein, 18 aa, Mycobacterium bovis
EDADWFRTYFHEVGPSIS

SEQ ID NO: 217420 - protein, 24 aa, Mycobacterium bovis
EDALADMFLAALFGDHPVGRPVIG

SEQ ID NO: 217421 - protein, 24 aa, Mycobacterium bovis
EDEEVPLPDFFYVSARLQRKHRQY

SEQ ID NO: 217422 - protein, 25 aa, Mycobacterium bovis
EDESPIVFLRLRKAARRHRVPVYTI

SEQ ID NO: 217423 - protein, 34 aa, Mycobacterium bovis
EDESRLTFLAVRRWYGWSAGRILNLDIGGGSLEV

SEQ ID NO: 217424 - protein, 20 aa, Mycobacterium bovis
EDFLDLPRQQLADAALSAAA

SEQ ID NO: 217425 - protein, 24 aa, Mycobacterium bovis
EDFNAIARGLKLLELDYLGGSGTR

SEQ ID NO: 217426 - protein, 33 aa, Mycobacterium bovis
EDFVLGGGKRLRPLFAYWGWHAVASREPDPDVL

SEQ ID NO: 217427 - protein, 22 aa, Mycobacterium bovis
EDGAFGLLRVLGTAMARLAEAE

SEQ ID NO: 217428 - protein, 26 aa, Mycobacterium bovis
EDGGYLAILDIRPFTRGHTLVLPKRH

SEQ ID NO: 217429 - protein, 20 aa, Mycobacterium bovis
EDHWYSTGADFKRPAPHWWF

SEQ ID NO: 217430 - protein, 25 aa, Mycobacterium bovis
EDIEQWYVSRFLAMRTTAFADPESH

SEQ ID NO: 217431 - protein, 25 aa, Mycobacterium bovis
EDIKGQFYCSISVPLDLYSCAVYAG

SEQ ID NO: 217432 - protein, 23 aa, Mycobacterium bovis
EDKPKPWRVFSAATPAESVSLVI

SEQ ID NO: 217433 - protein, 25 aa, Mycobacterium bovis
EDKRFPQLTVLSIAPLLASTIRAVF

SEQ ID NO: 217434 - protein, 25 aa, Mycobacterium bovis
EDLLGGIPLAGFFAAGEIGPVAGHN

SEQ ID NO: 217435 - protein, 18 aa, Mycobacterium bovis
EDLLPFSDETLCRAIAAC

SEQ ID NO: 217436 - protein, 31 aa, Mycobacterium bovis
EDLLRPVLNMPRHPIRLARFGPRAALPATAM

SEQ ID NO: 217437 - protein, 32 aa, Mycobacterium bovis
EDLMREHGVLKRILLIYREGIRRLQADDQSPA

SEQ ID NO: 217438 - protein, 21 aa, Mycobacterium bovis
EDLPTLVRTLAATTALMLTGD

SEQ ID NO: 217439 - protein, 26 aa, Mycobacterium bovis
EDLSELLWSFAPPPRPRPVDGSEIPS

SEQ ID NO: 217440 - protein, 20 aa, Mycobacterium bovis
EDLVFLRKVLNRADIPYLLI

SEQ ID NO: 217441 - protein, 18 aa, Mycobacterium bovis
EDPQLIERNLFRDMVHPL

SEQ ID NO: 217442 - protein, 17 aa, Mycobacterium bovis
EDQRFHRLAVSTAVRAR

SEQ ID NO: 217443 - protein, 25 aa, Mycobacterium bovis
EDRLRTRFEWGLITDVQPPELETRI

SEQ ID NO: 217444 - protein, 22 aa, Mycobacterium bovis
EDSRLLTRELLYTAVARAKRKV

SEQ ID NO: 217445 - protein, 24 aa, Mycobacterium bovis
EDSTFYGDLFPHAVKWRGTTYLED

SEQ ID NO: 217446 - protein, 18 aa, Mycobacterium bovis
EDSWLRSLVMAGARERYG

SEQ ID NO: 217447 - protein, 38 aa, Mycobacterium bovis
EDTVILYGGNNNWFAAYAYWYFKLYGHEKVKLLDGGRK

SEQ ID NO: 217448 - protein, 25 aa, Mycobacterium bovis
EDVAKLTYYGLYALQHRGQEAAGIA

SEQ ID NO: 217449 - protein, 26 aa, Mycobacterium bovis
EDVANLAMFLLSDAASWITGQVINVD

SEQ ID NO: 217450 - protein, 33 aa, Mycobacterium bovis
EDVLVHGLPLYHVHGLVLGLLGSLRFGNRFVHT

SEQ ID NO: 217451 - protein, 24 aa, Mycobacterium bovis
EDVPNLFWCVGYTNASWTLRADMT

SEQ ID NO: 217452 - protein, 21 aa, Mycobacterium bovis
EDYRTFWTQFGRVLKEGLLSD

SEQ ID NO: 217453 - protein, 24 aa, Mycobacterium bovis
EDYTNRGRIITPIKDRFGAEIRTH

SEQ ID NO: 217454 - protein, 26 aa, Mycobacterium bovis
EEAGPDALIVVLLPDGGRGYMSKIFN

SEQ ID NO: 217455 - protein, 22 aa, Mycobacterium bovis
EEATFLTRFARSVTLVHRRDEF

SEQ ID NO: 217456 - protein, 19 aa, Mycobacterium bovis
EEAVPYYGGLRRMVNRNDA

SEQ ID NO: 217457 - protein, 17 aa, Mycobacterium bovis
EEDGAVYQLRRWYEQFY

SEQ ID NO: 217458 - protein, 24 aa, Mycobacterium bovis
EEDLRGWLLGLTYTVSGEGMMAAT

SEQ ID NO: 217459 - protein, 19 aa, Mycobacterium bovis
EEDPRWRFGVPPANNANYA

SEQ ID NO: 217460 - protein, 18 aa, Mycobacterium bovis
EEEQVCADLLALLTSRRP

SEQ ID NO: 217461 - protein, 19 aa, Mycobacterium bovis
EEFILTLDRNGLATAYLFR

SEQ ID NO: 217462 - protein, 23 aa, Mycobacterium bovis
EEFNLKKMWLSPNGTIRNILGGT

SEQ ID NO: 217463 - protein, 21 aa, Mycobacterium bovis
EEFSETIRYFSTILAKHGVEV

SEQ ID NO: 217464 - protein, 24 aa, Mycobacterium bovis
EEGRLFTRFLGMLPTNEPMVEELL

SEQ ID NO: 217465 - protein, 28 aa, Mycobacterium bovis
EEHRKAFRRTIKWRTGCEGRISHLKRGY

SEQ ID NO: 217466 - protein, 20 aa, Mycobacterium bovis
EEILAAYHLVARVEGVFVEP

SEQ ID NO: 217467 - protein, 26 aa, Mycobacterium bovis
EEKFGFLLEAFMFGAPPHGGIAFGWD

SEQ ID NO: 217468 - protein, 23 aa, Mycobacterium bovis
EEKPYARRPYPPFMTSTLQQEAS

SEQ ID NO: 217469 - protein, 19 aa, Mycobacterium bovis
EELFSAVRFDIGWTASSDD

SEQ ID NO: 217470 - protein, 23 aa, Mycobacterium bovis
EELIGQFGIGFYSSFMVADKVQL

SEQ ID NO: 217471 - protein, 26 aa, Mycobacterium bovis
EELLGGIPLAGFFAAGEIGPIAGRNA

SEQ ID NO: 217472 - protein, 17 aa, Mycobacterium bovis
EEMAGIVVFLLSDDASM

SEQ ID NO: 217473 - protein, 30 aa, Mycobacterium bovis
EEMVDELLRGFLDWLFARYRDIVDSTANPL

SEQ ID NO: 217474 - protein, 21 aa, Mycobacterium bovis
EEPPPSTVFLLCAPSVDPEDI

SEQ ID NO: 217475 - protein, 24 aa, Mycobacterium bovis
EEQARALCLRLLTARSRTRAELAG

SEQ ID NO: 217476 - protein, 26 aa, Mycobacterium bovis
EERGMAFIYKLLELLAERDDRITKAR

SEQ ID NO: 217477 - protein, 18 aa, Mycobacterium bovis
EERRLAYVGITRARQRLY

SEQ ID NO: 217478 - protein, 20 aa, Mycobacterium bovis
EERRLLYVGITRARVHLALS

SEQ ID NO: 217479 - protein, 24 aa, Mycobacterium bovis
EERWRPGLPPPPEQFYRVLAEQSK

SEQ ID NO: 217480 - protein, 17 aa, Mycobacterium bovis
EESLPAVLAAIPAGYRA

SEQ ID NO: 217481 - protein, 25 aa, Mycobacterium bovis
EESYLALLDALRWLGLDWDEGPEVG

SEQ ID NO: 217482 - protein, 23 aa, Mycobacterium bovis
EETIKYLRFTGRTPEQVALVEAY

SEQ ID NO: 217483 - protein, 28 aa, Mycobacterium bovis
EETMKLPRTILMYPMTLASQAAHVVMRF

SEQ ID NO: 217484 - protein, 23 aa, Mycobacterium bovis
EEVDKMVWATRWGADTIMDLSTG

SEQ ID NO: 217485 - protein, 23 aa, Mycobacterium bovis
EEVEVLRLSALRGLFSAVIEDAV

SEQ ID NO: 217486 - protein, 20 aa, Mycobacterium bovis
EEVKRWWHSLTPGQQDRVKQ

SEQ ID NO: 217487 - protein, 19 aa, Mycobacterium bovis
EEVLQWPAGTIARIRRGEP

SEQ ID NO: 217488 - protein, 17 aa, Mycobacterium bovis
EEWNCDKGRWAFTYATQ

SEQ ID NO: 217489 - protein, 40 aa, Mycobacterium bovis
EFAEIMGFYGLSYWYPFQVTALGLGPIWMSANEDAKRKAA

SEQ ID NO: 217490 - protein, 25 aa, Mycobacterium bovis
EFAELRSAAPIWWNGQDPGKGGGFH

SEQ ID NO: 217491 - protein, 36 aa, Mycobacterium bovis
EFAQPALFAVEVALYRLLMSWGVRPGLVLGHSVGEL

SEQ ID NO: 217492 - protein, 28 aa, Mycobacterium bovis
EFATYAPGLWRYWAEHLDPDRARRNDPL

SEQ ID NO: 217493 - protein, 18 aa, Mycobacterium bovis
EFAYGSFVRTVSLPVGAD

SEQ ID NO: 217494 - protein, 19 aa, Mycobacterium bovis
EFCLGACVAGIRAIPGLSD

SEQ ID NO: 217495 - protein, 20 aa, Mycobacterium bovis
EFCYTTAWFDDQQLLGVMDG

SEQ ID NO: 217496 - protein, 25 aa, Mycobacterium bovis
EFDEWQRLYLFTRADTIYGGSNEIQ

SEQ ID NO: 217497 - protein, 21 aa, Mycobacterium bovis
EFEALLLEFLGESAVTVPELG

SEQ ID NO: 217498 - protein, 26 aa, Mycobacterium bovis
EFGHIDVHMLQYSGAIWYPMVYDMPA

SEQ ID NO: 217499 - protein, 35 aa, Mycobacterium bovis
EFGSQALRPAMFSTFLMWVLADLFTFLPEVGDLDK

SEQ ID NO: 217500 - protein, 17 aa, Mycobacterium bovis
EFLAALEKPRRVLIMVK

SEQ ID NO: 217501 - protein, 31 aa, Mycobacterium bovis
EFLNGHPSVRWVRYPYLPSHPQYDLAKRQMS

SEQ ID NO: 217502 - protein, 22 aa, Mycobacterium bovis
EFPRLMVYRGPRRKGVRYFGPY

SEQ ID NO: 217503 - protein, 25 aa, Mycobacterium bovis
EFPVNFDVWWFKLPREGDAEFSFLP

SEQ ID NO: 217504 - protein, 24 aa, Mycobacterium bovis
EFRRRVGMLFQRPNPFPMSIMDNV

SEQ ID NO: 217505 - protein, 28 aa, Mycobacterium bovis
EFRYHGERPLWAWLVLEPGDISVCLHDP

SEQ ID NO: 217506 - protein, 22 aa, Mycobacterium bovis
EFTTRFGVARVCEFYAASEGNS

SEQ ID NO: 217507 - protein, 19 aa, Mycobacterium bovis
EFVAEHLPPGWPGPGALPP

SEQ ID NO: 217508 - protein, 27 aa, Mycobacterium bovis
EFVEHTGIPFLPMSMAKGLLPDSHPQS

SEQ ID NO: 217509 - protein, 27 aa, Mycobacterium bovis
EFVGEFRDFRRATIGSFNALREDFTAL

SEQ ID NO: 217510 - protein, 19 aa, Mycobacterium bovis
EFVPVHHGELTLPQIREIV

SEQ ID NO: 217511 - protein, 19 aa, Mycobacterium bovis
EFYAGLLGAYPLVSIEDPL

SEQ ID NO: 217512 - protein, 19 aa, Mycobacterium bovis
EFYDPQPGVPGRTVCKWGG

SEQ ID NO: 217513 - protein, 27 aa, Mycobacterium bovis
EGAHGLLVVTPYYSKPPQRGLQAHFTA

SEQ ID NO: 217514 - protein, 23 aa, Mycobacterium bovis
EGAMAEALLFRLTRDDWQRHRTV

SEQ ID NO: 217515 - protein, 17 aa, Mycobacterium bovis
EGARRFGGRWNPPLLFP

SEQ ID NO: 217516 - protein, 23 aa, Mycobacterium bovis
EGAYEQMWAADVAAMVGYHSGAS

SEQ ID NO: 217517 - protein, 21 aa, Mycobacterium bovis
EGDILFLEWTANSAVSRVDDG

SEQ ID NO: 217518 - protein, 17 aa, Mycobacterium bovis
EGDPQHLIDWKGNDWYF

SEQ ID NO: 217519 - protein, 24 aa, Mycobacterium bovis
EGFTDAYRDLAFPGGIRESGFTRL

SEQ ID NO: 217520 - protein, 17 aa, Mycobacterium bovis
EGGGRLVVELTPDEAAA

SEQ ID NO: 217521 - protein, 27 aa, Mycobacterium bovis
EGGQMPIHMRLPKLKGFRNRFRTEYEI

SEQ ID NO: 217522 - protein, 25 aa, Mycobacterium bovis
EGGTFLQRAIFHLPGLTAAVDELQR

SEQ ID NO: 217523 - protein, 37 aa, Mycobacterium bovis
EGIGSLDLIRILPETRRYLGWRLSLLDLIGADTAANL

SEQ ID NO: 217524 - protein, 24 aa, Mycobacterium bovis
EGIRQLFVKLLDDIPNALWDLKTQ

SEQ ID NO: 217525 - protein, 22 aa, Mycobacterium bovis
EGISLSSLALNCDILDPTDGDD

SEQ ID NO: 217526 - protein, 32 aa, Mycobacterium bovis
EGLFDPRLKRPIPYLPNMIGLITGRASAAERD

SEQ ID NO: 217527 - protein, 26 aa, Mycobacterium bovis
EGLPPGSALLVVKRGPNAGSRFLLDQ

SEQ ID NO: 217528 - protein, 18 aa, Mycobacterium bovis
EGLRMTWGRAVILEAMRR

SEQ ID NO: 217529 - protein, 18 aa, Mycobacterium bovis
EGNAQNFRILTSLEPKVV

SEQ ID NO: 217530 - protein, 24 aa, Mycobacterium bovis
EGNFALVPLSLYFAEGKVKVELAL

SEQ ID NO: 217531 - protein, 23 aa, Mycobacterium bovis
EGNLGLIRAVEKFDYTKGYKFST

SEQ ID NO: 217532 - protein, 23 aa, Mycobacterium bovis
EGPIEALPIAAFSMMRAMSTRND

SEQ ID NO: 217533 - protein, 18 aa, Mycobacterium bovis
EGQRRYVESLSAYARQFL

SEQ ID NO: 217534 - protein, 24 aa, Mycobacterium bovis
EGRDIGTVVFPDAPVKIFLTASAE

SEQ ID NO: 217535 - protein, 19 aa, Mycobacterium bovis
EGRGIVMRVPLEGGGRLVV

SEQ ID NO: 217536 - protein, 33 aa, Mycobacterium bovis
EGRINPDVKMNYLASPPLVIAYALAGTMDFDFQ

SEQ ID NO: 217537 - protein, 22 aa, Mycobacterium bovis
EGRPKHYWSIYQKMIVKGRDFD

SEQ ID NO: 217538 - protein, 26 aa, Mycobacterium bovis
EGRPRLRYWLDRLSTDGILAHAAVVY

SEQ ID NO: 217539 - protein, 23 aa, Mycobacterium bovis
EGTPFLDEIPLSAFFGTGVVVSI

SEQ ID NO: 217540 - protein, 17 aa, Mycobacterium bovis
EGVLFDNWLLAENGRFR

SEQ ID NO: 217541 - protein, 17 aa, Mycobacterium bovis
EGWLTELSTRDLREVFA

SEQ ID NO: 217542 - protein, 20 aa, Mycobacterium bovis
EGYDMFMAMLDGMKEESVGF

SEQ ID NO: 217543 - protein, 27 aa, Mycobacterium bovis
EGYGRALEFIAYRYALATGIIDETGFP

SEQ ID NO: 217544 - protein, 25 aa, Mycobacterium bovis
EHDAHLHLRRALVTVGLFGGDAPVR

SEQ ID NO: 217545 - protein, 27 aa, Mycobacterium bovis
EHEGKPFFGSLLEFITSGPVVAAIVEG

SEQ ID NO: 217546 - protein, 30 aa, Mycobacterium bovis
EHELKVIAQLRFPGYFLVVHDITRFCRDND

SEQ ID NO: 217547 - protein, 18 aa, Mycobacterium bovis
EHIVIVGSGFIAAEFAHV

SEQ ID NO: 217548 - protein, 21 aa, Mycobacterium bovis
EHLRRWFDDKVLRIFVFARRG

SEQ ID NO: 217549 - protein, 27 aa, Mycobacterium bovis
EHQAIVRDVLAAGDFWGGAGSVACQEF

SEQ ID NO: 217550 - protein, 18 aa, Mycobacterium bovis
EHRKSLTFALRFRAPDRT

SEQ ID NO: 217551 - protein, 24 aa, Mycobacterium bovis
EHRPEILLSFGFVPKVETRIGLIN

SEQ ID NO: 217552 - protein, 22 aa, Mycobacterium bovis
EHVFDFFLRNKRTEWANYRSHV

SEQ ID NO: 217553 - protein, 19 aa, Mycobacterium bovis
EIAGRLAARIGSGLLVDVV

SEQ ID NO: 217554 - protein, 23 aa, Mycobacterium bovis
EIALFTVTNPPRTVSVSTLMDGR

SEQ ID NO: 217555 - protein, 18 aa, Mycobacterium bovis
EIAPQWHLRMQAAVQRHV

SEQ ID NO: 217556 - protein, 26 aa, Mycobacterium bovis
EIAQCDFWFPPIELPVGFGQTRTAKQ

SEQ ID NO: 217557 - protein, 23 aa, Mycobacterium bovis
EIDHVPFVAPVARFAATAQSAEN

SEQ ID NO: 217558 - protein, 21 aa, Mycobacterium bovis
EIEALYYLHPLTGEVIRQVDS

SEQ ID NO: 217559 - protein, 18 aa, Mycobacterium bovis
EIEEGILPALYAAATPQA

SEQ ID NO: 217560 - protein, 23 aa, Mycobacterium bovis
EIERRWGGWLNGLTIDDAFVETQ

SEQ ID NO: 217561 - protein, 23 aa, Mycobacterium bovis
EIGFSQLLYDDHIGKVSLIGAGM

SEQ ID NO: 217562 - protein, 22 aa, Mycobacterium bovis
EIGRGRVYRLGRGRYGPGYIPR

SEQ ID NO: 217563 - protein, 17 aa, Mycobacterium bovis
EIHRLRALIVELERLYN

SEQ ID NO: 217564 - protein, 19 aa, Mycobacterium bovis
EILAEKIARWARARSAEIE

SEQ ID NO: 217565 - protein, 18 aa, Mycobacterium bovis
EILPRWGVQTVFVDGDDL

SEQ ID NO: 217566 - protein, 17 aa, Mycobacterium bovis
EILVRQRGTKFHPGVNV

SEQ ID NO: 217567 - protein, 19 aa, Mycobacterium bovis
EIMGLGPIEASKKALERAG

SEQ ID NO: 217568 - protein, 19 aa, Mycobacterium bovis
EINSARLYVGAGLAPMLDA

SEQ ID NO: 217569 - protein, 23 aa, Mycobacterium bovis
EINSLRMFIGAGTAPMLAAAAAW

SEQ ID NO: 217570 - protein, 24 aa, Mycobacterium bovis
EINTRGDIILFIDELHTLVGAGAA

SEQ ID NO: 217571 - protein, 23 aa, Mycobacterium bovis
EIPPGFSHCLLLSEARVVAAGLL

SEQ ID NO: 217572 - protein, 17 aa, Mycobacterium bovis
EIQAYDPVFFPGLAAEW

SEQ ID NO: 217573 - protein, 18 aa, Mycobacterium bovis
EIRLLSRFTGANPTVPVV

SEQ ID NO: 217574 - protein, 22 aa, Mycobacterium bovis
EIRPELRRLDLGKLLELKREWG

SEQ ID NO: 217575 - protein, 18 aa, Mycobacterium bovis
EISPLQPEIPYYSATSFD

SEQ ID NO: 217576 - protein, 26 aa, Mycobacterium bovis
EITLVTFERLVFDGILQEVVLFCGVV

SEQ ID NO: 217577 - protein, 22 aa, Mycobacterium bovis
EITSGEMYLGPGAGPMLAAAVA

SEQ ID NO: 217578 - protein, 24 aa, Mycobacterium bovis
EIVERYDLVLSFHCKQRFPAALID

SEQ ID NO: 217579 - protein, 26 aa, Mycobacterium bovis
EIVGRLRRRFPKLQDPPSDDICYATQ

SEQ ID NO: 217580 - protein, 22 aa, Mycobacterium bovis
EKDRLLAPLLPEMAAPPHPRAP

SEQ ID NO: 217581 - protein, 22 aa, Mycobacterium bovis
EKDVKRQLLLDALADELQVQVG

SEQ ID NO: 217582 - protein, 25 aa, Mycobacterium bovis
EKEKWTKYFLDPAQIRLLRGLKQSA

SEQ ID NO: 217583 - protein, 24 aa, Mycobacterium bovis
EKEQRILVFDLGGGTFDVSLLEIG

SEQ ID NO: 217584 - protein, 36 aa, Mycobacterium bovis; identical to SEQ ID NO: 114216

SEQ ID NO: 217585 - protein, 25 aa, Mycobacterium bovis
EKKRHEILQLELLKPKIAILDETDS

SEQ ID NO: 217586 - protein, 24 aa, Mycobacterium bovis
EKLDDVVFPLFPQGGGFPRNNDDK

SEQ ID NO: 217587 - protein, 27 aa, Mycobacterium bovis
EKLERLGLWGLMPRTVYDTLIWCIYSG

SEQ ID NO: 217588 - protein, 23 aa, Mycobacterium bovis
EKSTFIEVCYLLIYGELPDTDQL

SEQ ID NO: 217589 - protein, 18 aa, Mycobacterium bovis
EKTRLALAGLVASTANVL

SEQ ID NO: 217590 - protein, 32 aa, Mycobacterium bovis; identical to SEQ ID NO: 119826

SEQ ID NO: 217591 - protein, 38 aa, Mycobacterium bovis
EKVPSTPVSWLPFYHDMGLMLGIILPMINQDTAVLMSP

SEQ ID NO: 217592 - protein, 24 aa, Mycobacterium bovis
EKVRRKPFSVVLFDEIEKAHQEIY

SEQ ID NO: 217593 - protein, 25 aa, Mycobacterium bovis
EKWGKPYPAITRLWDSAWEEFIPFL

SEQ ID NO: 217594 - protein, 20 aa, Mycobacterium bovis
EKYYRTLDPFVALAAAAATT

SEQ ID NO: 217595 - protein, 21 aa, Mycobacterium bovis
ELAAELWLAAASFESVCSGLA

SEQ ID NO: 217596 - protein, 20 aa, Mycobacterium bovis
ELAAHWLSHGRWTDGWDPHR

SEQ ID NO: 217597 - protein, 33 aa, Mycobacterium bovis
ELAAQGKLLRLWRPPLRPGEWRTLGLFAADDNG

SEQ ID NO: 217598 - protein, 27 aa, Mycobacterium bovis
ELADAGPALLLPLRARGTVAGVVVVLS

SEQ ID NO: 217599 - protein, 27 aa, Mycobacterium bovis
ELADNALGFLYDTGLYLRFRATGPDDF

SEQ ID NO: 217600 - protein, 36 aa, Mycobacterium bovis
ELAGSAHFVWVRDTLRLGGKFPLKAGMLTSLGFGHV

SEQ ID NO: 217601 - protein, 23 aa, Mycobacterium bovis
ELAGWLAEALTKVDGIASAEVAG

SEQ ID NO: 217602 - protein, 21 aa, Mycobacterium bovis
ELAHLGIRVNAIAPGLIRSAM

SEQ ID NO: 217603 - protein, 19 aa, Mycobacterium bovis
ELALASYPGFTATAPPGDG

SEQ ID NO: 217604 - protein, 25 aa, Mycobacterium bovis
ELARDALREWLRRGGKPARLIEIAT

SEQ ID NO: 217605 - protein, 25 aa, Mycobacterium bovis
ELCEEAPFYTLGPLATDIAPAYDHI

SEQ ID NO: 217606 - protein, 17 aa, Mycobacterium bovis
ELDEHLVALPNGRYGWR

SEQ ID NO: 217607 - protein, 35 aa, Mycobacterium bovis
ELDGQTHTVSWPRTAKLLDVLLAAGLDAPFSCREG

SEQ ID NO: 217608 - protein, 25 aa, Mycobacterium bovis
ELDLHAPVARYWPEFGQAGKQAITL

SEQ ID NO: 217609 - protein, 21 aa, Mycobacterium bovis
ELDPVGLRQTWLDLHESWLID

SEQ ID NO: 217610 - protein, 26 aa, Mycobacterium bovis
ELDRRGLLRRIGGAPYLHTLISTVPT

SEQ ID NO: 217611 - protein, 17 aa, Mycobacterium bovis
ELDVAWMIFAHRVFQEL

SEQ ID NO: 217612 - protein, 22 aa, Mycobacterium bovis
ELDVFLVRKLGVPQWRELAMGA

SEQ ID NO: 217613 - protein, 24 aa, Mycobacterium bovis
ELEDRMRHPLYGKIIRTTKKVKAH

SEQ ID NO: 217614 - protein, 17 aa, Mycobacterium bovis
ELEHHANLIPWQELARR

SEQ ID NO: 217615 - protein, 19 aa, Mycobacterium bovis
ELFPLLLSVMSTGVTFVRS

SEQ ID NO: 217616 - protein, 18 aa, Mycobacterium bovis
ELFTALLLSLPGSPVLYY

SEQ ID NO: 217617 - protein, 19 aa, Mycobacterium bovis
ELGAYLDELPADASALDAK

SEQ ID NO: 217618 - protein, 24 aa, Mycobacterium bovis
ELGDTGRILLRPSGTEPMIRVMVE

SEQ ID NO: 217619 - protein, 25 aa, Mycobacterium bovis
ELGEQLPVYRPPLDMARLFNQPELG

SEQ ID NO: 217620 - protein, 18 aa, Mycobacterium bovis
ELGFESFVYATPVDQRGW

SEQ ID NO: 217621 - protein, 27 aa, Mycobacterium bovis
ELGIPDQIRDSCEAYLLVALENRIADR

SEQ ID NO: 217622 - protein, 22 aa, Mycobacterium bovis
ELGLSYLLPRAIGSSRAFEIML

SEQ ID NO: 217623 - protein, 35 aa, Mycobacterium bovis
ELGLTSPMSLLRFIKFILTEIFPGGRLPRISQVDY

SEQ ID NO: 217624 - protein, 24 aa, Mycobacterium bovis
ELGPVPIKLRESPGLMILGRQGCG

SEQ ID NO: 217625 - protein, 32 aa, Mycobacterium bovis
ELGRALVPSPLLGTTLAELALLAAAKPDAQAL

SEQ ID NO: 217626 - protein, 24 aa, Mycobacterium bovis
ELGVLRLMMKYDPHFFTFLEIPEV

SEQ ID NO: 217627 - protein, 27 aa, Mycobacterium bovis
ELGYKLPSLLLPIWDSELGAGLIATLR

SEQ ID NO: 217628 - protein, 25 aa, Mycobacterium bovis
ELGYRVRRFAARVVWKLAPDAPLPP

SEQ ID NO: 217629 - protein, 19 aa, Mycobacterium bovis
ELHLGFNFRLARTEFDAAE

SEQ ID NO: 217630 - protein, 20 aa, Mycobacterium bovis
ELILVIAPDFEHTDAVRAAG

SEQ ID NO: 217631 - protein, 21 aa, Mycobacterium bovis
ELKKHFRPEFLNRIDDIIVFH

SEQ ID NO: 217632 - protein, 19 aa, Mycobacterium bovis
ELLARMRALLRRTKPEDAA

SEQ ID NO: 217633 - protein, 17 aa, Mycobacterium bovis
ELLASSGFAARLAGRSA

SEQ ID NO: 217634 - protein, 30 aa, Mycobacterium bovis
ELLAVELSSFQLHWAPSLRPEAGAVLNIAE

SEQ ID NO: 217635 - protein, 18 aa, Mycobacterium bovis
ELLDLWAAAYPGGLGRAN

SEQ ID NO: 217636 - protein, 28 aa, Mycobacterium bovis
ELLSVAAGMPFPLFVKAVAGGGGRGMRR

SEQ ID NO: 217637 - protein, 18 aa, Mycobacterium bovis
ELLSYRQTFDLRRATLTR

SEQ ID NO: 217638 - protein, 24 aa, Mycobacterium bovis
ELMRYYADLIAEFRRRPANNLTSA

SEQ ID NO: 217639 - protein, 24 aa, Mycobacterium bovis
ELNSLRMFTGAGSAPMLAAAVAWD

SEQ ID NO: 217640 - protein, 21 aa, Mycobacterium bovis
ELPADTRWHPVSSLPPMAFDH

SEQ ID NO: 217641 - protein, 17 aa, Mycobacterium bovis
ELPDIKCVYWAGGNPFH

SEQ ID NO: 217642 - protein, 23 aa, Mycobacterium bovis
ELPGDPLALIAPAGSGAGAGALG

SEQ ID NO: 217643 - protein, 23 aa, Mycobacterium bovis
ELPMQMICILLGVPETDRHWLFE

SEQ ID NO: 217644 - protein, 31 aa, Mycobacterium bovis
ELQRKVRPLLPSDDPFYFPPAGYQHAVPGTV

SEQ ID NO: 217645 - protein, 29 aa, Mycobacterium bovis
ELQSPTFQPVRRFGWRIMPQNLSDAGVSW

SEQ ID NO: 217646 - protein, 21 aa, Mycobacterium bovis
ELRAPMEQATPLRRLGDPVDI

SEQ ID NO: 217647 - protein, 21 aa, Mycobacterium bovis
ELRPQLLDRFGLTVDVQASRD

SEQ ID NO: 217648 - protein, 32 aa, Mycobacterium bovis
ELRQKRLMTLIHLWLVHRFKAQAVHYVTPTDD

SEQ ID NO: 217649 - protein, 18 aa, Mycobacterium bovis
ELRRIAALCAAFDVDGMR

SEQ ID NO: 217650 - protein, 19 aa, Mycobacterium bovis
ELRRRRWSLCPAKRDNSVS

SEQ ID NO: 217651 - protein, 21 aa, Mycobacterium bovis
ELRYSVIREVLPTRRARTFDL

SEQ ID NO: 217652 - protein, 33 aa, Mycobacterium bovis
ELSNVANLPITLWPGMKIGQLCMLRLTSPSEHP

SEQ ID NO: 217653 - protein, 28 aa, Mycobacterium bovis
ELSRAVFSKGIFPAVDPLASSSTILDPS

SEQ ID NO: 217654 - protein, 20 aa, Mycobacterium bovis
ELSTIRLLAKLPTIAAYAYK

SEQ ID NO: 217655 - protein, 22 aa, Mycobacterium bovis
ELSVHYPFPIADLVALDDALTY

SEQ ID NO: 217656 - protein, 21 aa, Mycobacterium bovis
ELSVLADCWRIAAKSLRPLPV

SEQ ID NO: 217657 - protein, 18 aa, Mycobacterium bovis
ELTAALRALGVSAPIYLG

SEQ ID NO: 217658 - protein, 25 aa, Mycobacterium bovis
ELTGHLIFDRPPLGAEALHANSSHL

SEQ ID NO: 217659 - protein, 20 aa, Mycobacterium bovis
ELTLHVRRDLLPRVAQRLRD

SEQ ID NO: 217660 - protein, 18 aa, Mycobacterium bovis
ELTLIAPASARLLVASAL

SEQ ID NO: 217661 - protein, 18 aa, Mycobacterium bovis
ELTLRCLGPVFIGSGEKR

SEQ ID NO: 217662 - protein, 28 aa, Mycobacterium bovis
ELTRNLPRLIRPVATVLGPLLFQSPEMG

SEQ ID NO: 217663 - protein, 29 aa, Mycobacterium bovis
ELVKVTPMDFLRDTLLWAKLIDKYQGTMT

SEQ ID NO: 217664 - protein, 23 aa, Mycobacterium bovis
ELVPVYPTCHYLMGGIPTTVTGQ

SEQ ID NO: 217665 - protein, 17 aa, Mycobacterium bovis
ELVRIVDIQLAQLGKRL

SEQ ID NO: 217666 - protein, 25 aa, Mycobacterium bovis
ELVRRFYAHWFALDASVRDLFPPDM

SEQ ID NO: 217667 - protein, 25 aa, Mycobacterium bovis
ELVVRTRYFDQFFLDAAAAGVRQAV

SEQ ID NO: 217668 - protein, 28 aa, Mycobacterium bovis
EMAPPNLIRAILRAPVDLLFNGGIGTYI

SEQ ID NO: 217669 - protein, 18 aa, Mycobacterium bovis
EMGIRVRYLHSEVDTLRR

SEQ ID NO: 217670 - protein, 19 aa, Mycobacterium bovis
EMLTTAATDLAKIGSTITA

SEQ ID NO: 217671 - protein, 17 aa, Mycobacterium bovis
EMPFVKMMLAAESLGIA

SEQ ID NO: 217672 - protein, 24 aa, Mycobacterium bovis
EMRSRFWMGGPHIAVRKAPEVASK

SEQ ID NO: 217673 - protein, 26 aa, Mycobacterium bovis
EMTHDDWRWVIDVDLWGSIHTVEAFL

SEQ ID NO: 217674 - protein, 17 aa, Mycobacterium bovis
EMWLRADGRQRVRVGAL

SEQ ID NO: 217675 - protein, 21 aa, Mycobacterium bovis
EMYKYLVAVSREPDHDKIRAY

SEQ ID NO: 217676 - protein, 20 aa, Mycobacterium bovis
EMYPLPRPHQPLLCNALIAL

SEQ ID NO: 217677 - protein, 22 aa, Mycobacterium bovis
ENAPNLAWIIGYTNASWTLKSD

SEQ ID NO: 217678 - protein, 25 aa, Mycobacterium bovis
ENGRSWSRWSFIGAGAPTALTVREG

SEQ ID NO: 217679 - protein, 24 aa, Mycobacterium bovis
ENKLLALLHRFGIAAPASADRSRA

SEQ ID NO: 217680 - protein, 24 aa, Mycobacterium bovis
ENKYRLIFEKLRLEPGDRLLDVGC

SEQ ID NO: 217681 - protein, 24 aa, Mycobacterium bovis
ENLEAFLRVMVYDKNLITPELVDQ

SEQ ID NO: 217682 - protein, 17 aa, Mycobacterium bovis
ENLLRRNAAVTGHRLLR

SEQ ID NO: 217683 - protein, 21 aa, Mycobacterium bovis
ENLQPLIFGLSQMISDYNAAR

SEQ ID NO: 217684 - protein, 17 aa, Mycobacterium bovis
ENMSAIHAIYRAAGLPS

SEQ ID NO: 217685 - protein, 19 aa, Mycobacterium bovis
ENPDSYLAYGFAVHNCTAP

SEQ ID NO: 217686 - protein, 29 aa, Mycobacterium bovis
ENPQRPWEHPDFWDIWKASLQGVLATRPD

SEQ ID NO: 217687 - protein, 19 aa, Mycobacterium bovis
ENPQWYRNLPPNPDTHIQI

SEQ ID NO: 217688 - protein, 32 aa, Mycobacterium bovis
ENPSFSVVAPLLSRSLILQLRPLTAEDTRAVV

SEQ ID NO: 217689 - protein, 25 aa, Mycobacterium bovis
ENSAGYLLPYLVPGLSVLDVGCGPG

SEQ ID NO: 217690 - protein, 25 aa, Mycobacterium bovis
ENSPGFLGFQLLRPVKGEERYFVVT

SEQ ID NO: 217691 - protein, 24 aa, Mycobacterium bovis
ENVATIAWVGYQPPPVLASWNTVD

SEQ ID NO: 217692 - protein, 21 aa, Mycobacterium bovis
ENWDAVLKVHLYGGYHVLRAA

SEQ ID NO: 217693 - protein, 20 aa, Mycobacterium bovis
ENYHRLTTPSTWLEALVKTY

SEQ ID NO: 217694 - protein, 41 aa, Mycobacterium bovis
ENYRGAMGLNWYLTDPTLQFIMAYYLRPDELAFAEPHLTRI

SEQ ID NO: 217695 - protein, 18 aa, Mycobacterium bovis
EPAAWIAEGLFGYLPPDA

SEQ ID NO: 217696 - protein, 23 aa, Mycobacterium bovis
EPANGPPPPGRWVRRKPAAAARL

SEQ ID NO: 217697 - protein, 31 aa, Mycobacterium bovis
EPASPIYNFRYPNMLRLRYEKKRNLPRALLA

SEQ ID NO: 217698 - protein, 25 aa, Mycobacterium bovis
EPDCLLDSLLLEDPGLLADDLQVPG

SEQ ID NO: 217699 - protein, 26 aa, Mycobacterium bovis
EPDDGFVRVIYRWSRTGDLAAALAAA

SEQ ID NO: 217700 - protein, 25 aa, Mycobacterium bovis
EPDVDRRVEFWPTVAIRSALESGDI

SEQ ID NO: 217701 - protein, 20 aa, Mycobacterium bovis
EPDVELPFAAQPRVCDAEQS

SEQ ID NO: 217702 - protein, 17 aa, Mycobacterium bovis
EPDWLVWTHGCPAGESV

SEQ ID NO: 217703 - protein, 27 aa, Mycobacterium bovis
EPEFGNLMLYSRLRLATAASWSIRYVV

SEQ ID NO: 217704 - protein, 23 aa, Mycobacterium bovis
EPEGRFRVRKRRRGRIGTKRSSI

SEQ ID NO: 217705 - protein, 26 aa, Mycobacterium bovis
EPGAYICVYPFVRSYEWYLLPDEERR

SEQ ID NO: 217706 - protein, 24 aa, Mycobacterium bovis
EPGDFVILNWRAVCGQCRACKRGR

SEQ ID NO: 217707 - protein, 26 aa, Mycobacterium bovis
EPGNSLFITVNCWGRLVTGVGAALGK

SEQ ID NO: 217708 - protein, 30 aa, Mycobacterium bovis
EPKAVLLANRTFFAVPDILQKEGLNWVTWV

SEQ ID NO: 217709 - protein, 22 aa, Mycobacterium bovis
EPKVPRAARVAVRWLRAVALDR

SEQ ID NO: 217710 - protein, 30 aa, Mycobacterium bovis
EPLAGQPLDRPFAWALIKLDGADTLLMHAV

SEQ ID NO: 217711 - protein, 21 aa, Mycobacterium bovis
EPLDADAWFDTVRRAAPFATL

SEQ ID NO: 217712 - protein, 35 aa, Mycobacterium bovis
EPLGVVGQIIPWNFPILMAAWKLAPALAAGNTAVL

SEQ ID NO: 217713 - protein, 23 aa, Mycobacterium bovis
EPLRRRVLARLRDLGQPIVLTVP

SEQ ID NO: 217714 - protein, 35 aa, Mycobacterium bovis
EPMGVVGVITPWNFPMVIASWAIAPALAAGNAVLV

SEQ ID NO: 217715 - protein, 21 aa, Mycobacterium bovis
EPPAAPLPRYPGGTSPRALSL

SEQ ID NO: 217716 - protein, 17 aa, Mycobacterium bovis
EPPLVLFCPTKVSRSWQ

SEQ ID NO: 217717 - protein, 17 aa, Mycobacterium bovis
EPRFPSFKGIMAAKKKE

SEQ ID NO: 217718 - protein, 18 aa, Mycobacterium bovis
EPRLGLILEIAAAAGLIA

SEQ ID NO: 217719 - protein, 30 aa, Mycobacterium bovis
EPRLRVPDEFGLSRYLAAGLAALQTVDPKL

SEQ ID NO: 217720 - protein, 25 aa, Mycobacterium bovis
EPRVLQIRALVLGGALDWLKDNKAS

SEQ ID NO: 217721 - protein, 18 aa, Mycobacterium bovis
EPSEAVVAAARWARSELD

SEQ ID NO: 217722 - protein, 17 aa, Mycobacterium bovis
EPSLLAVEPPDHTRYRK

SEQ ID NO: 217723 - protein, 24 aa, Mycobacterium bovis
EPSMDGVLLHYFLHAEPTGVAAWQ

SEQ ID NO: 217724 - protein, 19 aa, Mycobacterium bovis
EPTTRWWPLTVNVGGDSGP

SEQ ID NO: 217725 - protein, 19 aa, Mycobacterium bovis
EPVIWQLVDEDAPLRPRSL

SEQ ID NO: 217726 - protein, 18 aa, Mycobacterium bovis
EPVPVLAALIQTGVAIAT

SEQ ID NO: 217727 - protein, 25 aa, Mycobacterium bovis
EQAATMLPFSWQGVSLHAAGASRVR

SEQ ID NO: 217728 - protein, 25 aa, Mycobacterium bovis
EQAFYAALEFWSALHGFVLLEMTGV

SEQ ID NO: 217729 - protein, 23 aa, Mycobacterium bovis
EQAQQLLLRLLPDSGNAHRVGIT

SEQ ID NO: 217730 - protein, 25 aa, Mycobacterium bovis
EQDLRGLLGAFMFTGPQLEQPAGTL

SEQ ID NO: 217731 - protein, 23 aa, Mycobacterium bovis
EQHPLLTVIADHSLALLEVIRAI

SEQ ID NO: 217732 - protein, 24 aa, Mycobacterium bovis
EQIKDLLGRELLDQRFAGMKQALA

SEQ ID NO: 217733 - protein, 24 aa, Mycobacterium bovis
EQKQKWLPDLTSGRALAGFGLTEP

SEQ ID NO: 217734 - protein, 20 aa, Mycobacterium bovis
EQLEIELNWIDEHIGDHPYG

SEQ ID NO: 217735 - protein, 17 aa, Mycobacterium bovis
EQLPFVEINASYYPKRP

SEQ ID NO: 217736 - protein, 24 aa, Mycobacterium bovis
EQLRLVVGGRWLSPRNPLTGQFPA

SEQ ID NO: 217737 - protein, 28 aa, Mycobacterium bovis
EQPRQEDLLNRWTWIPFGAGRHRCVGAA

SEQ ID NO: 217738 - protein, 33 aa, Mycobacterium bovis
EQQLLAAINAPTQALLGRPLIGNGADGAPGTGQ

SEQ ID NO: 217739 - protein, 22 aa, Mycobacterium bovis
EQRPSFRRTVKWRTGSEGRIST

SEQ ID NO: 217740 - protein, 17 aa, Mycobacterium bovis
EQRSLEDVFLDLTGRKL

SEQ ID NO: 217741 - protein, 30 aa, Mycobacterium bovis
EQSKNPVLQLFIDILMRLTKRYVQKSGTQS

SEQ ID NO: 217742 - protein, 25 aa, Mycobacterium bovis
EQTDRLPRFMRYLAAITAQELNVAE

SEQ ID NO: 217743 - protein, 21 aa, Mycobacterium bovis
EQTIIEYPNPAPLKATLVARR

SEQ ID NO: 217744 - protein, 26 aa, Mycobacterium bovis
EQTPASVLYLMSLIGDLLPPGVVNVV

SEQ ID NO: 217745 - protein, 24 aa, Mycobacterium bovis
EQVGPMLADWAKWGQARHNYFLRP

SEQ ID NO: 217746 - protein, 18 aa, Mycobacterium bovis
EQVMTARGLALVRDDSLT

SEQ ID NO: 217747 - protein, 20 aa, Mycobacterium bovis
EQYWAAAGRPGPVPLALGPV

SEQ ID NO: 217748 - protein, 24 aa, Mycobacterium bovis
ERAAKLVGIELPKKAAPAKKAAPA

SEQ ID NO: 217749 - protein, 23 aa, Mycobacterium bovis
ERAAVFLRAADLLAGPWREKIAA

SEQ ID NO: 217750 - protein, 23 aa, Mycobacterium bovis
ERAKLVEWLLEQGITPDEIRATN

SEQ ID NO: 217751 - protein, 25 aa, Mycobacterium bovis
ERARAGLFLAMQYPVEVPGVSMSNF

SEQ ID NO: 217752 - protein, 22 aa, Mycobacterium bovis
ERARLRIFFEFLRGADETGTSA

SEQ ID NO: 217753 - protein, 17 aa, Mycobacterium bovis
ERATTCAPLTWPEGWRR

SEQ ID NO: 217754 - protein, 28 aa, Mycobacterium bovis
ERAVQAWRGFSRWLMRAYDVLVDEDQIT

SEQ ID NO: 217755 - protein, 26 aa, Mycobacterium bovis
ERCAFGLQLIAPRLPPFDVPDGHTED

SEQ ID NO: 217756 - protein, 24 aa, Mycobacterium bovis
ERDAIPLLDQLYGGALRMTRNPAD

SEQ ID NO: 217757 - protein, 36 aa, Mycobacterium bovis
ERDRTLFRRDQIGIVFQFFNLIPTLTVLENITLPQE

SEQ ID NO: 217758 - protein, 30 aa, Mycobacterium bovis
ERDYTAIYDKWLTLGPLIDQFGMTTKGYTV

SEQ ID NO: 217759 - protein, 20 aa, Mycobacterium bovis
EREFPSFQAMLDLTIAAAPH

SEQ ID NO: 217760 - protein, 25 aa, Mycobacterium bovis
EREYRTRLKTYLESQLEELGQRGSA

SEQ ID NO: 217761 - protein, 24 aa, Mycobacterium bovis
ERGEVDVLPFQLVTMGQPIADFAN

SEQ ID NO: 217762 - protein, 17 aa, Mycobacterium bovis
ERGFLAVRLEDIGAAAG

SEQ ID NO: 217763 - protein, 18 aa, Mycobacterium bovis
ERILAELAEHARATFAEI

SEQ ID NO: 217764 - protein, 19 aa, Mycobacterium bovis
ERKGYLRRDPNRPRAVNVR

SEQ ID NO: 217765 - protein, 24 aa, Mycobacterium bovis
ERLEPALRTVPLELARTWVGLAGT

SEQ ID NO: 217766 - protein, 29 aa, Mycobacterium bovis
ERLETICRQIMLYHLDRGWADHLAYLADI

SEQ ID NO: 217767 - protein, 18 aa, Mycobacterium bovis
ERLGFRRDQLSARVDDLS

SEQ ID NO: 217768 - protein, 17 aa, Mycobacterium bovis
ERLLLSYAAELARRRRA

SEQ ID NO: 217769 - protein, 30 aa, Mycobacterium bovis
ERLLRLGLQSLRLWREGSFLDGLGPQLVTA

SEQ ID NO: 217770 - protein, 26 aa, Mycobacterium bovis
ERLRQTIPELPWLSRRRIQQEWGVSD

SEQ ID NO: 217771 - protein, 19 aa, Mycobacterium bovis
ERMRLGALARHIAEELPLL

SEQ ID NO: 217772 - protein, 25 aa, Mycobacterium bovis
ERNQPWPYAHRLPPSGASNGLVRRV

SEQ ID NO: 217773 - protein, 21 aa, Mycobacterium bovis
ERPFMEFTPGYVLRSLDELPK

SEQ ID NO: 217774 - protein, 23 aa, Mycobacterium bovis
ERPVAVDSLWFDALRSVAVDHRD

SEQ ID NO: 217775 - protein, 21 aa, Mycobacterium bovis
ERPVTSLIRASAAAALVCVGA

SEQ ID NO: 217776 - protein, 25 aa, Mycobacterium bovis
ERREDGFFYIKGRSSEMIICGGVNI

SEQ ID NO: 217777 - protein, 25 aa, Mycobacterium bovis
ERRRRRALRLLTKRVASSAGTGALL

SEQ ID NO: 217778 - protein, 22 aa, Mycobacterium bovis
ERSADAIYLLYTGGTTGFPKGV

SEQ ID NO: 217779 - protein, 24 aa, Mycobacterium bovis
ERSSHTWFVLTHLLGKADVRNYDG

SEQ ID NO: 217780 - protein, 22 aa, Mycobacterium bovis
ERTLLVITRGFGDALRIAYQNR

SEQ ID NO: 217781 - protein, 24 aa, Mycobacterium bovis
ERTTLWHSTFAQCSMLGSVFVACR

SEQ ID NO: 217782 - protein, 18 aa, Mycobacterium bovis
ERVELRYTMPLGEIIFDF

SEQ ID NO: 217783 - protein, 24 aa, Mycobacterium bovis
ERVRRIYYYVRDVPYDVLASFRYL

SEQ ID NO: 217784 - protein, 24 aa, Mycobacterium bovis
ERWKETAFQYGWLLATADSDRYGG

SEQ ID NO: 217785 - protein, 24 aa, Mycobacterium bovis
ERYDTFFKKFYNLTPDDGRMLLHT

SEQ ID NO: 217786 - protein, 17 aa, Mycobacterium bovis
ERYRWRHGAAVSVGLVF

SEQ ID NO: 217787 - protein, 26 aa, Mycobacterium bovis
ESAQTLLENLFFKEKRYDLARVGRYK

SEQ ID NO: 217788 - protein, 20 aa, Mycobacterium bovis
ESAWSVFISARWQADFRADV

SEQ ID NO: 217789 - protein, 27 aa, Mycobacterium bovis
ESCDTLIVIPNDRLLQMGDAAVSLMDA

SEQ ID NO: 217790 - protein, 23 aa, Mycobacterium bovis
ESDNLAVKGIYWARRDAEPHRRR

SEQ ID NO: 217791 - protein, 23 aa, Mycobacterium bovis
ESEAFYMRVAAPGDLRCEGAQLG

SEQ ID NO: 217792 - protein, 21 aa, Mycobacterium bovis
ESFGFKYGLPMDADMVMDVRF

SEQ ID NO: 217793 - protein, 19 aa, Mycobacterium bovis
ESFKVLLKELQSLCLNVEV

SEQ ID NO: 217794 - protein, 22 aa, Mycobacterium bovis
ESIEIPAIRRSVDPRRQLTVVG

SEQ ID NO: 217795 - protein, 17 aa, Mycobacterium bovis
ESIPIRIPVDIPASVID

SEQ ID NO: 217796 - protein, 26 aa, Mycobacterium bovis
ESKLPKVFFVNWFRRGDDGRFLWPGF

SEQ ID NO: 217797 - protein, 22 aa, Mycobacterium bovis
ESLEQRGLLRRPIIPQGCSHNA

SEQ ID NO: 217798 - protein, 18 aa, Mycobacterium bovis
ESLVAGGSLVLRAARPGQ

SEQ ID NO: 217799 - protein, 31 aa, Mycobacterium bovis
ESLYGAWSANPFPFLRQIIANQQVYWQQIAA

SEQ ID NO: 217800 - protein, 27 aa, Mycobacterium bovis
ESNAPVLLGLIGLWYSNFFGAQSRTVL

SEQ ID NO: 217801 - protein, 24 aa, Mycobacterium bovis
ESPKPLGMPLQYMVSGMAVKATHK

SEQ ID NO: 217802 - protein, 24 aa, Mycobacterium bovis
ESPWALMHFMVRLPEVGVAGEGAA

SEQ ID NO: 217803 - protein, 35 aa, Mycobacterium bovis
ESPYFPLHNALFDLPPYRGKWPEIWVAAHGPRMLR

SEQ ID NO: 217804 - protein, 24 aa, Mycobacterium bovis
ESRRFLLISDGATKGLPLPFGATL

SEQ ID NO: 217805 - protein, 26 aa, Mycobacterium bovis
ESSLSEGLLYERRLFHSAFATEDQSE

SEQ ID NO: 217806 - protein, 26 aa, Mycobacterium bovis
ESSYRLRAVSAVGLRFPLNGTANGKA

SEQ ID NO: 217807 - protein, 19 aa, Mycobacterium bovis
ESTLRYWRYWAPVRAAIAL

SEQ ID NO: 217808 - protein, 17 aa, Mycobacterium bovis
ESTPWPTYPLMYRVSAA

SEQ ID NO: 217809 - protein, 30 aa, Mycobacterium bovis
ESTTMSHLLLDLDLLGPLRARLADGLPAYG

SEQ ID NO: 217810 - protein, 26 aa, Mycobacterium bovis
ESTVQRLLLDPLQLAHTRYFSDQIIG

SEQ ID NO: 217811 - protein, 17 aa, Mycobacterium bovis
ESVPLTFPSLVESGSRT

SEQ ID NO: 217812 - protein, 23 aa, Mycobacterium bovis
ESYAPLMAYLVRSMQSGGELAKM

SEQ ID NO: 217813 - protein, 27 aa, Mycobacterium bovis
ESYPTAMLMVFKLHRDFDIAEALKHGT

SEQ ID NO: 217814 - protein, 23 aa, Mycobacterium bovis
ETAPGLRWPDLALQGGRLNWSAV

SEQ ID NO: 217815 - protein, 23 aa, Mycobacterium bovis
ETAQRLLPRPLADTTIHVAVALE

SEQ ID NO: 217816 - protein, 18 aa, Mycobacterium bovis
ETATRFVADPFAAQPGSR

SEQ ID NO: 217817 - protein, 18 aa, Mycobacterium bovis
ETDKATVKLLFRDAYALG

SEQ ID NO: 217818 - protein, 23 aa, Mycobacterium bovis
ETDKPFLMPVEDVFTITGRGTVV

SEQ ID NO: 217819 - protein, 25 aa, Mycobacterium bovis
ETEQILFRRLAPFVGGFDLAAVRAV

SEQ ID NO: 217820 - protein, 17 aa, Mycobacterium bovis
ETGCRIVLPEGADPFVL

SEQ ID NO: 217821 - protein, 18 aa, Mycobacterium bovis
ETGLLPAELFAEAISQVA

SEQ ID NO: 217822 - protein, 21 aa, Mycobacterium bovis
ETGRRPFWTYAHVPSGSTLDA

SEQ ID NO: 217823 - protein, 24 aa, Mycobacterium bovis
ETGYVMPHWPRPWGRAAGAVEQLV

SEQ ID NO: 217824 - protein, 21 aa, Mycobacterium bovis
ETHTWAYWRAPLQAMLPDLQR

SEQ ID NO: 217825 - protein, 23 aa, Mycobacterium bovis
ETIKARLPVWKHQFFEDGTDEWV

SEQ ID NO: 217826 - protein, 24 aa, Mycobacterium bovis
ETKRKFREALDRKMAQSSSGSDHK

SEQ ID NO: 217827 - protein, 19 aa, Mycobacterium bovis
ETLVYMAFYERCGAVFCRN

SEQ ID NO: 217828 - protein, 25 aa, Mycobacterium bovis
ETQAVLALLESPLGQLLHAAATGKL

SEQ ID NO: 217829 - protein, 22 aa, Mycobacterium bovis
ETRHRPGWLPIPLRSIARLTAS

SEQ ID NO: 217830 - protein, 20 aa, Mycobacterium bovis
ETRIGLINWLIQDPGNAAVA

SEQ ID NO: 217831 - protein, 17 aa, Mycobacterium bovis
ETRIVVTGNYRAWRHFI

SEQ ID NO: 217832 - protein, 22 aa, Mycobacterium bovis
ETRKFRVEFLTPTAFKQSGEYV

SEQ ID NO: 217833 - protein, 29 aa, Mycobacterium bovis
ETRRILDRLYGYEVSPVLWKKVAPKLSAG

SEQ ID NO: 217834 - protein, 28 aa, Mycobacterium bovis
ETSKRYMHHYNFPPFSTGETGRVGSPKR

SEQ ID NO: 217835 - protein, 27 aa, Mycobacterium bovis
ETSVPYFSLAMLPGGRRRALLTGTVAV

SEQ ID NO: 217836 - protein, 17 aa, Mycobacterium bovis
ETSWLDQPIPALDGHTP

SEQ ID NO: 217837 - protein, 17 aa, Mycobacterium bovis
ETTPFTLENGLLTGIRK

SEQ ID NO: 217838 - protein, 32 aa, Mycobacterium bovis; identical to SEQ ID NO: 198861

SEQ ID NO: 217839 - protein, 25 aa, Mycobacterium bovis
ETVDLAGDYLDFLRICVIATEFELV

SEQ ID NO: 217840 - protein, 22 aa, Mycobacterium bovis
ETVRIYSNGLWRDAPLRRREAM

SEQ ID NO: 217841 - protein, 18 aa, Mycobacterium bovis
ETVRRRDALPRIAQAVVV

SEQ ID NO: 217842 - protein, 24 aa, Mycobacterium bovis
EVAAMMKATLPRAFIIGPDGSTTV

SEQ ID NO: 217843 - protein, 18 aa, Mycobacterium bovis
EVALPASIRFQQGAYRIH

SEQ ID NO: 217844 - protein, 18 aa, Mycobacterium bovis
EVARRWLAALSADQIGIC

SEQ ID NO: 217845 - protein, 25 aa, Mycobacterium bovis
EVAVRELYAPLLAAGVPFLVTDLQT

SEQ ID NO: 217846 - protein, 28 aa, Mycobacterium bovis
EVCGYHCWAEFFVAGLGWLPADASCATK

SEQ ID NO: 217847 - protein, 25 aa, Mycobacterium bovis
EVCLQMHLLNLSFAIAVRKRAKADA

SEQ ID NO: 217848 - protein, 24 aa, Mycobacterium bovis
EVDEPYVLILPTYGGGRANPGLDA

SEQ ID NO: 217849 - protein, 25 aa, Mycobacterium bovis
EVDIRPKISLPDLSALTVSVDPIEI

SEQ ID NO: 217850 - protein, 23 aa, Mycobacterium bovis
EVEALQLEYTWIKEFDPRFNVRY

SEQ ID NO: 217851 - protein, 17 aa, Mycobacterium bovis
EVELAKRIEAGLYATQL

SEQ ID NO: 217852 - protein, 26 aa, Mycobacterium bovis
EVEPRMLLVHFLRDQLRLTGTHWGCD

SEQ ID NO: 217853 - protein, 35 aa, Mycobacterium bovis
EVFDLRPGAIIRDLNLLRPIYAPTAAYGHFGRTDV

SEQ ID NO: 217854 - protein, 18 aa, Mycobacterium bovis
EVFGPVASVFRAANIDEA

SEQ ID NO: 217855 - protein, 24 aa, Mycobacterium bovis
EVGPTLHRLIRGADGRVIVACFAS

SEQ ID NO: 217856 - protein, 24 aa, Mycobacterium bovis
EVGRLWDRHLLNCAVIGELLERGD

SEQ ID NO: 217857 - protein, 36 aa, Mycobacterium bovis
EVIPPDYQLSWYDHVFFISVWWGWQDHFREIVNVDR

SEQ ID NO: 217858 - protein, 18 aa, Mycobacterium bovis
EVIRILQRYKDLQDIIAI

SEQ ID NO: 217859 - protein, 17 aa, Mycobacterium bovis
EVIRRRLSGMKPGDVYA

SEQ ID NO: 217860 - protein, 26 aa, Mycobacterium bovis
EVIRVRGLTFRYPKAAEPAVRGMEFT

SEQ ID NO: 217861 - protein, 17 aa, Mycobacterium bovis
EVLCIRRRIRTGDQPLA

SEQ ID NO: 217862 - protein, 29 aa, Mycobacterium bovis
EVLRLRWRPGCMPLPQRVIRARVRGRQVY

SEQ ID NO: 217863 - protein, 31 aa, Mycobacterium bovis
EVLTELWALIGYRIPTPIPRIGYAEAMRRFG

SEQ ID NO: 217864 - protein, 18 aa, Mycobacterium bovis
EVLVKYTAAGLCHSDLHL

SEQ ID NO: 217865 - protein, 21 aa, Mycobacterium bovis
EVLWEQLHDLEWVNALGALTG

SEQ ID NO: 217866 - protein, 18 aa, Mycobacterium bovis
EVMQANLAELPLPDASVD

SEQ ID NO: 217867 - protein, 17 aa, Mycobacterium bovis
EVNSVRMYAGPGSAPMV

SEQ ID NO: 217868 - protein, 19 aa, Mycobacterium bovis
EVPGTIVSVLRAAAGAVDQ

SEQ ID NO: 217869 - protein, 17 aa, Mycobacterium bovis
EVPPALRRLVLEGQAAV

SEQ ID NO: 217870 - protein, 27 aa, Mycobacterium bovis
EVQKSNLVVLWTFPNSALAIAGERVVW

SEQ ID NO: 217871 - protein, 22 aa, Mycobacterium bovis
EVRPDRSTTLALRWLVGYSRQR

SEQ ID NO: 217872 - protein, 18 aa, Mycobacterium bovis
EVSITRRMFRDGASEYEI

SEQ ID NO: 217873 - protein, 20 aa, Mycobacterium bovis
EVSLLLATQFRTHAATYQTA

SEQ ID NO: 217874 - protein, 21 aa, Mycobacterium bovis
EVSTAVAALFSSHAQAYQAAS

SEQ ID NO: 217875 - protein, 30 aa, Mycobacterium bovis; identical to SEQ ID NO: 114408

SEQ ID NO: 217876 - protein, 26 aa, Mycobacterium bovis
EVVFGWRSFELYPPQVRVAGAIPIQV

SEQ ID NO: 217877 - protein, 26 aa, Mycobacterium bovis
EVVGQDHLLAPGSPLRRLVEGSGVAS

SEQ ID NO: 217878 - protein, 19 aa, Mycobacterium bovis
EVVVIYLAAANRDPAVFPD

SEQ ID NO: 217879 - protein, 17 aa, Mycobacterium bovis
EVYWARYCDGIRTVGPA

SEQ ID NO: 217880 - protein, 17 aa, Mycobacterium bovis
EWARFVAACDLVRGAHA

SEQ ID NO: 217881 - protein, 26 aa, Mycobacterium bovis
EWEWPANPRFLMCTPLSHAGAAFFTP

SEQ ID NO: 217882 - protein, 34 aa, Mycobacterium bovis
EWFGENVPISPIWLCPLRLRDHAGWPLYPIRPDR

SEQ ID NO: 217883 - protein, 27 aa, Mycobacterium bovis
EWKDGEALFLRCNIWREAAENVAESLT

SEQ ID NO: 217884 - protein, 21 aa, Mycobacterium bovis
EWQRLMVALSAFDLIESTASH

SEQ ID NO: 217885 - protein, 21 aa, Mycobacterium bovis
EWVRLYPNRFAGLAAVDLDRP

SEQ ID NO: 217886 - protein, 26 aa, Mycobacterium bovis
EYAAPSFLPKRPLVEVLRDLASRIYT

SEQ ID NO: 217887 - protein, 25 aa, Mycobacterium bovis
EYEIKDVWYVVGLRGTGSNTLVVKD

SEQ ID NO: 217888 - protein, 35 aa, Mycobacterium bovis; identical to SEQ ID NO: 114415

SEQ ID NO: 217889 - protein, 19 aa, Mycobacterium bovis
EYGRTVVVLTIDPAKRLAQ

SEQ ID NO: 217890 - protein, 18 aa, Mycobacterium bovis
EYHWGPDWVCWDADQTFQ

SEQ ID NO: 217891 - protein, 22 aa, Mycobacterium bovis
EYLRQRATLIDPKRAMPAATGI

SEQ ID NO: 217892 - protein, 18 aa, Mycobacterium bovis
EYPLLPDELAEALAGFIA

SEQ ID NO: 217893 - protein, 18 aa, Mycobacterium bovis
EYRFTRTGLALPGDPVVQ

SEQ ID NO: 217894 - protein, 23 aa, Mycobacterium bovis
EYRRIRQILGRRPTDTELAMYSV

SEQ ID NO: 217895 - protein, 25 aa, Mycobacterium bovis
EYVAVTRRFTGVIPGLRASHSIASY

SEQ ID NO: 217896 - protein, 18 aa, Mycobacterium bovis
EYVLPTFRMFGMTKFYKH

SEQ ID NO: 217897 - protein, 17 aa, Mycobacterium bovis
EYYAYSPGFDKKAGEWF

SEQ ID NO: 217898 - protein, 24 aa, Mycobacterium bovis
EYYKSSVLPQIEGLDGFCSASLLV

SEQ ID NO: 217899 - protein, 24 aa, Mycobacterium bovis
FAAACLPYLSWLTQASADCAAAAA

SEQ ID NO: 217900 - protein, 26 aa, Mycobacterium bovis
FAAALTRLLTATLLGLLAGSPCECRS

SEQ ID NO: 217901 - protein, 17 aa, Mycobacterium bovis
FAADYLLNQADIGMACA

SEQ ID NO: 217902 - protein, 18 aa, Mycobacterium bovis
FAALSLEPPLVLFCPTKV

SEQ ID NO: 217903 - protein, 17 aa, Mycobacterium bovis
FAAPTTLRFEPGITAVV

SEQ ID NO: 217904 - protein, 22 aa, Mycobacterium bovis
FAAPVWMPRAKRTSIRRVQEAI

SEQ ID NO: 217905 - protein, 22 aa, Mycobacterium bovis
FAAVALASIRELGLNPQIVNVN

SEQ ID NO: 217906 - protein, 17 aa, Mycobacterium bovis
FAAVRQFRASVCVLGPL

SEQ ID NO: 217907 - protein, 31 aa, Mycobacterium bovis
FADAPAAWRRYLEAGILIRDVGIPGYLRATT

SEQ ID NO: 217908 - protein, 17 aa, Mycobacterium bovis
FADDPALLLKTAAEIAA

SEQ ID NO: 217909 - protein, 19 aa, Mycobacterium bovis
FADFLQREKLVLRSDLLRP

SEQ ID NO: 217910 - protein, 26 aa, Mycobacterium bovis
FADQRTFGGWLLADLVTVDGSVVPVP

SEQ ID NO: 217911 - protein, 21 aa, Mycobacterium bovis
FADVLIAFGRFPIIDDREPQL

SEQ ID NO: 217912 - protein, 31 aa, Mycobacterium bovis
FADVMPEDLIKFGLIPEFIGRLPVVASVTNL

SEQ ID NO: 217913 - protein, 18 aa, Mycobacterium bovis
FADYDAGLHWFRAALDAR

SEQ ID NO: 217914 - protein, 21 aa, Mycobacterium bovis
FAEELVRIIGVLRGMQLKKVP

SEQ ID NO: 217915 - protein, 23 aa, Mycobacterium bovis
FAEFGGWLMPVSYAGTVSEHNAT

SEQ ID NO: 217916 - protein, 24 aa, Mycobacterium bovis
FAERFGRFNFAAAALRPAYGMAEA

SEQ ID NO: 217917 - protein, 22 aa, Mycobacterium bovis
FAFSHRSYLDGMLLPEAILANR

SEQ ID NO: 217918 - protein, 19 aa, Mycobacterium bovis
FAHEGPMAARLGLAGWPRA

SEQ ID NO: 217919 - protein, 18 aa, Mycobacterium bovis
FAHRVFQELAGLATLPGL

SEQ ID NO: 217920 - protein, 23 aa, Mycobacterium bovis
FAKALVYEMPHTLAALDCGALSE

SEQ ID NO: 217921 - protein, 18 aa, Mycobacterium bovis
FALTERDLLRTDLFRTKA

SEQ ID NO: 217922 - protein, 25 aa, Mycobacterium bovis
FALTVPPAEVVANRALLAELTATNI

SEQ ID NO: 217923 - protein, 20 aa, Mycobacterium bovis
FAPLNSWPDNASLDKARRLL

SEQ ID NO: 217924 - protein, 22 aa, Mycobacterium bovis
FAPRFHPSYRHAAAVRREIGVP

SEQ ID NO: 217925 - protein, 23 aa, Mycobacterium bovis
FAPVVMAWLKEIKADPAKVNPNG

SEQ ID NO: 217926 - protein, 22 aa, Mycobacterium bovis
FAQALRLALIDAAPDVAQDPVV

SEQ ID NO: 217927 - protein, 25 aa, Mycobacterium bovis
FAQAVIDAGLIWIGPSPQSIRDLGD

SEQ ID NO: 217928 - protein, 19 aa, Mycobacterium bovis
FAQKLGWTGVPVSSSYAAC

SEQ ID NO: 217929 - protein, 17 aa, Mycobacterium bovis
FARRPLALPSELLAFIQ

SEQ ID NO: 217930 - protein, 18 aa, Mycobacterium bovis
FASMFPGRRFGGGALAVY

SEQ ID NO: 217931 - protein, 19 aa, Mycobacterium bovis
FASVVLSWARVHEPDMDRV

SEQ ID NO: 217932 - protein, 24 aa, Mycobacterium bovis
FATLPSMMHITLNAILRAIFGAGG

SEQ ID NO: 217933 - protein, 25 aa, Mycobacterium bovis
FATTELFLERLGLTSLSELPDIAPL

SEQ ID NO: 217934 - protein, 23 aa, Mycobacterium bovis
FATTPRMSTYLVALIAGPYAAWT

SEQ ID NO: 217935 - protein, 19 aa, Mycobacterium bovis
FAVALPFVDLIDYRLQVTY

SEQ ID NO: 217936 - protein, 18 aa, Mycobacterium bovis
FCATGVTDGDLLKGVRYY

SEQ ID NO: 217937 - protein, 20 aa, Mycobacterium bovis
FDDLAWIKSQWPGKLVVKGI

SEQ ID NO: 217938 - protein, 17 aa, Mycobacterium bovis
FDDLRLEHGRLDQPIPV

SEQ ID NO: 217939 - protein, 17 aa, Mycobacterium bovis
FDEAVGLQWALVARRHG

SEQ ID NO: 217940 - protein, 18 aa, Mycobacterium bovis
FDGPNAVNNIPFAAALHG

SEQ ID NO: 217941 - protein, 32 aa, Mycobacterium bovis
FDGVTYVLERGIRTDFALVHAWQGDRHGNLMY

SEQ ID NO: 217942 - protein, 28 aa, Mycobacterium bovis
FDIADMRNWRPGWFPTMHSRCLSNLIHD

SEQ ID NO: 217943 - protein, 26 aa, Mycobacterium bovis
FDPRPPMITSGLRIGTPALAARGFSH

SEQ ID NO: 217944 - protein, 20 aa, Mycobacterium bovis
FDQIMMDVALHKLPVTMVLD

SEQ ID NO: 217945 - protein, 21 aa, Mycobacterium bovis
FDQVIAVHLKGTWNGTRLAAA

SEQ ID NO: 217946 - protein, 32 aa, Mycobacterium bovis
FDRMAAKLAGFGYVVLLPDVYYREGDWAPFDM

SEQ ID NO: 217947 - protein, 27 aa, Mycobacterium bovis
FDSLPLLIKVVKHPSAWRGWLTTMRSR

SEQ ID NO: 217948 - protein, 22 aa, Mycobacterium bovis
FDSRAIGPGGLFLALPGARADG

SEQ ID NO: 217949 - protein, 18 aa, Mycobacterium bovis
FDVEPRYLPMERGRYVIT

SEQ ID NO: 217950 - protein, 24 aa, Mycobacterium bovis
FDYSTPLLKLLLVRAAHATELPYV

SEQ ID NO: 217951 - protein, 42 aa, Mycobacterium bovis
FEDLPQISPAGLLYLVGPIAWTLGFPIVPMLAPGSTDVNGIV

SEQ ID NO: 217952 - protein, 20 aa, Mycobacterium bovis
FEHWSIHRKPPAFEELEPRT

SEQ ID NO: 217953 - protein, 25 aa, Mycobacterium bovis
FEIADYGVVGDLFKVAPQLTEVIKA

SEQ ID NO: 217954 - protein, 29 aa, Mycobacterium bovis
FEITVDPQVPLPGFVLKRAIKGTIDTATE

SEQ ID NO: 217955 - protein, 21 aa, Mycobacterium bovis
FEKTLRFWLDRGVDGFRIDVA

SEQ ID NO: 217956 - protein, 35 aa, Mycobacterium bovis
FELNVYIPMMARNILESFKLLTNVSRLFAQRCIAG

SEQ ID NO: 217957 - protein, 23 aa, Mycobacterium bovis
FELQFGTNHLGHFALTGLVLDHM

SEQ ID NO: 217958 - protein, 20 aa, Mycobacterium bovis
FEMAATVDYLFGYDATAGVM

SEQ ID NO: 217959 - protein, 24 aa, Mycobacterium bovis
FEPKADWKHLFSYWDEILGYLKGV

SEQ ID NO: 217960 - protein, 17 aa, Mycobacterium bovis
FESIRWRLDVWNASAQV

SEQ ID NO: 217961 - protein, 17 aa, Mycobacterium bovis
FESMRTLAPPTARGWEV

SEQ ID NO: 217962 - protein, 21 aa, Mycobacterium bovis
FEVAWRILQATPVTATGLVSA

SEQ ID NO: 217963 - protein, 17 aa, Mycobacterium bovis
FFADIHMIAVLTENPDS

SEQ ID NO: 217964 - protein, 20 aa, Mycobacterium bovis
FFASIAQQLTFGPGGTTAGS

SEQ ID NO: 217965 - protein, 17 aa, Mycobacterium bovis
FFASVEQLTRPTLRGRP

SEQ ID NO: 217966 - protein, 18 aa, Mycobacterium bovis
FFDLLLSERGSGLDWGKT

SEQ ID NO: 217967 - protein, 32 aa, Mycobacterium bovis
FFDVGAVIYFLRKVIWFLPDFTVEGYHDRLRA

SEQ ID NO: 217968 - protein, 19 aa, Mycobacterium bovis
FFHQVLPGRVAPLGSPGGA

SEQ ID NO: 217969 - protein, 17 aa, Mycobacterium bovis
FFRLFLDPTQTYSCAYF

SEQ ID NO: 217970 - protein, 24 aa, Mycobacterium bovis
FFTDDEFFVGALPTLRAVRAIAGY

SEQ ID NO: 217971 - protein, 29 aa, Mycobacterium bovis
FFVDYVRRYTDLPFLIKLEKRGDLLVPGK

SEQ ID NO: 217972 - protein, 18 aa, Mycobacterium bovis
FFVPTQNSPWPTAEGPRR

SEQ ID NO: 217973 - protein, 18 aa, Mycobacterium bovis
FGAAGEGCLLLVYPNVIA

SEQ ID NO: 217974 - protein, 17 aa, Mycobacterium bovis
FGAPPPDVVQRLSALGL

SEQ ID NO: 217975 - protein, 25 aa, Mycobacterium bovis
FGAVRMVLALLPHWRERRFGHVVNV

SEQ ID NO: 217976 - protein, 21 aa, Mycobacterium bovis
FGDLLVEVLGGDAPPSGPGSR

SEQ ID NO: 217977 - protein, 19 aa, Mycobacterium bovis
FGDLVAMEAYRRSLLEQAS

SEQ ID NO: 217978 - protein, 18 aa, Mycobacterium bovis
FGELLFTNPTGAFQFLLY

SEQ ID NO: 217979 - protein, 25 aa, Mycobacterium bovis
FGEQKARIFLALLGKQYGVTPKGWQ

SEQ ID NO: 217980 - protein, 17 aa, Mycobacterium bovis
FGFATAPLVVAGCIMMR

SEQ ID NO: 217981 - protein, 19 aa, Mycobacterium bovis
FGFSIPQLGFTLSGATPAD

SEQ ID NO: 217982 - protein, 29 aa, Mycobacterium bovis
FGFYHKHFGLPYAFGKYDQLFVPEFNAGA

SEQ ID NO: 217983 - protein, 25 aa, Mycobacterium bovis
FGGGSMFLLVGILAALWERQSSGKG

SEQ ID NO: 217984 - protein, 24 aa, Mycobacterium bovis
FGHFLNRLRALTHDDFRNAWFVDA

SEQ ID NO: 217985 - protein, 17 aa, Mycobacterium bovis
FGHPWEFGPRKTKELLL

SEQ ID NO: 217986 - protein, 28 aa, Mycobacterium bovis
FGIMMQTVLPWFNLGNAAVSLGLATAAT

SEQ ID NO: 217987 - protein, 17 aa, Mycobacterium bovis
FGLGNSGLTPGLMGLGN

SEQ ID NO: 217988 - protein, 17 aa, Mycobacterium bovis
FGLGRLPADLRCQVEAE

SEQ ID NO: 217989 - protein, 19 aa, Mycobacterium bovis
FGLRLARWQGLGILGPVAV

SEQ ID NO: 217990 - protein, 18 aa, Mycobacterium bovis
FGMTPALARIYRASGQEV

SEQ ID NO: 217991 - protein, 23 aa, Mycobacterium bovis
FGNGGAINLGFGNSGQLNAGSFN

SEQ ID NO: 217992 - protein, 24 aa, Mycobacterium bovis
FGPEVKRRIMIGTYALSAGYYDAY

SEQ ID NO: 217993 - protein, 24 aa, Mycobacterium bovis
FGPGGLGTFSWPGAYGTWWQADPS

SEQ ID NO: 217994 - protein, 24 aa, Mycobacterium bovis
FGPSFMINWLHNRYGNYKSESILI

SEQ ID NO: 217995 - protein, 26 aa, Mycobacterium bovis
FGQSGGFIWVDPKADLALVVLTARDF

SEQ ID NO: 217996 - protein, 18 aa, Mycobacterium bovis
FGRLLQHTVVVLNAIQKT

SEQ ID NO: 217997 - protein, 17 aa, Mycobacterium bovis
FGRMLATIRPYRPSVSA

SEQ ID NO: 217998 - protein, 17 aa, Mycobacterium bovis
FGRTDVELPWEQLDKVD

SEQ ID NO: 217999 - protein, 20 aa, Mycobacterium bovis
FGRYGAYLSQLNVLPIYGGS

SEQ ID NO: 218000 - protein, 29 aa, Mycobacterium bovis
FGTAFEGTPPGLPPLVFCTDATSFPTMRT

SEQ ID NO: 218001 - protein, 20 aa, Mycobacterium bovis
FGTALHPRFGPDSSARHRRS

SEQ ID NO: 218002 - protein, 19 aa, Mycobacterium bovis
FGVHPALLDAVLHAVVIAG

SEQ ID NO: 218003 - protein, 19 aa, Mycobacterium bovis
FGVIELHDCFSANELLLYE

SEQ ID NO: 218004 - protein, 17 aa, Mycobacterium bovis
FGVPLVLTYATLGAPFA

SEQ ID NO: 218005 - protein, 17 aa, Mycobacterium bovis
FGYLYGTPGFQAPEIVR

SEQ ID NO: 218006 - protein, 20 aa, Mycobacterium bovis
FHALNYSMFDLAYGYAQNQM

SEQ ID NO: 218007 - protein, 17 aa, Mycobacterium bovis
FHAQFTQALTSGGGAYA

SEQ ID NO: 218008 - protein, 24 aa, Mycobacterium bovis
FHGFEPLPHRGGAVSNALIDRLRD

SEQ ID NO: 218009 - protein, 17 aa, Mycobacterium bovis
FHIDGRTFTWKPLSGVN

SEQ ID NO: 218010 - protein, 24 aa, Mycobacterium bovis
FHIDRGYPLFVENLVSLGAEIERV

SEQ ID NO: 218011 - protein, 22 aa, Mycobacterium bovis
FHLADYQPGLGPLLDRYRGRDV

SEQ ID NO: 218012 - protein, 18 aa, Mycobacterium bovis
FHLRDLAVTFRFGEEVTA

SEQ ID NO: 218013 - protein, 25 aa, Mycobacterium bovis
FHMNEGHAGFLGIERIRELVTDAGL

SEQ ID NO: 218014 - protein, 26 aa, Mycobacterium bovis
FHRIEAAYPGRFLLGIGVGHAEMISE

SEQ ID NO: 218015 - protein, 18 aa, Mycobacterium bovis
FHVHLHVLPRRNGDKLSV

SEQ ID NO: 218016 - protein, 17 aa, Mycobacterium bovis
FHVLRRAGTERPFTGEY

SEQ ID NO: 218017 - protein, 23 aa, Mycobacterium bovis
FHVYARIAPCWSFPQVRLAAQTV

SEQ ID NO: 218018 - protein, 17 aa, Mycobacterium bovis
FIALRTVIGYPAPNLMD

SEQ ID NO: 218019 - protein, 18 aa, Mycobacterium bovis
FIEDVARTWHLTRYAGVA

SEQ ID NO: 218020 - protein, 20 aa, Mycobacterium bovis
FIEETLRYEPPFRGQYRHVR

SEQ ID NO: 218021 - protein, 19 aa, Mycobacterium bovis
FIGGNFSNGAFWQSDHQGQ

SEQ ID NO: 218022 - protein, 27 aa, Mycobacterium bovis
FILASDSAFFMLANTKVALMPDGGASA

SEQ ID NO: 218023 - protein, 19 aa, Mycobacterium bovis
FINIFNVPRTAGVSPMPLA

SEQ ID NO: 218024 - protein, 33 aa, Mycobacterium bovis
FIRDLYEAISQLAFLPFPFDSVIAGGASMAYWR

SEQ ID NO: 218025 - protein, 18 aa, Mycobacterium bovis
FISARWQADFRADVPVLL

SEQ ID NO: 218026 - protein, 19 aa, Mycobacterium bovis
FITASTFLVDGGISSAYVT

SEQ ID NO: 218027 - protein, 24 aa, Mycobacterium bovis
FKDAELLGMPWIVVVGRGWADGVV

SEQ ID NO: 218028 - protein, 18 aa, Mycobacterium bovis
FKEMTLLELSDFVKKFEE

SEQ ID NO: 218029 - protein, 19 aa, Mycobacterium bovis
FKGLQLDIGAPPQFMDFRF

SEQ ID NO: 218030 - protein, 18 aa, Mycobacterium bovis
FKHRIADTRLLLNAALEA

SEQ ID NO: 218031 - protein, 24 aa, Mycobacterium bovis
FKKERYLTFFERSYDILPDDGRML

SEQ ID NO: 218032 - protein, 24 aa, Mycobacterium bovis
FKQCPLLYRFRAIDRLPEATSAAQ

SEQ ID NO: 218033 - protein, 18 aa, Mycobacterium bovis
FKVDMAAQYRIRLGGTWK

SEQ ID NO: 218034 - protein, 17 aa, Mycobacterium bovis
FKWIARSADGWITTPRD

SEQ ID NO: 218035 - protein, 19 aa, Mycobacterium bovis
FLAEPWWCRMVVMSAERIA

SEQ ID NO: 218036 - protein, 26 aa, Mycobacterium bovis
FLAMDLEFLGRKDLGDYFLAGYAVRS

SEQ ID NO: 218037 - protein, 18 aa, Mycobacterium bovis
FLASSRIFNRRKGVRMSM

SEQ ID NO: 218038 - protein, 26 aa, Mycobacterium bovis
FLCDTVLMTGFGFTPPVATPTWGVLE

SEQ ID NO: 218039 - protein, 24 aa, Mycobacterium bovis
FLDSFAGARRTMGLPATVVDWGLW

SEQ ID NO: 218040 - protein, 18 aa, Mycobacterium bovis
FLENIIVPGLTVSGQILV

SEQ ID NO: 218041 - protein, 26 aa, Mycobacterium bovis
FLESLRYDLAVQEIFVFTPKGDVITL

SEQ ID NO: 218042 - protein, 21 aa, Mycobacterium bovis
FLETDLFNQGVRPAINVGVSV

SEQ ID NO: 218043 - protein, 19 aa, Mycobacterium bovis
FLETNVMGTYRVLEAVRRY

SEQ ID NO: 218044 - protein, 24 aa, Mycobacterium bovis
FLETPSQFFPFTGLNSLTYDVSVA

SEQ ID NO: 218045 - protein, 24 aa, Mycobacterium bovis
FLGEQFMQWFLQEQIEEVALMATL

SEQ ID NO: 218046 - protein, 21 aa, Mycobacterium bovis
FLGQRIKPPYVAAYVLLDGAD

SEQ ID NO: 218047 - protein, 19 aa, Mycobacterium bovis
FLHVDYRRITPIDVPLIVR

SEQ ID NO: 218048 - protein, 19 aa, Mycobacterium bovis
FLIRGLLGADPTTGAIGIG

SEQ ID NO: 218049 - protein, 18 aa, Mycobacterium bovis
FLLAPWTAEQIVSELVSV

SEQ ID NO: 218050 - protein, 25 aa, Mycobacterium bovis
FLLDEAEVIYWGLCPDCSISDTSRS

SEQ ID NO: 218051 - protein, 30 aa, Mycobacterium bovis
FLLDNGCHHLQLIVTSWSRAGLPVGRLRIG

SEQ ID NO: 218052 - protein, 24 aa, Mycobacterium bovis
FLNGEARLPLALPTSATGGIPVTV

SEQ ID NO: 218053 - protein, 19 aa, Mycobacterium bovis
FLNNLQKGTIRKGVVSSIV

SEQ ID NO: 218054 - protein, 18 aa, Mycobacterium bovis
FLNNVPRLRKPTVLVIDQ

SEQ ID NO: 218055 - protein, 17 aa, Mycobacterium bovis
FLPAILAGEAHFAIGYT

SEQ ID NO: 218056 - protein, 19 aa, Mycobacterium bovis
FLPASLVEMRRVRDLQPYI

SEQ ID NO: 218057 - protein, 18 aa, Mycobacterium bovis
FLQAVLDDPDFRAGRVTT

SEQ ID NO: 218058 - protein, 25 aa, Mycobacterium bovis
FLRMEADWEASYLLSLRAAWQADNN

SEQ ID NO: 218059 - protein, 17 aa, Mycobacterium bovis
FLTLADYPDQLTLLAQQ

SEQ ID NO: 218060 - protein, 17 aa, Mycobacterium bovis
FMGLIPQPVTATQLLYR

SEQ ID NO: 218061 - protein, 22 aa, Mycobacterium bovis
FMISHFHYDPVWWNTQGAYTSQ

SEQ ID NO: 218062 - protein, 18 aa, Mycobacterium bovis
FMRLLLAAETPTSGDVRV

SEQ ID NO: 218063 - protein, 26 aa, Mycobacterium bovis
FNEHRRKFLSLLRDPSVHRIVVEHRD

SEQ ID NO: 218064 - protein, 18 aa, Mycobacterium bovis
FNGGIINTGSFNSGAFNS

SEQ ID NO: 218065 - protein, 19 aa, Mycobacterium bovis
FNLNDLFDAASRTGGTTIG

SEQ ID NO: 218066 - protein, 19 aa, Mycobacterium bovis
FNTVYLDDVFVPDELVLGE

SEQ ID NO: 218067 - protein, 18 aa, Mycobacterium bovis
FNWDPLRWFEEDEPIYGH

SEQ ID NO: 218068 - protein, 18 aa, Mycobacterium bovis
FPACLDPLRQSLPGKAIE

SEQ ID NO: 218069 - protein, 17 aa, Mycobacterium bovis
FPCYAKCVELGVPVSIH

SEQ ID NO: 218070 - protein, 17 aa, Mycobacterium bovis
FPDYGEDVYYSVSSVAT

SEQ ID NO: 218071 - protein, 23 aa, Mycobacterium bovis
FPKAHWQKIWSTNPLERINKEIK

SEQ ID NO: 218072 - protein, 25 aa, Mycobacterium bovis
FPKGVMWRHEDIYRVLFGGTDFATG

SEQ ID NO: 218073 - protein, 23 aa, Mycobacterium bovis
FPKKQGMRIDFILGSPALAARVM

SEQ ID NO: 218074 - protein, 21 aa, Mycobacterium bovis
FPPPNTYVAPIAFNVVPLAGS

SEQ ID NO: 218075 - protein, 22 aa, Mycobacterium bovis
FPQAFTHLALINAVVHVIRAEE

SEQ ID NO: 218076 - protein, 21 aa, Mycobacterium bovis
FPQIAQYYRRRFRHVLVDEYQ

SEQ ID NO: 218077 - protein, 18 aa, Mycobacterium bovis
FPTTARLTGRWLRGRLPT

SEQ ID NO: 218078 - protein, 17 aa, Mycobacterium bovis
FPVERFMRDAKITQIYE

SEQ ID NO: 218079 - protein, 19 aa, Mycobacterium bovis
FPVPSFAEFWRTGRLELPT

SEQ ID NO: 218080 - protein, 26 aa, Mycobacterium bovis
FPVTDFNVSLPWTKMVVLNPGVQTES

SEQ ID NO: 218081 - protein, 18 aa, Mycobacterium bovis
FQALDYRILPADADADIV

SEQ ID NO: 218082 - protein, 18 aa, Mycobacterium bovis
FQAWANGPAIAAHAGHRA

SEQ ID NO: 218083 - protein, 18 aa, Mycobacterium bovis
FQEFLSRQQLRPPRTPLL

SEQ ID NO: 218084 - protein, 26 aa, Mycobacterium bovis
FQGLQPADQLSRWVDSLLSATAGKLK

SEQ ID NO: 218085 - protein, 19 aa, Mycobacterium bovis
FQHLPVPFELYSDGIDLPV

SEQ ID NO: 218086 - protein, 18 aa, Mycobacterium bovis
FQLLVYPMLDDRTSIAPA

SEQ ID NO: 218087 - protein, 21 aa, Mycobacterium bovis
FQLQHWTHHFDYALVCGGGDW

SEQ ID NO: 218088 - protein, 26 aa, Mycobacterium bovis
FQQRVWKALLTIPYGETRSYGEIADQ

SEQ ID NO: 218089 - protein, 17 aa, Mycobacterium bovis
FQVGSRGGDGGVGGWLY

SEQ ID NO: 218090 - protein, 17 aa, Mycobacterium bovis
FQVLLNHPRLARTFNDL

SEQ ID NO: 218091 - protein, 18 aa, Mycobacterium bovis
FRALIQAALRHAGAVRID

SEQ ID NO: 218092 - protein, 21 aa, Mycobacterium bovis
FREEFILRPDRVQMAPVNVIS

SEQ ID NO: 218093 - protein, 19 aa, Mycobacterium bovis
FRGVKKVHYWAARSTGGEF

SEQ ID NO: 218094 - protein, 18 aa, Mycobacterium bovis
FRMWLDAVGISEDLHRYL

SEQ ID NO: 218095 - protein, 17 aa, Mycobacterium bovis
FRPGTMEKLGLGPDDLR

SEQ ID NO: 218096 - protein, 28 aa, Mycobacterium bovis
FRRANLPPLNVPLAVILLGGLRELTALT

SEQ ID NO: 218097 - protein, 19 aa, Mycobacterium bovis
FRRESQAYGIPFPPVGDRV

SEQ ID NO: 218098 - protein, 20 aa, Mycobacterium bovis
FRRRSCCLFYRVPAGGKCGD

SEQ ID NO: 218099 - protein, 27 aa, Mycobacterium bovis
FRSADLADLFMLIFTSGTSGDPKAVKC

SEQ ID NO: 218100 - protein, 26 aa, Mycobacterium bovis
FRSDALQIIAFGRYARTVTAAELTGL

SEQ ID NO: 218101 - protein, 22 aa, Mycobacterium bovis
FRTTLYVTCEVVRIAALLIQPV

SEQ ID NO: 218102 - protein, 17 aa, Mycobacterium bovis
FSAAIPPNLPLPAKIVM

SEQ ID NO: 218103 - protein, 25 aa, Mycobacterium bovis
FSCIDTFPEVLWLAQRARQAWDGVR

SEQ ID NO: 218104 - protein, 42 aa, Mycobacterium bovis
FSEHYLAEYMAIRGIGFLGWNTRFRGFESSFLLDHALVDIGV

SEQ ID NO: 218105 - protein, 18 aa, Mycobacterium bovis
FSFGDYFKRGAIELAWAL

SEQ ID NO: 218106 - protein, 29 aa, Mycobacterium bovis
FSGFDPWLPSLGNPLTFLSPANIAFALGY

SEQ ID NO: 218107 - protein, 26 aa, Mycobacterium bovis
FSGPARKVLELTFREALRLGHNYIGT

SEQ ID NO: 218108 - protein, 20 aa, Mycobacterium bovis
FSLFDVYTDIAFPGGIHAAW

SEQ ID NO: 218109 - protein, 20 aa, Mycobacterium bovis
FSLGHFPQSFEFATIGGFAA

SEQ ID NO: 218110 - protein, 19 aa, Mycobacterium bovis
FSLTVPRHDGGERRLYLIE

SEQ ID NO: 218111 - protein, 19 aa, Mycobacterium bovis
FSMLYAFSENYVLPLSHDE

SEQ ID NO: 218112 - protein, 20 aa, Mycobacterium bovis
FSNGILWRGNYEGLAGFSFG

SEQ ID NO: 218113 - protein, 18 aa, Mycobacterium bovis
FSPLLDTVGQPAREVYPE

SEQ ID NO: 218114 - protein, 22 aa, Mycobacterium bovis
FSPPPPRYTTGVLSKYVKLVSS

SEQ ID NO: 218115 - protein, 23 aa, Mycobacterium bovis
FSRCFGCGRIYWPGSHHARLVRL

SEQ ID NO: 218116 - protein, 23 aa, Mycobacterium bovis
FSRFNLREFAIRPAYGLAEATVY

SEQ ID NO: 218117 - protein, 36 aa, Mycobacterium bovis
FSVAGETIVRLKARLWFVHRGIEKLFHGRPATAAVD

SEQ ID NO: 218118 - protein, 33 aa, Mycobacterium bovis
FSVTRPDGLPVWIYQFKISPHPTIPLAPTVAER

SEQ ID NO: 218119 - protein, 18 aa, Mycobacterium bovis
FTANPWLSGYMSQALNLL

SEQ ID NO: 218120 - protein, 17 aa, Mycobacterium bovis
FTAVRRSVTVDGVATDI

SEQ ID NO: 218121 - protein, 28 aa, Mycobacterium bovis
FTCEHDLSLWLLRVQALHSAWGTPQEHR

SEQ ID NO: 218122 - protein, 29 aa, Mycobacterium bovis
FTENYVILNDFPLFWDPRLLERDVHLPRF

SEQ ID NO: 218123 - protein, 26 aa, Mycobacterium bovis
FTGEDRLLRLRWPCPVPGAMPISEVG

SEQ ID NO: 218124 - protein, 17 aa, Mycobacterium bovis
FTGLFSPTDVAVDNDGA

SEQ ID NO: 218125 - protein, 17 aa, Mycobacterium bovis
FTKLRIPGARVIPTIYF

SEQ ID NO: 218126 - protein, 17 aa, Mycobacterium bovis
FTLPNVVIQPWSLGGIS

SEQ ID NO: 218127 - protein, 17 aa, Mycobacterium bovis
FTLSFPYEPWTREEGIA

SEQ ID NO: 218128 - protein, 18 aa, Mycobacterium bovis
FTNICYTGCRFCAFAQRK

SEQ ID NO: 218129 - protein, 25 aa, Mycobacterium bovis
FTNQIRWLFEKLLGESPRRSPRRQY

SEQ ID NO: 218130 - protein, 19 aa, Mycobacterium bovis
FTPRYNPWDQRLCLIPDAD

SEQ ID NO: 218131 - protein, 29 aa, Mycobacterium bovis
FTSDIKNLLPMLAVFKPTVVVSVPRVFEK

SEQ ID NO: 218132 - protein, 23 aa, Mycobacterium bovis
FTSSFGYRWGVLHAGIDLANAIG

SEQ ID NO: 218133 - protein, 25 aa, Mycobacterium bovis
FTSTAELVALLYQAIPAPARRVGGH

SEQ ID NO: 218134 - protein, 26 aa, Mycobacterium bovis
FTVPNFLELDYWQTWHYGDSTMAGVY

SEQ ID NO: 218135 - protein, 26 aa, Mycobacterium bovis
FTVPNLVWASFLRLATNRRIFEIPSP

SEQ ID NO: 218136 - protein, 25 aa, Mycobacterium bovis
FTVPNLVWASFLRLTTNRRIFEIPS

SEQ ID NO: 218137 - protein, 25 aa, Mycobacterium bovis
FVAAESLIAIDRLPAAIITRLTQTN

SEQ ID NO: 218138 - protein, 21 aa, Mycobacterium bovis
FVAALRAIWLAWQDGTKLCFE

SEQ ID NO: 218139 - protein, 18 aa, Mycobacterium bovis
FVAFIAGIAPSATHRRSI

SEQ ID NO: 218140 - protein, 18 aa, Mycobacterium bovis
FVDAYNKPIDMGHDPAFV

SEQ ID NO: 218141 - protein, 18 aa, Mycobacterium bovis
FVDVAMCGLFHGPRLRDM

SEQ ID NO: 218142 - protein, 25 aa, Mycobacterium bovis
FVENYNLNMAIPWIAAERGFIDAVI

SEQ ID NO: 218143 - protein, 17 aa, Mycobacterium bovis
FVFNLLRELADVIVVGV

SEQ ID NO: 218144 - protein, 27 aa, Mycobacterium bovis
FVGVTAYDYMLTLAGRLRPVDLDAYIP

SEQ ID NO: 218145 - protein, 24 aa, Mycobacterium bovis
FVHAHPRWIAQAFADALGAAVGEL

SEQ ID NO: 218146 - protein, 19 aa, Mycobacterium bovis
FVLFGEFADAPAAWRRYLE

SEQ ID NO: 218147 - protein, 19 aa, Mycobacterium bovis
FVMDHFYQLPMLGTPDQPM

SEQ ID NO: 218148 - protein, 23 aa, Mycobacterium bovis
FVRSEGCAMVLLKRLPDALRDGN

SEQ ID NO: 218149 - protein, 19 aa, Mycobacterium bovis
FVTAMRWGHLPLAGENGAI

SEQ ID NO: 218150 - protein, 20 aa, Mycobacterium bovis
FVVCSEILPRWGVQTVFVDG

SEQ ID NO: 218151 - protein, 31 aa, Mycobacterium bovis
FWAQAMRLRDLLKFDFYFADSTAFRANIAQE

SEQ ID NO: 218152 - protein, 22 aa, Mycobacterium bovis
FWHQWMQTWFTGPQFYFDCVSG

SEQ ID NO: 218153 - protein, 24 aa, Mycobacterium bovis
FWRTGRLELPTRTGLTWLADFRAD

SEQ ID NO: 218154 - protein, 32 aa, Mycobacterium bovis
FYALPQSPQLFKQLLMVAGMERYYQIARCYRD

SEQ ID NO: 218155 - protein, 17 aa, Mycobacterium bovis
FYELVSRVGLERARRVV

SEQ ID NO: 218156 - protein, 28 aa, Mycobacterium bovis
FYSSYMHLHTRLTRRFNAVIVPGVTSVS

SEQ ID NO: 218157 - protein, 26 aa, Mycobacterium bovis
GAADSWDPFPEFLGGLRFAGAQVVPI

SEQ ID NO: 218158 - protein, 34 aa, Mycobacterium bovis
GAAELGYKGLLAPLTFICVFGYKAQAAFFKHANI

SEQ ID NO: 218159 - protein, 18 aa, Mycobacterium bovis
GAAFYHDQYRRTTDGWRI

SEQ ID NO: 218160 - protein, 17 aa, Mycobacterium bovis
GAAGFIDVGIKRSADHP

SEQ ID NO: 218161 - protein, 24 aa, Mycobacterium bovis
GAAGGAGGWLFGNGGNGGHGATNT

SEQ ID NO: 218162 - protein, 25 aa, Mycobacterium bovis
GAAGIVPAVLHYAIHYTSAGAGDPD

SEQ ID NO: 218163 - protein, 19 aa, Mycobacterium bovis
GAAGLLLRAPRPDGTPAVL

SEQ ID NO: 218164 - protein, 25 aa, Mycobacterium bovis
GAAKPQLNVLLWQRAKEPQRGAWSL

SEQ ID NO: 218165 - protein, 37 aa, Mycobacterium bovis
GAALDLMDDAWWGPTVPLVGKPWFALSERNSPGSIIV

SEQ ID NO: 218166 - protein, 22 aa, Mycobacterium bovis
GAALLLDSWALLGRQDLRAAED

SEQ ID NO: 218167 - protein, 19 aa, Mycobacterium bovis
GAALPALARTPVEAIGVDL

SEQ ID NO: 218168 - protein, 18 aa, Mycobacterium bovis
GAAMPHLSGPLAGVGVGG

SEQ ID NO: 218169 - protein, 28 aa, Mycobacterium bovis
GAAQLAGLKLLALGGRFIEIGKRDIYSN

SEQ ID NO: 218170 - protein, 25 aa, Mycobacterium bovis
GAARLLSIPLRHLYAALWRVGLLEV

SEQ ID NO: 218171 - protein, 30 aa, Mycobacterium bovis
GADFKRPAPHWWFDDATLYGPDGLALPMRL

SEQ ID NO: 218172 - protein, 23 aa, Mycobacterium bovis
GADGGAGGWLFGNGGNGGHGATG

SEQ ID NO: 218173 - protein, 26 aa, Mycobacterium bovis
GADLNNALLALLPLVGVWRGEGEGRG

SEQ ID NO: 218174 - protein, 25 aa, Mycobacterium bovis
GADPGLYARALADRALIDAVAGITD

SEQ ID NO: 218175 - protein, 45 aa, Mycobacterium bovis
GADTVAWLREQPWFTGRFGTIGLPYLGFTQWALLHDPPPELAAAV

SEQ ID NO: 218176 - protein, 21 aa, Mycobacterium bovis
GADVGYRWFASTNQTPMFAFG

SEQ ID NO: 218177 - protein, 26 aa, Mycobacterium bovis
GAEQRDWFEVSLIPTTRELTTLGSAA

SEQ ID NO: 218178 - protein, 30 aa, Mycobacterium bovis
GAESPRETWLRLLLIRAGFPRPQTQIPVYD

SEQ ID NO: 218179 - protein, 23 aa, Mycobacterium bovis
GAEVLLLSDLLTEALHHSGAARM

SEQ ID NO: 218180 - protein, 21 aa, Mycobacterium bovis
GAEVVSLWHADADLKGVDAVV

SEQ ID NO: 218181 - protein, 21 aa, Mycobacterium bovis
GAFGDLLSAAGLPAPKYGTAT

SEQ ID NO: 218182 - protein, 24 aa, Mycobacterium bovis
GAFQFLLYVVVVDLPTHIAQIATW

SEQ ID NO: 218183 - protein, 31 aa, Mycobacterium bovis
GAFWHIDYMFMPEPFAFSMVLPLAVPGHDRG

SEQ ID NO: 218184 - protein, 24 aa, Mycobacterium bovis
GAGGAAGMLFGAAGVGGPGGFAAA

SEQ ID NO: 218185 - protein, 23 aa, Mycobacterium bovis
GAGGAGGWLLGNGGAGGPGGPTD

SEQ ID NO: 218186 - protein, 25 aa, Mycobacterium bovis
GAGGAGPVLFGHGGAGGMGGQGGTG

SEQ ID NO: 218187 - protein, 18 aa, Mycobacterium bovis
GAGGLLYGNGGAGGSGAP

SEQ ID NO: 218188 - protein, 25 aa, Mycobacterium bovis
GAGGNAGILFGAGGIGGTGGTGLGA

SEQ ID NO: 218189 - protein, 18 aa, Mycobacterium bovis
GAGGTAGLFGVGGAGGAG

SEQ ID NO: 218190 - protein, 21 aa, Mycobacterium bovis
GAGLNLALAADVRIAGPAALF

SEQ ID NO: 218191 - protein, 18 aa, Mycobacterium bovis
GAGLTLALAADWRVSGDN

SEQ ID NO: 218192 - protein, 19 aa, Mycobacterium bovis
GAGMHPWGKWGNDFTEYGV

SEQ ID NO: 218193 - protein, 28 aa, Mycobacterium bovis
GAGPVVGVWRRAPLQALARLHMLAAADQ

SEQ ID NO: 218194 - protein, 26 aa, Mycobacterium bovis
GAGSNALGLFLGLGGSGGQGGDSAMG

SEQ ID NO: 218195 - protein, 20 aa, Mycobacterium bovis
GAGTALVSYPLPQSPIVRIV

SEQ ID NO: 218196 - protein, 25 aa, Mycobacterium bovis
GAGTGVRFTPTLTFTLDTISDSVHR

SEQ ID NO: 218197 - protein, 18 aa, Mycobacterium bovis
GAGWLKVKPVHTLDLVVL

SEQ ID NO: 218198 - protein, 22 aa, Mycobacterium bovis
GAIAVPLNFRLTPTEIAVLVED

SEQ ID NO: 218199 - protein, 31 aa, Mycobacterium bovis
GAIAYARARGLPVLGLCLGLQCIVIEAARSV

SEQ ID NO: 218200 - protein, 29 aa, Mycobacterium bovis
GAIVAWNVPLFLAVNKIAPALLAGCTIVL

SEQ ID NO: 218201 - protein, 28 aa, Mycobacterium bovis
GAKDQLRFTAPPRLDLSLLASALPEGYQ

SEQ ID NO: 218202 - protein, 25 aa, Mycobacterium bovis
GAKEQLGILARLAGAALVAKEDAVP

SEQ ID NO: 218203 - protein, 25 aa, Mycobacterium bovis
GALAERALVPVLPSVEEFPYAIRQV

SEQ ID NO: 218204 - protein, 31 aa, Mycobacterium bovis
GALAGIHPVDLGALAWRGLLDRTDIDPAAVD

SEQ ID NO: 218205 - protein, 29 aa, Mycobacterium bovis
GALAITGLPLFKAPFEPLTPGGFRVPNTN

SEQ ID NO: 218206 - protein, 26 aa, Mycobacterium bovis
GALESRTITFLKIDPAPGIGNSTTNP

SEQ ID NO: 218207 - protein, 22 aa, Mycobacterium bovis
GALHSWCLAAERPELVSALVVE

SEQ ID NO: 218208 - protein, 18 aa, Mycobacterium bovis
GALIAFEKGRSWPRERTR

SEQ ID NO: 218209 - protein, 21 aa, Mycobacterium bovis
GALKPARLLVSGSAALPVPVF

SEQ ID NO: 218210 - protein, 19 aa, Mycobacterium bovis
GALLERMPTSLSARFDRAC

SEQ ID NO: 218211 - protein, 20 aa, Mycobacterium bovis
GANIALAAALAPLQCYVSVD

SEQ ID NO: 218212 - protein, 31 aa, Mycobacterium bovis
GANIVKVALEAPLKQIAFNSGLEPGVVAEKV

SEQ ID NO: 218213 - protein, 25 aa, Mycobacterium bovis
GANSTWRAIAGPTPRLNPWRTPIPK

SEQ ID NO: 218214 - protein, 30 aa, Mycobacterium bovis
GAPAFYQAEIFEIVWSLWNLSRTDIDLSDP

SEQ ID NO: 218215 - protein, 18 aa, Mycobacterium bovis
GAPDIKLLQPVPAGDPSK

SEQ ID NO: 218216 - protein, 24 aa, Mycobacterium bovis
GAPGGPGGLLLGNGGNGGSGAPGQ

SEQ ID NO: 218217 - protein, 21 aa, Mycobacterium bovis
GAPGGWLIGNGGAGGSGAAGV

SEQ ID NO: 218218 - protein, 20 aa, Mycobacterium bovis
GAPGLGGRGGLLLGLPGANG

SEQ ID NO: 218219 - protein, 19 aa, Mycobacterium bovis
GAQAIRGGLADCVLALGFE

SEQ ID NO: 218220 - protein, 18 aa, Mycobacterium bovis
GAQPILLGAGWEGGWRCG

SEQ ID NO: 218221 - protein, 22 aa, Mycobacterium bovis
GAQVTIFRLGSDPGLARFIDQV

SEQ ID NO: 218222 - protein, 27 aa, Mycobacterium bovis
GAQVVPIRVYRWKPAPLGGVFDHLVTG

SEQ ID NO: 218223 - protein, 25 aa, Mycobacterium bovis
GARALEWVVGYPDRVRAGLLLAVGA

SEQ ID NO: 218224 - protein, 35 aa, Mycobacterium bovis
GARAYHPTLLRKGERLLVFLPLAHVLARAISMAAF

SEQ ID NO: 218225 - protein, 25 aa, Mycobacterium bovis
GAREFQTFLVAKQREIVAVVAAAHE

SEQ ID NO: 218226 - protein, 24 aa, Mycobacterium bovis
GAREHALLLALGKDPQVSGLIVAP

SEQ ID NO: 218227 - protein, 23 aa, Mycobacterium bovis
GARGTFFARCEQALRAAGRSFVV

SEQ ID NO: 218228 - protein, 23 aa, Mycobacterium bovis
GARLDSLVPLGPPVMDVALNITC

SEQ ID NO: 218229 - protein, 26 aa, Mycobacterium bovis
GARSPVSFFAYPGMPSDLVPAGCEVH

SEQ ID NO: 218230 - protein, 23 aa, Mycobacterium bovis
GARVDLAGWDLWVSGKAEAMSDE

SEQ ID NO: 218231 - protein, 26 aa, Mycobacterium bovis
GARYTWPRFVCALPKEFFAAVRAELA

SEQ ID NO: 218232 - protein, 33 aa, Mycobacterium bovis
GASQAAAQLPLPAGLQQFLNTLPNLGIGNQGNA

SEQ ID NO: 218233 - protein, 23 aa, Mycobacterium bovis
GASRKRFLGALLAGPDGVMRPTD

SEQ ID NO: 218234 - protein, 19 aa, Mycobacterium bovis
GASYWYAHTDQWRYDGYGA

SEQ ID NO: 218235 - protein, 19 aa, Mycobacterium bovis
GATLPAAAWQRCRTHYAAN

SEQ ID NO: 218236 - protein, 26 aa, Mycobacterium bovis
GATMAALANFFRIKAAYFTDDEYYEK

SEQ ID NO: 218237 - protein, 22 aa, Mycobacterium bovis
GATRVFALRPRGRGPSLRLPLA

SEQ ID NO: 218238 - protein, 23 aa, Mycobacterium bovis
GATVDPVLWRTASLVGARVDVDQ

SEQ ID NO: 218239 - protein, 21 aa, Mycobacterium bovis
GAVFHYVPLHDSPAGRRYGRT

SEQ ID NO: 218240 - protein, 24 aa, Mycobacterium bovis
GAVLHTLNIRLFPEQIAYVTNEAE

SEQ ID NO: 218241 - protein, 24 aa, Mycobacterium bovis
GAVSAWVELHARFGRLPFETLFEP

SEQ ID NO: 218242 - protein, 30 aa, Mycobacterium bovis
GAWIADIDGLRYLDWLAAYSAVNLGHRNPA

SEQ ID NO: 218243 - protein, 26 aa, Mycobacterium bovis
GAWSDIGQLGWWSASPARASALEESN

SEQ ID NO: 218244 - protein, 24 aa, Mycobacterium bovis
GCAALIVALLGACPALRVLATSRE

SEQ ID NO: 218245 - protein, 19 aa, Mycobacterium bovis
GCATPARVFKGTRMAGRMG

SEQ ID NO: 218246 - protein, 37 aa, Mycobacterium bovis
GCDKSLPGMLMAAARLDLAAVFLYAGSILPGRAKLSD

SEQ ID NO: 218247 - protein, 18 aa, Mycobacterium bovis
GCFLLHDNGIDGIVDPSN

SEQ ID NO: 218248 - protein, 31 aa, Mycobacterium bovis
GCGDLDFDWLDDGWLTLLRRWLNDAQRAGVS

SEQ ID NO: 218249 - protein, 19 aa, Mycobacterium bovis
GCGGGAFTAGVTTGGAGGT

SEQ ID NO: 218250 - protein, 18 aa, Mycobacterium bovis
GCLLLVYPNVIAVERQLR

SEQ ID NO: 218251 - protein, 20 aa, Mycobacterium bovis
GCMRGRTMYVVPFCMGPLGA

SEQ ID NO: 218252 - protein, 24 aa, Mycobacterium bovis
GCVFQDFRLLQQKTVYDNVAFALE

SEQ ID NO: 218253 - protein, 20 aa, Mycobacterium bovis
GCYGIQRIHPLRNVMILAGA

SEQ ID NO: 218254 - protein, 33 aa, Mycobacterium bovis
GDALKAVAAFRLALPRTMLRFAGGREITLGDLG

SEQ ID NO: 218255 - protein, 22 aa, Mycobacterium bovis
GDCALNRGVFADAYGVVGAVGE

SEQ ID NO: 218256 - protein, 27 aa, Mycobacterium bovis
GDDDNEAKWFWFEGNFGAYEENKVERL

SEQ ID NO: 218257 - protein, 25 aa, Mycobacterium bovis
GDDGGAGGWLFGNGGNGGAGAAGTN

SEQ ID NO: 218258 - protein, 23 aa, Mycobacterium bovis
GDDKPWFAIGGINAQRLPAVLDA

SEQ ID NO: 218259 - protein, 27 aa, Mycobacterium bovis
GDDTLFLERFVLRPRHIEVQVLADAHG

SEQ ID NO: 218260 - protein, 23 aa, Mycobacterium bovis
GDDWTPVTLLEGGTPLIAATNLS

SEQ ID NO: 218261 - protein, 18 aa, Mycobacterium bovis
GDEAILFGPGIRGEPTAQ

SEQ ID NO: 218262 - protein, 27 aa, Mycobacterium bovis
GDECHMAFHFPLMPRIFMAVRRESRFP

SEQ ID NO: 218263 - protein, 35 aa, Mycobacterium bovis
GDEMTRVIWKLIKDMLILPYLDIRLDYYDLGIEHR

SEQ ID NO: 218264 - protein, 18 aa, Mycobacterium bovis
GDFDLSTLRFALSGAEPV

SEQ ID NO: 218265 - protein, 29 aa, Mycobacterium bovis
GDFDPAIRRKPSIFVLEDAPWSAFRDRDN

SEQ ID NO: 218266 - protein, 31 aa, Mycobacterium bovis
GDFLRTIHELLLSDGFWDEVFRELSIPYLPV

SEQ ID NO: 218267 - protein, 27 aa, Mycobacterium bovis
GDGADAVNVVFMPTEPQAATGTAGSAG

SEQ ID NO: 218268 - protein, 22 aa, Mycobacterium bovis
GDGFDGTMAGLGGTGGSGGTGG

SEQ ID NO: 218269 - protein, 25 aa, Mycobacterium bovis
GDGGAGPLLIGNGGVGGLGGAGAAG

SEQ ID NO: 218270 - protein, 25 aa, Mycobacterium bovis
GDGGNAGLLFGAAGVGGAGGFALAT

SEQ ID NO: 218271 - protein, 25 aa, Mycobacterium bovis
GDGGRCMVVFQPHLYSRTKAFAAEF

SEQ ID NO: 218272 - protein, 18 aa, Mycobacterium bovis
GDGPWRLGLGSAGTFENL

SEQ ID NO: 218273 - protein, 24 aa, Mycobacterium bovis
GDGRIRARREISVKIPAGVGDGMR

SEQ ID NO: 218274 - protein, 29 aa, Mycobacterium bovis
GDGSSWINRLYWNLADYAGSPVRIIGYAN

SEQ ID NO: 218275 - protein, 18 aa, Mycobacterium bovis
GDGSTWILRRILRRLGYA

SEQ ID NO: 218276 - protein, 20 aa, Mycobacterium bovis
GDGTCYWKRMGNPDGALIDN

SEQ ID NO: 218277 - protein, 24 aa, Mycobacterium bovis
GDGTSVFFDYPPHPRTIAHTVRGF

SEQ ID NO: 218278 - protein, 29 aa, Mycobacterium bovis
GDHDLEPGPWRLDPLPLVISAADWEVLEA

SEQ ID NO: 218279 - protein, 25 aa, Mycobacterium bovis
GDKWRLAEVLAWQAYVGFAGEGDPG

SEQ ID NO: 218280 - protein, 18 aa, Mycobacterium bovis
GDLLLLRQGQLLAHTTPH

SEQ ID NO: 218281 - protein, 24 aa, Mycobacterium bovis
GDLQTLEFAALDRVPPGPGEIEVA

SEQ ID NO: 218282 - protein, 21 aa, Mycobacterium bovis
GDLVAYRYLDHARSAAGCALE

SEQ ID NO: 218283 - protein, 21 aa, Mycobacterium bovis
GDLVFPHPGHVQLAIGNNLVV

SEQ ID NO: 218284 - protein, 19 aa, Mycobacterium bovis
GDLWAAPSGWRGGGHMAPV

SEQ ID NO: 218285 - protein, 20 aa, Mycobacterium bovis
GDMPNDVPMLLRAGLGVAMG

SEQ ID NO: 218286 - protein, 26 aa, Mycobacterium bovis
GDMQTIELAAFHRVPPGPGQIEVAVR

SEQ ID NO: 218287 - protein, 18 aa, Mycobacterium bovis
GDPALPHLFFVEGGALAV

SEQ ID NO: 218288 - protein, 17 aa, Mycobacterium bovis
GDPFQHWIGRRFDAVAT

SEQ ID NO: 218289 - protein, 22 aa, Mycobacterium bovis
GDPMSGLRQAVAARHGFAQDVA

SEQ ID NO: 218290 - protein, 24 aa, Mycobacterium bovis
GDPTVFPGHWYSAEPSASLSEVKR

SEQ ID NO: 218291 - protein, 24 aa, Mycobacterium bovis
GDQPGKWSLMAQGVYAPAIPRRKS

SEQ ID NO: 218292 - protein, 26 aa, Mycobacterium bovis
GDQPLALVTAYLPPGVGPAVEPLLSG

SEQ ID NO: 218293 - protein, 17 aa, Mycobacterium bovis
GDRFGRVVAPHRLTDPK

SEQ ID NO: 218294 - protein, 24 aa, Mycobacterium bovis
GDRVDLLIDVLAAALPAGPAYYPD

SEQ ID NO: 218295 - protein, 21 aa, Mycobacterium bovis
GDRVLLCLPDSPDLVQLLLAC

SEQ ID NO: 218296 - protein, 28 aa, Mycobacterium bovis
GDSESYEFWREFLASLKARGLTGVHLVI

SEQ ID NO: 218297 - protein, 22 aa, Mycobacterium bovis
GDTTIVVNGMLAPSTLGYGGNG

SEQ ID NO: 218298 - protein, 17 aa, Mycobacterium bovis
GDTWAAIGVALGITRQA

SEQ ID NO: 218299 - protein, 24 aa, Mycobacterium bovis
GDVKRFRGFDNWEGDAATACEASL

SEQ ID NO: 218300 - protein, 20 aa, Mycobacterium bovis
GDVWALLVDGNFGSGLPPAE

SEQ ID NO: 218301 - protein, 19 aa, Mycobacterium bovis
GDVYTSVAVWFPETAKPAP

SEQ ID NO: 218302 - protein, 20 aa, Mycobacterium bovis
GDYLAELTMLILGRDRMKNP

SEQ ID NO: 218303 - protein, 27 aa, Mycobacterium bovis
GDYQEPGLREAGFWRFVADPYDPSESQ

SEQ ID NO: 218304 - protein, 26 aa, Mycobacterium bovis
GEAHIKVIRALFRPPARRGGCVHPPG

SEQ ID NO: 218305 - protein, 25 aa, Mycobacterium bovis
GEAYQLMRDGLGLTAPAIADVFTEW

SEQ ID NO: 218306 - protein, 25 aa, Mycobacterium bovis
GEDGVIAWLLAGPEHTYRVPLPAPG

SEQ ID NO: 218307 - protein, 22 aa, Mycobacterium bovis
GEEQFMAWRRSYDTPPPPIERG

SEQ ID NO: 218308 - protein, 30 aa, Mycobacterium bovis
GEESALFAADLARMYIRYAERHGWAVTVLD

SEQ ID NO: 218309 - protein, 21 aa, Mycobacterium bovis
GEFDYNLQWKPVGGFPVTFGW

SEQ ID NO: 218310 - protein, 17 aa, Mycobacterium bovis
GEFLLFDGRVHTYEAVN

SEQ ID NO: 218311 - protein, 32 aa, Mycobacterium bovis; identical to SEQ ID NO: 114674

SEQ ID NO: 218312 - protein, 23 aa, Mycobacterium bovis
GEGKRLYPLTADRAKPAVPFGGA

SEQ ID NO: 218313 - protein, 18 aa, Mycobacterium bovis
GEGPARAWERGRFAAPYL

SEQ ID NO: 218314 - protein, 25 aa, Mycobacterium bovis
GEGPHVQLWPHRHGTDAMFAAALRR

SEQ ID NO: 218315 - protein, 23 aa, Mycobacterium bovis
GEGVRPPWSIGEPQPELAALIVQ

SEQ ID NO: 218316 - protein, 25 aa, Mycobacterium bovis
GEHGYELLPPWESAGVVFDALLAAV

SEQ ID NO: 218317 - protein, 20 aa, Mycobacterium bovis
GEHLAMLRRLMMDDSFFRGE

SEQ ID NO: 218318 - protein, 31 aa, Mycobacterium bovis
GEIARLTFDLLPTSYLFQPGHRIRIAIAGAD

SEQ ID NO: 218319 - protein, 22 aa, Mycobacterium bovis
GEIPLGLRLGSDTTLLDAALAG

SEQ ID NO: 218320 - protein, 19 aa, Mycobacterium bovis
GELFNIPLTAHFLGGAVIG

SEQ ID NO: 218321 - protein, 18 aa, Mycobacterium bovis
GELLDYLAGLGRSVHMVV

SEQ ID NO: 218322 - protein, 18 aa, Mycobacterium bovis
GELLGALPMLHAAFERAG

SEQ ID NO: 218323 - protein, 18 aa, Mycobacterium bovis
GELMAILESLPLAGWMTI

SEQ ID NO: 218324 - protein, 25 aa, Mycobacterium bovis
GELNRFVFAMPEQLGRIYLGLTDED

SEQ ID NO: 218325 - protein, 17 aa, Mycobacterium bovis
GELPRLFVVTRQAQIVK

SEQ ID NO: 218326 - protein, 22 aa, Mycobacterium bovis
GENGWPMPLPDDLKDDLKSTVA

SEQ ID NO: 218327 - protein, 26 aa, Mycobacterium bovis
GENPENIFFYITVYNEPYVQPPEPEN

SEQ ID NO: 218328 - protein, 18 aa, Mycobacterium bovis
GEPPLTGSLLIGGAGRVV

SEQ ID NO: 218329 - protein, 23 aa, Mycobacterium bovis
GEPRPRIALAAPTGKAAARLAEA

SEQ ID NO: 218330 - protein, 22 aa, Mycobacterium bovis
GEQFGVASWTPQGEFEFGGQEA

SEQ ID NO: 218331 - protein, 24 aa, Mycobacterium bovis
GEQLDWGTYVFDFGRPEVRNFLVA

SEQ ID NO: 218332 - protein, 23 aa, Mycobacterium bovis
GEQLRKLRYILNFARLADFEPGA

SEQ ID NO: 218333 - protein, 25 aa, Mycobacterium bovis
GERAFGAGPLRPWPDDVRRAIRESR

SEQ ID NO: 218334 - protein, 29 aa, Mycobacterium bovis
GERRRVALCKLLLSKPDLLLLDEPTNHLD

SEQ ID NO: 218335 - protein, 22 aa, Mycobacterium bovis
GERVVWFGFIPQSIDRVQVLGG

SEQ ID NO: 218336 - protein, 18 aa, Mycobacterium bovis
GESWLDELLPYLRANRDH

SEQ ID NO: 218337 - protein, 21 aa, Mycobacterium bovis
GETLYRRFMSARVPSPALMHY

SEQ ID NO: 218338 - protein, 24 aa, Mycobacterium bovis
GETRDLFLTLLSVSGVGPRLAMAA

SEQ ID NO: 218339 - protein, 23 aa, Mycobacterium bovis
GEVDVRIWIHPDHRKKGYGTAAL

SEQ ID NO: 218340 - protein, 31 aa, Mycobacterium bovis
GEVYFELRLADAWVWDMYRPARFVKQVRVVT

SEQ ID NO: 218341 - protein, 21 aa, Mycobacterium bovis
GEWTVRHTVAAWPAVCSGLRS

SEQ ID NO: 218342 - protein, 24 aa, Mycobacterium bovis
GFAIFRIEVNLPVDGRWVLVVTGD

SEQ ID NO: 218343 - protein, 20 aa, Mycobacterium bovis
GFAIPAAMGAKIALPGTEVW

SEQ ID NO: 218344 - protein, 23 aa, Mycobacterium bovis
GFANLGNYNIGFGNAGDFNQGFA

SEQ ID NO: 218345 - protein, 18 aa, Mycobacterium bovis
GFATLLFDLLTPEEERNR

SEQ ID NO: 218346 - protein, 17 aa, Mycobacterium bovis
GFCLDTCHTWAAGEALT

SEQ ID NO: 218347 - protein, 25 aa, Mycobacterium bovis
GFDEVFARMWELYLAYSEAGFRSGY

SEQ ID NO: 218348 - protein, 25 aa, Mycobacterium bovis
GFDIASLWPVKPLLSLSALETHFAI

SEQ ID NO: 218349 - protein, 24 aa, Mycobacterium bovis
GFDNRFFDIPPDEALRMDPQQRLL

SEQ ID NO: 218350 - protein, 33 aa, Mycobacterium bovis
GFDPTARTAWLAEGLLMYLPAEAQDRLFTQVGA

SEQ ID NO: 218351 - protein, 20 aa, Mycobacterium bovis
GFDRLRLIQRITDRLPAKAP

SEQ ID NO: 218352 - protein, 19 aa, Mycobacterium bovis
GFEMQFGTNHLGHFALTGL

SEQ ID NO: 218353 - protein, 22 aa, Mycobacterium bovis
GFGAVGHPTPQPAALGAAGVVA

SEQ ID NO: 218354 - protein, 18 aa, Mycobacterium bovis
GFGEEAFGMAKDSWDLGP

SEQ ID NO: 218355 - protein, 18 aa, Mycobacterium bovis
GFGGRRFDSGFGGGFGGF

SEQ ID NO: 218356 - protein, 25 aa, Mycobacterium bovis
GFIGSPAMNLFRLSIADSTVSLGDW

SEQ ID NO: 218357 - protein, 30 aa, Mycobacterium bovis
GFITGNYSNGFWWRGDYQGLAGISQTITVP

SEQ ID NO: 218358 - protein, 24 aa, Mycobacterium bovis
GFLGPRVYELLYGDPFPSGVQTAE

SEQ ID NO: 218359 - protein, 32 aa, Mycobacterium bovis
GFLGRYLALEWLDRMDLVNGKLICLVRARSDE

SEQ ID NO: 218360 - protein, 20 aa, Mycobacterium bovis
GFLMMAHTIAPEKLAAQARI

SEQ ID NO: 218361 - protein, 24 aa, Mycobacterium bovis
GFNIARVVAVALGYDFLPGTTVNR

SEQ ID NO: 218362 - protein, 26 aa, Mycobacterium bovis
GFPIAKIAAKLAIGYTLDEIVNDITG

SEQ ID NO: 218363 - protein, 32 aa, Mycobacterium bovis
GFPKASVMTHHRWLRALAVFGGMGLRLKGSDT

SEQ ID NO: 218364 - protein, 18 aa, Mycobacterium bovis
GFQLHPAIAALVSGLRLR

SEQ ID NO: 218365 - protein, 22 aa, Mycobacterium bovis
GFRAREIVLTLFEKITGLRMNS

SEQ ID NO: 218366 - protein, 23 aa, Mycobacterium bovis
GFRLGITTDWKSRWYADKQYAEY

SEQ ID NO: 218367 - protein, 27 aa, Mycobacterium bovis
GFTEFVPLPFVHQNSPLYLAGAARPGP

SEQ ID NO: 218368 - protein, 22 aa, Mycobacterium bovis
GFVAHRGMTVLPLAKSASGGEL

SEQ ID NO: 218369 - protein, 28 aa, Mycobacterium bovis
GFVSEDKFFIIGRIKDLLIVYGRNHSPD

SEQ ID NO: 218370 - protein, 20 aa, Mycobacterium bovis
GFVVADLLAARLGAKFKAHK

SEQ ID NO: 218371 - protein, 18 aa, Mycobacterium bovis
GGAAFSKHLPIERAFRDA

SEQ ID NO: 218372 - protein, 23 aa, Mycobacterium bovis
GGAAVIGGLPGNGGAGGNAGLIG

SEQ ID NO: 218373 - protein, 23 aa, Mycobacterium bovis
GGADTVLVHPFDVAIPGGFPGTA

SEQ ID NO: 218374 - protein, 31 aa, Mycobacterium bovis
GGAEHAVLHLLYSRFWHKVLYDLGHVSSREP

SEQ ID NO: 218375 - protein, 22 aa, Mycobacterium bovis
GGAGFVYIGGMQRLLAAGQVPD

SEQ ID NO: 218376 - protein, 24 aa, Mycobacterium bovis
GGAGGAGGWLWGNGGAGGNGGVGV

SEQ ID NO: 218377 - protein, 26 aa, Mycobacterium bovis
GGAGGHGGWLWGNGGVGGSGGAGVGA

SEQ ID NO: 218378 - protein, 23 aa, Mycobacterium bovis
GGAGGLGVGLLGGAGGAGGPGGA

SEQ ID NO: 218379 - protein, 30 aa, Mycobacterium bovis
GGAGGNAGLLIGAAGLGGCGGGAFTAGVTT

SEQ ID NO: 218380 - protein, 25 aa, Mycobacterium bovis
GGAGGNGGWLYGNGGLGGNGGAATQ

SEQ ID NO: 218381 - protein, 19 aa, Mycobacterium bovis
GGAGGWIYGHGGHGGAGGN

SEQ ID NO: 218382 - protein, 19 aa, Mycobacterium bovis
GGALLLEPGTLATLGAAAG

SEQ ID NO: 218383 - protein, 32 aa, Mycobacterium bovis
GGAPKGWGWVAPYIGMIWPNGDSTKLRAAAVA

SEQ ID NO: 218384 - protein, 25 aa, Mycobacterium bovis
GGARNAGLLAVRMLGAANPQLRARI

SEQ ID NO: 218385 - protein, 17 aa, Mycobacterium bovis
GGAYFFRQLTHDGLTEA

SEQ ID NO: 218386 - protein, 19 aa, Mycobacterium bovis
GGAYRLIDFVLSNLVNARY

SEQ ID NO: 218387 - protein, 25 aa, Mycobacterium bovis
GGCAGLRYNLFFDDRTLDGDQTAEF

SEQ ID NO: 218388 - protein, 24 aa, Mycobacterium bovis
GGCWRTFLTCDANLAVTLPPGLTD

SEQ ID NO: 218389 - protein, 21 aa, Mycobacterium bovis
GGDAGLFLGAAGTGGQAALSQ

SEQ ID NO: 218390 - protein, 22 aa, Mycobacterium bovis
GGDAGMLSLGAAGGAGGSGGSS

SEQ ID NO: 218391 - protein, 26 aa, Mycobacterium bovis
GGDGGAAGLFGAGGIGGAGGPGFNGG

SEQ ID NO: 218392 - protein, 25 aa, Mycobacterium bovis
GGDPGLGARLFQVGSRGGDGGVGGW

SEQ ID NO: 218393 - protein, 19 aa, Mycobacterium bovis
GGDTAVQLGLPRLAARINN

SEQ ID NO: 218394 - protein, 26 aa, Mycobacterium bovis
GGEEALYLRPFIFATEPGLGVRPATQ

SEQ ID NO: 218395 - protein, 20 aa, Mycobacterium bovis
GGEMIVLAKFDPAEVLRIIE

SEQ ID NO: 218396 - protein, 24 aa, Mycobacterium bovis
GGFEYFYGFIGGEANQWYPSLYEG

SEQ ID NO: 218397 - protein, 20 aa, Mycobacterium bovis
GGFGGSGGRGGLLLGTGGAG

SEQ ID NO: 218398 - protein, 25 aa, Mycobacterium bovis
GGFGHLLILGFDYSDNPGPWKESLR

SEQ ID NO: 218399 - protein, 17 aa, Mycobacterium bovis
GGFLIRRGPMARGDFST

SEQ ID NO: 218400 - protein, 25 aa, Mycobacterium bovis
GGFTPRTWVALATEYFLAGRARVLV

SEQ ID NO: 218401 - protein, 25 aa, Mycobacterium bovis
GGGARWLIPRLDLPAKKRDAIVGLA

SEQ ID NO: 218402 - protein, 25 aa, Mycobacterium bovis
GGGATGTLTFFGSGGDGGPGGAGAN

SEQ ID NO: 218403 - protein, 20 aa, Mycobacterium bovis
GGGGTGGFGFAAGGQGGVGG

SEQ ID NO: 218404 - protein, 31 aa, Mycobacterium bovis
GGGHGGNGGNPGWLLGTAGGGGNGGAGSTGT

SEQ ID NO: 218405 - protein, 18 aa, Mycobacterium bovis
GGGPAPRPILDAAAAAGI

SEQ ID NO: 218406 - protein, 26 aa, Mycobacterium bovis
GGGTMTHAWLLTGPPGSGRSVAALCF

SEQ ID NO: 218407 - protein, 24 aa, Mycobacterium bovis
GGHEAVLPSAFFFEIAQWADGDGE

SEQ ID NO: 218408 - protein, 26 aa, Mycobacterium bovis
GGHGGAGGWLYGNGGAGGFGGAGAVG

SEQ ID NO: 218409 - protein, 29 aa, Mycobacterium bovis
GGIAAVHRLVTRLGLVTRLGLVERVDAHS

SEQ ID NO: 218410 - protein, 17 aa, Mycobacterium bovis
GGKAGLYGNGGDGGAGG

SEQ ID NO: 218411 - protein, 25 aa, Mycobacterium bovis
GGKGGTGGWLWGSGGAGGAGGSGGG

SEQ ID NO: 218412 - protein, 25 aa, Mycobacterium bovis
GGKPYGVDVLLPPKYIGAEQGGIDA

SEQ ID NO: 218413 - protein, 18 aa, Mycobacterium bovis
GGKTPINFINVQRALIDD

SEQ ID NO: 218414 - protein, 20 aa, Mycobacterium bovis
GGKYGSHWLVDNRPDLFDGI

SEQ ID NO: 218415 - protein, 17 aa, Mycobacterium bovis
GGLGLVVARWLVDRGAG

SEQ ID NO: 218416 - protein, 17 aa, Mycobacterium bovis
GGLPLQRLVNGESMAAV

SEQ ID NO: 218417 - protein, 19 aa, Mycobacterium bovis
GGLSRVLPIYPTVDTALGK

SEQ ID NO: 218418 - protein, 18 aa, Mycobacterium bovis
GGLVHIFLPPTDALEHFI

SEQ ID NO: 218419 - protein, 26 aa, Mycobacterium bovis
GGLVTRSFSPRWRGLKADVVHVDPDP

SEQ ID NO: 218420 - protein, 27 aa, Mycobacterium bovis
GGLYRQWALARRAQGDLWAAPSGWRGG

SEQ ID NO: 218421 - protein, 24 aa, Mycobacterium bovis
GGMELGAMTPMFVGFRAREIVLTL

SEQ ID NO: 218422 - protein, 25 aa, Mycobacterium bovis
GGMGGDYFALSLVLEELGKVDQSVA

SEQ ID NO: 218423 - protein, 20 aa, Mycobacterium bovis
GGMHALIWHHGAIIAHAAVI

SEQ ID NO: 218424 - protein, 17 aa, Mycobacterium bovis
GGMHAVLGPFWPRNPWT

SEQ ID NO: 218425 - protein, 17 aa, Mycobacterium bovis
GGMHSLWTDVLAAQVFA

SEQ ID NO: 218426 - protein, 21 aa, Mycobacterium bovis
GGNAGLWGNGGAGGAGAAGAA

SEQ ID NO: 218427 - protein, 23 aa, Mycobacterium bovis
GGNAGVIANGSFAPSFVGFGGNG

SEQ ID NO: 218428 - protein, 24 aa, Mycobacterium bovis
GGNAVIPGDGVGKAPHGGAGGSGG

SEQ ID NO: 218429 - protein, 27 aa, Mycobacterium bovis
GGNGGDGGWLFGSGGNGAPGAAGQSGG

SEQ ID NO: 218430 - protein, 25 aa, Mycobacterium bovis
GGNGGHGGLWIGNGGDGGAGGVGGV

SEQ ID NO: 218431 - protein, 27 aa, Mycobacterium bovis
GGNGGNGALLIGAGGVGGAGGIGGQGT

SEQ ID NO: 218432 - protein, 28 aa, Mycobacterium bovis
GGNGGNGALLIGGGGLGGAGGMGGTGGG

SEQ ID NO: 218433 - protein, 25 aa, Mycobacterium bovis
GGNGGSAGLWGNGGAGGAGGSGGAA

SEQ ID NO: 218434 - protein, 24 aa, Mycobacterium bovis
GGNHAFYLAIPPKSFPVVCEQLHK

SEQ ID NO: 218435 - protein, 17 aa, Mycobacterium bovis
GGNPVCAAAALAVLRVL

SEQ ID NO: 218436 - protein, 25 aa, Mycobacterium bovis
GGNQDWWPNRLNLKVLHQNPAVADP

SEQ ID NO: 218437 - protein, 27 aa, Mycobacterium bovis
GGPATIVPMFLLYDYSFLPEGANSKAE

SEQ ID NO: 218438 - protein, 24 aa, Mycobacterium bovis
GGPAVAGVLGGMPGAGGNGGNANW

SEQ ID NO: 218439 - protein, 37 aa, Mycobacterium bovis
GGPLLAVPPHGWVNLHFSLLPAWRGAAPVQAAIAAGD

SEQ ID NO: 218440 - protein, 23 aa, Mycobacterium bovis
GGQGAALIGLGAGGAGGAGGATV

SEQ ID NO: 218441 - protein, 21 aa, Mycobacterium bovis
GGQVGLAAQVGLGFTAVIEAE

SEQ ID NO: 218442 - protein, 24 aa, Mycobacterium bovis
GGRAVLVLSDWPAPQAPQSASGEM

SEQ ID NO: 218443 - protein, 28 aa, Mycobacterium bovis
GGRAVVMTYWNPVLRYGVDAFARDLAAA

SEQ ID NO: 218444 - protein, 23 aa, Mycobacterium bovis
GGRELDLWLHRAAVDLVAVHADQ

SEQ ID NO: 218445 - protein, 27 aa, Mycobacterium bovis
GGRGAHGTLFSSLAGTGGTGGNGGTGG

SEQ ID NO: 218446 - protein, 21 aa, Mycobacterium bovis
GGRGGLLIGDGGAGGAGGVGG

SEQ ID NO: 218447 - protein, 31 aa, Mycobacterium bovis; identical to SEQ ID NO: 114747

SEQ ID NO: 218448 - protein, 17 aa, Mycobacterium bovis
GGRLVVELTPDEAAALG

SEQ ID NO: 218449 - protein, 20 aa, Mycobacterium bovis
GGRPDELTLIAPASARLLVA

SEQ ID NO: 218450 - protein, 17 aa, Mycobacterium bovis
GGRVKDLPGVRYKIIRG

SEQ ID NO: 218451 - protein, 18 aa, Mycobacterium bovis
GGRWPDHPKFHGPKGIGY

SEQ ID NO: 218452 - protein, 23 aa, Mycobacterium bovis
GGSAGLIGIGGTGGAGGAGAVGG

SEQ ID NO: 218453 - protein, 23 aa, Mycobacterium bovis
GGSAGLLGYVGRAGDGGAGGGGG

SEQ ID NO: 218454 - protein, 20 aa, Mycobacterium bovis
GGSAMLFGAGGAGGAGGAAT

SEQ ID NO: 218455 - protein, 25 aa, Mycobacterium bovis
GGSFIYVPPGVHVDIPLQAYFRINT

SEQ ID NO: 218456 - protein, 24 aa, Mycobacterium bovis
GGSGFLVDYPLEQYIRDAKIDSLY

SEQ ID NO: 218457 - protein, 22 aa, Mycobacterium bovis
GGSGGSLFGFGGAGGTGGSSGI

SEQ ID NO: 218458 - protein, 24 aa, Mycobacterium bovis
GGSPPAALSWVEPILQATTTLCVA

SEQ ID NO: 218459 - protein, 26 aa, Mycobacterium bovis
GGTGGNGALLFGFGGAGGAGGHGGAA

SEQ ID NO: 218460 - protein, 25 aa, Mycobacterium bovis
GGTGLLDLLNRLGITPLPNTAGCRS

SEQ ID NO: 218461 - protein, 20 aa, Mycobacterium bovis
GGTRNGTIVHWPNGIAAKGE

SEQ ID NO: 218462 - protein, 25 aa, Mycobacterium bovis
GGVGGNGGWLYGNGGAGGLGGTGVA

SEQ ID NO: 218463 - protein, 20 aa, Mycobacterium bovis
GGVGPLTRAFLLTNVVELAE

SEQ ID NO: 218464 - protein, 23 aa, Mycobacterium bovis
GGVGWTTRRFGLSCDNLVAVRLV

SEQ ID NO: 218465 - protein, 26 aa, Mycobacterium bovis
GGVKGFFEKTFAPLGLKKIQAEVLSN

SEQ ID NO: 218466 - protein, 24 aa, Mycobacterium bovis
GGVPVVMKALLDAGLLHGDCLTVT

SEQ ID NO: 218467 - protein, 21 aa, Mycobacterium bovis
GGVRALNPLFGTENLRRIEPL

SEQ ID NO: 218468 - protein, 25 aa, Mycobacterium bovis
GGVSFWASLFPAVWSFCLALRSRGL

SEQ ID NO: 218469 - protein, 25 aa, Mycobacterium bovis
GGVSPDRWLLALRAELELAAAKLDA

SEQ ID NO: 218470 - protein, 27 aa, Mycobacterium bovis
GGVVLLMWAGILAYLDRYGYDYVTGCV

SEQ ID NO: 218471 - protein, 29 aa, Mycobacterium bovis
GGVVNEEVAPWLDLVRKLGVLAGVLSDEL

SEQ ID NO: 218472 - protein, 23 aa, Mycobacterium bovis
GGVYVMLEPRRFASGSALGMLSA

SEQ ID NO: 218473 - protein, 22 aa, Mycobacterium bovis
GGWSVGAVALVAGWAARNLPAD

SEQ ID NO: 218474 - protein, 26 aa, Mycobacterium bovis
GGYAPNRTGWLLPFASELVTSAQARR

SEQ ID NO: 218475 - protein, 26 aa, Mycobacterium bovis
GGYCGYLLYNLTTSGFRPATFAAIVD

SEQ ID NO: 218476 - protein, 18 aa, Mycobacterium bovis
GGYFESRSLTRLAGRLLG

SEQ ID NO: 218477 - protein, 20 aa, Mycobacterium bovis
GGYGYMREYPVARAYLDSRV

SEQ ID NO: 218478 - protein, 25 aa, Mycobacterium bovis
GGYPFEGLRILDLGIIVAGGELSRL

SEQ ID NO: 218479 - protein, 23 aa, Mycobacterium bovis
GHAAELFGWLGPHPDTMVSSAAT

SEQ ID NO: 218480 - protein, 33 aa, Mycobacterium bovis
GHADSVVIPFLLPDIPVVAWWPDIAPAVPAQDA

SEQ ID NO: 218481 - protein, 19 aa, Mycobacterium bovis
GHAIELRVYRFGGSLHLDW

SEQ ID NO: 218482 - protein, 20 aa, Mycobacterium bovis
GHAQAYQALSAQAALFHEQF

SEQ ID NO: 218483 - protein, 22 aa, Mycobacterium bovis
GHDYTWFVLNAKIIEKEFALSG

SEQ ID NO: 218484 - protein, 26 aa, Mycobacterium bovis
GHEVGWSMLPVARSVLRRIGDGTDVV

SEQ ID NO: 218485 - protein, 24 aa, Mycobacterium bovis
GHEWDLVVIAGLQDGLWPNTVPRG

SEQ ID NO: 218486 - protein, 23 aa, Mycobacterium bovis
GHFALVTGILDWLARPARIVVVS

SEQ ID NO: 218487 - protein, 25 aa, Mycobacterium bovis
GHIEAPTLILHRVGSTYIPVGHGRY

SEQ ID NO: 218488 - protein, 21 aa, Mycobacterium bovis
GHIEFPYVYLDATYLNVRNGT

SEQ ID NO: 218489 - protein, 21 aa, Mycobacterium bovis
GHLAAILYDIPHILTAHSLEP

SEQ ID NO: 218490 - protein, 26 aa, Mycobacterium bovis
GHLPKGLGVIGLLIEDPKPLRLDDVS

SEQ ID NO: 218491 - protein, 17 aa, Mycobacterium bovis
GHLPMTDLTLEEGVVFN

SEQ ID NO: 218492 - protein, 25 aa, Mycobacterium bovis
GHNYIGTEHILLGLIREGEGVAAQV

SEQ ID NO: 218493 - protein, 20 aa, Mycobacterium bovis
GHPLGYIATDVYARYFRMVG

SEQ ID NO: 218494 - protein, 26 aa, Mycobacterium bovis
GHPTFPRTRLTPICQLPTAAIDSTAG

SEQ ID NO: 218495 - protein, 17 aa, Mycobacterium bovis
GHQWLTGLRIEDGLLKK

SEQ ID NO: 218496 - protein, 25 aa, Mycobacterium bovis
GHRLRADAILLRRTDRLPFAEPPDW

SEQ ID NO: 218497 - protein, 22 aa, Mycobacterium bovis
GHRYRWLRGTGLLAAAACAGFF

SEQ ID NO: 218498 - protein, 21 aa, Mycobacterium bovis
GHRYYWKSDYLAELNDEAIDL

SEQ ID NO: 218499 - protein, 27 aa, Mycobacterium bovis
GHSSLTLYIQLYLGGFGLELSDIESLR

SEQ ID NO: 218500 - protein, 19 aa, Mycobacterium bovis
GHTEWLPPPHLDHGQPWTN

SEQ ID NO: 218501 - protein, 24 aa, Mycobacterium bovis
GHTHAWYTTPLLTSPLGAAITPIG

SEQ ID NO: 218502 - protein, 20 aa, Mycobacterium bovis
GHWLLAHNGVVDRAVLPAGP

SEQ ID NO: 218503 - protein, 31 aa, Mycobacterium bovis
GIAKQLKDELASCPPILVLTGRPDDTWLASW

SEQ ID NO: 218504 - protein, 25 aa, Mycobacterium bovis
GIANVRILDGGLPAWRSAGGSIETG

SEQ ID NO: 218505 - protein, 17 aa, Mycobacterium bovis
GIAPSATHRRSIDLSYV

SEQ ID NO: 218506 - protein, 19 aa, Mycobacterium bovis
GIATWPARAGLAAADTGLN

SEQ ID NO: 218507 - protein, 17 aa, Mycobacterium bovis
GICFGNQILGRALGLST

SEQ ID NO: 218508 - protein, 18 aa, Mycobacterium bovis
GIDMYWPGRLDGCAEPHV

SEQ ID NO: 218509 - protein, 24 aa, Mycobacterium bovis
GIEKNLEYRYWTQGVTFVTRMDYL

SEQ ID NO: 218510 - protein, 27 aa, Mycobacterium bovis
GIGCSSRFPYYLETYGFHSIHGRAPAI

SEQ ID NO: 218511 - protein, 25 aa, Mycobacterium bovis
GIGFVFQHYAAFKHLTVRDNVAFGL

SEQ ID NO: 218512 - protein, 33 aa, Mycobacterium bovis
GIGGGTGGAGGHAWLFGHGGTGGIGGGPGGNGG

SEQ ID NO: 218513 - protein, 30 aa, Mycobacterium bovis
GIGPITVLPPIHIPPIPVGFAAVGGIGPIA

SEQ ID NO: 218514 - protein, 23 aa, Mycobacterium bovis
GIGREMHVIVGQGKLEEILQSRP

SEQ ID NO: 218515 - protein, 18 aa, Mycobacterium bovis
GILMGYGWHRGRDEGQLL

SEQ ID NO: 218516 - protein, 19 aa, Mycobacterium bovis
GIPAVERLAYFAEGAAAQL

SEQ ID NO: 218517 - protein, 29 aa, Mycobacterium bovis
GIPAVTFWAAVPHYVSHPPNPKATIALLR

SEQ ID NO: 218518 - protein, 19 aa, Mycobacterium bovis
GIQRPLIVFTPKSMLRHKA

SEQ ID NO: 218519 - protein, 26 aa, Mycobacterium bovis
GIRARQMFDGYRFQRGPVLVVVEDGR

SEQ ID NO: 218520 - protein, 20 aa, Mycobacterium bovis
GIRRFGDAFIPMDETLAHAA

SEQ ID NO: 218521 - protein, 24 aa, Mycobacterium bovis
GITIAYFESKLPAGTPVVRAMPNA

SEQ ID NO: 218522 - protein, 24 aa, Mycobacterium bovis
GIVSRRRYHTLRGARPTRPPPPML

SEQ ID NO: 218523 - protein, 20 aa, Mycobacterium bovis
GKALKFYASVRMDVRRVETL

SEQ ID NO: 218524 - protein, 31 aa, Mycobacterium bovis
GKANFAVNPLQWVPVPPGRLVLQTLRSHDQY

SEQ ID NO: 218525 - protein, 38 aa, Mycobacterium bovis
GKDIIRFHAVYWPAFLMSAGIELPRRIFAHGFLHNRGE

SEQ ID NO: 218526 - protein, 23 aa, Mycobacterium bovis
GKGGASGMLIGNGGNGGSGGVGG

SEQ ID NO: 218527 - protein, 24 aa, Mycobacterium bovis
GKGSLIHTTWSPEGWVRVAGRVVS

SEQ ID NO: 218528 - protein, 23 aa, Mycobacterium bovis
GKIYVRFPEAVSMRQYLGAPHGE

SEQ ID NO: 218529 - protein, 21 aa, Mycobacterium bovis
GKKLIGIVSIGDVVKSRMGEL

SEQ ID NO: 218530 - protein, 24 aa, Mycobacterium bovis
GKKYGPIAALPKYDSAPANRYRLP

SEQ ID NO: 218531 - protein, 20 aa, Mycobacterium bovis
GKLAARLRGQGHTPLLVACD

SEQ ID NO: 218532 - protein, 39 aa, Mycobacterium bovis
GKLLSPTRIRRLLTVSRLLAPILTPVIYRAAMAARGLID

SEQ ID NO: 218533 - protein, 22 aa, Mycobacterium bovis
GKLRPPVFGILRYITDAVDEID

SEQ ID NO: 218534 - protein, 28 aa, Mycobacterium bovis
GKNTVLWCGYTWQYWLTTRSVNPAEYRF

SEQ ID NO: 218535 - protein, 25 aa, Mycobacterium bovis
GKNVVTPLGWFYPSEKEAAPLEVAA

SEQ ID NO: 218536 - protein, 33 aa, Mycobacterium bovis
GKPADILRPVADRLWYPLWDANIRLDHSVRTVS

SEQ ID NO: 218537 - protein, 22 aa, Mycobacterium bovis
GKPLEVVVFHHRPERYQFSVTL

SEQ ID NO: 218538 - protein, 26 aa, Mycobacterium bovis
GKRIERGLWLTALLQATLSTVRHPAA

SEQ ID NO: 218539 - protein, 17 aa, Mycobacterium bovis
GKRRLAYEIAKHAEGIY

SEQ ID NO: 218540 - protein, 27 aa, Mycobacterium bovis
GKSTLLLEVAHRWAQSGRRALYVSGEE

SEQ ID NO: 218541 - protein, 19 aa, Mycobacterium bovis
GKTMVVTGLHLLGGARADA

SEQ ID NO: 218542 - protein, 20 aa, Mycobacterium bovis
GKVIYPGRKQVFRKLEHGVF

SEQ ID NO: 218543 - protein, 30 aa, Mycobacterium bovis
GKVLPAMLKRQLQLLLPLVEDRFVESVCLS

SEQ ID NO: 218544 - protein, 23 aa, Mycobacterium bovis
GKVRRVRLLPTDPPATRQAVDAI

SEQ ID NO: 218545 - protein, 24 aa, Mycobacterium bovis
GKYQSLDFRFPYPDASFDVVFLTS

SEQ ID NO: 218546 - protein, 27 aa, Mycobacterium bovis
GLAAGLRNLYLLPSSPLSELRKRLPNA

SEQ ID NO: 218547 - protein, 23 aa, Mycobacterium bovis
GLADCVLALGFEKMQPGALGGGA

SEQ ID NO: 218548 - protein, 19 aa, Mycobacterium bovis
GLAECRDGRWRILRAGAGQ

SEQ ID NO: 218549 - protein, 17 aa, Mycobacterium bovis
GLAEIQLPDLQPGSSIM

SEQ ID NO: 218550 - protein, 25 aa, Mycobacterium bovis
GLAERLMEFFGGIPILDGIGSTEVG

SEQ ID NO: 218551 - protein, 27 aa, Mycobacterium bovis
GLAGFSFGYPIPLFPAVGADVTGDIGP

SEQ ID NO: 218552 - protein, 25 aa, Mycobacterium bovis
GLAKPAGIYQLTDANWMAIMGDRTV

SEQ ID NO: 218553 - protein, 19 aa, Mycobacterium bovis
GLARDLAFIAFSSADGDLV

SEQ ID NO: 218554 - protein, 23 aa, Mycobacterium bovis
GLASTDQLYFASGLLDCPGAMFT

SEQ ID NO: 218555 - protein, 24 aa, Mycobacterium bovis
GLATVIPFHRAVVSDPAFIGDANG

SEQ ID NO: 218556 - protein, 23 aa, Mycobacterium bovis
GLAVQPMSPIFLYARGRHDLDQA

SEQ ID NO: 218557 - protein, 20 aa, Mycobacterium bovis
GLCDVKAVWRSGTQVPLQAS

SEQ ID NO: 218558 - protein, 18 aa, Mycobacterium bovis
GLDEDLLQVLPGKGTVVG

SEQ ID NO: 218559 - protein, 30 aa, Mycobacterium bovis
GLDEDRLRKALWNLYWRGTANMRERIEAEL

SEQ ID NO: 218560 - protein, 19 aa, Mycobacterium bovis
GLDLDASLRLWERGEQLAK

SEQ ID NO: 218561 - protein, 26 aa, Mycobacterium bovis
GLDSRAFRLQWPIGTTIFELDRPQVL

SEQ ID NO: 218562 - protein, 27 aa, Mycobacterium bovis
GLDVTIVRPFNIFGVRQKAGRFGALIP

SEQ ID NO: 218563 - protein, 32 aa, Mycobacterium bovis
GLDYDDYVYPGHAIWWLARGLEFFQDGEQFGE

SEQ ID NO: 218564 - protein, 24 aa, Mycobacterium bovis
GLERIGLRFVLEIRVPAGVDGRIT

SEQ ID NO: 218565 - protein, 19 aa, Mycobacterium bovis
GLEWDAVFLVGLADGTLPI

SEQ ID NO: 218566 - protein, 18 aa, Mycobacterium bovis
GLFLNWVDRVIGPGDPAL

SEQ ID NO: 218567 - protein, 24 aa, Mycobacterium bovis
GLFSGFMSGFGNTGFLQSGFGNLE

SEQ ID NO: 218568 - protein, 25 aa, Mycobacterium bovis
GLGDDLRRTLLKLRRSRSNVQRLKL

SEQ ID NO: 218569 - protein, 25 aa, Mycobacterium bovis
GLGGFAGLFTLRGDYREPVLAASSD

SEQ ID NO: 218570 - protein, 23 aa, Mycobacterium bovis
GLGGFAYQSAVSEIPWSYDIGSN

SEQ ID NO: 218571 - protein, 17 aa, Mycobacterium bovis
GLGGLLLGNGGAGGVGG

SEQ ID NO: 218572 - protein, 26 aa, Mycobacterium bovis
GLGLDFLRHIERCAVLVHVVDCATAE

SEQ ID NO: 218573 - protein, 22 aa, Mycobacterium bovis
GLGSPALLYLAAAGVGTIGIID

SEQ ID NO: 218574 - protein, 24 aa, Mycobacterium bovis
GLHFICRDVWLRVASTSTAWTSRF

SEQ ID NO: 218575 - protein, 22 aa, Mycobacterium bovis
GLIAPLRPDRYLRIVAAMRREG

SEQ ID NO: 218576 - protein, 23 aa, Mycobacterium bovis
GLIKTILCLKNKALPATLHYTSP

SEQ ID NO: 218577 - protein, 18 aa, Mycobacterium bovis
GLITNMRGYWNLDMMTFG

SEQ ID NO: 218578 - protein, 25 aa, Mycobacterium bovis
GLLDLSSLWQIYAVDRPTLKDRTFV

SEQ ID NO: 218579 - protein, 38 aa, Mycobacterium bovis
GLLEQSRRHAFLASLLGIRHLVLAVNKMDLLGWDQEKF

SEQ ID NO: 218580 - protein, 19 aa, Mycobacterium bovis
GLLETYHDVLRLPVDLVVT

SEQ ID NO: 218581 - protein, 24 aa, Mycobacterium bovis
GLLGSRWLAHYTATSAFLDSFAGA

SEQ ID NO: 218582 - protein, 19 aa, Mycobacterium bovis
GLLKFRTGVRPPVPLDEVE

SEQ ID NO: 218583 - protein, 36 aa, Mycobacterium bovis
GLLLRLRFELDHHINLRPARLYPGVASPLSGNPGID

SEQ ID NO: 218584 - protein, 25 aa, Mycobacterium bovis
GLNAKWPVYLSTKNTILKAYDGMFK

SEQ ID NO: 218585 - protein, 23 aa, Mycobacterium bovis
GLNLSIRDGWWDEWYDGENGWEI

SEQ ID NO: 218586 - protein, 34 aa, Mycobacterium bovis
GLNMLRLWDDRRTLEPWIAPLTKALNDGTILPIV

SEQ ID NO: 218587 - protein, 22 aa, Mycobacterium bovis
GLPEMGLVGRQLWAQSGLTPAD

SEQ ID NO: 218588 - protein, 24 aa, Mycobacterium bovis
GLPGLSLPRTLIFDYPTASALAEC

SEQ ID NO: 218589 - protein, 17 aa, Mycobacterium bovis
GLPSSPWHERAKRLAPK

SEQ ID NO: 218590 - protein, 30 aa, Mycobacterium bovis; identical to SEQ ID NO: 114827

SEQ ID NO: 218591 - protein, 25 aa, Mycobacterium bovis
GLPVPVTSRHTLLLGPPGTGKTSVA

SEQ ID NO: 218592 - protein, 21 aa, Mycobacterium bovis
GLQARLMSQALRKMTGALNNS

SEQ ID NO: 218593 - protein, 24 aa, Mycobacterium bovis
GLQHAIRVLRYPTLEDDYANAWQE

SEQ ID NO: 218594 - protein, 19 aa, Mycobacterium bovis
GLQIMAPALADDRLYRVGA

SEQ ID NO: 218595 - protein, 24 aa, Mycobacterium bovis
GLRAAYLPCRLAPHVGALTTSLDL

SEQ ID NO: 218596 - protein, 25 aa, Mycobacterium bovis
GLRAGMPTLILWDVADQPIWAGAVQ

SEQ ID NO: 218597 - protein, 30 aa, Mycobacterium bovis
GLRDTGRCRVPLILRLDPKIGLPDIRAVLT

SEQ ID NO: 218598 - protein, 17 aa, Mycobacterium bovis
GLRIIVLDTSVPGHHHG

SEQ ID NO: 218599 - protein, 20 aa, Mycobacterium bovis
GLRLRLPVIATALGTYDTAS

SEQ ID NO: 218600 - protein, 23 aa, Mycobacterium bovis
GLSKIARLVDLYAKRPQVQERLT

SEQ ID NO: 218601 - protein, 18 aa, Mycobacterium bovis
GLTGRPPRAIPDPTPRSS

SEQ ID NO: 218602 - protein, 19 aa, Mycobacterium bovis
GLTSKPWVKTTIAPGSQVV

SEQ ID NO: 218603 - protein, 24 aa, Mycobacterium bovis
GLTWQQVVLLRAYAKYLRQAGFPY

SEQ ID NO: 218604 - protein, 19 aa, Mycobacterium bovis
GLVAIDTLLARMENDRDRL

SEQ ID NO: 218605 - protein, 25 aa, Mycobacterium bovis
GLVDAPLLAAELWERGRIVRSLGDH

SEQ ID NO: 218606 - protein, 19 aa, Mycobacterium bovis
GLVELALSAPTFQQLMQRA

SEQ ID NO: 218607 - protein, 21 aa, Mycobacterium bovis
GLVFQGWFHKAPYYPHDFFVP

SEQ ID NO: 218608 - protein, 19 aa, Mycobacterium bovis
GLVTATPRLALAVVTADCV

SEQ ID NO: 218609 - protein, 30 aa, Mycobacterium bovis
GLVVDLATRRKIFIPILRVAAIEPHAVTLS

SEQ ID NO: 218610 - protein, 18 aa, Mycobacterium bovis
GLYRLRALHRLCGVFVVR

SEQ ID NO: 218611 - protein, 17 aa, Mycobacterium bovis
GLYYVPINTHLTASEAA

SEQ ID NO: 218612 - protein, 25 aa, Mycobacterium bovis
GMAKGAGMLAPSLATMLCVLTTDAA

SEQ ID NO: 218613 - protein, 32 aa, Mycobacterium bovis
GMAVIISDFLGPINWMRPLRAIAARHEVLAIE

SEQ ID NO: 218614 - protein, 23 aa, Mycobacterium bovis
GMESLLGAIYLQHGMEKAREVIL

SEQ ID NO: 218615 - protein, 18 aa, Mycobacterium bovis
GMGINPFFDAPYADVSKG

SEQ ID NO: 218616 - protein, 26 aa, Mycobacterium bovis
GMGLDWASVFSGYRPKRVELPTYAFQ

SEQ ID NO: 218617 - protein, 23 aa, Mycobacterium bovis
GMGWVSLFDPQRLAALLAMPADA

SEQ ID NO: 218618 - protein, 17 aa, Mycobacterium bovis
GMIGITQALAPGLAAKG

SEQ ID NO: 218619 - protein, 18 aa, Mycobacterium bovis
GMIWRYPDYFIVGREQCR

SEQ ID NO: 218620 - protein, 19 aa, Mycobacterium bovis
GMLPAFRHTVEELFTAGLV

SEQ ID NO: 218621 - protein, 20 aa, Mycobacterium bovis
GMLTTPQLKAFYLDLQDERL

SEQ ID NO: 218622 - protein, 26 aa, Mycobacterium bovis
GMNEIVFPAAILQPPFFDPQADEAAN

SEQ ID NO: 218623 - protein, 19 aa, Mycobacterium bovis
GMNIFFVLGSGGSARLVTP

SEQ ID NO: 218624 - protein, 26 aa, Mycobacterium bovis
GMPNRIKWTIVRYKPPEGMTLNGDGV

SEQ ID NO: 218625 - protein, 27 aa, Mycobacterium bovis
GMQLTLTELWRSYGVQPDLVIGHSMGE

SEQ ID NO: 218626 - protein, 32 aa, Mycobacterium bovis
GMRDIRKHIAWYLHGFPAGSALRRALAMVKTL

SEQ ID NO: 218627 - protein, 23 aa, Mycobacterium bovis
GMRGLLRVIGAEHPHLKASYVDV

SEQ ID NO: 218628 - protein, 26 aa, Mycobacterium bovis
GMRREQPLPLGLRRLLTDLHNAGAAV

SEQ ID NO: 218629 - protein, 25 aa, Mycobacterium bovis
GMTETSPLATMAWPPPGTPDDQHWA

SEQ ID NO: 218630 - protein, 23 aa, Mycobacterium bovis
GMVRQWQSLFYAERYSQTDLATH

SEQ ID NO: 218631 - protein, 20 aa, Mycobacterium bovis
GMWDLSMLGIVPGIRVAAPR

SEQ ID NO: 218632 - protein, 19 aa, Mycobacterium bovis
GMYYHCTAPPLPGPLEIDV

SEQ ID NO: 218633 - protein, 34 aa, Mycobacterium bovis
GNADWVRINGFGTPWWADDLAMLADSPVGGVMLA

SEQ ID NO: 218634 - protein, 17 aa, Mycobacterium bovis
GNANWFGSGGAGGQGGT

SEQ ID NO: 218635 - protein, 25 aa, Mycobacterium bovis
GNATRARIVLFRKPIERRAKDTEEL

SEQ ID NO: 218636 - protein, 17 aa, Mycobacterium bovis
GNDLRGLNLTGCRLRET

SEQ ID NO: 218637 - protein, 22 aa, Mycobacterium bovis
GNEIVAFVLKNATRFGMQDVIW

SEQ ID NO: 218638 - protein, 25 aa, Mycobacterium bovis
GNEVTVPKGHRLPPSPKPGQKWVNV

SEQ ID NO: 218639 - protein, 23 aa, Mycobacterium bovis
GNFFRGAQLQQLGMERTRSDYMG

SEQ ID NO: 218640 - protein, 26 aa, Mycobacterium bovis
GNFSNGILWRGDYQGLAGFAVGYTLP

SEQ ID NO: 218641 - protein, 23 aa, Mycobacterium bovis
GNGATGTWGHNLGAGGTGGNGGN

SEQ ID NO: 218642 - protein, 23 aa, Mycobacterium bovis
GNGGAIFNAGTPGAAGTGGDGGV

SEQ ID NO: 218643 - protein, 25 aa, Mycobacterium bovis
GNGGTGGFAGFGGTAGNGGSGGTGG

SEQ ID NO: 218644 - protein, 21 aa, Mycobacterium bovis
GNGGVWYGNGGAGGAAGQGGP

SEQ ID NO: 218645 - protein, 22 aa, Mycobacterium bovis
GNGIALLRYLSAQAQQIEWSKV

SEQ ID NO: 218646 - protein, 19 aa, Mycobacterium bovis
GNGLLFGAGGTGGAGTLGA

SEQ ID NO: 218647 - protein, 20 aa, Mycobacterium bovis
GNGMLLSKHIRLIAAFDHRH

SEQ ID NO: 218648 - protein, 27 aa, Mycobacterium bovis
GNGSKGLPGLGRLGNPGLDGGTGGNGG

SEQ ID NO: 218649 - protein, 19 aa, Mycobacterium bovis
GNKLLIFQVYDHQTNFPLG

SEQ ID NO: 218650 - protein, 21 aa, Mycobacterium bovis
GNPAPRLFRLADDRALLNRMG

SEQ ID NO: 218651 - protein, 18 aa, Mycobacterium bovis
GNPPLACGLPALPQGNNP

SEQ ID NO: 218652 - protein, 32 aa, Mycobacterium bovis
GNPSNVIGLSLPLLRSLVQRCGLSVAALWAGN

SEQ ID NO: 218653 - protein, 21 aa, Mycobacterium bovis
GNQVPLTYPFALTFPSVMSLV

SEQ ID NO: 218654 - protein, 33 aa, Mycobacterium bovis
GNQWGELYLPRFLFGVFLSEQMIAAIAALGERD

SEQ ID NO: 218655 - protein, 38 aa, Mycobacterium bovis
GNTLMAIANRLPFPMTAWAVGLLMRLPQRGVVTVATNV

SEQ ID NO: 218656 - protein, 17 aa, Mycobacterium bovis
GNVTHGALRSAWIGYWV

SEQ ID NO: 218657 - protein, 20 aa, Mycobacterium bovis
GNWTGIPVFKLTEAETTRLL

SEQ ID NO: 218658 - protein, 17 aa, Mycobacterium bovis
GNYNIGFANLGNYNIGF

SEQ ID NO: 218659 - protein, 32 aa, Mycobacterium bovis
GNYSNGAFWRGDYQGLLGFSYTSTIIPEFTVA

SEQ ID NO: 218660 - protein, 26 aa, Mycobacterium bovis
GNYSNGVLWRGDYQGLIGADIALEIP

SEQ ID NO: 218661 - protein, 26 aa, Mycobacterium bovis
GPADIPLLVADLAYVRGMVYRQLHEE

SEQ ID NO: 218662 - protein, 23 aa, Mycobacterium bovis
GPAFQGTIKSAVAFGALLSRGIG

SEQ ID NO: 218663 - protein, 23 aa, Mycobacterium bovis
GPALLGPIGMIVAAALRADIRES

SEQ ID NO: 218664 - protein, 29 aa, Mycobacterium bovis
GPASLSMAAAVQPYLVWLTCTAESSALAA

SEQ ID NO: 218665 - protein, 25 aa, Mycobacterium bovis
GPDDPRPWLVDGERLRLLLREVFTA

SEQ ID NO: 218666 - protein, 25 aa, Mycobacterium bovis
GPDEVPLNFLNPRPGTPFADLEVMP

SEQ ID NO: 218667 - protein, 28 aa, Mycobacterium bovis
GPDGQPHLTAMWYAVIDGEIWLETKAKS

SEQ ID NO: 218668 - protein, 26 aa, Mycobacterium bovis
GPDSYGRFMRIRIFDCWMHEQDIRAA

SEQ ID NO: 218669 - protein, 20 aa, Mycobacterium bovis
GPDVWLAALATLPLVHQPGD

SEQ ID NO: 218670 - protein, 24 aa, Mycobacterium bovis
GPELAPADLAYTLARRRGHRPVRT

SEQ ID NO: 218671 - protein, 18 aa, Mycobacterium bovis
GPESWGFTGWRWFSGTAP

SEQ ID NO: 218672 - protein, 32 aa, Mycobacterium bovis
GPGDRVGIWAPNRWEWVLVQYATAEIGAILVT

SEQ ID NO: 218673 - protein, 23 aa, Mycobacterium bovis
GPGEFLDPLGGLAALRAKVLDTP

SEQ ID NO: 218674 - protein, 27 aa, Mycobacterium bovis
GPGENIPAWLVFDQRYRDRYIFAGLQP

SEQ ID NO: 218675 - protein, 19 aa, Mycobacterium bovis
GPGGLLYGNGGNGGAGDTA

SEQ ID NO: 218676 - protein, 26 aa, Mycobacterium bovis
GPGHPTPGWWDGVAGPGAPIDTTRWC

SEQ ID NO: 218677 - protein, 27 aa, Mycobacterium bovis
GPGQPGGPGGLLYGNGGHGGAGAAGQD

SEQ ID NO: 218678 - protein, 19 aa, Mycobacterium bovis
GPGVLQHPDLVILRGRTFG

SEQ ID NO: 218679 - protein, 19 aa, Mycobacterium bovis
GPHRVLRGDLAFAGLPGVV

SEQ ID NO: 218680 - protein, 21 aa, Mycobacterium bovis
GPIMRAMIDAGHRLAAVEYQT

SEQ ID NO: 218681 - protein, 24 aa, Mycobacterium bovis
GPIVIPDTTILPPLHLQITGDADY

SEQ ID NO: 218682 - protein, 22 aa, Mycobacterium bovis
GPLAHPFQPLLAPRLREFALRE

SEQ ID NO: 218683 - protein, 22 aa, Mycobacterium bovis
GPLEFPFVYRRHQLSLRISGRS

SEQ ID NO: 218684 - protein, 26 aa, Mycobacterium bovis
GPLLSGMFGTFPVAQTFHDAVGAAHA

SEQ ID NO: 218685 - protein, 22 aa, Mycobacterium bovis
GPLTAQFYNQFDPKTAVLNWKG

SEQ ID NO: 218686 - protein, 18 aa, Mycobacterium bovis
GPLTITPITLFAQQTFVN

SEQ ID NO: 218687 - protein, 26 aa, Mycobacterium bovis
GPLTTPPITIPAIPLGIDVSGSLGPI

SEQ ID NO: 218688 - protein, 30 aa, Mycobacterium bovis
GPMLHIVRHYRPIVVVLFLSAEIAAFENAD

SEQ ID NO: 218689 - protein, 26 aa, Mycobacterium bovis
GPNIDDFRLYELIWQRTVASQMADAR

SEQ ID NO: 218690 - protein, 25 aa, Mycobacterium bovis
GPPASHHLRWLASANGLLDIPEDVV

SEQ ID NO: 218691 - protein, 17 aa, Mycobacterium bovis
GPPPVPTSSPPTTPAGA

SEQ ID NO: 218692 - protein, 18 aa, Mycobacterium bovis
GPPVGGLLFTCNGRGRRM

SEQ ID NO: 218693 - protein, 24 aa, Mycobacterium bovis
GPQRDYWIRQLGGLAGETGLRPDF

SEQ ID NO: 218694 - protein, 17 aa, Mycobacterium bovis
GPQRFTPGGLVLTEWQG

SEQ ID NO: 218695 - protein, 24 aa, Mycobacterium bovis
GPSGGLLVVITTRAQSDGGRIGSR

SEQ ID NO: 218696 - protein, 23 aa, Mycobacterium bovis
GPSHHGLWDLALLACVPGFQIAC

SEQ ID NO: 218697 - protein, 18 aa, Mycobacterium bovis
GPSKFRMELLSLPQDEWA

SEQ ID NO: 218698 - protein, 17 aa, Mycobacterium bovis
GPSLWHRDFHDAVIVEC

SEQ ID NO: 218699 - protein, 21 aa, Mycobacterium bovis
GPSSLWLDAAGKRLPVPLFPG

SEQ ID NO: 218700 - protein, 25 aa, Mycobacterium bovis
GPTEQLYLAGAPLVAFSGLPIVPPG

SEQ ID NO: 218701 - protein, 29 aa, Mycobacterium bovis
GPTPPKVKSPFGVPGMPGLAGLPGGLPDL

SEQ ID NO: 218702 - protein, 23 aa, Mycobacterium bovis
GPTPRLNPWRTPIPKVYLCSAAT

SEQ ID NO: 218703 - protein, 30 aa, Mycobacterium bovis
GPTSEIWVKPSFFPGIRIAPSSGGGATSTQ

SEQ ID NO: 218704 - protein, 22 aa, Mycobacterium bovis
GPVEIAVIHRPRYDDWSLPKGK

SEQ ID NO: 218705 - protein, 23 aa, Mycobacterium bovis
GPVIPASAYLMKSPPEQLPDDIA

SEQ ID NO: 218706 - protein, 25 aa, Mycobacterium bovis
GPVNTPLLQELFAKNPERAARRMVH

SEQ ID NO: 218707 - protein, 20 aa, Mycobacterium bovis
GPVSLPIFGFGGAPGFGNDT

SEQ ID NO: 218708 - protein, 17 aa, Mycobacterium bovis
GPVWVFSGQGSQWAAMG

SEQ ID NO: 218709 - protein, 17 aa, Mycobacterium bovis
GPVWVFSGQGSQWAGMG

SEQ ID NO: 218710 - protein, 17 aa, Mycobacterium bovis
GPWHLLPTGPVVCSSAC

SEQ ID NO: 218711 - protein, 25 aa, Mycobacterium bovis
GPYFGDRRKAFLEDLAVVTGGQVVN

SEQ ID NO: 218712 - protein, 25 aa, Mycobacterium bovis
GQAGGPGGLLYGNGGNGAAGGPNQA

SEQ ID NO: 218713 - protein, 24 aa, Mycobacterium bovis
GQAGGPGGLLYGNGGNGGSGGVGQ

SEQ ID NO: 218714 - protein, 20 aa, Mycobacterium bovis
GQAPAALLGGDGLIPAELVA

SEQ ID NO: 218715 - protein, 23 aa, Mycobacterium bovis
GQAPVDVLTLFSYPVHPPGKPER

SEQ ID NO: 218716 - protein, 19 aa, Mycobacterium bovis
GQCPPMRYAPNAAAGNIGL

SEQ ID NO: 218717 - protein, 19 aa, Mycobacterium bovis
GQFSDEFLRWLAGVRFTGD

SEQ ID NO: 218718 - protein, 24 aa, Mycobacterium bovis
GQGGWPMTCFLTPNGRPFFCGTYY

SEQ ID NO: 218719 - protein, 24 aa, Mycobacterium bovis
GQGKTRLLRALAGLLDEWTPVIAG

SEQ ID NO: 218720 - protein, 24 aa, Mycobacterium bovis
GQGSVLVPFSWQGVSLHAAGASAV

SEQ ID NO: 218721 - protein, 24 aa, Mycobacterium bovis
GQLARLLRLLGFDTRWSSAADDPT

SEQ ID NO: 218722 - protein, 25 aa, Mycobacterium bovis
GQLEIKTILHRLLRRYRLELSRPDY

SEQ ID NO: 218723 - protein, 18 aa, Mycobacterium bovis
GQLIVIGMQGGVKAELNL

SEQ ID NO: 218724 - protein, 29 aa, Mycobacterium bovis
GQNARLAARLTGWRIDIRGDAPPPPPGQP

SEQ ID NO: 218725 - protein, 22 aa, Mycobacterium bovis
GQPFGVYLHVPFCLTRCGYCDF

SEQ ID NO: 218726 - protein, 26 aa, Mycobacterium bovis
GQQVLSRFLHDFAGLGAQWTPANIAN

SEQ ID NO: 218727 - protein, 28 aa, Mycobacterium bovis
GQRAKNMFALGLLSWMYGRELEHSEAFI

SEQ ID NO: 218728 - protein, 24 aa, Mycobacterium bovis
GQRDVRALLIDVLNVLLAAITAAG

SEQ ID NO: 218729 - protein, 21 aa, Mycobacterium bovis
GQRFVIDVTVWIDLAEAANSD

SEQ ID NO: 218730 - protein, 24 aa, Mycobacterium bovis
GQRRRVELARILFAASESGAGNST

SEQ ID NO: 218731 - protein, 25 aa, Mycobacterium bovis
GQTKWAVRWKPALNALAITFADRMP

SEQ ID NO: 218732 - protein, 17 aa, Mycobacterium bovis
GQTLFEHQALRLRMADL

SEQ ID NO: 218733 - protein, 24 aa, Mycobacterium bovis
GQTRGWFYTLHVLATALFDRPAFK

SEQ ID NO: 218734 - protein, 23 aa, Mycobacterium bovis
GQVDVYNMGWQRYVDARATDEQR

SEQ ID NO: 218735 - protein, 22 aa, Mycobacterium bovis
GQVFDWAPGVTLSLGLAAAHQS

SEQ ID NO: 218736 - protein, 22 aa, Mycobacterium bovis
GQVMMPAFDIGDAGRMSFITDP

SEQ ID NO: 218737 - protein, 24 aa, Mycobacterium bovis
GQVNKVWLWQSLPGPWIGSARNTV

SEQ ID NO: 218738 - protein, 22 aa, Mycobacterium bovis
GQYEAPLGITLRELLDYAGGVR

SEQ ID NO: 218739 - protein, 24 aa, Mycobacterium bovis
GRAALQKAVPLWRGVQAEVTASVG

SEQ ID NO: 218740 - protein, 17 aa, Mycobacterium bovis
GRAFSFISAIDSIGAVP

SEQ ID NO: 218741 - protein, 21 aa, Mycobacterium bovis
GRARAFALGQLRSLAERNGYP

SEQ ID NO: 218742 - protein, 23 aa, Mycobacterium bovis
GRASLTARTLYWEVPDRADHLAV

SEQ ID NO: 218743 - protein, 23 aa, Mycobacterium bovis
GRAVILEAMRRYLQQRRAMEPWE

SEQ ID NO: 218744 - protein, 20 aa, Mycobacterium bovis
GRAVPQYGFRPNFVARPPAA

SEQ ID NO: 218745 - protein, 19 aa, Mycobacterium bovis
GRCTPIAAWLAGLGLFTKR

SEQ ID NO: 218746 - protein, 18 aa, Mycobacterium bovis
GRDAGRRRPPVLSEAEFL

SEQ ID NO: 218747 - protein, 33 aa, Mycobacterium bovis
GRDTRVEFWAFDLLYLDGRALLGTRYQDRRKLL

SEQ ID NO: 218748 - protein, 19 aa, Mycobacterium bovis
GREHPLIARSSLGSAPRQA

SEQ ID NO: 218749 - protein, 20 aa, Mycobacterium bovis
GREYVAQFLISGAGALHIPS

SEQ ID NO: 218750 - protein, 26 aa, Mycobacterium bovis
GRFNDMILGLRMITPVGVLDLGRVPA

SEQ ID NO: 218751 - protein, 25 aa, Mycobacterium bovis
GRGDGGLHRFLLSAASAFVAGVAVN

SEQ ID NO: 218752 - protein, 25 aa, Mycobacterium bovis
GRGGAGGLGFGSEAPGRPGGAGGTG

SEQ ID NO: 218753 - protein, 19 aa, Mycobacterium bovis
GRGGLLLGTGGAGGDGGVG

SEQ ID NO: 218754 - protein, 25 aa, Mycobacterium bovis
GRGIGRRLLRELLDFARGGVVYLEV

SEQ ID NO: 218755 - protein, 18 aa, Mycobacterium bovis
GRHLVSRKTWSAAAAVVL

SEQ ID NO: 218756 - protein, 26 aa, Mycobacterium bovis
GRIDPRTRWLLRELVYALLVKKDHAA

SEQ ID NO: 218757 - protein, 19 aa, Mycobacterium bovis
GRIGRLPKPEPLRTFVARL

SEQ ID NO: 218758 - protein, 23 aa, Mycobacterium bovis
GRIQRELPDWLSADVAILGEPTA

SEQ ID NO: 218759 - protein, 18 aa, Mycobacterium bovis
GRIRAGIRQLTAPRRVAR

SEQ ID NO: 218760 - protein, 41 aa, Mycobacterium bovis
GRITLGEDLVLYLFGTPGQRRFWFMWDDLVRGAIGAIVLVD

SEQ ID NO: 218761 - protein, 25 aa, Mycobacterium bovis
GRIYAELTRLCRYPLLVVDEVGYIP

SEQ ID NO: 218762 - protein, 18 aa, Mycobacterium bovis
GRKIGDLVDEPLWRVVQA

SEQ ID NO: 218763 - protein, 23 aa, Mycobacterium bovis
GRLEALLNFQTLVTDLTGLEIAN

SEQ ID NO: 218764 - protein, 26 aa, Mycobacterium bovis
GRLGAWAGPPPQWWAQRFGIEPDLAE

SEQ ID NO: 218765 - protein, 18 aa, Mycobacterium bovis
GRLGVGWPKEFGGLGFGP

SEQ ID NO: 218766 - protein, 23 aa, Mycobacterium bovis
GRLPLFEPPGDEFFGRYRDIVTA

SEQ ID NO: 218767 - protein, 17 aa, Mycobacterium bovis
GRLQLVKNPAHGLTLVS

SEQ ID NO: 218768 - protein, 24 aa, Mycobacterium bovis
GRLTAHLPSARRLLLFKADGSVSV

SEQ ID NO: 218769 - protein, 17 aa, Mycobacterium bovis
GRLTGVTALSPVAPLDE

SEQ ID NO: 218770 - protein, 21 aa, Mycobacterium bovis
GRLVSLPRRVGGDLYGSFLPG

SEQ ID NO: 218771 - protein, 23 aa, Mycobacterium bovis
GRMLLHSLFTYDRRWLHEQGIAL

SEQ ID NO: 218772 - protein, 23 aa, Mycobacterium bovis
GRNMTMVLAPHRGAKTRARARHP

SEQ ID NO: 218773 - protein, 19 aa, Mycobacterium bovis
GRNRIVRRLLAAAGFPVEA

SEQ ID NO: 218774 - protein, 26 aa, Mycobacterium bovis
GRNTLKWNYFGPDVVPLWLAEMDFPT

SEQ ID NO: 218775 - protein, 29 aa, Mycobacterium bovis
GRNVGEIELLPITKFFPATDVAILFRLGC

SEQ ID NO: 218776 - protein, 33 aa, Mycobacterium bovis
GRPADPPFEGMWWLYVPLAFDDFAVVLIIQEEP

SEQ ID NO: 218777 - protein, 17 aa, Mycobacterium bovis
GRPFPWHSLGEAYLGRR

SEQ ID NO: 218778 - protein, 19 aa, Mycobacterium bovis
GRPLDGLNQIVLHLGNGAS

SEQ ID NO: 218779 - protein, 19 aa, Mycobacterium bovis
GRPPLMFRAVRRTDSTGTR

SEQ ID NO: 218780 - protein, 21 aa, Mycobacterium bovis
GRPPRFCRRVGVRPPAPAALP

SEQ ID NO: 218781 - protein, 18 aa, Mycobacterium bovis
GRPVAVLTPVRPRRRRWL

SEQ ID NO: 218782 - protein, 17 aa, Mycobacterium bovis
GRQLWAQSGLTPADVQT

SEQ ID NO: 218783 - protein, 19 aa, Mycobacterium bovis
GRQVPKVMEVLLAESVRAD

SEQ ID NO: 218784 - protein, 21 aa, Mycobacterium bovis
GRRFHGLAVDVGNPHLACVDS

SEQ ID NO: 218785 - protein, 31 aa, Mycobacterium bovis
GRRIELPTYAFQRQRYWLPPTSAGSADISGV

SEQ ID NO: 218786 - protein, 20 aa, Mycobacterium bovis
GRRLLTVTYPTDSPFRGVKK

SEQ ID NO: 218787 - protein, 25 aa, Mycobacterium bovis
GRRRPVAGLHWPWVARVGTVVMSWR

SEQ ID NO: 218788 - protein, 22 aa, Mycobacterium bovis
GRRSFILVPGIDVPFHSRVLRV

SEQ ID NO: 218789 - protein, 18 aa, Mycobacterium bovis
GRRVLAVLGLVERAARGR

SEQ ID NO: 218790 - protein, 22 aa, Mycobacterium bovis
GRRVRINDLWIAAVAASRALPV

SEQ ID NO: 218791 - protein, 25 aa, Mycobacterium bovis
GRRVTEIALVFRRAPHLPFDATMTD

SEQ ID NO: 218792 - protein, 26 aa, Mycobacterium bovis
GRSGAALIFVSPRELHLLKAIEKATR

SEQ ID NO: 218793 - protein, 27 aa, Mycobacterium bovis
GRSHAWVQAWTGGWWHYDPTNDNEITE

SEQ ID NO: 218794 - protein, 17 aa, Mycobacterium bovis
GRSIGSFQNSRFLLAEL

SEQ ID NO: 218795 - protein, 28 aa, Mycobacterium bovis
GRSRERGYAYFLYPPQVPLTETAYDRLA

SEQ ID NO: 218796 - protein, 25 aa, Mycobacterium bovis
GRSYSDFPTILRSISGRLGALPGDT

SEQ ID NO: 218797 - protein, 18 aa, Mycobacterium bovis
GRTHLQFRRFAACPICHL

SEQ ID NO: 218798 - protein, 23 aa, Mycobacterium bovis
GRTRYRLLETVRRYALEKLGDSG

SEQ ID NO: 218799 - protein, 21 aa, Mycobacterium bovis
GRTWHPHQVPAFLAAGYRCIT

SEQ ID NO: 218800 - protein, 23 aa, Mycobacterium bovis
GRVAGVHFLMKKNKITEIHGYGT

SEQ ID NO: 218801 - protein, 20 aa, Mycobacterium bovis
GRVALRRRFVHRRRLGHHHS

SEQ ID NO: 218802 - protein, 27 aa, Mycobacterium bovis
GRWAQAYGFPLMPIDGILVGTAAMATK

SEQ ID NO: 218803 - protein, 25 aa, Mycobacterium bovis
GRWDKPFLAIFGYRDPILGQADGPL

SEQ ID NO: 218804 - protein, 18 aa, Mycobacterium bovis
GRWQADAVILAVPAPRLA

SEQ ID NO: 218805 - protein, 17 aa, Mycobacterium bovis
GRYPQAIFDHGTPLALY

SEQ ID NO: 218806 - protein, 37 aa, Mycobacterium bovis
GRYQPLGVILAVMPWNFPLWQAVRFAAPALMAGNVGL

SEQ ID NO: 218807 - protein, 17 aa, Mycobacterium bovis
GRYRQRCWLRQLTPHAN

SEQ ID NO: 218808 - protein, 24 aa, Mycobacterium bovis
GRYSPFAVYLPRGDPGRLAPVRDG

SEQ ID NO: 218809 - protein, 22 aa, Mycobacterium bovis
GSAACQGFITQLGRNFQVIYEQ

SEQ ID NO: 218810 - protein, 19 aa, Mycobacterium bovis
GSAAYWRRHIRQAVRFADS

SEQ ID NO: 218811 - protein, 20 aa, Mycobacterium bovis
GSAFFFHTTDGGPTAGCVAI

SEQ ID NO: 218812 - protein, 26 aa, Mycobacterium bovis
GSAHAPFAPVPWLADVLRAGVPDGPV

SEQ ID NO: 218813 - protein, 32 aa, Mycobacterium bovis
GSALGLRLELGGRALFGPLGSAAARAVKGDVE

SEQ ID NO: 218814 - protein, 22 aa, Mycobacterium bovis
GSALVPSWVAFAVTGLLEQHFG

SEQ ID NO: 218815 - protein, 22 aa, Mycobacterium bovis
GSANTLVRTPHGWRADNTDIDG

SEQ ID NO: 218816 - protein, 26 aa, Mycobacterium bovis
GSAPMLAAAVAWDGLAAELGSAASSF

SEQ ID NO: 218817 - protein, 23 aa, Mycobacterium bovis
GSAPRQAFVFPGQGGHWPGMGAV

SEQ ID NO: 218818 - protein, 26 aa, Mycobacterium bovis
GSATPVHLPFADLSFPAGVTVDRDDS

SEQ ID NO: 218819 - protein, 24 aa, Mycobacterium bovis
GSDAWDRLFAGPRPTELHPFVELT

SEQ ID NO: 218820 - protein, 23 aa, Mycobacterium bovis
GSDFELVQGFLLAEGVVAHREDV

SEQ ID NO: 218821 - protein, 36 aa, Mycobacterium bovis
GSDKPFSCLMLNAIPDLAFWGSSNGQFFPRWTYEKT

SEQ ID NO: 218822 - protein, 19 aa, Mycobacterium bovis
GSDRRLWQRLCTELELPAL

SEQ ID NO: 218823 - protein, 25 aa, Mycobacterium bovis
GSDTVTLVWLGQRRIPGIDTGRTLR

SEQ ID NO: 218824 - protein, 27 aa, Mycobacterium bovis
GSEATTVGLFTYPVLQAADVLAYDTEL

SEQ ID NO: 218825 - protein, 21 aa, Mycobacterium bovis
GSFGDDPLRMLRAARFVSQLG

SEQ ID NO: 218826 - protein, 26 aa, Mycobacterium bovis
GSFKKGPFRIAMAAKIPIVPIVIRNA

SEQ ID NO: 218827 - protein, 29 aa, Mycobacterium bovis
GSGGAGGNGGWLLGNGGIGGAGGTGGGAG

SEQ ID NO: 218828 - protein, 22 aa, Mycobacterium bovis
GSGIDYGLLRYLRADTAERLRA

SEQ ID NO: 218829 - protein, 34 aa, Mycobacterium bovis
GSGLARDYPPILRLAYRLLSPMLRVLPFVHSTRV

SEQ ID NO: 218830 - protein, 26 aa, Mycobacterium bovis
GSGLASIYRLRLALPQLDPGTLTLGR

SEQ ID NO: 218831 - protein, 39 aa, Mycobacterium bovis
GSGPDPLIDIAGTGGLLPIKIPLIDIPAAPGFGNSTTTP

SEQ ID NO: 218832 - protein, 29 aa, Mycobacterium bovis
GSGPGKLEQWTLLARARALDSMSYVAAAG

SEQ ID NO: 218833 - protein, 17 aa, Mycobacterium bovis
GSGRWPGRLLGSVSSGL

SEQ ID NO: 218834 - protein, 18 aa, Mycobacterium bovis
GSGSSRDWAAKGTLLLGV

SEQ ID NO: 218835 - protein, 18 aa, Mycobacterium bovis
GSLGNIAWYLQYAGKKSI

SEQ ID NO: 218836 - protein, 20 aa, Mycobacterium bovis
GSLRLWSLAGGMPLHRYRKS

SEQ ID NO: 218837 - protein, 25 aa, Mycobacterium bovis
GSLTAPAPFVYGLGAVGPALTTMTA

SEQ ID NO: 218838 - protein, 19 aa, Mycobacterium bovis
GSLTHGFLNLFQLGGGSAA

SEQ ID NO: 218839 - protein, 31 aa, Mycobacterium bovis
GSLWLDPQMTSPYAWYQYFVNTADADVIRYL

SEQ ID NO: 218840 - protein, 32 aa, Mycobacterium bovis
GSNMSGFFGGPPVFNLGLANRGVVNILGNANI

SEQ ID NO: 218841 - protein, 24 aa, Mycobacterium bovis
GSNVLRAFTFPFDNVRVLIVGQDP

SEQ ID NO: 218842 - protein, 24 aa, Mycobacterium bovis
GSPAEGFGWPWSVCRWVAGENPSA

SEQ ID NO: 218843 - protein, 17 aa, Mycobacterium bovis
GSQLTLTATVRLAGLRP

SEQ ID NO: 218844 - protein, 21 aa, Mycobacterium bovis
GSQVLVFKDLGLVSQVFDEQT

SEQ ID NO: 218845 - protein, 20 aa, Mycobacterium bovis
GSQWLGMGMGLHAGYPVFAE

SEQ ID NO: 218846 - protein, 25 aa, Mycobacterium bovis
GSRFALTHFGLFGFAVMSCGTLREL

SEQ ID NO: 218847 - protein, 23 aa, Mycobacterium bovis
GSRIDPVLARSWLLVNGAHGDRF

SEQ ID NO: 218848 - protein, 29 aa, Mycobacterium bovis
GSRTPWRLNQNYLRDIRLIRRGKIDDEGL

SEQ ID NO: 218849 - protein, 17 aa, Mycobacterium bovis
GSRVRLCPTPGHLHFFA

SEQ ID NO: 218850 - protein, 25 aa, Mycobacterium bovis
GSSGTVFALDLSWGGAGGNGGAATT

SEQ ID NO: 218851 - protein, 35 aa, Mycobacterium bovis
GSSRRWAERFATLLRNLEFLPNSPTLMNSGTDLGL

SEQ ID NO: 218852 - protein, 26 aa, Mycobacterium bovis
GSTAARLFYAYAEILLALGRGDEALQ

SEQ ID NO: 218853 - protein, 25 aa, Mycobacterium bovis
GSTGSLLMALLGDAGVPFRVIPIAA

SEQ ID NO: 218854 - protein, 22 aa, Mycobacterium bovis
GSTLFGRWELCALMQTVAELAE

SEQ ID NO: 218855 - protein, 24 aa, Mycobacterium bovis
GSTRPLTVVAGAASRWAWVTDADG

SEQ ID NO: 218856 - protein, 25 aa, Mycobacterium bovis
GSTTENHRLKWRPWLTGPNIDGTET

SEQ ID NO: 218857 - protein, 22 aa, Mycobacterium bovis
GSVCWYAPELGPGTGTVFSGDT

SEQ ID NO: 218858 - protein, 31 aa, Mycobacterium bovis
GSVRFLMSVGDLIIGWLLQRQAAVAVAALDA

SEQ ID NO: 218859 - protein, 34 aa, Mycobacterium bovis
GSVRYLLAVGDLLIGWRLLVLAGVAHAALADGPS

SEQ ID NO: 218860 - protein, 17 aa, Mycobacterium bovis
GSWNGPRRSRAIGPSAA

SEQ ID NO: 218861 - protein, 25 aa, Mycobacterium bovis
GSYSNGILWRGDYQGLIGYSDTLSI

SEQ ID NO: 218862 - protein, 19 aa, Mycobacterium bovis
GTADGRILRVRGRGVPKRS

SEQ ID NO: 218863 - protein, 25 aa, Mycobacterium bovis
GTALNQIPILNIGLADVGNFNVGFG

SEQ ID NO: 218864 - protein, 22 aa, Mycobacterium bovis
GTALRLLERKIAQLPPKKHGNV

SEQ ID NO: 218865 - protein, 18 aa, Mycobacterium bovis
GTALVIADLVWADGSEVA

SEQ ID NO: 218866 - protein, 23 aa, Mycobacterium bovis
GTAWARLADADLAWLDGDQLGRR

SEQ ID NO: 218867 - protein, 17 aa, Mycobacterium bovis
GTAYRRYAIERPHMYRL

SEQ ID NO: 218868 - protein, 23 aa, Mycobacterium bovis
GTDAVTATFWLLNASDSLAEQSR

SEQ ID NO: 218869 - protein, 28 aa, Mycobacterium bovis
GTDEAGAAALWFALDTDLPVLVDADGLT

SEQ ID NO: 218870 - protein, 21 aa, Mycobacterium bovis
GTDPLAYVDPYLPIESFRRRD

SEQ ID NO: 218871 - protein, 24 aa, Mycobacterium bovis
GTEAPAEMHFYFPRFRALCMAENA

SEQ ID NO: 218872 - protein, 18 aa, Mycobacterium bovis
GTEKNFKWIARSADGWIT

SEQ ID NO: 218873 - protein, 19 aa, Mycobacterium bovis
GTENLRRIEPLLATLRAIA

SEQ ID NO: 218874 - protein, 21 aa, Mycobacterium bovis
GTFNELHILAITQAIVEYRAA

SEQ ID NO: 218875 - protein, 55 aa, Mycobacterium bovis
GTFTVHGFRFPEITGDIFLIGIPFNAATLDAFSFPNISIVLPNIGINLGSGPDPL

SEQ ID NO: 218876 - protein, 25 aa, Mycobacterium bovis
GTGAAVALMVLRAAVAALSSMATFT

SEQ ID NO: 218877 - protein, 28 aa, Mycobacterium bovis
GTGAPEVHRWWTSLTSEERQRLIAEHPE

SEQ ID NO: 218878 - protein, 17 aa, Mycobacterium bovis
GTGFYRTDSRESGKKSK

SEQ ID NO: 218879 - protein, 24 aa, Mycobacterium bovis
GTGMGIDRLLMSLTGLSIRETVLF

SEQ ID NO: 218880 - protein, 27 aa, Mycobacterium bovis
GTGQPGGPGGLLWGNGGNGGSGVAGVG

SEQ ID NO: 218881 - protein, 27 aa, Mycobacterium bovis
GTHHYRFTLYHLPVALQLPPGATGVQA

SEQ ID NO: 218882 - protein, 27 aa, Mycobacterium bovis
GTIGVISWTCEGFFGRMLATIRPYRPS

SEQ ID NO: 218883 - protein, 23 aa, Mycobacterium bovis
GTITAFLANLPFSTPVVTIDEIP

SEQ ID NO: 218884 - protein, 27 aa, Mycobacterium bovis
GTIVLLMAVERIELFVDVLLKGGRTAD

SEQ ID NO: 218885 - protein, 26 aa, Mycobacterium bovis
GTKGLSLFYVPNYLFDPDTFELGARN

SEQ ID NO: 218886 - protein, 25 aa, Mycobacterium bovis
GTKGLSLYFVPKFLFDVETGEPGER

SEQ ID NO: 218887 - protein, 21 aa, Mycobacterium bovis
GTKPTLLIWGMKDVAFRPKTI

SEQ ID NO: 218888 - protein, 25 aa, Mycobacterium bovis
GTKRRLVEYYFAVAGGPMLTALRDR

SEQ ID NO: 218889 - protein, 25 aa, Mycobacterium bovis
GTLQSELIRLARYPLLVVDEVGYIP

SEQ ID NO: 218890 - protein, 20 aa, Mycobacterium bovis
GTLVMTHYVPAIGPGQEEQW

SEQ ID NO: 218891 - protein, 19 aa, Mycobacterium bovis
GTMSAILLGLEGCQPETIT

SEQ ID NO: 218892 - protein, 24 aa, Mycobacterium bovis
GTNGSFPDFPLPLGDPSKPSDADI

SEQ ID NO: 218893 - protein, 21 aa, Mycobacterium bovis
GTNIAGLLRDGAGTAAINLGL

SEQ ID NO: 218894 - protein, 19 aa, Mycobacterium bovis
GTPIRIGFVARSALEPGPN

SEQ ID NO: 218895 - protein, 25 aa, Mycobacterium bovis
GTQNDFVLLPDVDAELVLTAARVAA

SEQ ID NO: 218896 - protein, 29 aa, Mycobacterium bovis
GTQPTAWLAEGLLPYLPGDAADRLFDMVT

SEQ ID NO: 218897 - protein, 24 aa, Mycobacterium bovis
GTSDAILHVLAHDMRHLEAALERI

SEQ ID NO: 218898 - protein, 32 aa, Mycobacterium bovis
GTTTTYMIPSPTLPLLLPLKQIGVPDWIVGGL

SEQ ID NO: 218899 - protein, 19 aa, Mycobacterium bovis
GTTYEIPPATLPPGEYRQI

SEQ ID NO: 218900 - protein, 27 aa, Mycobacterium bovis
GTVDAALRPIIDRAYQPGPAPAVNPRD

SEQ ID NO: 218901 - protein, 27 aa, Mycobacterium bovis
GTVEAYLHRRSADLPPAVGVLVEYRGD

SEQ ID NO: 218902 - protein, 26 aa, Mycobacterium bovis
GTVGAFPFGFGWQQSPGFFNSTTTPS

SEQ ID NO: 218903 - protein, 25 aa, Mycobacterium bovis
GTYLNSFYEIRPLPYAEAGYGYPEA

SEQ ID NO: 218904 - protein, 35 aa, Mycobacterium bovis
GTYRGAELLGTRYLPPFAYFMDWPNAFQVLAGDFV

SEQ ID NO: 218905 - protein, 25 aa, Mycobacterium bovis
GVACYPARFQLVLAANPCPCAPADP

SEQ ID NO: 218906 - protein, 24 aa, Mycobacterium bovis
GVAGRPMILKRFVKGISAEAVFQK

SEQ ID NO: 218907 - protein, 22 aa, Mycobacterium bovis
GVARFMPVYPTEKAASKAIGRL

SEQ ID NO: 218908 - protein, 27 aa, Mycobacterium bovis
GVARGTAYRWFRAGLLSVMARRVGRLI

SEQ ID NO: 218909 - protein, 17 aa, Mycobacterium bovis
GVAVSLALACDFILASD

SEQ ID NO: 218910 - protein, 26 aa, Mycobacterium bovis
GVAWVIAYRWFRAGLLPVPAQRVGRL

SEQ ID NO: 218911 - protein, 18 aa, Mycobacterium bovis
GVAYLTAWHSLCEVGRLS

SEQ ID NO: 218912 - protein, 27 aa, Mycobacterium bovis
GVCQDFVHLSLMVLRSMGIPCRYVSGY

SEQ ID NO: 218913 - protein, 25 aa, Mycobacterium bovis
GVDAINIPIIHIPATPGFGNSTGGL

SEQ ID NO: 218914 - protein, 22 aa, Mycobacterium bovis
GVDGLIINLAPHGYLPGVITTA

SEQ ID NO: 218915 - protein, 20 aa, Mycobacterium bovis
GVDLVPTLLDLLRLEVPADV

SEQ ID NO: 218916 - protein, 30 aa, Mycobacterium bovis
GVDNAINPSVLWTLTPRIVSLDVEYFGVMW

SEQ ID NO: 218917 - protein, 25 aa, Mycobacterium bovis
GVDSPLPYLIAPPGTDERQAFCEIE

SEQ ID NO: 218918 - protein, 27 aa, Mycobacterium bovis
GVDTFASYIAALLWFGEFSGCGIKASM

SEQ ID NO: 218919 - protein, 31 aa, Mycobacterium bovis
GVDVFSEALAAPLFWIAANAGLDGSVVVNKV

SEQ ID NO: 218920 - protein, 28 aa, Mycobacterium bovis
GVDYMTVHAGVLLRYVPLTAKRVTGIVS

SEQ ID NO: 218921 - protein, 25 aa, Mycobacterium bovis
GVEFKDLTPLFADRRGLAAVTEALA

SEQ ID NO: 218922 - protein, 22 aa, Mycobacterium bovis
GVEHTWLGFVDSGLPKGDLPPP

SEQ ID NO: 218923 - protein, 33 aa, Mycobacterium bovis
GVEPADRVAIWSPNTWHWVVACLAIHHAGAAVV

SEQ ID NO: 218924 - protein, 22 aa, Mycobacterium bovis
GVEPNMRWRTFCDELLAVIDKL

SEQ ID NO: 218925 - protein, 22 aa, Mycobacterium bovis
GVEPPRGVLLYGPPGCGKTFVV

SEQ ID NO: 218926 - protein, 18 aa, Mycobacterium bovis
GVEPPVALILQGASLHDL

SEQ ID NO: 218927 - protein, 21 aa, Mycobacterium bovis
GVERTWLDGWLLRAGHGAVLA

SEQ ID NO: 218928 - protein, 17 aa, Mycobacterium bovis
GVGFRWWTRCRALELGL

SEQ ID NO: 218929 - protein, 26 aa, Mycobacterium bovis
GVGGATGLIGSGGFGGAGGAAAGVGT

SEQ ID NO: 218930 - protein, 23 aa, Mycobacterium bovis
GVGGLMLFGVPRDQDKDGVGSAG

SEQ ID NO: 218931 - protein, 18 aa, Mycobacterium bovis
GVGGPGGFAAAFGATGGA

SEQ ID NO: 218932 - protein, 20 aa, Mycobacterium bovis
GVGGVFGNGGFGGAGGLGAA

SEQ ID NO: 218933 - protein, 18 aa, Mycobacterium bovis
GVGLGLLLQHKRIRRTVS

SEQ ID NO: 218934 - protein, 24 aa, Mycobacterium bovis
GVGPAQFPAMLTALRQAMAEDAVR

SEQ ID NO: 218935 - protein, 21 aa, Mycobacterium bovis
GVGPRLAMAALAVHDAPALRQ

SEQ ID NO: 218936 - protein, 19 aa, Mycobacterium bovis
GVGPTLLLCPMSLVGNWQQ

SEQ ID NO: 218937 - protein, 23 aa, Mycobacterium bovis
GVGQLIAAALRAGAARIVVGLGG

SEQ ID NO: 218938 - protein, 32 aa, Mycobacterium bovis
GVGVRGHHLVCDLPDLLVAPAAPLTSRSRFRP

SEQ ID NO: 218939 - protein, 22 aa, Mycobacterium bovis
GVHAPTWAAPQWLQLGRELAGS

SEQ ID NO: 218940 - protein, 17 aa, Mycobacterium bovis
GVHFGFGRWLVNGSRKG

SEQ ID NO: 218941 - protein, 24 aa, Mycobacterium bovis
GVHWSRIRLADRAHLEPWEPSADG

SEQ ID NO: 218942 - protein, 17 aa, Mycobacterium bovis
GVISGRIAYTLDLAGPA

SEQ ID NO: 218943 - protein, 22 aa, Mycobacterium bovis
GVKDAFVLIRRADIQTAVHLSD

SEQ ID NO: 218944 - protein, 23 aa, Mycobacterium bovis
GVKPGRSYTARQLLDGLLLVSGN

SEQ ID NO: 218945 - protein, 20 aa, Mycobacterium bovis
GVLAFRHIFLTLRPGEDTRP

SEQ ID NO: 218946 - protein, 31 aa, Mycobacterium bovis
GVLFAGDLLFIGCTPIVWAGPIANWVAACDA

SEQ ID NO: 218947 - protein, 18 aa, Mycobacterium bovis
GVLGYWVTSQAPPAMQIC

SEQ ID NO: 218948 - protein, 21 aa, Mycobacterium bovis
GVLPDIYLLGKTLGGGAVPLS

SEQ ID NO: 218949 - protein, 23 aa, Mycobacterium bovis
GVLPPEMLFAHPGYVRAANGIQM

SEQ ID NO: 218950 - protein, 19 aa, Mycobacterium bovis
GVLVGSWHTIEGLVYSMPD

SEQ ID NO: 218951 - protein, 20 aa, Mycobacterium bovis
GVPFYDHMLTALGSHASFDL

SEQ ID NO: 218952 - protein, 18 aa, Mycobacterium bovis
GVPILDEDGFRRLLADGP

SEQ ID NO: 218953 - protein, 22 aa, Mycobacterium bovis
GVPLIAVGLYYRSGYFRQSLTA

SEQ ID NO: 218954 - protein, 25 aa, Mycobacterium bovis
GVPLWTTRAKRWLRRRTGAEHPAVA

SEQ ID NO: 218955 - protein, 20 aa, Mycobacterium bovis
GVPPFYVMDVWLAAAERQRT

SEQ ID NO: 218956 - protein, 23 aa, Mycobacterium bovis
GVPSLPFRLIHIADTYTPIAPAD

SEQ ID NO: 218957 - protein, 34 aa, Mycobacterium bovis
GVPVFAWKGETLEEYWWAAEQMLTWPDPDKPANM

SEQ ID NO: 218958 - protein, 17 aa, Mycobacterium bovis
GVQGITDLITTPGLINV

SEQ ID NO: 218959 - protein, 25 aa, Mycobacterium bovis
GVQTPQPYWYWALDRESIGGSVSAA

SEQ ID NO: 218960 - protein, 26 aa, Mycobacterium bovis
GVQYRWPQGTYLAWLDCRELGFDDAA

SEQ ID NO: 218961 - protein, 23 aa, Mycobacterium bovis
GVRHQLPMPSILDTKGRIVDTGT

SEQ ID NO: 218962 - protein, 18 aa, Mycobacterium bovis
GVRIDADLLLGEQTRLAR

SEQ ID NO: 218963 - protein, 25 aa, Mycobacterium bovis
GVRPDALRWHPNGLALDVMVPNPGT

SEQ ID NO: 218964 - protein, 24 aa, Mycobacterium bovis
GVRSLRVRLGIHPVYKTVDTCAAE

SEQ ID NO: 218965 - protein, 19 aa, Mycobacterium bovis
GVRVGLTVCYDIRFPALYT

SEQ ID NO: 218966 - protein, 20 aa, Mycobacterium bovis
GVSFLADEIGRFIRAALAGR

SEQ ID NO: 218967 - protein, 17 aa, Mycobacterium bovis
GVSLLIGSGGTGGNGGN

SEQ ID NO: 218968 - protein, 17 aa, Mycobacterium bovis
GVSNPYLSQVERGLRKP

SEQ ID NO: 218969 - protein, 23 aa, Mycobacterium bovis
GVSNYSLARWRKADAALGRPVVS

SEQ ID NO: 218970 - protein, 28 aa, Mycobacterium bovis
GVSRAELIRLLLNRALTTAGDDLASDLQ

SEQ ID NO: 218971 - protein, 18 aa, Mycobacterium bovis
GVSRPTVVRLIKSGELAA

SEQ ID NO: 218972 - protein, 24 aa, Mycobacterium bovis
GVSRPTVYRRWPDTRSIMASMLTS

SEQ ID NO: 218973 - protein, 24 aa, Mycobacterium bovis
GVTDAFLRAVERNGLHRLVNPRTG

SEQ ID NO: 218974 - protein, 24 aa, Mycobacterium bovis
GVTHVLLPVSALLRRADTAAVIVS

SEQ ID NO: 218975 - protein, 17 aa, Mycobacterium bovis
GVTLGLLSAWRGPNGQD

SEQ ID NO: 218976 - protein, 23 aa, Mycobacterium bovis
GVTRELQWPAMRISHCRPPGSDR

SEQ ID NO: 218977 - protein, 18 aa, Mycobacterium bovis
GVVHPAVVQANRVRTWLL

SEQ ID NO: 218978 - protein, 25 aa, Mycobacterium bovis
GVVLGNTWFWPADTLAMKAFSRVMS

SEQ ID NO: 218979 - protein, 17 aa, Mycobacterium bovis
GVVLLRPASPGTGVIAG

SEQ ID NO: 218980 - protein, 20 aa, Mycobacterium bovis
GVVPDALTVLVRLLASLHDD

SEQ ID NO: 218981 - protein, 41 aa, Mycobacterium bovis
GVVPPDLTVVSWLPLYHDMGLLLGAIMPILAGVPTVLTSPV

SEQ ID NO: 218982 - protein, 28 aa, Mycobacterium bovis
GVWELFWPDFPCDGLYKFRVHGADGVVT

SEQ ID NO: 218983 - protein, 37 aa, Mycobacterium bovis
GWDKPSFAKELFLGRFPLGLIHPFPKPSDAEEARTEA

SEQ ID NO: 218984 - protein, 20 aa, Mycobacterium bovis
GWDYPACEAIGLLKMDFLGL

SEQ ID NO: 218985 - protein, 21 aa, Mycobacterium bovis
GWGHRTVGLGLRQKLDRVAQG

SEQ ID NO: 218986 - protein, 18 aa, Mycobacterium bovis
GWGYPQPRSGQRARRATG

SEQ ID NO: 218987 - protein, 24 aa, Mycobacterium bovis
GWHNARVIPYGPIELDPSAIVLHY

SEQ ID NO: 218988 - protein, 20 aa, Mycobacterium bovis
GWLFCPADRPERFAKAAAAA

SEQ ID NO: 218989 - protein, 18 aa, Mycobacterium bovis
GWLRRFAERVEAVRSVFT

SEQ ID NO: 218990 - protein, 18 aa, Mycobacterium bovis
GWMVQAFRFTLDPTAEQA

SEQ ID NO: 218991 - protein, 22 aa, Mycobacterium bovis
GWPFVARLLYGRRSLVLVHHCH

SEQ ID NO: 218992 - protein, 19 aa, Mycobacterium bovis
GWPVPAAAAAVIGPAGVLA

SEQ ID NO: 218993 - protein, 23 aa, Mycobacterium bovis
GWQSFRVPCLPSDRLLNLLIYIK

SEQ ID NO: 218994 - protein, 19 aa, Mycobacterium bovis
GWSGVRWRNLTGGIVALHA

SEQ ID NO: 218995 - protein, 26 aa, Mycobacterium bovis
GWVDANVWRHVVPKGWFYNVMITGVK

SEQ ID NO: 218996 - protein, 17 aa, Mycobacterium bovis
GWYGSALVVADRWFPSL

SEQ ID NO: 218997 - protein, 21 aa, Mycobacterium bovis
GYAPMIGGLGYVLAPGPAAYT

SEQ ID NO: 218998 - protein, 23 aa, Mycobacterium bovis
GYFHVELMSIRRSATKLKYLAAA

SEQ ID NO: 218999 - protein, 20 aa, Mycobacterium bovis
GYGMVSYWTAYLKANYPAEY

SEQ ID NO: 219000 - protein, 25 aa, Mycobacterium bovis
GYIDVKGLRLTLTQAAWRVAEDSLA

SEQ ID NO: 219001 - protein, 21 aa, Mycobacterium bovis
GYIETWPVARLLRDAQVNTIW

SEQ ID NO: 219002 - protein, 21 aa, Mycobacterium bovis
GYIGVTRWWNVKHPNTYAEIL

SEQ ID NO: 219003 - protein, 17 aa, Mycobacterium bovis
GYKVPRSLWFVDEVKRS

SEQ ID NO: 219004 - protein, 21 aa, Mycobacterium bovis
GYMAVTPPQPRWIISESILNR

SEQ ID NO: 219005 - protein, 27 aa, Mycobacterium bovis
GYRGAKNVLLVFFPLAFTGICQGELDQ

SEQ ID NO: 219006 - protein, 26 aa, Mycobacterium bovis
GYRQYLFWTFAIYTGRLLHGRLPGVD

SEQ ID NO: 219007 - protein, 32 aa, Mycobacterium bovis
GYTEYHQLGLIDKLPRMLGTQAAGAAPLVLGE

SEQ ID NO: 219008 - protein, 25 aa, Mycobacterium bovis
GYVFDLETDWPIRAALLSTPEQTVL

SEQ ID NO: 219009 - protein, 23 aa, Mycobacterium bovis
GYYQIRGGIPYAIAKSLAAAPFA

SEQ ID NO: 219010 - protein, 25 aa, Mycobacterium bovis
HAAAAPFIAAVIPPGSDSVSVCNAV

SEQ ID NO: 219011 - protein, 36 aa, Mycobacterium bovis
HAAGVIILTCGMFGNIIRLLPPLTIGDELLSEGLDI

SEQ ID NO: 219012 - protein, 19 aa, Mycobacterium bovis
HAASHWRGLSKAGKAPKDI

SEQ ID NO: 219013 - protein, 23 aa, Mycobacterium bovis
HADAVDFHRWLQWQLDEQLASAQ

SEQ ID NO: 219014 - protein, 24 aa, Mycobacterium bovis
HADGIRAVAVVCLHSYLYPGHERE

SEQ ID NO: 219015 - protein, 23 aa, Mycobacterium bovis
HAEVLAHWPEVIASPTPAAAGRV

SEQ ID NO: 219016 - protein, 19 aa, Mycobacterium bovis
HAFEELRMLSLLPSRATTL

SEQ ID NO: 219017 - protein, 17 aa, Mycobacterium bovis
HAFFQFYVADGRLSCQL

SEQ ID NO: 219018 - protein, 18 aa, Mycobacterium bovis
HAFMAERVESGFGSLDEV

SEQ ID NO: 219019 - protein, 28 aa, Mycobacterium bovis
HAFWDTEGFVLPVLTYTAPHAVADALRW

SEQ ID NO: 219020 - protein, 18 aa, Mycobacterium bovis
HAGHLVPLLTLRRFQRAG

SEQ ID NO: 219021 - protein, 24 aa, Mycobacterium bovis
HAGRGSYPWLPTDNANWHMIGVEC

SEQ ID NO: 219022 - protein, 18 aa, Mycobacterium bovis
HAHAWALRMSPDGNVWGA

SEQ ID NO: 219023 - protein, 20 aa, Mycobacterium bovis
HAHLRYLNPFPANLGEVLRR

SEQ ID NO: 219024 - protein, 19 aa, Mycobacterium bovis
HALDLLLGSWPGENRTLAC

SEQ ID NO: 219025 - protein, 25 aa, Mycobacterium bovis
HANLIPWQELARRTGATLRWYGVTD

SEQ ID NO: 219026 - protein, 18 aa, Mycobacterium bovis
HAQAYQALSAQAAAFHQQ

SEQ ID NO: 219027 - protein, 19 aa, Mycobacterium bovis
HAQAYQTLGTQAAAFHERF

SEQ ID NO: 219028 - protein, 22 aa, Mycobacterium bovis
HARLLGYLIGDGRDGWVGGKTP

SEQ ID NO: 219029 - protein, 17 aa, Mycobacterium bovis
HARTGLPCPVCGDTVRE

SEQ ID NO: 219030 - protein, 22 aa, Mycobacterium bovis
HASHGYIRYHDVRVPADHVLGG

SEQ ID NO: 219031 - protein, 27 aa, Mycobacterium bovis
HASVPPSWAWPKPAVAPPVLFGCRPSA

SEQ ID NO: 219032 - protein, 22 aa, Mycobacterium bovis
HATAIMWAREQFGLELIWGIED

SEQ ID NO: 219033 - protein, 17 aa, Mycobacterium bovis
HATFDALLHNFYGPTET

SEQ ID NO: 219034 - protein, 19 aa, Mycobacterium bovis
HAVHRKLVLRHLAAKRIRV

SEQ ID NO: 219035 - protein, 25 aa, Mycobacterium bovis
HAVWALMDYGFRVVISSRFGDIFRG

SEQ ID NO: 219036 - protein, 28 aa, Mycobacterium bovis
HAVWGHRLAHWLWQRGARLLARAAAEFT

SEQ ID NO: 219037 - protein, 19 aa, Mycobacterium bovis
HAYEILSSIRLPGGHFRSD

SEQ ID NO: 219038 - protein, 23 aa, Mycobacterium bovis
HCPPDRFPGVISAPLTPPVKASA

SEQ ID NO: 219039 - protein, 19 aa, Mycobacterium bovis
HDAEFFFVANAHLRLHVHL

SEQ ID NO: 219040 - protein, 18 aa, Mycobacterium bovis
HDAPKGEFLLFDGRVHTY

SEQ ID NO: 219041 - protein, 23 aa, Mycobacterium bovis
HDDFRNAWFVDASGRKVFVRVVL

SEQ ID NO: 219042 - protein, 23 aa, Mycobacterium bovis
HDDLPWPDPADWLAAVRASPLLA

SEQ ID NO: 219043 - protein, 27 aa, Mycobacterium bovis
HDELRPLKALAARMACPYLNPGRYVQG

SEQ ID NO: 219044 - protein, 20 aa, Mycobacterium bovis
HDFFLFYDKDTERPSVVYRR

SEQ ID NO: 219045 - protein, 20 aa, Mycobacterium bovis
HDGLWRVWRSQMSFVIAAPE

SEQ ID NO: 219046 - protein, 21 aa, Mycobacterium bovis
HDGRTWYRTGDLARYWHDGTL

SEQ ID NO: 219047 - protein, 26 aa, Mycobacterium bovis
HDHCSAFHPLGVGSPFWAAIDLQRYG

SEQ ID NO: 219048 - protein, 31 aa, Mycobacterium bovis
HDIETVWFGAAAPLALLAPRARLAGASRVLA

SEQ ID NO: 219049 - protein, 20 aa, Mycobacterium bovis
HDLGVRTVAIPRKGRPSQAR

SEQ ID NO: 219050 - protein, 26 aa, Mycobacterium bovis
HDLSDPLWSARLLVDAPHAITAVHTA

SEQ ID NO: 219051 - protein, 26 aa, Mycobacterium bovis
HDLVSIVTSMLFSMHGELYKAIARQA

SEQ ID NO: 219052 - protein, 17 aa, Mycobacterium bovis
HDPAGLCDVKAVWRSGT

SEQ ID NO: 219053 - protein, 24 aa, Mycobacterium bovis
HDPSDTHWLGRDRFVLSAGHSSLT

SEQ ID NO: 219054 - protein, 33 aa, Mycobacterium bovis
HDRAYSGYIPILGAPWLADLVRRSPWGEMFAST

SEQ ID NO: 219055 - protein, 29 aa, Mycobacterium bovis
HDRRVGLLLQDPLLFPHLSVAKNVAFGPQ

SEQ ID NO: 219056 - protein, 22 aa, Mycobacterium bovis
HDVDRLSAFFDLVQQDPVVSQV

SEQ ID NO: 219057 - protein, 26 aa, Mycobacterium bovis
HDVEFFNEFYALDLALTQTPSGPVAT

SEQ ID NO: 219058 - protein, 27 aa, Mycobacterium bovis
HDWGAPVAWTFAWLHPDRCAGVVGISV

SEQ ID NO: 219059 - protein, 32 aa, Mycobacterium bovis
HEAADLGPRRTLTGQPLPPLLTATAAAQRAGH

SEQ ID NO: 219060 - protein, 25 aa, Mycobacterium bovis
HEAPAPPRGLSAVPLEPGQQTVGFS

SEQ ID NO: 219061 - protein, 26 aa, Mycobacterium bovis
HECCRLRKVVPLGKTLRGYSAWVTGL

SEQ ID NO: 219062 - protein, 23 aa, Mycobacterium bovis
HEDQAHVDLLWSLSRAPDADAAL

SEQ ID NO: 219063 - protein, 20 aa, Mycobacterium bovis
HEGVDWLLAQPDKPDLVFEA

SEQ ID NO: 219064 - protein, 23 aa, Mycobacterium bovis
HEHERLLGWQRQMLARIEVPYRV

SEQ ID NO: 219065 - protein, 25 aa, Mycobacterium bovis
HEIGHYYFYRLIASSSDYLSRFNEL

SEQ ID NO: 219066 - protein, 28 aa, Mycobacterium bovis
HEPELRAIFINSVWAPRLRIVESILQAG

SEQ ID NO: 219067 - protein, 22 aa, Mycobacterium bovis
HERANDILIRISGVEPTTGTVL

SEQ ID NO: 219068 - protein, 26 aa, Mycobacterium bovis
HERGLPMSFTFARFLKFIVTEIFPGG

SEQ ID NO: 219069 - protein, 35 aa, Mycobacterium bovis
HERIWYSDFLDFVGRERIFASLLTPASYGADDCRW

SEQ ID NO: 219070 - protein, 25 aa, Mycobacterium bovis
HESALFRLMRSPLMPITPRDHVDVH

SEQ ID NO: 219071 - protein, 22 aa, Mycobacterium bovis
HESLCFAGANLIPLRGGPIDLN

SEQ ID NO: 219072 - protein, 28 aa, Mycobacterium bovis
HETGHLDGFLYLDRLIGRYARNAKRAVK

SEQ ID NO: 219073 - protein, 30 aa, Mycobacterium bovis
HETTANAMSWFWYLMALNPQARDHMLTELD

SEQ ID NO: 219074 - protein, 26 aa, Mycobacterium bovis
HEVKPLSLVVGLIDELRKRHPDLDEN

SEQ ID NO: 219075 - protein, 19 aa, Mycobacterium bovis
HEVLLDCDSPHVGAALRAI

SEQ ID NO: 219076 - protein, 17 aa, Mycobacterium bovis
HEVTKLYYEAYPAMVHR

SEQ ID NO: 219077 - protein, 25 aa, Mycobacterium bovis
HFDAQAMHLALEAIWLMLGDANKYF

SEQ ID NO: 219078 - protein, 30 aa, Mycobacterium bovis
HFEKMLYDNALLLRAYAHWARRTGDPLARR

SEQ ID NO: 219079 - protein, 28 aa, Mycobacterium bovis
HFESILIRGLMNYTFWMPNGSPEYRYCL

SEQ ID NO: 219080 - protein, 17 aa, Mycobacterium bovis
HFFRSVLRWLQVGYPEG

SEQ ID NO: 219081 - protein, 19 aa, Mycobacterium bovis
HFGGPSGWGGRYVPEALMA

SEQ ID NO: 219082 - protein, 21 aa, Mycobacterium bovis
HFHSIFYLRHNARRQEHLATL

SEQ ID NO: 219083 - protein, 26 aa, Mycobacterium bovis
HFKSVAYELLWFLRGDSNIGWLHEHG

SEQ ID NO: 219084 - protein, 17 aa, Mycobacterium bovis
HGAAGLSLRAIARNLGM

SEQ ID NO: 219085 - protein, 28 aa, Mycobacterium bovis
HGADDVFITYPLWIGTRQADRLRQLADR

SEQ ID NO: 219086 - protein, 22 aa, Mycobacterium bovis
HGEIPLGIYCRASLAEYMDAER

SEQ ID NO: 219087 - protein, 26 aa, Mycobacterium bovis
HGEPTWSYLYRTMIPPLSAAGHRVLA

SEQ ID NO: 219088 - protein, 32 aa, Mycobacterium bovis
HGESLLGKPAVLWFWAPWCPTCQGEAPVVGQV

SEQ ID NO: 219089 - protein, 17 aa, Mycobacterium bovis
HGGAALTSIQQGGAGGA

SEQ ID NO: 219090 - protein, 23 aa, Mycobacterium bovis
HGGNAGLLSLGASGGAGGSGGAS

SEQ ID NO: 219091 - protein, 23 aa, Mycobacterium bovis
HGGNAILFGQGGAGGPGGTGAMG

SEQ ID NO: 219092 - protein, 31 aa, Mycobacterium bovis
HGHEDHIGAIPFLLKLRPDIPVVGSKFTLAL

SEQ ID NO: 219093 - protein, 20 aa, Mycobacterium bovis
HGIGGFLGGSGRWLRRVTAL

SEQ ID NO: 219094 - protein, 24 aa, Mycobacterium bovis
HGLLRGLPLGSRITRRSGAFAHRY

SEQ ID NO: 219095 - protein, 28 aa, Mycobacterium bovis
HGPMDRFHRRLLWPIRTSAGEVVGFGAR

SEQ ID NO: 219096 - protein, 19 aa, Mycobacterium bovis
HGPRYLWTRTVAGRGTKGR

SEQ ID NO: 219097 - protein, 22 aa, Mycobacterium bovis
HGRIWHRLAHHLPEIPIAAPDL

SEQ ID NO: 219098 - protein, 25 aa, Mycobacterium bovis
HGRRRRARFFGRNVNVPLMIIAVGT

SEQ ID NO: 219099 - protein, 17 aa, Mycobacterium bovis
HGRSGFLLAPWTAEQIV

SEQ ID NO: 219100 - protein, 25 aa, Mycobacterium bovis
HGSQGIRLHAPLPAAGKLSVVTEVA

SEQ ID NO: 219101 - protein, 25 aa, Mycobacterium bovis
HGTVMLRMPLHPVAIELLREVGPMA

SEQ ID NO: 219102 - protein, 27 aa, Mycobacterium bovis
HGVSWLPLYHDMGLSMIGFPAVYGGHS

SEQ ID NO: 219103 - protein, 30 aa, Mycobacterium bovis
HGYGDLLELAYPLMSWPRRGVFGGPTPAPR

SEQ ID NO: 219104 - protein, 20 aa, Mycobacterium bovis
HGYLAYMHDPLAAAVAMDPE

SEQ ID NO: 219105 - protein, 27 aa, Mycobacterium bovis
HGYRVSPGTLYPTLHRLEADGLLVSEQ

SEQ ID NO: 219106 - protein, 26 aa, Mycobacterium bovis
HHELGWFARQALRLFDDLRLEHGRLD

SEQ ID NO: 219107 - protein, 19 aa, Mycobacterium bovis
HHEMTFSMLYAFSENYVLP

SEQ ID NO: 219108 - protein, 29 aa, Mycobacterium bovis
HHKQPPLQRLVRALLGFDAKLSQYTRGKA

SEQ ID NO: 219109 - protein, 21 aa, Mycobacterium bovis
HHPMRFYNALGAIRSVLQRNP

SEQ ID NO: 219110 - protein, 18 aa, Mycobacterium bovis
HHRNEVTEIIPLDGFLDG

SEQ ID NO: 219111 - protein, 18 aa, Mycobacterium bovis
HHSLAFLPMPTSSGIVHL

SEQ ID NO: 219112 - protein, 27 aa, Mycobacterium bovis
HIAGVDTFFVATAPRYSFVSSSLAKEV

SEQ ID NO: 219113 - protein, 20 aa, Mycobacterium bovis
HICPISMTYAVVPALRYNSE

SEQ ID NO: 219114 - protein, 17 aa, Mycobacterium bovis
HIEAIANWDPKAEPSIE

SEQ ID NO: 219115 - protein, 33 aa, Mycobacterium bovis
HIELAAPVTHIWYFKGVPSRLGYLLDLAPKDLE

SEQ ID NO: 219116 - protein, 17 aa, Mycobacterium bovis
HIGIRLPGRYNVANCLV

SEQ ID NO: 219117 - protein, 30 aa, Mycobacterium bovis
HIGVKNYPFYFGFLKSKLRTGGLLLNHCIT

SEQ ID NO: 219118 - protein, 30 aa, Mycobacterium bovis
HIKAQVLAEALPWLKQLHGKVVVVKYGGNA

SEQ ID NO: 219119 - protein, 27 aa, Mycobacterium bovis
HILEVQRLIRFMPKVVICLVNGWAAGG

SEQ ID NO: 219120 - protein, 18 aa, Mycobacterium bovis
HIPGVGERLLRTARQRLA

SEQ ID NO: 219121 - protein, 20 aa, Mycobacterium bovis
HIRLMSTASYLETALVIEAR

SEQ ID NO: 219122 - protein, 17 aa, Mycobacterium bovis
HIYAVIGLKDTTTGDTL

SEQ ID NO: 219123 - protein, 24 aa, Mycobacterium bovis
HIYHYAPYEKTALLRLVGRYGIGE

SEQ ID NO: 219124 - protein, 27 aa, Mycobacterium bovis
HKIWATQSGFTFPLLSDFWPHGAVSQA

SEQ ID NO: 219125 - protein, 17 aa, Mycobacterium bovis
HKLPPRILAAVVEFAFG

SEQ ID NO: 219126 - protein, 37 aa, Mycobacterium bovis
HKSTYIFLADRHSGWWRAPLRWTLRGSLALRSHLMVR

SEQ ID NO: 219127 - protein, 24 aa, Mycobacterium bovis
HKTVHHYLMRFLGGELSDEDLEVA

SEQ ID NO: 219128 - protein, 33 aa, Mycobacterium bovis
HKVMPIMTSLLNYYPHLLALSASSPWWGGEDTG

SEQ ID NO: 219129 - protein, 18 aa, Mycobacterium bovis
HKVPRRLLKAARLGLIDF

SEQ ID NO: 219130 - protein, 19 aa, Mycobacterium bovis
HLAGRLAGLARDLTAPPVW

SEQ ID NO: 219131 - protein, 26 aa, Mycobacterium bovis
HLAQAWRKHIGPPRQLPADSPQGQAI

SEQ ID NO: 219132 - protein, 19 aa, Mycobacterium bovis
HLAQCNWLVPSDQLGGLCS

SEQ ID NO: 219133 - protein, 20 aa, Mycobacterium bovis
HLARHHLHRFLPGASTRRSP

SEQ ID NO: 219134 - protein, 18 aa, Mycobacterium bovis
HLATLRLQPAYEQALETG

SEQ ID NO: 219135 - protein, 17 aa, Mycobacterium bovis
HLATRLSAMFRTRRFRV

SEQ ID NO: 219136 - protein, 33 aa, Mycobacterium bovis
HLFFGARYACELYDLPTLWQIAAHNPWLSVSPV

SEQ ID NO: 219137 - protein, 27 aa, Mycobacterium bovis
HLGVGVTSIYWYFRKKDDLLNAMTDRA

SEQ ID NO: 219138 - protein, 25 aa, Mycobacterium bovis
HLIHALRRNINVTILLFNNRIYGLT

SEQ ID NO: 219139 - protein, 19 aa, Mycobacterium bovis
HLITKPVFDALFAGHDFAS

SEQ ID NO: 219140 - protein, 22 aa, Mycobacterium bovis
HLKGHFATMRHAASHWRGLSKA

SEQ ID NO: 219141 - protein, 25 aa, Mycobacterium bovis
HLLSAPAIKLLIRKAGAASADMAAE

SEQ ID NO: 219142 - protein, 23 aa, Mycobacterium bovis
HLPGGLPDLLMLAGGGLVGWMTY

SEQ ID NO: 219143 - protein, 31 aa, Mycobacterium bovis
HLVALPNGRYGWRISLPAMVCYWSELARDIV

SEQ ID NO: 219144 - protein, 30 aa, Mycobacterium bovis
HLVVSYRREALPRVQLWPIGPDGNYGEPEE

SEQ ID NO: 219145 - protein, 26 aa, Mycobacterium bovis
HNAGFDIGFLRAAARRCDITWPQPQV

SEQ ID NO: 219146 - protein, 24 aa, Mycobacterium bovis
HNAVEYFVSYYDYYQPEAYIAQTD

SEQ ID NO: 219147 - protein, 25 aa, Mycobacterium bovis
HNFHRKIVELNVLAPLLVSQHANVL

SEQ ID NO: 219148 - protein, 18 aa, Mycobacterium bovis
HNGLMGYVLAELGYRVRR

SEQ ID NO: 219149 - protein, 24 aa, Mycobacterium bovis
HNGLTAAVLLQRAGLRTACLDAKR

SEQ ID NO: 219150 - protein, 23 aa, Mycobacterium bovis
HNGVPLYIELPVTVELEVTHTEP

SEQ ID NO: 219151 - protein, 19 aa, Mycobacterium bovis
HPAGAYWVPRRLGGGAPTL

SEQ ID NO: 219152 - protein, 22 aa, Mycobacterium bovis
HPARIRILELLVERDRSVGELL

SEQ ID NO: 219153 - protein, 20 aa, Mycobacterium bovis
HPDIVLPTHPNGMTFTAAGP

SEQ ID NO: 219154 - protein, 19 aa, Mycobacterium bovis
HPFLQHLLAHRDVTRLKVT

SEQ ID NO: 219155 - protein, 21 aa, Mycobacterium bovis
HPGEFVLGSTLELFTLPDNLA

SEQ ID NO: 219156 - protein, 26 aa, Mycobacterium bovis
HPGIVAPPAMIQVWTMMGLGGVRPKD

SEQ ID NO: 219157 - protein, 25 aa, Mycobacterium bovis
HPGLLRFTVGLAQITSLLLAGDVAP

SEQ ID NO: 219158 - protein, 18 aa, Mycobacterium bovis
HPGSFYALPQSPQLFKQL

SEQ ID NO: 219159 - protein, 27 aa, Mycobacterium bovis
HPHWDPRHLWLVPITQAVQLQMVRNLP

SEQ ID NO: 219160 - protein, 22 aa, Mycobacterium bovis
HPLLAVAPRRPQGELPAVGSLL

SEQ ID NO: 219161 - protein, 23 aa, Mycobacterium bovis
HPLTITALYLPHLSATAALQAWD

SEQ ID NO: 219162 - protein, 25 aa, Mycobacterium bovis
HPLWIVRRTMVDLIRPIEFGDMLRC

SEQ ID NO: 219163 - protein, 20 aa, Mycobacterium bovis
HPPPDLTALGLAAPRVSPPA

SEQ ID NO: 219164 - protein, 23 aa, Mycobacterium bovis
HPQYPKVVLVTGACRFLGGYLTA

SEQ ID NO: 219165 - protein, 17 aa, Mycobacterium bovis
HPRAHLSARWKDGDQDS

SEQ ID NO: 219166 - protein, 21 aa, Mycobacterium bovis
HPRELLVVGIATFDQKRPAVG

SEQ ID NO: 219167 - protein, 20 aa, Mycobacterium bovis
HPRSWLLRQASSGVSAATVV

SEQ ID NO: 219168 - protein, 20 aa, Mycobacterium bovis
HPTLRLTTNLRIGLEGREAR

SEQ ID NO: 219169 - protein, 22 aa, Mycobacterium bovis
HPVLLESYLDGPEVSLFCVVDR

SEQ ID NO: 219170 - protein, 19 aa, Mycobacterium bovis
HPVLPPFPTVLKQVLRPLD

SEQ ID NO: 219171 - protein, 21 aa, Mycobacterium bovis
HQAKFHLDRLTAEGLLDTEYA

SEQ ID NO: 219172 - protein, 17 aa, Mycobacterium bovis
HQGAAEMMRPIARKYDL

SEQ ID NO: 219173 - protein, 17 aa, Mycobacterium bovis
HQLNRYPDGLEKCIGCE

SEQ ID NO: 219174 - protein, 17 aa, Mycobacterium bovis
HQLQVIEKSFPAGYHVG

SEQ ID NO: 219175 - protein, 23 aa, Mycobacterium bovis
HQPWPGVIAAYRDRLPVGDDWTP

SEQ ID NO: 219176 - protein, 17 aa, Mycobacterium bovis
HQVKTLDAIKAVSALDL

SEQ ID NO: 219177 - protein, 17 aa, Mycobacterium bovis
HQVRMEFAYAGGGLGKG

SEQ ID NO: 219178 - protein, 33 aa, Mycobacterium bovis
HREELDAFVVRRLNLPFRDVDWTEWDDLLRRVH

SEQ ID NO: 219179 - protein, 23 aa, Mycobacterium bovis
HRGLTYFMFDLKAKGVTVRPIAQ

SEQ ID NO: 219180 - protein, 17 aa, Mycobacterium bovis
HRGRRQLRGLLADVARD

SEQ ID NO: 219181 - protein, 26 aa, Mycobacterium bovis
HRGSYLQMHFALAQPPAFAAPYQALN

SEQ ID NO: 219182 - protein, 27 aa, Mycobacterium bovis
HRHIAYVPGDVTLWPSLTGGETIDLLA

SEQ ID NO: 219183 - protein, 20 aa, Mycobacterium bovis
HRLAERLLVDVIGLPWEEVH

SEQ ID NO: 219184 - protein, 20 aa, Mycobacterium bovis
HRLAVLVVSAIPLAEPVRLA

SEQ ID NO: 219185 - protein, 20 aa, Mycobacterium bovis
HRNRPFYELVSRVGLERARR

SEQ ID NO: 219186 - protein, 21 aa, Mycobacterium bovis
HRPGVYLFRGPSGEVLYVGTA

SEQ ID NO: 219187 - protein, 33 aa, Mycobacterium bovis
HRPVPLWQHVLVGKRMFDLFDYRIGEAEGQPQV

SEQ ID NO: 219188 - protein, 24 aa, Mycobacterium bovis
HRRDALWAAALQTAISRRTGDIGA

SEQ ID NO: 219189 - protein, 25 aa, Mycobacterium bovis
HRRHRPTVWALWGDAMALLAGDAML

SEQ ID NO: 219190 - protein, 18 aa, Mycobacterium bovis
HRSVKIPDLIIAAVAEHH

SEQ ID NO: 219191 - protein, 25 aa, Mycobacterium bovis
HRTGKPHGWIHDELRRRCGGPPIAA

SEQ ID NO: 219192 - protein, 19 aa, Mycobacterium bovis
HRVCRYLEDLAGDYHRFYD

SEQ ID NO: 219193 - protein, 17 aa, Mycobacterium bovis
HRYYSTIKDLTRLLGGP

SEQ ID NO: 219194 - protein, 23 aa, Mycobacterium bovis
HSAACTTMRWPLHDDQLAAADQL

SEQ ID NO: 219195 - protein, 23 aa, Mycobacterium bovis
HSAHYYFRDFWGADSGMLAALHV

SEQ ID NO: 219196 - protein, 25 aa, Mycobacterium bovis
HSDDFQIILVDTPGLHRPRTLLGKR

SEQ ID NO: 219197 - protein, 24 aa, Mycobacterium bovis
HSDRLPYAWNPSYPARVGVMPREG

SEQ ID NO: 219198 - protein, 18 aa, Mycobacterium bovis
HSEAPPFFVLHGEKDPMV

SEQ ID NO: 219199 - protein, 24 aa, Mycobacterium bovis
HSLWPVFADIPAGWRVVHGEASRA

SEQ ID NO: 219200 - protein, 29 aa, Mycobacterium bovis
HSMNHVLAEMKLLRPLLSAGDYLVVEDSN

SEQ ID NO: 219201 - protein, 26 aa, Mycobacterium bovis
HSNALDIDLYLRIAPELFLKRCIVGG

SEQ ID NO: 219202 - protein, 23 aa, Mycobacterium bovis
HSRGPFPGALWLQVRDLEATQTE

SEQ ID NO: 219203 - protein, 26 aa, Mycobacterium bovis
HSTLGPVHILIDLPAVPGFGNTTGAP

SEQ ID NO: 219204 - protein, 27 aa, Mycobacterium bovis
HSTRNRALGLLYRWVEHAFGGREHALT

SEQ ID NO: 219205 - protein, 17 aa, Mycobacterium bovis
HSWRRNIALSADDVLAA

SEQ ID NO: 219206 - protein, 26 aa, Mycobacterium bovis
HTARAFGRALGCPQPLIAVASAATRW

SEQ ID NO: 219207 - protein, 21 aa, Mycobacterium bovis
HTDPRVRDGLAWCYARVQIMR

SEQ ID NO: 219208 - protein, 18 aa, Mycobacterium bovis
HTDYNLGFALPIALPRRT

SEQ ID NO: 219209 - protein, 20 aa, Mycobacterium bovis
HTFRRLNGTLLAGLPALVVA

SEQ ID NO: 219210 - protein, 17 aa, Mycobacterium bovis
HTKAWKAMFDAYLAERA

SEQ ID NO: 219211 - protein, 29 aa, Mycobacterium bovis
HTMTSVVINPFFDWAYDRSPRTPYHETVI

SEQ ID NO: 219212 - protein, 17 aa, Mycobacterium bovis
HTPIGPLFESLITSELR

SEQ ID NO: 219213 - protein, 17 aa, Mycobacterium bovis
HTPLLAGLPPLAADGEV

SEQ ID NO: 219214 - protein, 20 aa, Mycobacterium bovis
HTPPAPIELPSYGLFGLPGF

SEQ ID NO: 219215 - protein, 29 aa, Mycobacterium bovis
HTPPVLLRNIIENPAWYTAYTPYQPEISQ

SEQ ID NO: 219216 - protein, 23 aa, Mycobacterium bovis
HTQARWQLLSVVSDRALTVPQAA

SEQ ID NO: 219217 - protein, 17 aa, Mycobacterium bovis
HTQVFRMWLDAVGISED

SEQ ID NO: 219218 - protein, 18 aa, Mycobacterium bovis
HTRDSLRRAAAAAVAAGV

SEQ ID NO: 219219 - protein, 17 aa, Mycobacterium bovis
HTTVRLIDLATRMPRVL

SEQ ID NO: 219220 - protein, 23 aa, Mycobacterium bovis
HTVEMWCPVIGDGAFQRVLDVEV

SEQ ID NO: 219221 - protein, 17 aa, Mycobacterium bovis
HTWKRSSFSGTEIFGKT

SEQ ID NO: 219222 - protein, 20 aa, Mycobacterium bovis
HVAYWWSAEPQRLSMAASQA

SEQ ID NO: 219223 - protein, 18 aa, Mycobacterium bovis
HVCALANNHILDFGYQGL

SEQ ID NO: 219224 - protein, 24 aa, Mycobacterium bovis
HVDHPRLGWRQAPVGPVLADALGL

SEQ ID NO: 219225 - protein, 19 aa, Mycobacterium bovis
HVFNRLDIPSWMARMGFQM

SEQ ID NO: 219226 - protein, 31 aa, Mycobacterium bovis
HVGDPEFLPLLRRLGRFLPADVRILDITRAP

SEQ ID NO: 219227 - protein, 24 aa, Mycobacterium bovis
HVGRRRAGRFLAEGPNLVAAALAR

SEQ ID NO: 219228 - protein, 17 aa, Mycobacterium bovis
HVGWLDDRKWAYVRLEG

SEQ ID NO: 219229 - protein, 18 aa, Mycobacterium bovis
HVLLQRDVHYIVRDDAVH

SEQ ID NO: 219230 - protein, 23 aa, Mycobacterium bovis
HVRAWARLWERCAIDLTGNTEEL

SEQ ID NO: 219231 - protein, 25 aa, Mycobacterium bovis
HVRGRGLLLGIALTAPHAKDAEATA

SEQ ID NO: 219232 - protein, 21 aa, Mycobacterium bovis
HVRNLIRRFVEVGVPGYHIED

SEQ ID NO: 219233 - protein, 17 aa, Mycobacterium bovis
HVRRFSLGTNPMVLDLS

SEQ ID NO: 219234 - protein, 20 aa, Mycobacterium bovis
HVVTINDYLARRDAEWMGPL

SEQ ID NO: 219235 - protein, 19 aa, Mycobacterium bovis
HVYTRLDRPLTASLGLMIL

SEQ ID NO: 219236 - protein, 18 aa, Mycobacterium bovis
HWVRARVVQLERGWVLRD

SEQ ID NO: 219237 - protein, 23 aa, Mycobacterium bovis
HYATVELRRPGGPGVIMGRNVVR

SEQ ID NO: 219238 - protein, 22 aa, Mycobacterium bovis
HYDQHLTLQGLRLVFERNLEVQ

SEQ ID NO: 219239 - protein, 23 aa, Mycobacterium bovis
HYDVYPAFGFRFDLKKSGVSVTF

SEQ ID NO: 219240 - protein, 31 aa, Mycobacterium bovis
HYGMCGRAYDPRFLFAWPSAKSAVMGGAQLS

SEQ ID NO: 219241 - protein, 24 aa, Mycobacterium bovis
HYGPLFIRMAWHAAGTYRIHDGRG

SEQ ID NO: 219242 - protein, 27 aa, Mycobacterium bovis
HYLAVAIEYLYTHRPSWPAGIAVGKTV

SEQ ID NO: 219243 - protein, 19 aa, Mycobacterium bovis
HYLCELKIDGVALSLVYRE

SEQ ID NO: 219244 - protein, 17 aa, Mycobacterium bovis
HYLHVRPADQFDAMIHI

SEQ ID NO: 219245 - protein, 18 aa, Mycobacterium bovis
HYTRKWLQKMTVSQIDRS

SEQ ID NO: 219246 - protein, 31 aa, Mycobacterium bovis
IAAGHSFVIFLREGFPINILNPVQAVPEVCT

SEQ ID NO: 219247 - protein, 25 aa, Mycobacterium bovis
IAAGTPPIYFGFGSTPVQTPVQTLA

SEQ ID NO: 219248 - protein, 25 aa, Mycobacterium bovis
IAANFRDVMIALGLYPDPDAVMGVE

SEQ ID NO: 219249 - protein, 19 aa, Mycobacterium bovis
IAAPPPLPLVSRDGGYLIV

SEQ ID NO: 219250 - protein, 18 aa, Mycobacterium bovis
IAARHLLDPMPRGELSYG

SEQ ID NO: 219251 - protein, 23 aa, Mycobacterium bovis
IADAILDGVFPPGSTLPPERDLA

SEQ ID NO: 219252 - protein, 20 aa, Mycobacterium bovis
IADLAWLRARDLDRALLVHV

SEQ ID NO: 219253 - protein, 23 aa, Mycobacterium bovis
IAELEASLLLYFGGVSRLSSEVI

SEQ ID NO: 219254 - protein, 23 aa, Mycobacterium bovis
IAETIDWGRTVLALGLDTIDDAV

SEQ ID NO: 219255 - protein, 17 aa, Mycobacterium bovis
IAFALRAGANRYAEADL

SEQ ID NO: 219256 - protein, 20 aa, Mycobacterium bovis
IAFLAWHAWNDAERGNWPPG

SEQ ID NO: 219257 - protein, 29 aa, Mycobacterium bovis
IAGAFGYWRESGRFIVFEAPAVVLATGGI

SEQ ID NO: 219258 - protein, 23 aa, Mycobacterium bovis
IAGDQQLSFALIDGVRRQWRNGI

SEQ ID NO: 219259 - protein, 23 aa, Mycobacterium bovis
IAGFCAQAAVRRTPLLLDGVAVT

SEQ ID NO: 219260 - protein, 28 aa, Mycobacterium bovis
IAGMRPYDPPWCRPLLGVRRSVTHAACR

SEQ ID NO: 219261 - protein, 35 aa, Mycobacterium bovis
IAGTERGLLLTTLWYIREVDPTTLLLTGLTRDGVY

SEQ ID NO: 219262 - protein, 24 aa, Mycobacterium bovis
IAHGGLGWIYLALDRNVNGRPVVL

SEQ ID NO: 219263 - protein, 22 aa, Mycobacterium bovis
IAHLPNTLLGLTSPLSSALTAA

SEQ ID NO: 219264 - protein, 26 aa, Mycobacterium bovis
IAIELDGLRLITWRGASRAEQGLPFA

SEQ ID NO: 219265 - protein, 18 aa, Mycobacterium bovis
IAITSALLVAYLPARSRE

SEQ ID NO: 219266 - protein, 32 aa, Mycobacterium bovis
IAKRANEILLARSMVKRLPLARALRTAQRHDY

SEQ ID NO: 219267 - protein, 20 aa, Mycobacterium bovis
IALAEELVALLGADQRTRVF

SEQ ID NO: 219268 - protein, 20 aa, Mycobacterium bovis
IALAFPRGPFVPAAAAWELQ

SEQ ID NO: 219269 - protein, 21 aa, Mycobacterium bovis
IALIEDGLPVIVVMPSPKGSA

SEQ ID NO: 219270 - protein, 19 aa, Mycobacterium bovis
IAMYLCRELTDLSLPKIGQ

SEQ ID NO: 219271 - protein, 24 aa, Mycobacterium bovis
IANRISYFLDIQGPSIVIDTACSS

SEQ ID NO: 219272 - protein, 22 aa, Mycobacterium bovis
IANRLCAQILLLAAEDASKDIS

SEQ ID NO: 219273 - protein, 27 aa, Mycobacterium bovis
IAPANPHYRLWNGRANRFGWRAYLGDA

SEQ ID NO: 219274 - protein, 21 aa, Mycobacterium bovis
IAPLDGVGALLRYAATNRLGS

SEQ ID NO: 219275 - protein, 18 aa, Mycobacterium bovis
IAQLQRWPDGLQAAVEAK

SEQ ID NO: 219276 - protein, 19 aa, Mycobacterium bovis
IAQLVKWGYAATQLLEGLV

SEQ ID NO: 219277 - protein, 25 aa, Mycobacterium bovis
IARALPGMIVGEIALLRDSPRSATV

SEQ ID NO: 219278 - protein, 26 aa, Mycobacterium bovis
IARPDLQVVLLEPLLRRTEFLREMVT

SEQ ID NO: 219279 - protein, 18 aa, Mycobacterium bovis
IARSFAAALGLDFTRVQF

SEQ ID NO: 219280 - protein, 26 aa, Mycobacterium bovis
IASIAGFQPIPYMAVYSATKAFVLTF

SEQ ID NO: 219281 - protein, 25 aa, Mycobacterium bovis
IATDHLMRFPGRFSEQLLPEHLHKV

SEQ ID NO: 219282 - protein, 24 aa, Mycobacterium bovis
IATEPVVHYLLAAAGLKNRTPATF

SEQ ID NO: 219283 - protein, 20 aa, Mycobacterium bovis
IATPYLIQPLAQGADIVVHS

SEQ ID NO: 219284 - protein, 21 aa, Mycobacterium bovis
IATTRFLLDVNISGGLPAFTL

SEQ ID NO: 219285 - protein, 25 aa, Mycobacterium bovis
IAVAADHVWLMSTASYPEMATVIET

SEQ ID NO: 219286 - protein, 22 aa, Mycobacterium bovis
IAVAHKLIVIIWHVLATGRPYQ

SEQ ID NO: 219287 - protein, 23 aa, Mycobacterium bovis
IAVAHKLIVIIWHVLATGRPYQD

SEQ ID NO: 219288 - protein, 27 aa, Mycobacterium bovis
IAVEARRLAFQALHRPCNSAEWTAAVA

SEQ ID NO: 219289 - protein, 18 aa, Mycobacterium bovis
IAVPDRQLACVPVHSPDG

SEQ ID NO: 219290 - protein, 24 aa, Mycobacterium bovis
IAVSDWMRAVPEQIRPWVPGTYLT

SEQ ID NO: 219291 - protein, 19 aa, Mycobacterium bovis
ICDHVRLEILYSANSATDY

SEQ ID NO: 219292 - protein, 20 aa, Mycobacterium bovis
ICHRLDGIPLAIELAASRVR

SEQ ID NO: 219293 - protein, 28 aa, Mycobacterium bovis
ICSATVEGLILGSYRFSAFRSDKTAPKD

SEQ ID NO: 219294 - protein, 17 aa, Mycobacterium bovis
ICSHWYGLIPPIKEVRD

SEQ ID NO: 219295 - protein, 30 aa, Mycobacterium bovis
IDAAEIYVPFSWFEPMWLENLGFAREGEGW

SEQ ID NO: 219296 - protein, 24 aa, Mycobacterium bovis
IDALRARFPTLGQPPSEDICYATT

SEQ ID NO: 219297 - protein, 20 aa, Mycobacterium bovis
IDDMAWMRQLLDWQREAADP

SEQ ID NO: 219298 - protein, 25 aa, Mycobacterium bovis
IDEFDAGFFGFPPLAAQVLDPQHRL

SEQ ID NO: 219299 - protein, 23 aa, Mycobacterium bovis
IDELIPLVRGVVRGAPHALVVAD

SEQ ID NO: 219300 - protein, 20 aa, Mycobacterium bovis
IDFHIRRIGVPAPGGRRELE

SEQ ID NO: 219301 - protein, 17 aa, Mycobacterium bovis
IDFTGFISDRHAVAGLL

SEQ ID NO: 219302 - protein, 23 aa, Mycobacterium bovis
IDGVRAGALPPGTRLPTVRDLAG

SEQ ID NO: 219303 - protein, 18 aa, Mycobacterium bovis
IDHFLVQADLTVVVPGPL

SEQ ID NO: 219304 - protein, 21 aa, Mycobacterium bovis
IDHPLAVATLLDRAALDARAQ

SEQ ID NO: 219305 - protein, 28 aa, Mycobacterium bovis
IDLELRYRGLRAPHKIKLGVSGCARECA

SEQ ID NO: 219306 - protein, 19 aa, Mycobacterium bovis
IDLFNSARFSRQGEHRARD

SEQ ID NO: 219307 - protein, 18 aa, Mycobacterium bovis
IDLIRVIRELNIASVAVP

SEQ ID NO: 219308 - protein, 22 aa, Mycobacterium bovis
IDMMRRHHLPVPPAFCITTEVG

SEQ ID NO: 219309 - protein, 27 aa, Mycobacterium bovis
IDPDAVELPAWYRPNPGLARDLAFIAF

SEQ ID NO: 219310 - protein, 20 aa, Mycobacterium bovis
IDPDGILNVALRDLAKDLGE

SEQ ID NO: 219311 - protein, 23 aa, Mycobacterium bovis
IDPDHLRRILTAVLDNAITHGDG

SEQ ID NO: 219312 - protein, 24 aa, Mycobacterium bovis
IDPFSLTLLGFINVNVPAIQTAPS

SEQ ID NO: 219313 - protein, 26 aa, Mycobacterium bovis
IDPNAEFFAAPLAWQERLWPTEEFEL

SEQ ID NO: 219314 - protein, 21 aa, Mycobacterium bovis
IDQLPSLPPLPTDLRTRLDAA

SEQ ID NO: 219315 - protein, 19 aa, Mycobacterium bovis
IDRMGRRPGVRWAADLLSA

SEQ ID NO: 219316 - protein, 30 aa, Mycobacterium bovis
IDRRRPVGQLRPLLAPGLVDSVLAVSRTAA

SEQ ID NO: 219317 - protein, 25 aa, Mycobacterium bovis
IDSSDEWIYTRTGIKTRRFAADDES

SEQ ID NO: 219318 - protein, 18 aa, Mycobacterium bovis
IDSTLFHSLPVDSRDRYL

SEQ ID NO: 219319 - protein, 23 aa, Mycobacterium bovis
IEAGRALVLAYNKWDLVDEDRRE

SEQ ID NO: 219320 - protein, 21 aa, Mycobacterium bovis
IEALGHPLIDHVRGRGLLLGI

SEQ ID NO: 219321 - protein, 22 aa, Mycobacterium bovis
IEALWHGQRLRALAALPELIAA

SEQ ID NO: 219322 - protein, 25 aa, Mycobacterium bovis
IEDQSPIVGIWHSGGARLAEGVRAL

SEQ ID NO: 219323 - protein, 30 aa, Mycobacterium bovis
IEELRARFNLRYPLAHLRPFLSTHERDLTM

SEQ ID NO: 219324 - protein, 19 aa, Mycobacterium bovis
IEEMGGMNIFFVLGSGGSA

SEQ ID NO: 219325 - protein, 26 aa, Mycobacterium bovis
IEEVVLRLRALLRRTGVTTVDSGAQL

SEQ ID NO: 219326 - protein, 22 aa, Mycobacterium bovis
IEFHLDFALGEADLIRIQDRDL

SEQ ID NO: 219327 - protein, 18 aa, Mycobacterium bovis
IEFVIERLSLIPESKKAV

SEQ ID NO: 219328 - protein, 17 aa, Mycobacterium bovis
IEGVEGLRMTWGRAVIL

SEQ ID NO: 219329 - protein, 26 aa, Mycobacterium bovis
IEIVGRFLALLELYRTRAVAFEQSEP

SEQ ID NO: 219330 - protein, 26 aa, Mycobacterium bovis
IELGPIRPPQRLAPYSYALGAEIKHP

SEQ ID NO: 219331 - protein, 17 aa, Mycobacterium bovis
IELRRMGYLQRMSTVLS

SEQ ID NO: 219332 - protein, 24 aa, Mycobacterium bovis
IEPSRRDSLFKHPPMVLTSSAPRS

SEQ ID NO: 219333 - protein, 34 aa, Mycobacterium bovis
IEQIQLGLIGMQLALTALWRSYGVTPDAVIGHSM

SEQ ID NO: 219334 - protein, 18 aa, Mycobacterium bovis
IERKLYPNVDFYTGLIYR

SEQ ID NO: 219335 - protein, 22 aa, Mycobacterium bovis
IERPHMYRLMFGSTSAHGINVP

SEQ ID NO: 219336 - protein, 17 aa, Mycobacterium bovis
IERSIIGFGARIGPRAL

SEQ ID NO: 219337 - protein, 27 aa, Mycobacterium bovis
IERSTALLDLGWTIIRVTSELLRYRRG

SEQ ID NO: 219338 - protein, 18 aa, Mycobacterium bovis
IERVLRPAAQRLGRPLRI

SEQ ID NO: 219339 - protein, 22 aa, Mycobacterium bovis
IETAYCAPPPVRRDRVPINATV

SEQ ID NO: 219340 - protein, 26 aa, Mycobacterium bovis
IEVDQTLWGWPQLAGDIWVGAATVAE

SEQ ID NO: 219341 - protein, 25 aa, Mycobacterium bovis
IEVIPDVLRHRLVLTYDALADEISP

SEQ ID NO: 219342 - protein, 22 aa, Mycobacterium bovis
IEVVGKKLRDLMSWVDRPITET

SEQ ID NO: 219343 - protein, 27 aa, Mycobacterium bovis
IEVVKGGLILDIGLRGFLPASLVEMRR

SEQ ID NO: 219344 - protein, 18 aa, Mycobacterium bovis
IEVYPHPATVALFRLPRA

SEQ ID NO: 219345 - protein, 18 aa, Mycobacterium bovis
IEYKFGFMGNPWGELEGV

SEQ ID NO: 219346 - protein, 20 aa, Mycobacterium bovis
IFAMLRAHIATGGYAALVAP

SEQ ID NO: 219347 - protein, 17 aa, Mycobacterium bovis
IFEGDILFLEWTANSAV

SEQ ID NO: 219348 - protein, 22 aa, Mycobacterium bovis
IFEGELFITGRIKELLVVDGAN

SEQ ID NO: 219349 - protein, 25 aa, Mycobacterium bovis
IFEQMLIDDGILLRKYWFSVSDAEQ

SEQ ID NO: 219350 - protein, 19 aa, Mycobacterium bovis
IFIADYVLAGYGTGAIMAV

SEQ ID NO: 219351 - protein, 23 aa, Mycobacterium bovis
IFMGPLFTLLGRPKVEGLEYIPS

SEQ ID NO: 219352 - protein, 30 aa, Mycobacterium bovis
IFPGGYTIDPLPLHLALNLTVPDSSIPIID

SEQ ID NO: 219353 - protein, 20 aa, Mycobacterium bovis
IFQLAFMRPLRKSRERLMVA

SEQ ID NO: 219354 - protein, 17 aa, Mycobacterium bovis
IFSFPYDVDAVTKIASL

SEQ ID NO: 219355 - protein, 17 aa, Mycobacterium bovis
IFVKDKPAWLDRAWRRI

SEQ ID NO: 219356 - protein, 20 aa, Mycobacterium bovis
IFVPSVPNLLQLASALEVQR

SEQ ID NO: 219357 - protein, 17 aa, Mycobacterium bovis
IGAILAVPGIRAALREA

SEQ ID NO: 219358 - protein, 19 aa, Mycobacterium bovis
IGAILPLLAGVADPSNFGA

SEQ ID NO: 219359 - protein, 32 aa, Mycobacterium bovis
IGAIVEWISAIMTLLPGDLILTGTPAGVGPIE

SEQ ID NO: 219360 - protein, 17 aa, Mycobacterium bovis
IGAPRWDTVIVGLDCQT

SEQ ID NO: 219361 - protein, 17 aa, Mycobacterium bovis
IGEHRFDALLAAAAEYI

SEQ ID NO: 219362 - protein, 19 aa, Mycobacterium bovis
IGEPASWLEMPIQAGVGIT

SEQ ID NO: 219363 - protein, 24 aa, Mycobacterium bovis
IGEVTNVLLLRGMIGKPGAGVCPV

SEQ ID NO: 219364 - protein, 26 aa, Mycobacterium bovis
IGGLLIACLQFDLPIRLFEIGSSAGL

SEQ ID NO: 219365 - protein, 26 aa, Mycobacterium bovis
IGGQEILFPALLPRAPYETTNRWTQY

SEQ ID NO: 219366 - protein, 17 aa, Mycobacterium bovis
IGGSFWPRGIYSVVNHA

SEQ ID NO: 219367 - protein, 20 aa, Mycobacterium bovis
IGIPINIGPLTITPITLFAQ

SEQ ID NO: 219368 - protein, 17 aa, Mycobacterium bovis
IGKTPIKRIGVLGAGMM

SEQ ID NO: 219369 - protein, 28 aa, Mycobacterium bovis
IGLANYFAGAFLLPYREFHRAAEQLRYD

SEQ ID NO: 219370 - protein, 19 aa, Mycobacterium bovis
IGLFRYQLIREAADAAHST

SEQ ID NO: 219371 - protein, 26 aa, Mycobacterium bovis
IGLGNLGSYNFGFGNAGDFNLGFANS

SEQ ID NO: 219372 - protein, 27 aa, Mycobacterium bovis
IGLGNLGSYNFGFGNAGDFNLGFANTG

SEQ ID NO: 219373 - protein, 18 aa, Mycobacterium bovis
IGLWGYSGGGLASAWAAE

SEQ ID NO: 219374 - protein, 24 aa, Mycobacterium bovis
IGMTIPYAALEIMKLRLTRSAYQQ

SEQ ID NO: 219375 - protein, 17 aa, Mycobacterium bovis
IGNMTLLADAMGTVGGA

SEQ ID NO: 219376 - protein, 30 aa, Mycobacterium bovis
IGPATIIPPIHIPSIPLGFAAIGHIGPISI

SEQ ID NO: 219377 - protein, 23 aa, Mycobacterium bovis
IGPTLLHDWIQFGGSTMFGAAMR

SEQ ID NO: 219378 - protein, 23 aa, Mycobacterium bovis
IGQLVAQRIAAFGAYVVAYDPYV

SEQ ID NO: 219379 - protein, 27 aa, Mycobacterium bovis
IGRELDRYLPFLATTKVLMAAVRAGMG

SEQ ID NO: 219380 - protein, 26 aa, Mycobacterium bovis
IGRGCLGRPWLFAELSAAFTGSPAPT

SEQ ID NO: 219381 - protein, 18 aa, Mycobacterium bovis
IGRRFSLPTVSLAETAVA

SEQ ID NO: 219382 - protein, 23 aa, Mycobacterium bovis
IGRRIVARLNWIKQGPAPAPVTE

SEQ ID NO: 219383 - protein, 29 aa, Mycobacterium bovis
IGRYPDRRSALLPLLHLVQGEDSYLTPAG

SEQ ID NO: 219384 - protein, 23 aa, Mycobacterium bovis
IGSITIPIIDIPATSGFGNSTTS

SEQ ID NO: 219385 - protein, 34 aa, Mycobacterium bovis
IGSPAMNFFPARLTAIGLTLPFGEVTLAPEVQGV

SEQ ID NO: 219386 - protein, 21 aa, Mycobacterium bovis
IGTHRLLQTGVRWKDLGLVVV

SEQ ID NO: 219387 - protein, 36 aa, Mycobacterium bovis
IGTPYSRMWGAYLTGMWLYRLSLAKVKWHSLTGRPL

SEQ ID NO: 219388 - protein, 30 aa, Mycobacterium bovis
IGVLYGRRELLAQMPPFLTGGSMIETVTME

SEQ ID NO: 219389 - protein, 25 aa, Mycobacterium bovis
IGVMRDMLAAPDQFDWLATRLEIAR

SEQ ID NO: 219390 - protein, 26 aa, Mycobacterium bovis
IGVNFIDTYFRSGQYPRELPFVIGSE

SEQ ID NO: 219391 - protein, 17 aa, Mycobacterium bovis
IGVSLLVDRQSGRCIAT

SEQ ID NO: 219392 - protein, 23 aa, Mycobacterium bovis
IGYLTALLRDEGITAMHFVPSLL

SEQ ID NO: 219393 - protein, 25 aa, Mycobacterium bovis
IGYPPTRVWGVPAAGLWAHRLGDQR

SEQ ID NO: 219394 - protein, 26 aa, Mycobacterium bovis
IHAPSLRERLRYRRGQWAHGPKLVEH

SEQ ID NO: 219395 - protein, 18 aa, Mycobacterium bovis
IHESIRELRFYRRTAFVP

SEQ ID NO: 219396 - protein, 18 aa, Mycobacterium bovis
IHGFILAAAHLVPDGTAP

SEQ ID NO: 219397 - protein, 17 aa, Mycobacterium bovis
IHHDPRWWPDPDRFDPG

SEQ ID NO: 219398 - protein, 18 aa, Mycobacterium bovis
IHLTATGLMLSGLDLRPA

SEQ ID NO: 219399 - protein, 23 aa, Mycobacterium bovis
IHLVGANRLATAVLPAMVARRRG

SEQ ID NO: 219400 - protein, 26 aa, Mycobacterium bovis
IHPGKPATAVLLLPSLRSAPLDSPEL

SEQ ID NO: 219401 - protein, 37 aa, Mycobacterium bovis
IHRGQGRWYPGEPLPRWQIALYWRTDGRPLWTNDALL

SEQ ID NO: 219402 - protein, 26 aa, Mycobacterium bovis
IHVDSRGLFFEWLTDHGFRAFAGHSL

SEQ ID NO: 219403 - protein, 17 aa, Mycobacterium bovis
IIDGIIASAPLFSRVVV

SEQ ID NO: 219404 - protein, 19 aa, Mycobacterium bovis
IIDMHLPRHRLDSGTWGVM

SEQ ID NO: 219405 - protein, 26 aa, Mycobacterium bovis
IIDSALDGVLFLDEAYALVATGAKND

SEQ ID NO: 219406 - protein, 19 aa, Mycobacterium bovis
IIGCLLHDIGKPVQRAALG

SEQ ID NO: 219407 - protein, 26 aa, Mycobacterium bovis
IIGHTDAVLWDVDRPQPALLTPGMWV

SEQ ID NO: 219408 - protein, 17 aa, Mycobacterium bovis
IIGPNCPGIISPGQSLA

SEQ ID NO: 219409 - protein, 26 aa, Mycobacterium bovis
IIGYRSLLRTELPPGGRLGLYGFGGS

SEQ ID NO: 219410 - protein, 18 aa, Mycobacterium bovis
IIPGPSSLWLDAAGKRLP

SEQ ID NO: 219411 - protein, 40 aa, Mycobacterium bovis
IISFPPTQWTRWRQPVIGMPSTPRFLGHGRLLVSTHLGQL

SEQ ID NO: 219412 - protein, 20 aa, Mycobacterium bovis
IITGGLGGLGLFLAEKMAAA

SEQ ID NO: 219413 - protein, 33 aa, Mycobacterium bovis
IIVYDLRPVPHWPKYWIQALAKHFQRQLKPSPK

SEQ ID NO: 219414 - protein, 20 aa, Mycobacterium bovis
IKATLTFRDPKELRFFTRTD

SEQ ID NO: 219415 - protein, 26 aa, Mycobacterium bovis
IKDAQTPTLLFPFAAPRVVGDLSEAG

SEQ ID NO: 219416 - protein, 18 aa, Mycobacterium bovis
IKDLLIVYGRNHSPDDIE

SEQ ID NO: 219417 - protein, 24 aa, Mycobacterium bovis
IKDSLSPQLLFTDLGLKYVGPVDG

SEQ ID NO: 219418 - protein, 23 aa, Mycobacterium bovis
IKEAGWWRLGLAEEIGGMPAPPP

SEQ ID NO: 219419 - protein, 27 aa, Mycobacterium bovis
IKGDPHRYTFQYALDLQLQSLVRVIEA

SEQ ID NO: 219420 - protein, 23 aa, Mycobacterium bovis
IKNAREMALLPYPGQDRQRRAAL

SEQ ID NO: 219421 - protein, 25 aa, Mycobacterium bovis
IKPGNNLPLRNIPAGTLIHAVELRP

SEQ ID NO: 219422 - protein, 22 aa, Mycobacterium bovis
IKRPFAIQELTLPLALDGEDVI

SEQ ID NO: 219423 - protein, 25 aa, Mycobacterium bovis
IKSATFAVHAPFAYGTLSVEQGTHR

SEQ ID NO: 219424 - protein, 21 aa, Mycobacterium bovis
IKVFDAFPLTHYVECVALLTR

SEQ ID NO: 219425 - protein, 19 aa, Mycobacterium bovis
ILADEHYVLAGGSAGARDE

SEQ ID NO: 219426 - protein, 17 aa, Mycobacterium bovis
ILDLRAGTLTRRAHWRS

SEQ ID NO: 219427 - protein, 25 aa, Mycobacterium bovis
ILDVLDNYAFVRTSGYLPGPHDVYV

SEQ ID NO: 219428 - protein, 26 aa, Mycobacterium bovis
ILENPGLLRFLPQLSERLLDESPLLH

SEQ ID NO: 219429 - protein, 32 aa, Mycobacterium bovis
ILGSGSSWLDKLWALLDPNSNFWNTIASSGLF

SEQ ID NO: 219430 - protein, 17 aa, Mycobacterium bovis
ILLSLQRIRSDPLGKLM

SEQ ID NO: 219431 - protein, 21 aa, Mycobacterium bovis
ILPPSIFHWLNYSVTAYQTGA

SEQ ID NO: 219432 - protein, 17 aa, Mycobacterium bovis
ILPSYTFVSTANAFVLR

SEQ ID NO: 219433 - protein, 18 aa, Mycobacterium bovis
ILPVEDMPFLADGTPVDI

SEQ ID NO: 219434 - protein, 32 aa, Mycobacterium bovis
ILRLSPEAITRPRWLWKFAKTLRPPDLRVPNQ

SEQ ID NO: 219435 - protein, 23 aa, Mycobacterium bovis
ILRRYGEERFARRIAAGIVRRRA

SEQ ID NO: 219436 - protein, 22 aa, Mycobacterium bovis
ILTCRLIDRPLRPSFVDGLRNE

SEQ ID NO: 219437 - protein, 17 aa, Mycobacterium bovis
ILTIRHDSLDRTSFVPG

SEQ ID NO: 219438 - protein, 17 aa, Mycobacterium bovis
ILVDRAVAELALLAAAE

SEQ ID NO: 219439 - protein, 18 aa, Mycobacterium bovis
ILVRGVAIDPDALRRRLR

SEQ ID NO: 219440 - protein, 21 aa, Mycobacterium bovis
IMRYRGYRDLTLALTGRPPGA

SEQ ID NO: 219441 - protein, 18 aa, Mycobacterium bovis
IMTPFRIVRLLEQTVRQQ

SEQ ID NO: 219442 - protein, 18 aa, Mycobacterium bovis
IMVQAWDRVDNDPDIRCC

SEQ ID NO: 219443 - protein, 19 aa, Mycobacterium bovis
INAQRLPAVLDAGARRIVV

SEQ ID NO: 219444 - protein, 20 aa, Mycobacterium bovis
INATQLLKLLAKLAELVAAA

SEQ ID NO: 219445 - protein, 18 aa, Mycobacterium bovis
INEAFASVVLSWARVHEP

SEQ ID NO: 219446 - protein, 19 aa, Mycobacterium bovis
INFGLAGRVVLVTGGVRGV

SEQ ID NO: 219447 - protein, 17 aa, Mycobacterium bovis
INGGYFCRGLPSDFDRA

SEQ ID NO: 219448 - protein, 30 aa, Mycobacterium bovis
INIGLLGKFMPNYLFAPDSTLPVIPRRDDA

SEQ ID NO: 219449 - protein, 25 aa, Mycobacterium bovis
INKEINLRFVLGYTPLEFRDTLHML

SEQ ID NO: 219450 - protein, 18 aa, Mycobacterium bovis
INMPVLDGVSVVTALRAM

SEQ ID NO: 219451 - protein, 25 aa, Mycobacterium bovis
INQLIAQWLKLMQPASDHLAKRVDT

SEQ ID NO: 219452 - protein, 27 aa, Mycobacterium bovis
INSPVQTLTGRPLIGNGANGVAGTGQN

SEQ ID NO: 219453 - protein, 18 aa, Mycobacterium bovis
INVDFADVKGIMSGAGTA

SEQ ID NO: 219454 - protein, 17 aa, Mycobacterium bovis
IPARTTAGYLALLEAAF

SEQ ID NO: 219455 - protein, 17 aa, Mycobacterium bovis
IPAVLYGHGAEPQHLEL

SEQ ID NO: 219456 - protein, 25 aa, Mycobacterium bovis
IPDHFRIYVSQKLARLERFDRTIYL

SEQ ID NO: 219457 - protein, 24 aa, Mycobacterium bovis
IPDNEFRVVLARRGQHWVSAVRVG

SEQ ID NO: 219458 - protein, 17 aa, Mycobacterium bovis
IPDRGLFAVYLATERPS

SEQ ID NO: 219459 - protein, 25 aa, Mycobacterium bovis
IPDVCDALGVPWLTLMGYIEAQGWT

SEQ ID NO: 219460 - protein, 25 aa, Mycobacterium bovis
IPDVGGVYLLSRAPGALGLHAALTG

SEQ ID NO: 219461 - protein, 24 aa, Mycobacterium bovis
IPEEVAWRMGWIDDEQLVQRARAL

SEQ ID NO: 219462 - protein, 17 aa, Mycobacterium bovis
IPEIDIHTLVAFACREL

SEQ ID NO: 219463 - protein, 18 aa, Mycobacterium bovis
IPGFTIPGSPLNLTANGG

SEQ ID NO: 219464 - protein, 20 aa, Mycobacterium bovis
IPGSILIPKGEIGSAAGLAQ

SEQ ID NO: 219465 - protein, 19 aa, Mycobacterium bovis
IPGTWLCRNGMEGTLIEGD

SEQ ID NO: 219466 - protein, 20 aa, Mycobacterium bovis
IPHGLLFERFLNPERTSMPD

SEQ ID NO: 219467 - protein, 28 aa, Mycobacterium bovis
IPKLRAGSFFPSLLERRRRIDKALHAVI

SEQ ID NO: 219468 - protein, 19 aa, Mycobacterium bovis
IPMAGFPVLGGHEGAGIVT

SEQ ID NO: 219469 - protein, 26 aa, Mycobacterium bovis
IPPFPANLTTLFFGPTGIPLPPPSML

SEQ ID NO: 219470 - protein, 31 aa, Mycobacterium bovis
IPPPNSALVSWLPFYHDMGLVIGICAPILGG

SEQ ID NO: 219471 - protein, 25 aa, Mycobacterium bovis
IPPVDIPAIVLDRILLDLHADTTIG

SEQ ID NO: 219472 - protein, 17 aa, Mycobacterium bovis
IPRHLNFHQLTPHASEA

SEQ ID NO: 219473 - protein, 23 aa, Mycobacterium bovis
IPTECEFFSLRGLALLTDTVDKV

SEQ ID NO: 219474 - protein, 17 aa, Mycobacterium bovis
IPTNAIPLTIDASGALD

SEQ ID NO: 219475 - protein, 18 aa, Mycobacterium bovis
IPTPRRVQLPLVHCGGAA

SEQ ID NO: 219476 - protein, 17 aa, Mycobacterium bovis
IPVIENISYLVGDSKHR

SEQ ID NO: 219477 - protein, 28 aa, Mycobacterium bovis
IPWSDIQKYWMMFLGALATAEGFIYDSG

SEQ ID NO: 219478 - protein, 24 aa, Mycobacterium bovis
IQALNRDFTLPGERIHVVFRSDES

SEQ ID NO: 219479 - protein, 24 aa, Mycobacterium bovis
IQAPAALGLICPWADLAVDIEATR

SEQ ID NO: 219480 - protein, 22 aa, Mycobacterium bovis
IQAQDFFFRKIVRDKGVALAHV

SEQ ID NO: 219481 - protein, 24 aa, Mycobacterium bovis
IQGHLPVILPTRRRARDLGHTTAL

SEQ ID NO: 219482 - protein, 18 aa, Mycobacterium bovis
IQGVWVHPEWRGIGLGTA

SEQ ID NO: 219483 - protein, 17 aa, Mycobacterium bovis
IQIDTTNVLFIVAGAFA

SEQ ID NO: 219484 - protein, 17 aa, Mycobacterium bovis
IQLLPLWRRVHSHVLRI

SEQ ID NO: 219485 - protein, 17 aa, Mycobacterium bovis
IQPLIQAMSFGLTAAEM

SEQ ID NO: 219486 - protein, 24 aa, Mycobacterium bovis
IQPTQLLRVWVRDVRRLTPGHAAA

SEQ ID NO: 219487 - protein, 19 aa, Mycobacterium bovis
IRAALLAHKVVFFRGQHQL

SEQ ID NO: 219488 - protein, 27 aa, Mycobacterium bovis
IRADFPILKRIMRGGNPLAYLDSGATS

SEQ ID NO: 219489 - protein, 27 aa, Mycobacterium bovis
IRDEAVHGYYIGYKFQRGLALVDDVTR

SEQ ID NO: 219490 - protein, 23 aa, Mycobacterium bovis
IREAGLAGGWLRANLPAVDAVLC

SEQ ID NO: 219491 - protein, 20 aa, Mycobacterium bovis
IRETLDLLTRVFPARTCSAG

SEQ ID NO: 219492 - protein, 25 aa, Mycobacterium bovis
IRGGKVPFVFRTLPGYTFYASQIEP

SEQ ID NO: 219493 - protein, 23 aa, Mycobacterium bovis
IRGRLTLGVLVSCPLDVADGTAL

SEQ ID NO: 219494 - protein, 20 aa, Mycobacterium bovis
IRLIFQRAREKASEGTPVIV

SEQ ID NO: 219495 - protein, 31 aa, Mycobacterium bovis
IRLLRDRIHQGWILTVLWVIDTGVTAATLEH

SEQ ID NO: 219496 - protein, 28 aa, Mycobacterium bovis
IRLSDYPYVVPLIDLEMRRPTYVFAAVD

SEQ ID NO: 219497 - protein, 17 aa, Mycobacterium bovis
IRNLVHGIGFQRDVLGA

SEQ ID NO: 219498 - protein, 17 aa, Mycobacterium bovis
IRPYERLLYAGLVGDHQ

SEQ ID NO: 219499 - protein, 19 aa, Mycobacterium bovis
IRQTVIDRGLIGDRLSIED

SEQ ID NO: 219500 - protein, 26 aa, Mycobacterium bovis
IRSGPPMGFFRIGWVRTLANLNEFFV

SEQ ID NO: 219501 - protein, 21 aa, Mycobacterium bovis
IRWSLDLLRRRFAKVIWVPGN

SEQ ID NO: 219502 - protein, 27 aa, Mycobacterium bovis
ISDELWDLLPGYLIFRSIIPNRPPTQD

SEQ ID NO: 219503 - protein, 25 aa, Mycobacterium bovis
ISDGELFIMGRIKDLLIVDGRNHYP

SEQ ID NO: 219504 - protein, 19 aa, Mycobacterium bovis
ISDVLTASDFWGGAGSAAC

SEQ ID NO: 219505 - protein, 22 aa, Mycobacterium bovis
ISEPAELVAVRSALQDAGIDYE

SEQ ID NO: 219506 - protein, 24 aa, Mycobacterium bovis
ISFTHLLGYALVQAVKKFPNMNRH

SEQ ID NO: 219507 - protein, 27 aa, Mycobacterium bovis
ISGAKAWLGTALALKPLLSVDDGKLVL

SEQ ID NO: 219508 - protein, 24 aa, Mycobacterium bovis
ISGLVIALLCRGHVLLEGVPGVAK

SEQ ID NO: 219509 - protein, 27 aa, Mycobacterium bovis
ISGSYSNGFLWSGNYQGLIGLHAALAI

SEQ ID NO: 219510 - protein, 21 aa, Mycobacterium bovis
ISLGWGLWDQASAMTSGLDAA

SEQ ID NO: 219511 - protein, 18 aa, Mycobacterium bovis
ISPHPSAGIPALAVPHIR

SEQ ID NO: 219512 - protein, 19 aa, Mycobacterium bovis
ISPRDALASAGKTLVELFG

SEQ ID NO: 219513 - protein, 18 aa, Mycobacterium bovis
ISPTTIYDKFPTLTPDQA

SEQ ID NO: 219514 - protein, 29 aa, Mycobacterium bovis
ISTDLLYKLLRSEWLEPRWMVGIDPESDG

SEQ ID NO: 219515 - protein, 18 aa, Mycobacterium bovis
ISTLKRNYGWNRSCIDGT

SEQ ID NO: 219516 - protein, 22 aa, Mycobacterium bovis
ISVGYLRWDFFPKPGSAPDFLT

SEQ ID NO: 219517 - protein, 17 aa, Mycobacterium bovis
ISVKLIQPVAMDEGLRF

SEQ ID NO: 219518 - protein, 19 aa, Mycobacterium bovis
ITAALWGVDEAISRAVPLR

SEQ ID NO: 219519 - protein, 18 aa, Mycobacterium bovis
ITAIDWLYWRMTKGVEDA

SEQ ID NO: 219520 - protein, 23 aa, Mycobacterium bovis
ITALVPGLTWRTDMDTWTGCGGE

SEQ ID NO: 219521 - protein, 18 aa, Mycobacterium bovis
ITAPRGWELVRHAGPLPS

SEQ ID NO: 219522 - protein, 21 aa, Mycobacterium bovis
ITCLAEPDPSWWDRLAPVSHH

SEQ ID NO: 219523 - protein, 28 aa, Mycobacterium bovis
ITDNSTLAHLLKFDSILGRLPCDVGLEG

SEQ ID NO: 219524 - protein, 19 aa, Mycobacterium bovis
ITEHLLGAARRRAFRVWLD

SEQ ID NO: 219525 - protein, 26 aa, Mycobacterium bovis
ITELAQQILLPRLPPKGLSQEELRAL

SEQ ID NO: 219526 - protein, 24 aa, Mycobacterium bovis
ITERQKQILLDIYASFTHQNEATR

SEQ ID NO: 219527 - protein, 25 aa, Mycobacterium bovis
ITGGLGGLGLFFASKLAAAGCGRIV

SEQ ID NO: 219528 - protein, 35 aa, Mycobacterium bovis
ITGNFNNGFLWRGDHQGLIFGSPGFFNSTSAPSSG

SEQ ID NO: 219529 - protein, 17 aa, Mycobacterium bovis
ITGPDTAAQARCVVECM

SEQ ID NO: 219530 - protein, 17 aa, Mycobacterium bovis
ITGYRFDRTAHDLHLLL

SEQ ID NO: 219531 - protein, 17 aa, Mycobacterium bovis
ITGYRFDRTARDLHLLL

SEQ ID NO: 219532 - protein, 26 aa, Mycobacterium bovis
ITIQPIPILPTIPLSIHQTVNLGPLV

SEQ ID NO: 219533 - protein, 29 aa, Mycobacterium bovis
ITITGGGAIRIPLISIPAAPGFGNSTTNP

SEQ ID NO: 219534 - protein, 19 aa, Mycobacterium bovis
ITKSRRPIGALLMDQTVIA

SEQ ID NO: 219535 - protein, 18 aa, Mycobacterium bovis
ITLYSPLRHWNAGANTRV

SEQ ID NO: 219536 - protein, 30 aa, Mycobacterium bovis; identical to SEQ ID NO: 115434

SEQ ID NO: 219537 - protein, 27 aa, Mycobacterium bovis
ITMPENTIRWNWAPGDVAIWDNRATQH

SEQ ID NO: 219538 - protein, 18 aa, Mycobacterium bovis
ITMSAPYLSQLRSGNRTN

SEQ ID NO: 219539 - protein, 27 aa, Mycobacterium bovis
ITPAQTGPFFLLDIDSFWTPSGGSIPE

SEQ ID NO: 219540 - protein, 25 aa, Mycobacterium bovis
ITPEQVLESPFLLLGTHEQMAEALA

SEQ ID NO: 219541 - protein, 19 aa, Mycobacterium bovis
ITPFRPRALSARGVEATIA

SEQ ID NO: 219542 - protein, 17 aa, Mycobacterium bovis
ITPIMVREINIGEIPLG

SEQ ID NO: 219543 - protein, 26 aa, Mycobacterium bovis
ITPRTRLIWVETPTNPLLSIADITAI

SEQ ID NO: 219544 - protein, 17 aa, Mycobacterium bovis
ITPVNRAIWIPAGCWHQ

SEQ ID NO: 219545 - protein, 24 aa, Mycobacterium bovis
ITRARVHLALSWALSRSPGGRQSR

SEQ ID NO: 219546 - protein, 32 aa, Mycobacterium bovis; identical to SEQ ID NO: 120768

SEQ ID NO: 219547 - protein, 24 aa, Mycobacterium bovis
ITSDRLYPLRLQQELADLLPGCAG

SEQ ID NO: 219548 - protein, 25 aa, Mycobacterium bovis
ITTPALISGFFNTGSNMSGFFGGPP

SEQ ID NO: 219549 - protein, 23 aa, Mycobacterium bovis
ITVDPITLTIPGLSLDAAVSEIR

SEQ ID NO: 219550 - protein, 26 aa, Mycobacterium bovis
ITVGELLARPFFADPLRRHDIAPITD

SEQ ID NO: 219551 - protein, 23 aa, Mycobacterium bovis
ITVRGQRLLQRCPVCLYAGSIMP

SEQ ID NO: 219552 - protein, 24 aa, Mycobacterium bovis
ITWEHDMHLYFKRAHGSAQLLESP

SEQ ID NO: 219553 - protein, 19 aa, Mycobacterium bovis
IVAGWHGRPWAHHVPVMRE

SEQ ID NO: 219554 - protein, 17 aa, Mycobacterium bovis
IVAPYLLALATEEQKRR

SEQ ID NO: 219555 - protein, 28 aa, Mycobacterium bovis
IVASIPVKRLRQAGVLDLLLALANETET

SEQ ID NO: 219556 - protein, 23 aa, Mycobacterium bovis
IVEGMLALTGYYAWHKICVERAI

SEQ ID NO: 219557 - protein, 25 aa, Mycobacterium bovis
IVELCALWAVHLHFDPSPEPWSIVQ

SEQ ID NO: 219558 - protein, 26 aa, Mycobacterium bovis
IVELLRSRVFFDWFDAMGVDDIPAVF

SEQ ID NO: 219559 - protein, 18 aa, Mycobacterium bovis
IVERFGFSEIMRSTLEKD

SEQ ID NO: 219560 - protein, 18 aa, Mycobacterium bovis
IVEYIGQTRGWFYTLHVL

SEQ ID NO: 219561 - protein, 17 aa, Mycobacterium bovis
IVGAPVDALVNLADEEK

SEQ ID NO: 219562 - protein, 18 aa, Mycobacterium bovis
IVGGGPYLETLRKLAHDC

SEQ ID NO: 219563 - protein, 26 aa, Mycobacterium bovis
IVGHDRLRLALLLCAVRPEIGGALIR

SEQ ID NO: 219564 - protein, 17 aa, Mycobacterium bovis
IVGPIVYLGGGAGYRSK

SEQ ID NO: 219565 - protein, 19 aa, Mycobacterium bovis
IVHVLGGCSTALFPAGGST

SEQ ID NO: 219566 - protein, 20 aa, Mycobacterium bovis
IVICSPRRRTLDTAKLAGLT

SEQ ID NO: 219567 - protein, 17 aa, Mycobacterium bovis
IVIGKGGARLREVGTAA

SEQ ID NO: 219568 - protein, 19 aa, Mycobacterium bovis
IVMGRRTWDSLPAKVRPLP

SEQ ID NO: 219569 - protein, 20 aa, Mycobacterium bovis
IVMPARLPNRIHPFVQEIVP

SEQ ID NO: 219570 - protein, 19 aa, Mycobacterium bovis
IVMPVLPMHGPRGQGLPKG

SEQ ID NO: 219571 - protein, 20 aa, Mycobacterium bovis
IVPHIVWGAQRIWTKDRPKK

SEQ ID NO: 219572 - protein, 26 aa, Mycobacterium bovis
IVPMFHANGWGLPYAALMAGADLVLP

SEQ ID NO: 219573 - protein, 18 aa, Mycobacterium bovis
IVQGCDHFTFFASVDHVH

SEQ ID NO: 219574 - protein, 18 aa, Mycobacterium bovis
IVTMNRPAARNALSTEMM

SEQ ID NO: 219575 - protein, 17 aa, Mycobacterium bovis
IVVLMQWGDEYLPRPEG

SEQ ID NO: 219576 - protein, 21 aa, Mycobacterium bovis
IVYVHGAVISSRRGELSVLAD

SEQ ID NO: 219577 - protein, 18 aa, Mycobacterium bovis
IYAPLLPSVDEVAALLRS

SEQ ID NO: 219578 - protein, 34 aa, Mycobacterium bovis
IYGDTKLGLFPFRRNLSFYAVDLGLLSATHPEEL

SEQ ID NO: 219579 - protein, 20 aa, Mycobacterium bovis
IYKIRGVAAVTFYGRGRLVS

SEQ ID NO: 219580 - protein, 30 aa, Mycobacterium bovis; identical to SEQ ID NO: 115465

SEQ ID NO: 219581 - protein, 33 aa, Mycobacterium bovis
IYTLTDEAPLLATYAFLPIVRAFAEPAGIKIEA

SEQ ID NO: 219582 - protein, 25 aa, Mycobacterium bovis
KAAAAGRPWWEWAATHERAFTAAYD

SEQ ID NO: 219583 - protein, 19 aa, Mycobacterium bovis
KAAEIAINSPLLEASMEGA

SEQ ID NO: 219584 - protein, 22 aa, Mycobacterium bovis
KAAGLFNAPASQLARLAAALQE

SEQ ID NO: 219585 - protein, 17 aa, Mycobacterium bovis
KAAGLRSLLAYQWAHPG

SEQ ID NO: 219586 - protein, 25 aa, Mycobacterium bovis
KAAIRQIEFLIRATAQRPDAVSVAD

SEQ ID NO: 219587 - protein, 30 aa, Mycobacterium bovis
KAALYRRWAGKRELVLAAVQYALPPVPEPR

SEQ ID NO: 219588 - protein, 25 aa, Mycobacterium bovis
KAAPVLWTQQVLTTGRLRAVILNSG

SEQ ID NO: 219589 - protein, 20 aa, Mycobacterium bovis
KAARFIRFSDAFDIPLVFVV

SEQ ID NO: 219590 - protein, 17 aa, Mycobacterium bovis
KAARFVRTCDCFNIPIV

SEQ ID NO: 219591 - protein, 27 aa, Mycobacterium bovis
KADSIVIGGGMCFTFLAAQGFSVGTSL

SEQ ID NO: 219592 - protein, 25 aa, Mycobacterium bovis
KAEAASVPSWPQILGRLTDNRDLAR

SEQ ID NO: 219593 - protein, 17 aa, Mycobacterium bovis
KAELNLGKLLTKRARVI

SEQ ID NO: 219594 - protein, 18 aa, Mycobacterium bovis
KAFGRSIGSFQNSRFLLA

SEQ ID NO: 219595 - protein, 17 aa, Mycobacterium bovis
KAFYLDLQDERLTSALG

SEQ ID NO: 219596 - protein, 20 aa, Mycobacterium bovis
KAHELRIQRLADGSLRHPPV

SEQ ID NO: 219597 - protein, 19 aa, Mycobacterium bovis
KAILDRTPWRAEEVTVIVA

SEQ ID NO: 219598 - protein, 36 aa, Mycobacterium bovis
KAIYQRYMGWFDGNPGWLWPHPPEALAPRYVDALGG

SEQ ID NO: 219599 - protein, 20 aa, Mycobacterium bovis
KALDQLLVLGTLLEGHAEHV

SEQ ID NO: 219600 - protein, 18 aa, Mycobacterium bovis
KALDWIGERLGPAEVGPD

SEQ ID NO: 219601 - protein, 17 aa, Mycobacterium bovis
KALLFSVFEGGLRHGLF

SEQ ID NO: 219602 - protein, 39 aa, Mycobacterium bovis
KAMLFDGRSGEPFPYPVTVGYMYIMKLHHLVDDKIHARS

SEQ ID NO: 219603 - protein, 24 aa, Mycobacterium bovis
KAQELGLTWLAEIGAHGVVAGPDS

SEQ ID NO: 219604 - protein, 25 aa, Mycobacterium bovis
KAQHGVMELLLINHPLDCPMCDKGG

SEQ ID NO: 219605 - protein, 23 aa, Mycobacterium bovis
KAQILASGVAMPAALRAAQMLAA

SEQ ID NO: 219606 - protein, 19 aa, Mycobacterium bovis
KARHNYSIIEVFEAGVALQ

SEQ ID NO: 219607 - protein, 22 aa, Mycobacterium bovis
KARPDIGPLFYEPTVLTNVAPE

SEQ ID NO: 219608 - protein, 17 aa, Mycobacterium bovis
KARYMWVSTFHSTCVRI

SEQ ID NO: 219609 - protein, 22 aa, Mycobacterium bovis
KATLVRAVCDGRRLVTLDGPEI

SEQ ID NO: 219610 - protein, 21 aa, Mycobacterium bovis
KATVKLLFRDAYALGGRFEEH

SEQ ID NO: 219611 - protein, 19 aa, Mycobacterium bovis
KAVFSARALAEVCRRGWAQ

SEQ ID NO: 219612 - protein, 26 aa, Mycobacterium bovis
KAVGATWYTAVPTIHQILLERSATEP

SEQ ID NO: 219613 - protein, 24 aa, Mycobacterium bovis
KAVVVLGLPRGGVPVAFEVAKSLQ

SEQ ID NO: 219614 - protein, 26 aa, Mycobacterium bovis
KAYAEGLRALYLYTATFQDAAVAEVV

SEQ ID NO: 219615 - protein, 18 aa, Mycobacterium bovis
KCFANRYQSWLPTLKEMV

SEQ ID NO: 219616 - protein, 26 aa, Mycobacterium bovis
KDAEVWDRLTGNFWLPEKVPVSNDIP

SEQ ID NO: 219617 - protein, 19 aa, Mycobacterium bovis
KDAHWFDPGKFWSGDSLPL

SEQ ID NO: 219618 - protein, 24 aa, Mycobacterium bovis
KDALLDDALGRCFSTWNQRVQEAF

SEQ ID NO: 219619 - protein, 26 aa, Mycobacterium bovis
KDDIFYYVYGLLHDPAYRTKYAADLK

SEQ ID NO: 219620 - protein, 32 aa, Mycobacterium bovis
KDGVEARRFWRHEYLLNALIGRFAKPYVALMD

SEQ ID NO: 219621 - protein, 22 aa, Mycobacterium bovis
KDHPPILRVTPGATPWVTWGEF

SEQ ID NO: 219622 - protein, 25 aa, Mycobacterium bovis
KDIEDLTFALNLGVDMVALSFVRSP

SEQ ID NO: 219623 - protein, 20 aa, Mycobacterium bovis
KDKQLYTLDLGSLVAGSRYR

SEQ ID NO: 219624 - protein, 27 aa, Mycobacterium bovis
KDNRPVARIVPLKRRRQWLPAAEVIGE

SEQ ID NO: 219625 - protein, 25 aa, Mycobacterium bovis
KDRDAVLRRAPWVDVVFGTHNIGSL

SEQ ID NO: 219626 - protein, 18 aa, Mycobacterium bovis
KDRPKKLFRPKVPVTIVV

SEQ ID NO: 219627 - protein, 31 aa, Mycobacterium bovis
KDRVYCPGWVALFRWLKPLLSTRVGQRPIRN

SEQ ID NO: 219628 - protein, 18 aa, Mycobacterium bovis
KDTLWKAADKLRGSLSAS

SEQ ID NO: 219629 - protein, 38 aa, Mycobacterium bovis
KDVMVSWLPCFHDMGMVGFLTIPMFFGAELVKVTPMDF

SEQ ID NO: 219630 - protein, 23 aa, Mycobacterium bovis
KDVVGAYRFLQRVWRLVVDEHTG

SEQ ID NO: 219631 - protein, 26 aa, Mycobacterium bovis
KEAIAIDPQHRLLLETSWEAMEHGGL

SEQ ID NO: 219632 - protein, 20 aa, Mycobacterium bovis
KEAVLPFHRFRRADGAAIDS

SEQ ID NO: 219633 - protein, 23 aa, Mycobacterium bovis
KEEAKVWVGDLPGWLALHGYQNS

SEQ ID NO: 219634 - protein, 27 aa, Mycobacterium bovis
KEFMVRNTYIYPPKPSMRIISDIFAYT

SEQ ID NO: 219635 - protein, 18 aa, Mycobacterium bovis
KEFTLLEALIRRPGIVHT

SEQ ID NO: 219636 - protein, 23 aa, Mycobacterium bovis
KEHFDFFPLTVDVEERMYAAGRI

SEQ ID NO: 219637 - protein, 29 aa, Mycobacterium bovis
KELAAMGFKFQFITLAGFHALNYSMFDLA

SEQ ID NO: 219638 - protein, 28 aa, Mycobacterium bovis
KELCRRWYPRIYFGQPPKGLTHRALADI

SEQ ID NO: 219639 - protein, 20 aa, Mycobacterium bovis
KEPHYGPPPLLLRMVEAGQL

SEQ ID NO: 219640 - protein, 21 aa, Mycobacterium bovis
KEPLYRLYELRLRQGLAASKS

SEQ ID NO: 219641 - protein, 23 aa, Mycobacterium bovis
KESLLVELLVGVSARLLAGARDV

SEQ ID NO: 219642 - protein, 25 aa, Mycobacterium bovis
KETLAFFAGIGIPIAEIWGMSELSC

SEQ ID NO: 219643 - protein, 26 aa, Mycobacterium bovis
KEWAQLLMVAVRVASLPGLLSTTTVF

SEQ ID NO: 219644 - protein, 17 aa, Mycobacterium bovis
KEYVGVARALGLTKSDA

SEQ ID NO: 219645 - protein, 18 aa, Mycobacterium bovis
KFDLVRYYLAVAEGAMRG

SEQ ID NO: 219646 - protein, 30 aa, Mycobacterium bovis
KFDYTKGFKFSTYATWWIRQAITRGMADQS

SEQ ID NO: 219647 - protein, 18 aa, Mycobacterium bovis
KFEGWTPLAQLKVGDRIA

SEQ ID NO: 219648 - protein, 20 aa, Mycobacterium bovis
KFPVLLGGAALTRSYVENDL

SEQ ID NO: 219649 - protein, 27 aa, Mycobacterium bovis
KGAGLGKDVLLLTDGRFSGGTTGLCVG

SEQ ID NO: 219650 - protein, 24 aa, Mycobacterium bovis
KGAPPAPLDARIGWRRATLAVCEA

SEQ ID NO: 219651 - protein, 24 aa, Mycobacterium bovis
KGEFRKLWIARINAAARLNDITYN

SEQ ID NO: 219652 - protein, 24 aa, Mycobacterium bovis
KGEVKDVLLLDVTPLSLGIETKGG

SEQ ID NO: 219653 - protein, 18 aa, Mycobacterium bovis
KGFKSFAAPTTLRFEPGI

SEQ ID NO: 219654 - protein, 18 aa, Mycobacterium bovis
KGGLRLVAAGVNPIALGV

SEQ ID NO: 219655 - protein, 31 aa, Mycobacterium bovis
KGGTGGAGMNSLDPLLAAQDGGQGGTGGTGG

SEQ ID NO: 219656 - protein, 25 aa, Mycobacterium bovis
KGKRYALPHARILMHQPLGGVTGSA

SEQ ID NO: 219657 - protein, 22 aa, Mycobacterium bovis
KGLVRVLAFEHPDMRTTLVDLD

SEQ ID NO: 219658 - protein, 21 aa, Mycobacterium bovis
KGMLTGPVTILAWSFVRDDQP

SEQ ID NO: 219659 - protein, 21 aa, Mycobacterium bovis
KGMMLSGIPNMAYTVGYTNAS

SEQ ID NO: 219660 - protein, 23 aa, Mycobacterium bovis
KGPKIRIHKFKNKTGYHKRQGHR

SEQ ID NO: 219661 - protein, 23 aa, Mycobacterium bovis
KGQLLSLHLGRLKDRVGLRPDQV

SEQ ID NO: 219662 - protein, 31 aa, Mycobacterium bovis
KGRATREAMLARIPLRRFAEPEDFVGALIYL

SEQ ID NO: 219663 - protein, 26 aa, Mycobacterium bovis
KGRLTLPAKFRDALAGGLMVTKSQDH

SEQ ID NO: 219664 - protein, 17 aa, Mycobacterium bovis
KGTMKSQPWILAYEDHN

SEQ ID NO: 219665 - protein, 17 aa, Mycobacterium bovis
KGVKWDPAELGPVVSDL

SEQ ID NO: 219666 - protein, 19 aa, Mycobacterium bovis
KHGPIALIEDGLPVIVVMP

SEQ ID NO: 219667 - protein, 22 aa, Mycobacterium bovis
KHPWRVLMHYEKDAKILLEDPI

SEQ ID NO: 219668 - protein, 17 aa, Mycobacterium bovis
KHRGLSFLLVPMDQPGV

SEQ ID NO: 219669 - protein, 19 aa, Mycobacterium bovis
KHRVTRETLALLIDLARTA

SEQ ID NO: 219670 - protein, 24 aa, Mycobacterium bovis
KHTVARLIGAPPGYVGYEAGGQLT

SEQ ID NO: 219671 - protein, 24 aa, Mycobacterium bovis
KIADYPFTTLVPNLGVVSAGEHAF

SEQ ID NO: 219672 - protein, 18 aa, Mycobacterium bovis
KIHEFAGALLGKQGDRGV

SEQ ID NO: 219673 - protein, 17 aa, Mycobacterium bovis
KILGSDRPAWATGFGRL

SEQ ID NO: 219674 - protein, 20 aa, Mycobacterium bovis
KIRGRYLLEVSSPGVERPLT

SEQ ID NO: 219675 - protein, 27 aa, Mycobacterium bovis
KIRLLTRIAFGFRSPQALIALAMLTLA

SEQ ID NO: 219676 - protein, 32 aa, Mycobacterium bovis
KIRLLTRIAFGFRSPQALIALAMLTLAGHRPT

SEQ ID NO: 219677 - protein, 28 aa, Mycobacterium bovis
KIRNLVKKYSDFIAWPIRMDVERRTPAS

SEQ ID NO: 219678 - protein, 24 aa, Mycobacterium bovis
KIVEGRLNGFFKDAVLLEQASVSD

SEQ ID NO: 219679 - protein, 18 aa, Mycobacterium bovis
KKKFLPAILAGEAHFAIG

SEQ ID NO: 219680 - protein, 19 aa, Mycobacterium bovis
KKLGLPAQRRALTVHSARW

SEQ ID NO: 219681 - protein, 18 aa, Mycobacterium bovis
KKQVRCVYVAIGQKGTTI

SEQ ID NO: 219682 - protein, 20 aa, Mycobacterium bovis
KLADLVAVFAPGGALAQYDE

SEQ ID NO: 219683 - protein, 19 aa, Mycobacterium bovis
KLAMPFIVLATDNPIEYEG

SEQ ID NO: 219684 - protein, 28 aa, Mycobacterium bovis
KLAPKHVLPAWIGLVTLAAQEPGREWSA

SEQ ID NO: 219685 - protein, 20 aa, Mycobacterium bovis
KLDVLDFWSIIKPELAGVHG

SEQ ID NO: 219686 - protein, 20 aa, Mycobacterium bovis
KLEAKYFMMRVRCDGGALSA

SEQ ID NO: 219687 - protein, 18 aa, Mycobacterium bovis
KLEGDAAFFWAPGGNTSV

SEQ ID NO: 219688 - protein, 19 aa, Mycobacterium bovis
KLEVLPVTAFSLHDAADAF

SEQ ID NO: 219689 - protein, 20 aa, Mycobacterium bovis
KLEVYSPNSPLGGALIDAKV

SEQ ID NO: 219690 - protein, 17 aa, Mycobacterium bovis
KLFQRYQDRYDMELSHP

SEQ ID NO: 219691 - protein, 18 aa, Mycobacterium bovis
KLFRPKVPVTIVVGERIE

SEQ ID NO: 219692 - protein, 37 aa, Mycobacterium bovis
KLGDLITFVIHIPLSIDLLLDLRLDKQRFMVAGDIAL

SEQ ID NO: 219693 - protein, 25 aa, Mycobacterium bovis
KLGPDFLVELLEIRAALGPLIGRLA

SEQ ID NO: 219694 - protein, 27 aa, Mycobacterium bovis
KLHELQRLWLIEATRYNVLPLDDDTAS

SEQ ID NO: 219695 - protein, 20 aa, Mycobacterium bovis
KLKVLVSIFGRETPVELTFG

SEQ ID NO: 219696 - protein, 36 aa, Mycobacterium bovis
KLLFTNPVKAFQFLVDLILFDWPTHMLQLATWLAEN

SEQ ID NO: 219697 - protein, 25 aa, Mycobacterium bovis
KLLRSDFPVLWPVGTRWADNDMFGH

SEQ ID NO: 219698 - protein, 24 aa, Mycobacterium bovis
KLMTDIFALAMELGGAISGEHGVG

SEQ ID NO: 219699 - protein, 26 aa, Mycobacterium bovis
KLNAQLIDELPLPRPRYEIFVYSPRV

SEQ ID NO: 219700 - protein, 20 aa, Mycobacterium bovis
KLPPRPLVSGNYRRPPRELS

SEQ ID NO: 219701 - protein, 19 aa, Mycobacterium bovis
KLRQAPILALGGRPEELRE

SEQ ID NO: 219702 - protein, 37 aa, Mycobacterium bovis
KLTPAWRTTIKRWFPGFMTFRFLECGLLTMVSNPLAL

SEQ ID NO: 219703 - protein, 21 aa, Mycobacterium bovis
KLTPDRFIHELLVEHLHVVEV

SEQ ID NO: 219704 - protein, 21 aa, Mycobacterium bovis
KLVHELVRRWSGHMVTSQGDG

SEQ ID NO: 219705 - protein, 22 aa, Mycobacterium bovis
KLVYAVLNLYPYNPGHLMVVPY

SEQ ID NO: 219706 - protein, 19 aa, Mycobacterium bovis
KMTPAPTQPIPILVGGHAD

SEQ ID NO: 219707 - protein, 22 aa, Mycobacterium bovis
KMVRKRMRALKYSKQMIDDISQ

SEQ ID NO: 219708 - protein, 41 aa, Mycobacterium bovis
KNAYVGRTFIQPSQTIRQLGIRLKLNPLKEVIRGKRLIVVD

SEQ ID NO: 219709 - protein, 32 aa, Mycobacterium bovis
KNEPDWMLQSRLKALRIFDRKPIPKWGSNLDG

SEQ ID NO: 219710 - protein, 24 aa, Mycobacterium bovis
KNILGLDIKGHIVKKLLVAEASDI

SEQ ID NO: 219711 - protein, 24 aa, Mycobacterium bovis
KNNPGLVVLLTFGTGIGSAVIHNG

SEQ ID NO: 219712 - protein, 25 aa, Mycobacterium bovis
KNVDAFLAVCRKWEVLATVIGEVTD

SEQ ID NO: 219713 - protein, 18 aa, Mycobacterium bovis
KNYFYPDMPKNYQISQYD

SEQ ID NO: 219714 - protein, 18 aa, Mycobacterium bovis
KPATVLVLGVGVAGLQAL

SEQ ID NO: 219715 - protein, 20 aa, Mycobacterium bovis
KPAYIAGDLAYYLDKRQRGF

SEQ ID NO: 219716 - protein, 29 aa, Mycobacterium bovis
KPDAPVRYRFHFPRQQRGRFLCIADFIRS

SEQ ID NO: 219717 - protein, 23 aa, Mycobacterium bovis
KPEEFVQFARFAEGLGFAGVLAG

SEQ ID NO: 219718 - protein, 19 aa, Mycobacterium bovis
KPEWTERWPDLVASFTAAT

SEQ ID NO: 219719 - protein, 33 aa, Mycobacterium bovis
KPGDALFFGHGLNVHFGLIKPPADVAVAMVAPK

SEQ ID NO: 219720 - protein, 25 aa, Mycobacterium bovis
KPGQLISYLLRRRGMLTSNVGEAYG

SEQ ID NO: 219721 - protein, 17 aa, Mycobacterium bovis
KPLVRLRVPFTLSRNEI

SEQ ID NO: 219722 - protein, 18 aa, Mycobacterium bovis
KPPYVAAYVLLDGADIPF

SEQ ID NO: 219723 - protein, 18 aa, Mycobacterium bovis
KPRPGRIVFVGSGPGDPG

SEQ ID NO: 219724 - protein, 25 aa, Mycobacterium bovis
KPVRPRLHSISFIFKGRPGEVYLTV

SEQ ID NO: 219725 - protein, 18 aa, Mycobacterium bovis
KPVVLRRATPLQAIAAMD

SEQ ID NO: 219726 - protein, 25 aa, Mycobacterium bovis
KPVVRRRILLPEHKDFGRIAPDEKT

SEQ ID NO: 219727 - protein, 25 aa, Mycobacterium bovis
KQDGQWRIAYRRLRNDRLVSDPSVA

SEQ ID NO: 219728 - protein, 24 aa, Mycobacterium bovis
KQERLAALDHSRGSWRGRDFTGTE

SEQ ID NO: 219729 - protein, 24 aa, Mycobacterium bovis
KQLDMRRMPWRLHVFTPVHDVPGV

SEQ ID NO: 219730 - protein, 17 aa, Mycobacterium bovis
KQLVAYVGLERFLAGLR

SEQ ID NO: 219731 - protein, 21 aa, Mycobacterium bovis
KQYIRLFEMDGVELEFTDDAL

SEQ ID NO: 219732 - protein, 25 aa, Mycobacterium bovis
KREVMMVHTLLWPDEIRDPDFPVLD

SEQ ID NO: 219733 - protein, 28 aa, Mycobacterium bovis
KRGAIELAWALLTNSLAAGGYGLDPERI

SEQ ID NO: 219734 - protein, 20 aa, Mycobacterium bovis
KRGDLLVPGKFLTAADIGEE

SEQ ID NO: 219735 - protein, 26 aa, Mycobacterium bovis
KRGGKVWINIFPDRPLTKKPAETRMG

SEQ ID NO: 219736 - protein, 23 aa, Mycobacterium bovis
KRHQNKPVLFLGDTRLTGGQLAD

SEQ ID NO: 219737 - protein, 21 aa, Mycobacterium bovis
KRLAAALPDYPFAYLITVDDG

SEQ ID NO: 219738 - protein, 23 aa, Mycobacterium bovis
KRLCERLLSFASPLLLYAEEIEP

SEQ ID NO: 219739 - protein, 25 aa, Mycobacterium bovis
KRLKPSLRQRVIAAWLWSGRKGVIA

SEQ ID NO: 219740 - protein, 17 aa, Mycobacterium bovis
KRLLVNLDKAKAAPLWR

SEQ ID NO: 219741 - protein, 17 aa, Mycobacterium bovis
KRLVDFAAGLAFALRGS

SEQ ID NO: 219742 - protein, 28 aa, Mycobacterium bovis
KRQEDFIGIHFFSPVDKMPLVEIIKGEK

SEQ ID NO: 219743 - protein, 21 aa, Mycobacterium bovis
KRQRRRDGRDAGRRRPPVLSE

SEQ ID NO: 219744 - protein, 28 aa, Mycobacterium bovis
KRRATIEQLLTIPLAKELAWAPDEIREE

SEQ ID NO: 219745 - protein, 17 aa, Mycobacterium bovis
KRRRPQLLAVDNVVVCA

SEQ ID NO: 219746 - protein, 25 aa, Mycobacterium bovis
KRSLNHWYRMFGPAFETSLGLEFIG

SEQ ID NO: 219747 - protein, 29 aa, Mycobacterium bovis
KRSWLRARGLKIFRWWAGPSVVVTTRRGT

SEQ ID NO: 219748 - protein, 24 aa, Mycobacterium bovis
KRTGELIPLCHPLGIEAVTVTLEP

SEQ ID NO: 219749 - protein, 23 aa, Mycobacterium bovis
KRVLEALLLVIDTPVTADALAAA

SEQ ID NO: 219750 - protein, 23 aa, Mycobacterium bovis
KRVPDFFRIPYDPHLATGLAVDF

SEQ ID NO: 219751 - protein, 26 aa, Mycobacterium bovis
KRVRRWMRRRYLLLEVPQLPGRGWVE

SEQ ID NO: 219752 - protein, 23 aa, Mycobacterium bovis
KRVTFAAFPWRWVGGDGCIVRLV

SEQ ID NO: 219753 - protein, 21 aa, Mycobacterium bovis
KSCFLAMVRRFYELGVKELNG

SEQ ID NO: 219754 - protein, 22 aa, Mycobacterium bovis
KSETFPGLAGLGDLIVTCTSQR

SEQ ID NO: 219755 - protein, 25 aa, Mycobacterium bovis
KSLAAAPFADILWMETKTADLADAR

SEQ ID NO: 219756 - protein, 21 aa, Mycobacterium bovis
KSLPPKWFYDTVGSELFDQIT

SEQ ID NO: 219757 - protein, 23 aa, Mycobacterium bovis
KSTIAAALALTLAAGGRKVLLVE

SEQ ID NO: 219758 - protein, 20 aa, Mycobacterium bovis
KSTLLRLLSGIYEPTRGWAK

SEQ ID NO: 219759 - protein, 18 aa, Mycobacterium bovis
KSVIWRLAEDLDAGDDLG

SEQ ID NO: 219760 - protein, 25 aa, Mycobacterium bovis
KSVYLCCRAALRHMVLAGKGSIVNT

SEQ ID NO: 219761 - protein, 21 aa, Mycobacterium bovis
KTAAFAIPMLSKIDITSKVPQ

SEQ ID NO: 219762 - protein, 18 aa, Mycobacterium bovis
KTAGAVEFGIKRGRKTVS

SEQ ID NO: 219763 - protein, 24 aa, Mycobacterium bovis
KTATEWVQLLQANGLMACLAHTWK

SEQ ID NO: 219764 - protein, 20 aa, Mycobacterium bovis
KTAVLTRRIAYLMAARGVGV

SEQ ID NO: 219765 - protein, 19 aa, Mycobacterium bovis
KTFFQVYWQGGRDALAERV

SEQ ID NO: 219766 - protein, 24 aa, Mycobacterium bovis
KTLDLAYMESVIWAFKQLWDKGLA

SEQ ID NO: 219767 - protein, 20 aa, Mycobacterium bovis
KTLGVPLFQEQLMQLAVDCA

SEQ ID NO: 219768 - protein, 23 aa, Mycobacterium bovis
KTLREAVLYLTGMNQRELYGASY

SEQ ID NO: 219769 - protein, 23 aa, Mycobacterium bovis
KTLTCVLPAYLNALAGNGVHIVT

SEQ ID NO: 219770 - protein, 21 aa, Mycobacterium bovis
KTMLAQRLPGLLPSLSGSESL

SEQ ID NO: 219771 - protein, 25 aa, Mycobacterium bovis
KTNVPELMIMPFTESLAFGATRNPW

SEQ ID NO: 219772 - protein, 29 aa, Mycobacterium bovis
KTRGFPLGPGYLLDGLPVILTAPRCAAAA

SEQ ID NO: 219773 - protein, 23 aa, Mycobacterium bovis
KTRQVVLALADWLRDETLPAPDT

SEQ ID NO: 219774 - protein, 25 aa, Mycobacterium bovis
KTTTTERILYYTGINYKIGEVHDGA

SEQ ID NO: 219775 - protein, 17 aa, Mycobacterium bovis
KTVFMVLRDPAADMSLT

SEQ ID NO: 219776 - protein, 24 aa, Mycobacterium bovis
KTVPPRWLPGPRELRAWTLAAGSP

SEQ ID NO: 219777 - protein, 18 aa, Mycobacterium bovis
KVADGVRMLIVPGSMRVR

SEQ ID NO: 219778 - protein, 20 aa, Mycobacterium bovis
KVARLMEWCAMVGCPIVGIN

SEQ ID NO: 219779 - protein, 25 aa, Mycobacterium bovis
KVDVLAHALAQLRPLPERLVMVGDR

SEQ ID NO: 219780 - protein, 25 aa, Mycobacterium bovis
KVESFGVRLRKGDIVLPGSCTFAVE

SEQ ID NO: 219781 - protein, 31 aa, Mycobacterium bovis
KVFIPVTRLCRDNCHYCTFVTVPGKLRAQGS

SEQ ID NO: 219782 - protein, 39 aa, Mycobacterium bovis
KVGPFALQDFSLFQVLRYGFRPSKIAFLAWHAWNDAERG

SEQ ID NO: 219783 - protein, 24 aa, Mycobacterium bovis
KVGQYVTWGLNHLVFHAPGHDQRR

SEQ ID NO: 219784 - protein, 24 aa, Mycobacterium bovis
KVGRIARVLGPRGLMPNPKTGTVT

SEQ ID NO: 219785 - protein, 26 aa, Mycobacterium bovis
KVHLYGGYHVLRAAWPHFREQSYGRV

SEQ ID NO: 219786 - protein, 20 aa, Mycobacterium bovis
KVILDDVTLSFYPGAKIGVV

SEQ ID NO: 219787 - protein, 21 aa, Mycobacterium bovis
KVIPDLITWWCERDGVHPDKS

SEQ ID NO: 219788 - protein, 24 aa, Mycobacterium bovis
KVLGYRNWLGLNKGDLAAAVDKDG

SEQ ID NO: 219789 - protein, 20 aa, Mycobacterium bovis
KVLNRADIPYLLIRNHKNRP

SEQ ID NO: 219790 - protein, 24 aa, Mycobacterium bovis
KVLRVAHWLMPGQRAFQIATQLAL

SEQ ID NO: 219791 - protein, 22 aa, Mycobacterium bovis
KVNRGFGPLLLPRIVASVFANE

SEQ ID NO: 219792 - protein, 23 aa, Mycobacterium bovis
KVNRLLLNNIDVVGVGWGAWSLT

SEQ ID NO: 219793 - protein, 22 aa, Mycobacterium bovis
KVPHRFAVVDRLPRTPNGKLVR

SEQ ID NO: 219794 - protein, 24 aa, Mycobacterium bovis
KVRPGVPVIFLDTGYHFVETIGTR

SEQ ID NO: 219795 - protein, 22 aa, Mycobacterium bovis
KVRVPDGFQLPHPPRDAREFRT

SEQ ID NO: 219796 - protein, 19 aa, Mycobacterium bovis
KVSALLEALPKVGKVKAQE

SEQ ID NO: 219797 - protein, 24 aa, Mycobacterium bovis
KVSENQLFYLMSRGLTEDEAMAMV

SEQ ID NO: 219798 - protein, 18 aa, Mycobacterium bovis
KVSLSAPAVKRRVDRMLE

SEQ ID NO: 219799 - protein, 17 aa, Mycobacterium bovis
KVTALQLVWADRRGRWP

SEQ ID NO: 219800 - protein, 25 aa, Mycobacterium bovis
KVTKRGCGAALPFKRRLFGQIVAAA

SEQ ID NO: 219801 - protein, 36 aa, Mycobacterium bovis
KVTTLPLGVPTFRMLRALRGFDPDVVHLASPALLGY

SEQ ID NO: 219802 - protein, 20 aa, Mycobacterium bovis
KVVDLLTPYVRGGKIALFGG

SEQ ID NO: 219803 - protein, 19 aa, Mycobacterium bovis
KVVQLSTGAWFDPADPRDP

SEQ ID NO: 219804 - protein, 24 aa, Mycobacterium bovis
KVVSWYDNEWGYSNRLVDLVTLVG

SEQ ID NO: 219805 - protein, 17 aa, Mycobacterium bovis
KVVWQVLNALRSHDERF

SEQ ID NO: 219806 - protein, 18 aa, Mycobacterium bovis
KVWGLYMAASRVAFERNN

SEQ ID NO: 219807 - protein, 17 aa, Mycobacterium bovis
KVYAPFESGLPGPTGRV

SEQ ID NO: 219808 - protein, 21 aa, Mycobacterium bovis
KWGQLSNVVLLLPHGHEGQGP

SEQ ID NO: 219809 - protein, 31 aa, Mycobacterium bovis
KYALRSVNMFAPWIRRIFIATDSTPPPWLAE

SEQ ID NO: 219810 - protein, 29 aa, Mycobacterium bovis
KYGGRDAPLLHWIVFEEEYFRAGAPGRAS

SEQ ID NO: 219811 - protein, 19 aa, Mycobacterium bovis
KYRDTVRDYWRGEPATLGE

SEQ ID NO: 219812 - protein, 22 aa, Mycobacterium bovis
KYYDRVDVAVIPPFTDLRSVQT

SEQ ID NO: 219813 - protein, 17 aa, Mycobacterium bovis
LAAAHAAAAPFIAAVIP

SEQ ID NO: 219814 - protein, 24 aa, Mycobacterium bovis
LAAAVAWDGLAAELGMAAASFSLL

SEQ ID NO: 219815 - protein, 24 aa, Mycobacterium bovis
LAADIPLAVDHFRYFAAAIRAQEG

SEQ ID NO: 219816 - protein, 17 aa, Mycobacterium bovis
LAAFTAIVPCGISDAAV

SEQ ID NO: 219817 - protein, 25 aa, Mycobacterium bovis
LAAGHLTLVPALRDALAQVGRPDIM

SEQ ID NO: 219818 - protein, 20 aa, Mycobacterium bovis
LAAGLDAPFSCREGHCGACA

SEQ ID NO: 219819 - protein, 38 aa, Mycobacterium bovis
LAAGLDTLLRLLHPVIPFLTEALWLALTGRESLVSADW

SEQ ID NO: 219820 - protein, 18 aa, Mycobacterium bovis
LAAGREHPLIARSSLGSA

SEQ ID NO: 219821 - protein, 32 aa, Mycobacterium bovis
LAALRKVMPRLLNVGPWATLALANPSLLNNRL

SEQ ID NO: 219822 - protein, 17 aa, Mycobacterium bovis
LAALRRAVPATKGNTRR

SEQ ID NO: 219823 - protein, 17 aa, Mycobacterium bovis
LAALRRVAAGADVLTFD

SEQ ID NO: 219824 - protein, 22 aa, Mycobacterium bovis
LAAMPGNVFLPATTTRLPRDSV

SEQ ID NO: 219825 - protein, 19 aa, Mycobacterium bovis
LAAQLAVYLAPPGYGEMFS

SEQ ID NO: 219826 - protein, 19 aa, Mycobacterium bovis
LAARLLAIGHKTASRMSPE

SEQ ID NO: 219827 - protein, 18 aa, Mycobacterium bovis
LAARLRLPIDVIATVPMA

SEQ ID NO: 219828 - protein, 33 aa, Mycobacterium bovis
LAATVHPAIISANRALFVSLVVSNLLGQNAPAI

SEQ ID NO: 219829 - protein, 19 aa, Mycobacterium bovis
LAAYRALGLHDWTYERIEC

SEQ ID NO: 219830 - protein, 20 aa, Mycobacterium bovis
LADDIFLVDGEPALLDCLEF

SEQ ID NO: 219831 - protein, 26 aa, Mycobacterium bovis
LADFAHRGWIRLEGKSVLISDSERLA

SEQ ID NO: 219832 - protein, 19 aa, Mycobacterium bovis
LADFGELRWRDGVAVTVVL

SEQ ID NO: 219833 - protein, 25 aa, Mycobacterium bovis
LADGRDLLFFSLPGHVPAPVSDRRP

SEQ ID NO: 219834 - protein, 25 aa, Mycobacterium bovis
LADGRELLFFSLPGPRTSGTAAERV

SEQ ID NO: 219835 - protein, 24 aa, Mycobacterium bovis
LADHKVFGQPIMPAAGFAEIALAA

SEQ ID NO: 219836 - protein, 21 aa, Mycobacterium bovis
LADHLRRRWARNTGGLLVVTH

SEQ ID NO: 219837 - protein, 17 aa, Mycobacterium bovis
LADHPDLVAGRNAPTVL

SEQ ID NO: 219838 - protein, 21 aa, Mycobacterium bovis
LADIALRRPSLDDVFLAMTTD

SEQ ID NO: 219839 - protein, 20 aa, Mycobacterium bovis
LADLELGFAAARRFSADPQS

SEQ ID NO: 219840 - protein, 28 aa, Mycobacterium bovis
LADNQGILTYMRAIWTGSIAFGLVNVPV

SEQ ID NO: 219841 - protein, 17 aa, Mycobacterium bovis
LADRTPASFIAFDLLAL

SEQ ID NO: 219842 - protein, 28 aa, Mycobacterium bovis
LADVYWGDLDVLLLDLPPGTGDVAISVA

SEQ ID NO: 219843 - protein, 24 aa, Mycobacterium bovis
LADYLESLHRLRGLGRRTVLPGHG

SEQ ID NO: 219844 - protein, 27 aa, Mycobacterium bovis
LADYRGRRVIVYFYPAASTPGCTKQAC

SEQ ID NO: 219845 - protein, 21 aa, Mycobacterium bovis
LAEARLFPLAQFMGDVYAGAL

SEQ ID NO: 219846 - protein, 31 aa, Mycobacterium bovis
LAEETGQPPWTPWYAGRPLLVTANDYGLRVY

SEQ ID NO: 219847 - protein, 26 aa, Mycobacterium bovis
LAEFKAMFQMKFYAVALFRSRGVPPT

SEQ ID NO: 219848 - protein, 21 aa, Mycobacterium bovis
LAEFVGAAAGLLFSSGYTANL

SEQ ID NO: 219849 - protein, 17 aa, Mycobacterium bovis
LAEGLFQERLRASGADV

SEQ ID NO: 219850 - protein, 27 aa, Mycobacterium bovis
LAEIDEFGFPVAPWMFGAAGREHMKKY

SEQ ID NO: 219851 - protein, 27 aa, Mycobacterium bovis
LAELRAARRMGSKSPLLALIADCERGL

SEQ ID NO: 219852 - protein, 18 aa, Mycobacterium bovis
LAEMDFPTAPAVLDGVRA

SEQ ID NO: 219853 - protein, 32 aa, Mycobacterium bovis
LAERGYAYGPAFQGLVAIWRRGSELFAEVVAP

SEQ ID NO: 219854 - protein, 21 aa, Mycobacterium bovis
LAERNGVPVRALWASSGQAPS

SEQ ID NO: 219855 - protein, 32 aa, Mycobacterium bovis
LAERVNGRIPLPVDWRWPWGEALAVLENTATD

SEQ ID NO: 219856 - protein, 25 aa, Mycobacterium bovis
LAEVILQSPLDISRPLWTATLVEGM

SEQ ID NO: 219857 - protein, 21 aa, Mycobacterium bovis
LAFAGLLGTPIGHPAAIALAD

SEQ ID NO: 219858 - protein, 17 aa, Mycobacterium bovis
LAFYAASPERLSGRQIP

SEQ ID NO: 219859 - protein, 35 aa, Mycobacterium bovis
LAGAFLRAGAINRILAYVAPILLGGPVTAVDDVGV

SEQ ID NO: 219860 - protein, 18 aa, Mycobacterium bovis
LAGELTWRVPPLSLTNDA

SEQ ID NO: 219861 - protein, 27 aa, Mycobacterium bovis
LAGFAVGYTLPLFPAVGADVSGGIGPI

SEQ ID NO: 219862 - protein, 18 aa, Mycobacterium bovis
LAGGCFWGLQDLIRNQPG

SEQ ID NO: 219863 - protein, 19 aa, Mycobacterium bovis
LAGISLAWGLWEQPGGMTA

SEQ ID NO: 219864 - protein, 26 aa, Mycobacterium bovis
LAGKSVWFQRGPLDAAIRASIAIPGV

SEQ ID NO: 219865 - protein, 29 aa, Mycobacterium bovis
LAGLCGALRRYHEALGVPISTLPMAVPVN

SEQ ID NO: 219866 - protein, 23 aa, Mycobacterium bovis
LAGPLPLQIICDMMGIPKADHQR

SEQ ID NO: 219867 - protein, 22 aa, Mycobacterium bovis
LAGQAWQGPAALAMAAAAAPYA

SEQ ID NO: 219868 - protein, 26 aa, Mycobacterium bovis
LAGQRSFIALEFLLDEPASYPQTMEL

SEQ ID NO: 219869 - protein, 27 aa, Mycobacterium bovis
LAGSDPLLAVPFSYPASLPTPFGPVTM

SEQ ID NO: 219870 - protein, 17 aa, Mycobacterium bovis
LAGWLQNGPTETTFSVG

SEQ ID NO: 219871 - protein, 17 aa, Mycobacterium bovis
LAHEVLLDCDSPHVGAA

SEQ ID NO: 219872 - protein, 23 aa, Mycobacterium bovis
LAHLRSLLRRGGELRYLEHVASA

SEQ ID NO: 219873 - protein, 24 aa, Mycobacterium bovis
LAHWTRLYPEVRVDRAIAGGSACR

SEQ ID NO: 219874 - protein, 25 aa, Mycobacterium bovis
LAIDGKLLLIGFAAGAVPTLKVNRL

SEQ ID NO: 219875 - protein, 34 aa, Mycobacterium bovis
LAIDIEAAFLEYLDMFYNLGIAGRAMRRIGAVEF

SEQ ID NO: 219876 - protein, 33 aa, Mycobacterium bovis
LAIMRLRMLRRRSVRFFGTYDVLLTPTVAEATP

SEQ ID NO: 219877 - protein, 29 aa, Mycobacterium bovis
LAIPAGPADWALLGAALLGVGGSGAAVVN

SEQ ID NO: 219878 - protein, 21 aa, Mycobacterium bovis
LAIVLLPRHHRRHSRRGRALP

SEQ ID NO: 219879 - protein, 24 aa, Mycobacterium bovis
LAKACARIMLGATIAQLRAEGLLA

SEQ ID NO: 219880 - protein, 24 aa, Mycobacterium bovis
LAKLKPAFEGLAALGGFDDVALQK

SEQ ID NO: 219881 - protein, 22 aa, Mycobacterium bovis
LALCQATRQVIANGLAIIGVTA

SEQ ID NO: 219882 - protein, 18 aa, Mycobacterium bovis
LALDNWLSSPYSHWAFQH

SEQ ID NO: 219883 - protein, 20 aa, Mycobacterium bovis
LALRQRFGGARLVWSGHWTT

SEQ ID NO: 219884 - protein, 19 aa, Mycobacterium bovis
LALSLGFRVRVAATVASPA

SEQ ID NO: 219885 - protein, 31 aa, Mycobacterium bovis
LALTKALHIHPIRRTIQHADLLVVRRGEKVV

SEQ ID NO: 219886 - protein, 21 aa, Mycobacterium bovis
LALYHTKRLASPGQRIVLYAK

SEQ ID NO: 219887 - protein, 25 aa, Mycobacterium bovis
LAMAAAAAPYAGWLTAAAAQSAGAA

SEQ ID NO: 219888 - protein, 24 aa, Mycobacterium bovis
LAMAALALTILQWNRTHDVPAADS

SEQ ID NO: 219889 - protein, 25 aa, Mycobacterium bovis
LAMDPQHRMLLELSWEALERAGIDP

SEQ ID NO: 219890 - protein, 25 aa, Mycobacterium bovis
LAMDPQQRMLLELSWEALERAGIDP

SEQ ID NO: 219891 - protein, 19 aa, Mycobacterium bovis
LAMRDYVERFRRIEALARS

SEQ ID NO: 219892 - protein, 19 aa, Mycobacterium bovis
LANAVRALAARLGIPAQVA

SEQ ID NO: 219893 - protein, 18 aa, Mycobacterium bovis
LANPSLLNNRLWSRLRRR

SEQ ID NO: 219894 - protein, 24 aa, Mycobacterium bovis
LANVGSTISAANKAAAAATTQVLA

SEQ ID NO: 219895 - protein, 17 aa, Mycobacterium bovis
LANWLRHGVITSADVRA

SEQ ID NO: 219896 - protein, 17 aa, Mycobacterium bovis
LAPECCAVVAYGALLGG

SEQ ID NO: 219897 - protein, 22 aa, Mycobacterium bovis
LAPGHWPMMVFRIGHARAPSVR

SEQ ID NO: 219898 - protein, 24 aa, Mycobacterium bovis
LAPKDLEKIIYFAAYVITSVDEEM

SEQ ID NO: 219899 - protein, 23 aa, Mycobacterium bovis
LAPRHPHLVKLVARRANVEGIGE

SEQ ID NO: 219900 - protein, 23 aa, Mycobacterium bovis
LAPSLTNVPDALVGPCWPAVFAA

SEQ ID NO: 219901 - protein, 21 aa, Mycobacterium bovis
LAQDMAAYIRMFEPHEAREDT

SEQ ID NO: 219902 - protein, 24 aa, Mycobacterium bovis
LAQKGLPVRAGWIHLPCLPSVAAL

SEQ ID NO: 219903 - protein, 25 aa, Mycobacterium bovis
LAQLSILVTLLDQGPIRMTDLAAHE

SEQ ID NO: 219904 - protein, 18 aa, Mycobacterium bovis
LAQLTIPIPTVTTPQMFT

SEQ ID NO: 219905 - protein, 48 aa, Mycobacterium bovis
LAQRRLQLQVSLPAKRWLAQRGFDPVYGARPLRRLVQQAIGDQLAKML

SEQ ID NO: 219906 - protein, 24 aa, Mycobacterium bovis
LAQRTRQVFLPVSRLKRDPHLEMH

SEQ ID NO: 219907 - protein, 18 aa, Mycobacterium bovis
LAREPRRGPRLPVQNIRA

SEQ ID NO: 219908 - protein, 17 aa, Mycobacterium bovis
LARGGVPVGWEVASALG

SEQ ID NO: 219909 - protein, 25 aa, Mycobacterium bovis
LARKMTFRALYRLERHQLLDCPILG

SEQ ID NO: 219910 - protein, 24 aa, Mycobacterium bovis
LARLEARIVLRLLLDRTSVIEAAD

SEQ ID NO: 219911 - protein, 17 aa, Mycobacterium bovis
LARLERFDRTIYLFDVE

SEQ ID NO: 219912 - protein, 24 aa, Mycobacterium bovis
LARNAAELALIPDTNHLELLNHDK

SEQ ID NO: 219913 - protein, 30 aa, Mycobacterium bovis
LARSRKMSVSKLLRPVLDEFVQRETGRILP

SEQ ID NO: 219914 - protein, 26 aa, Mycobacterium bovis
LARSRRRWYPLTACLPLAPDHTNPDT

SEQ ID NO: 219915 - protein, 26 aa, Mycobacterium bovis
LASAPRPAPFRLRVVKRHTLGYDGTA

SEQ ID NO: 219916 - protein, 18 aa, Mycobacterium bovis
LASFSRVIRLDHRGVGLS

SEQ ID NO: 219917 - protein, 28 aa, Mycobacterium bovis
LASGLGAGFLGQGGLALAASSGGFGGQV

SEQ ID NO: 219918 - protein, 37 aa, Mycobacterium bovis
LASIGNTWLADPAPFLQQYLANQFGYGQLTLTALTDA

SEQ ID NO: 219919 - protein, 19 aa, Mycobacterium bovis
LASLGTGGAYFFRQLTHDG

SEQ ID NO: 219920 - protein, 19 aa, Mycobacterium bovis
LASLGVFEEAFRRAQEAIE

SEQ ID NO: 219921 - protein, 26 aa, Mycobacterium bovis
LASLPDGALMRRAAFGLATEIGRELT

SEQ ID NO: 219922 - protein, 17 aa, Mycobacterium bovis
LASRLIDVTGWLATQPD

SEQ ID NO: 219923 - protein, 21 aa, Mycobacterium bovis
LATAYLFRCLSCGVHLAYADF

SEQ ID NO: 219924 - protein, 25 aa, Mycobacterium bovis
LATEIPLRTWLFRIADDEHVLVAVA

SEQ ID NO: 219925 - protein, 19 aa, Mycobacterium bovis
LATPGFLSGIGNFGTNLAG

SEQ ID NO: 219926 - protein, 30 aa, Mycobacterium bovis
LATQRHDFYLLDEFTYPLKWGWLDVDEVVD

SEQ ID NO: 219927 - protein, 21 aa, Mycobacterium bovis
LATQRIQMPLPAAQARLLATI

SEQ ID NO: 219928 - protein, 22 aa, Mycobacterium bovis
LAVDFRQRFKKDVVIDMLCYRR

SEQ ID NO: 219929 - protein, 26 aa, Mycobacterium bovis
LAVDLAVPMIGMLKRKAERRLIDGAL

SEQ ID NO: 219930 - protein, 19 aa, Mycobacterium bovis
LAVFITHYVGFPLGSRLNS

SEQ ID NO: 219931 - protein, 18 aa, Mycobacterium bovis
LAVTFRNGWQWATVEGRA

SEQ ID NO: 219932 - protein, 17 aa, Mycobacterium bovis
LCAPCDLFTPTYEASSR

SEQ ID NO: 219933 - protein, 20 aa, Mycobacterium bovis
LCATVQWSHALLSGPERALL

SEQ ID NO: 219934 - protein, 17 aa, Mycobacterium bovis
LCDNAIEAVWPADPLAA

SEQ ID NO: 219935 - protein, 19 aa, Mycobacterium bovis
LCERAELAAHWLSHGRWTD

SEQ ID NO: 219936 - protein, 18 aa, Mycobacterium bovis
LCPFAYQTSVWIRDVRAQ

SEQ ID NO: 219937 - protein, 19 aa, Mycobacterium bovis
LCQIPTLTAPYRAVLEYRS

SEQ ID NO: 219938 - protein, 32 aa, Mycobacterium bovis
LCSARMYFAYGLGNSVWFPLATGGSAVINSAP

SEQ ID NO: 219939 - protein, 30 aa, Mycobacterium bovis
LCSLTYPGYKPTLPGLVGSALFADGAAAVV

SEQ ID NO: 219940 - protein, 20 aa, Mycobacterium bovis
LDACDRWSVGLSGGPDSLAL

SEQ ID NO: 219941 - protein, 28 aa, Mycobacterium bovis
LDADSLGWLRDFLRLHTGGLVVISHNVD

SEQ ID NO: 219942 - protein, 34 aa, Mycobacterium bovis
LDAEWLVHLLECGLLRGWLIPPADIKAARDVIRY

SEQ ID NO: 219943 - protein, 17 aa, Mycobacterium bovis
LDAFRRVLRDGEVGHLV

SEQ ID NO: 219944 - protein, 18 aa, Mycobacterium bovis
LDAGKPFGLRPSAILPAY

SEQ ID NO: 219945 - protein, 18 aa, Mycobacterium bovis
LDAKLARQAQLRTLTRKY

SEQ ID NO: 219946 - protein, 28 aa, Mycobacterium bovis
LDALARAGFHTLKLQTFLTAGPKEARAW

SEQ ID NO: 219947 - protein, 19 aa, Mycobacterium bovis
LDALMRATPFSRDDVLLLA

SEQ ID NO: 219948 - protein, 28 aa, Mycobacterium bovis
LDAMGHPRWWFDLLTTEPLAFASLDRWP

SEQ ID NO: 219949 - protein, 24 aa, Mycobacterium bovis
LDARQWFQSFPAVAGSSLFAKLHD

SEQ ID NO: 219950 - protein, 26 aa, Mycobacterium bovis
LDASTFLGRLALIRIYNGRIRKGQQV

SEQ ID NO: 219951 - protein, 17 aa, Mycobacterium bovis
LDCGALSEWRATLIVRE

SEQ ID NO: 219952 - protein, 19 aa, Mycobacterium bovis
LDCGTPVNGPLFSNILNDV

SEQ ID NO: 219953 - protein, 22 aa, Mycobacterium bovis
LDDDGYLFLTGRRHHMIISGGV

SEQ ID NO: 219954 - protein, 24 aa, Mycobacterium bovis
LDDIPNALWDLKTQIFEGDILFLE

SEQ ID NO: 219955 - protein, 20 aa, Mycobacterium bovis
LDDLAKRLIVLVEPVEAIVD

SEQ ID NO: 219956 - protein, 29 aa, Mycobacterium bovis
LDDPHYTYKLDWLAALRDTAEGWLRDDPA

SEQ ID NO: 219957 - protein, 18 aa, Mycobacterium bovis
LDDPTVVRVLGAIEIPVV

SEQ ID NO: 219958 - protein, 25 aa, Mycobacterium bovis
LDDVARVYIIYRQRRAELRTAKALL

SEQ ID NO: 219959 - protein, 25 aa, Mycobacterium bovis
LDDVNLRRLLSLFEQLREQSQIIII

SEQ ID NO: 219960 - protein, 47 aa, Mycobacterium bovis
LDELLAPLAEPRYLIGRKILTPPARPVARRLFAVRAVVGLSLPGTVA

SEQ ID NO: 219961 - protein, 28 aa, Mycobacterium bovis
LDELRRLIPPWVTLGSRLAALPKPKRDY

SEQ ID NO: 219962 - protein, 25 aa, Mycobacterium bovis
LDEVDGYVWHAYLPNITPGQRYGFR

SEQ ID NO: 219963 - protein, 21 aa, Mycobacterium bovis
LDGAALHQYLVLRGGIRAEES

SEQ ID NO: 219964 - protein, 22 aa, Mycobacterium bovis
LDGGFGPVVLPPIPVPAVNAHL

SEQ ID NO: 219965 - protein, 29 aa, Mycobacterium bovis
LDGLAAYRRSRGLAALSVAWGLWEQASAM

SEQ ID NO: 219966 - protein, 25 aa, Mycobacterium bovis
LDGLDSLLSIVQMPAGVPVATVSIG

SEQ ID NO: 219967 - protein, 17 aa, Mycobacterium bovis
LDGLSEITIPPGTQPGS

SEQ ID NO: 219968 - protein, 24 aa, Mycobacterium bovis
LDGQRFLLTAGFFETHRPYPHERY

SEQ ID NO: 219969 - protein, 24 aa, Mycobacterium bovis
LDGRFRVPFVMRAEEKLLSYNRNQ

SEQ ID NO: 219970 - protein, 22 aa, Mycobacterium bovis
LDGYGLHIIERVPLPVRANAEN

SEQ ID NO: 219971 - protein, 21 aa, Mycobacterium bovis
LDHSLPYIFAVALQDGCWHHE

SEQ ID NO: 219972 - protein, 17 aa, Mycobacterium bovis
LDITLYRDDLMIKPPRP

SEQ ID NO: 219973 - protein, 26 aa, Mycobacterium bovis
LDIYRIGQNVAWRRWTDIAFGLTSDP

SEQ ID NO: 219974 - protein, 18 aa, Mycobacterium bovis
LDKPVKWMEDRSENLTST

SEQ ID NO: 219975 - protein, 17 aa, Mycobacterium bovis
LDLHRRRAIADAILVGT

SEQ ID NO: 219976 - protein, 25 aa, Mycobacterium bovis
LDLQGPAILRLPLTSAFFAAMARMR

SEQ ID NO: 219977 - protein, 18 aa, Mycobacterium bovis
LDLWPDFAGSDLVTGPDG

SEQ ID NO: 219978 - protein, 18 aa, Mycobacterium bovis
LDNFATRWRHGGSPLLRG

SEQ ID NO: 219979 - protein, 21 aa, Mycobacterium bovis
LDNGNWVWRYDAIRTFGDFAG

SEQ ID NO: 219980 - protein, 17 aa, Mycobacterium bovis
LDNLRRSGRISGAKAWL

SEQ ID NO: 219981 - protein, 23 aa, Mycobacterium bovis
LDNQIWQCPVVLLADVRSVGVQG

SEQ ID NO: 219982 - protein, 25 aa, Mycobacterium bovis
LDPDRPLWECWIIEGLNGNRWAILI

SEQ ID NO: 219983 - protein, 20 aa, Mycobacterium bovis
LDPVLRVELWDRFTALARRG

SEQ ID NO: 219984 - protein, 31 aa, Mycobacterium bovis
LDQALTLLDSLGNPALWSNSLHWAGVHAGIL

SEQ ID NO: 219985 - protein, 20 aa, Mycobacterium bovis
LDQAYPPRLAQSWDSVGLVC

SEQ ID NO: 219986 - protein, 26 aa, Mycobacterium bovis
LDQLMKAALPFGLWVPVLPGTRQVTV

SEQ ID NO: 219987 - protein, 24 aa, Mycobacterium bovis
LDQQRQWILHMAKLSAAMAKQAQY

SEQ ID NO: 219988 - protein, 26 aa, Mycobacterium bovis
LDQSVSLLHLQLILREGGAELTLYLH

SEQ ID NO: 219989 - protein, 20 aa, Mycobacterium bovis
LDREILGIAEAIRASGLSAG

SEQ ID NO: 219990 - protein, 17 aa, Mycobacterium bovis
LDRGLVDELGGLRTAVR

SEQ ID NO: 219991 - protein, 23 aa, Mycobacterium bovis
LDRIRELVLKPVEGSGGYGIVFG

SEQ ID NO: 219992 - protein, 25 aa, Mycobacterium bovis
LDRLEDIWSTFTKLAPKQLIVDENL

SEQ ID NO: 219993 - protein, 25 aa, Mycobacterium bovis
LDRLYVVALPMRVRFRGITTREVAL

SEQ ID NO: 219994 - protein, 20 aa, Mycobacterium bovis
LDRRLRTGPTPWSGSETLPG

SEQ ID NO: 219995 - protein, 25 aa, Mycobacterium bovis
LDRSRPLWQVDLIEGLPGGRCAVYV

SEQ ID NO: 219996 - protein, 38 aa, Mycobacterium bovis
LDRTAQRIVLTRNPRWWGARPRLDSITYLVLDDAARLP

SEQ ID NO: 219997 - protein, 17 aa, Mycobacterium bovis
LDRYLYTPMAYPTDYGF

SEQ ID NO: 219998 - protein, 24 aa, Mycobacterium bovis
LDSADRLWIPVRRSWRLNERHYGA

SEQ ID NO: 219999 - protein, 19 aa, Mycobacterium bovis
LDSGLFAVALPFVDLIDYR

SEQ ID NO: 220000 - protein, 27 aa, Mycobacterium bovis
LDSPISLAFLTFLPRFDCQDRADWLSV

SEQ ID NO: 220001 - protein, 35 aa, Mycobacterium bovis
LDSWRNYQWHQLARAFLMYVTQRWPDVLSTAAEDL

SEQ ID NO: 220002 - protein, 29 aa, Mycobacterium bovis
LDTRRLIDRAGRWLLNYRPQPLAVGAEIN

SEQ ID NO: 220003 - protein, 24 aa, Mycobacterium bovis
LDTSAIEAVFYKGAYTGAYSGFEG

SEQ ID NO: 220004 - protein, 22 aa, Mycobacterium bovis
LDVDARFYFVHSYAAQRWEGSP

SEQ ID NO: 220005 - protein, 18 aa, Mycobacterium bovis
LDVFRPGDRRAARAALGL

SEQ ID NO: 220006 - protein, 18 aa, Mycobacterium bovis
LDVFTLADRVLVLESGTI

SEQ ID NO: 220007 - protein, 20 aa, Mycobacterium bovis
LDVIALYIASIATGSIALAI

SEQ ID NO: 220008 - protein, 35 aa, Mycobacterium bovis
LDYSALYPAGRLVDAPLPAWTHARLFIDDDGQEQR

SEQ ID NO: 220009 - protein, 17 aa, Mycobacterium bovis
LEAQGLFFPGGHCRGVC

SEQ ID NO: 220010 - protein, 27 aa, Mycobacterium bovis
LEAQVPIIPMIVWGAHRIWPKDHPKNL

SEQ ID NO: 220011 - protein, 28 aa, Mycobacterium bovis
LEAVRQFLNLDVPLFVESAFHGLGGVAD

SEQ ID NO: 220012 - protein, 40 aa, Mycobacterium bovis
LEDALILLHQDKISSLPDLLPLLEKVAGTGKPLLIVAEDV

SEQ ID NO: 220013 - protein, 31 aa, Mycobacterium bovis
LEELILEHPYHEALWRQLIAAYYVSERQSDA

SEQ ID NO: 220014 - protein, 23 aa, Mycobacterium bovis
LEEQLLSHPAIFSAAAVGLPDQY

SEQ ID NO: 220015 - protein, 19 aa, Mycobacterium bovis
LEEWLAMWSGHYQLKDKLR

SEQ ID NO: 220016 - protein, 25 aa, Mycobacterium bovis
LEFRPKVIIAGWSAYPRVLDFAAFR

SEQ ID NO: 220017 - protein, 25 aa, Mycobacterium bovis
LEFYDLSHPWGHGAPAWPYFEDVQI

SEQ ID NO: 220018 - protein, 26 aa, Mycobacterium bovis
LEHGTALVPTLINLENFPGIADAAGR

SEQ ID NO: 220019 - protein, 38 aa, Mycobacterium bovis
LEHVWALMGMPCGKYLVVMLELWLPLVAAAGDLDKPFA

SEQ ID NO: 220020 - protein, 20 aa, Mycobacterium bovis
LEIPAIPINAQLFSMPIHQV

SEQ ID NO: 220021 - protein, 34 aa, Mycobacterium bovis
LELAPAHPPALPDPLPAGPTRRVPLGLIAGARSG

SEQ ID NO: 220022 - protein, 26 aa, Mycobacterium bovis
LELIKAHLPDVALLDYRMPGMDGAQV

SEQ ID NO: 220023 - protein, 23 aa, Mycobacterium bovis
LELRFDVPLYTLAEASRYLVVPR

SEQ ID NO: 220024 - protein, 23 aa, Mycobacterium bovis
LELRPRKLREAGALWERLTRAVG

SEQ ID NO: 220025 - protein, 21 aa, Mycobacterium bovis
LENRIVIAYSPLAQGLLGGKY

SEQ ID NO: 220026 - protein, 30 aa, Mycobacterium bovis
LENTATPMYVGLLLILRRPRAGLSYEALLE

SEQ ID NO: 220027 - protein, 18 aa, Mycobacterium bovis
LEPALAKQMLRHFGVLLD

SEQ ID NO: 220028 - protein, 41 aa, Mycobacterium bovis
LEQINFGFTIDIAGIPLLAGAISKAVLPPITGTGPAITVNI

SEQ ID NO: 220029 - protein, 17 aa, Mycobacterium bovis
LEQQLRCGLRRAVELAG

SEQ ID NO: 220030 - protein, 27 aa, Mycobacterium bovis
LEQRFDRELWRKLIDAGILSSAAPESL

SEQ ID NO: 220031 - protein, 19 aa, Mycobacterium bovis
LERFGMFGIRMSIAVLAAG

SEQ ID NO: 220032 - protein, 26 aa, Mycobacterium bovis
LERHDALPYDLAGRKLLVTAGGTREP

SEQ ID NO: 220033 - protein, 20 aa, Mycobacterium bovis
LERMRSAPTVFIDAAHNPAG

SEQ ID NO: 220034 - protein, 27 aa, Mycobacterium bovis
LERPRFDALGRWLLARTAEIVAGRPGI

SEQ ID NO: 220035 - protein, 17 aa, Mycobacterium bovis
LERRILLSRVPELPEHF

SEQ ID NO: 220036 - protein, 36 aa, Mycobacterium bovis
LERSLVHLGLKHYFLVDFPQEPGALRRFLDDVLGPN

SEQ ID NO: 220037 - protein, 23 aa, Mycobacterium bovis
LESALTDALASNGPSLIDCELDP

SEQ ID NO: 220038 - protein, 20 aa, Mycobacterium bovis
LESLIRPTGFYRNKAASLIG

SEQ ID NO: 220039 - protein, 35 aa, Mycobacterium bovis
LETEWPARQLVDDRWVWLPTLLAGRVFTHRLGADE

SEQ ID NO: 220040 - protein, 21 aa, Mycobacterium bovis
LETLLTRLNLPDDVPIEAKMV

SEQ ID NO: 220041 - protein, 23 aa, Mycobacterium bovis
LETNLFGPLALASAFADRIAERS

SEQ ID NO: 220042 - protein, 29 aa, Mycobacterium bovis
LEVEAWMRPMFRGLRHWRVLRLLRTVGMH

SEQ ID NO: 220043 - protein, 19 aa, Mycobacterium bovis
LEVRIRLLRDRIHQGWILT

SEQ ID NO: 220044 - protein, 22 aa, Mycobacterium bovis
LEYHAIAHMRRGPGGGLVVTTP

SEQ ID NO: 220045 - protein, 17 aa, Mycobacterium bovis
LFAFGKVMSGGMPAAAF

SEQ ID NO: 220046 - protein, 20 aa, Mycobacterium bovis
LFAGILAQVPFVDPLTTILD

SEQ ID NO: 220047 - protein, 30 aa, Mycobacterium bovis
LFAQQTFVNQLPFPTFSLGKITIPQIQTFD

SEQ ID NO: 220048 - protein, 26 aa, Mycobacterium bovis
LFASDWALQRFAGLSNLPATPQRLGA

SEQ ID NO: 220049 - protein, 18 aa, Mycobacterium bovis
LFCDLLANLHLHLEQEVD

SEQ ID NO: 220050 - protein, 22 aa, Mycobacterium bovis
LFDEWFPANKLVKLGLRLTNIS

SEQ ID NO: 220051 - protein, 17 aa, Mycobacterium bovis
LFEEGISTSRMGLDPDR

SEQ ID NO: 220052 - protein, 18 aa, Mycobacterium bovis
LFEFAIRAAIAEMDLDSA

SEQ ID NO: 220053 - protein, 19 aa, Mycobacterium bovis
LFEKITGLRMNSAYIRPGG

SEQ ID NO: 220054 - protein, 17 aa, Mycobacterium bovis
LFEPVLAGLGEGPHVQL

SEQ ID NO: 220055 - protein, 18 aa, Mycobacterium bovis
LFETGIPTRYYIDPADIA

SEQ ID NO: 220056 - protein, 22 aa, Mycobacterium bovis
LFGSGQMQLPFVLQSAEVMKAA

SEQ ID NO: 220057 - protein, 22 aa, Mycobacterium bovis
LFNDLTVYFALAVRGRLQAGET

SEQ ID NO: 220058 - protein, 20 aa, Mycobacterium bovis
LFNLRFQMATGQLNNNRRLR

SEQ ID NO: 220059 - protein, 18 aa, Mycobacterium bovis
LFTFLPEVGDLDKPKLVF

SEQ ID NO: 220060 - protein, 19 aa, Mycobacterium bovis
LFTRTGAGLAFTPGGLRLA

SEQ ID NO: 220061 - protein, 21 aa, Mycobacterium bovis
LGAAFARLMRTEDARPVVIGH

SEQ ID NO: 220062 - protein, 27 aa, Mycobacterium bovis
LGAARRRAFRVWLDARRNALVVLAPGY

SEQ ID NO: 220063 - protein, 23 aa, Mycobacterium bovis
LGADPLPFLRRFDIPPGIEHQED

SEQ ID NO: 220064 - protein, 24 aa, Mycobacterium bovis
LGALHLDLRFVNGKSWLVFGPYAG

SEQ ID NO: 220065 - protein, 20 aa, Mycobacterium bovis
LGALPMLHAAFERAGRDPAT

SEQ ID NO: 220066 - protein, 20 aa, Mycobacterium bovis
LGAMPIYRFGTEEQKQKWLP

SEQ ID NO: 220067 - protein, 24 aa, Mycobacterium bovis
LGATFRRFCRCSVSIESIANARSK

SEQ ID NO: 220068 - protein, 23 aa, Mycobacterium bovis
LGCELRHAHRLVYSEGLDLSGDP

SEQ ID NO: 220069 - protein, 18 aa, Mycobacterium bovis
LGCFGLKIPSEYGGLNMS

SEQ ID NO: 220070 - protein, 20 aa, Mycobacterium bovis
LGCRSLALVAFGTGVGGFPL

SEQ ID NO: 220071 - protein, 22 aa, Mycobacterium bovis
LGDGWVHFDAPAGMLIPDSVAT

SEQ ID NO: 220072 - protein, 25 aa, Mycobacterium bovis
LGDLRSLFAFLADRGSSLDALTLSV

SEQ ID NO: 220073 - protein, 23 aa, Mycobacterium bovis
LGDNGYIPIPDEFKSRLSTAVNA

SEQ ID NO: 220074 - protein, 22 aa, Mycobacterium bovis
LGDVLITSWVTNFAADPAPLPI

SEQ ID NO: 220075 - protein, 24 aa, Mycobacterium bovis
LGELPNKSLIVVLPVNVRPKDDEG

SEQ ID NO: 220076 - protein, 20 aa, Mycobacterium bovis
LGELPVGSLVGTSSPRRAAQ

SEQ ID NO: 220077 - protein, 28 aa, Mycobacterium bovis
LGEQPQVTELLPFGRPQLAGGPLGSVAK

SEQ ID NO: 220078 - protein, 18 aa, Mycobacterium bovis
LGETAAELSALGLGRVEH

SEQ ID NO: 220079 - protein, 24 aa, Mycobacterium bovis
LGFDVDTPWRKLPAKARKAILEGA

SEQ ID NO: 220080 - protein, 19 aa, Mycobacterium bovis
LGFETKVCWFPDSGNPGLV

SEQ ID NO: 220081 - protein, 22 aa, Mycobacterium bovis
LGFLMARFNIWGRPDLRRWLPL

SEQ ID NO: 220082 - protein, 20 aa, Mycobacterium bovis
LGFQVPGSIDAITLFPGGLT

SEQ ID NO: 220083 - protein, 25 aa, Mycobacterium bovis
LGFTQSYSYFTWRTTKWELTEFGNQ

SEQ ID NO: 220084 - protein, 19 aa, Mycobacterium bovis
LGFVAGGYLSADRLADDIA

SEQ ID NO: 220085 - protein, 23 aa, Mycobacterium bovis
LGGFSTIWLARGAGPQGRVVTLE

SEQ ID NO: 220086 - protein, 29 aa, Mycobacterium bovis
LGGGVGAFLTALFASPAKALSLNAGLGNV

SEQ ID NO: 220087 - protein, 20 aa, Mycobacterium bovis
LGGHIWADGGIRHPRDVALA

SEQ ID NO: 220088 - protein, 21 aa, Mycobacterium bovis
LGGKLPFALAERLHISRGEAS

SEQ ID NO: 220089 - protein, 20 aa, Mycobacterium bovis
LGGLALKWRWRQRVGSWKGR

SEQ ID NO: 220090 - protein, 18 aa, Mycobacterium bovis
LGGLPFSGPIGGVRVALI

SEQ ID NO: 220091 - protein, 20 aa, Mycobacterium bovis
LGGVLYLFVRGMCGAATPVT

SEQ ID NO: 220092 - protein, 28 aa, Mycobacterium bovis
LGHFALTAHLLPLLRAAQRARVVSLSSL

SEQ ID NO: 220093 - protein, 27 aa, Mycobacterium bovis
LGHFALTGLLIDRLLPVAGSRVVTISS

SEQ ID NO: 220094 - protein, 24 aa, Mycobacterium bovis
LGHRELGLLTMRLGRDRRQDLVDA

SEQ ID NO: 220095 - protein, 22 aa, Mycobacterium bovis
LGIEFPIFAFTHCRDVVVAVSK

SEQ ID NO: 220096 - protein, 25 aa, Mycobacterium bovis
LGIRQEWLPLFDQYQVDLVVCGHEH

SEQ ID NO: 220097 - protein, 22 aa, Mycobacterium bovis
LGKMGFVFNFITYGGHQIDGVA

SEQ ID NO: 220098 - protein, 17 aa, Mycobacterium bovis
LGLAHRLADAGVPIVGT

SEQ ID NO: 220099 - protein, 24 aa, Mycobacterium bovis
LGLDSVRFVLLMKQLGVNRQSELP

SEQ ID NO: 220100 - protein, 30 aa, Mycobacterium bovis
LGLIDPDAWAFVWVVDPPLFEPADEATAAG

SEQ ID NO: 220101 - protein, 20 aa, Mycobacterium bovis
LGLLTRLLKGISALGGERTS

SEQ ID NO: 220102 - protein, 29 aa, Mycobacterium bovis
LGLPEEIVARQPFPGPGLGIRIVGEVTAK

SEQ ID NO: 220103 - protein, 18 aa, Mycobacterium bovis
LGLPLAQELSAYLRSLDP

SEQ ID NO: 220104 - protein, 20 aa, Mycobacterium bovis
LGLPVVVRPSFTMGGLGSGI

SEQ ID NO: 220105 - protein, 17 aa, Mycobacterium bovis
LGLRERFIGLTDTVWRV

SEQ ID NO: 220106 - protein, 19 aa, Mycobacterium bovis
LGLTITDALFHRHPDRSEG

SEQ ID NO: 220107 - protein, 25 aa, Mycobacterium bovis
LGMAAASFSLLISGLTAGPGSAWQG

SEQ ID NO: 220108 - protein, 19 aa, Mycobacterium bovis
LGMMMRIAVRLPGEVITFV

SEQ ID NO: 220109 - protein, 18 aa, Mycobacterium bovis
LGMVFGRKRPGSGPLMIG

SEQ ID NO: 220110 - protein, 24 aa, Mycobacterium bovis
LGNSGLLNFGALQSGLANLGNTIS

SEQ ID NO: 220111 - protein, 18 aa, Mycobacterium bovis
LGPEGFARWLRESAAVGV

SEQ ID NO: 220112 - protein, 35 aa, Mycobacterium bovis
LGPIRGPQEVLPFSPRSQYLVGHLAPVKLTGAALI

SEQ ID NO: 220113 - protein, 17 aa, Mycobacterium bovis
LGPQRVVLLPDGTEDYW

SEQ ID NO: 220114 - protein, 19 aa, Mycobacterium bovis
LGPRRALTGEPLAPQLTAT

SEQ ID NO: 220115 - protein, 24 aa, Mycobacterium bovis
LGPSWVRVNSIRPGLIRTDLVVPV

SEQ ID NO: 220116 - protein, 33 aa, Mycobacterium bovis
LGPVHPGGPTLIDLLMALFGLSTNADLGGTNAD

SEQ ID NO: 220117 - protein, 28 aa, Mycobacterium bovis
LGQEGMGFIYLMQNLPQERISIAIMAAA

SEQ ID NO: 220118 - protein, 34 aa, Mycobacterium bovis
LGQGIPARPVIIGPITFLLLSKAVDGAGAPIERL

SEQ ID NO: 220119 - protein, 27 aa, Mycobacterium bovis
LGRDGVPTFLLPANPVSALVVFEVMVR

SEQ ID NO: 220120 - protein, 23 aa, Mycobacterium bovis
LGRGDEALQWFLRSAAADIDGVT

SEQ ID NO: 220121 - protein, 21 aa, Mycobacterium bovis
LGRHVWRIALPRPGNEDQLFE

SEQ ID NO: 220122 - protein, 19 aa, Mycobacterium bovis
LGRIIFMDEFYSLIERHQD

SEQ ID NO: 220123 - protein, 25 aa, Mycobacterium bovis
LGRLTTMRKAVLAVGSVCWLVGCSS

SEQ ID NO: 220124 - protein, 21 aa, Mycobacterium bovis
LGRPPRMLVLLHLDESVQRPS

SEQ ID NO: 220125 - protein, 21 aa, Mycobacterium bovis
LGRRELLPYSDLDVLLLHDGK

SEQ ID NO: 220126 - protein, 31 aa, Mycobacterium bovis
LGSAGVQLFSPAFLLAVPTALGGVGSLAIAV

SEQ ID NO: 220127 - protein, 27 aa, Mycobacterium bovis
LGSKMNRFFLRGALVARLLSQSAWKQY

SEQ ID NO: 220128 - protein, 26 aa, Mycobacterium bovis
LGTLRVTRALLPKLIDSGDGLIVTVT

SEQ ID NO: 220129 - protein, 35 aa, Mycobacterium bovis
LGTPRRHLSYKTVWYGSALVVADRWFPSSKTCHAC

SEQ ID NO: 220130 - protein, 35 aa, Mycobacterium bovis
LGTVEPWVRDYLLLRGLLGTSILWFEQDRDCGPAG

SEQ ID NO: 220131 - protein, 23 aa, Mycobacterium bovis
LGVGVFTTALREAMEAGLVDAAV

SEQ ID NO: 220132 - protein, 18 aa, Mycobacterium bovis
LGVLELHPLLNPAGYVLA

SEQ ID NO: 220133 - protein, 27 aa, Mycobacterium bovis
LGVLERAATAEALLLAKLAAIPTGRAE

SEQ ID NO: 220134 - protein, 19 aa, Mycobacterium bovis
LGVNWRVRCETGEPAAAAS

SEQ ID NO: 220135 - protein, 21 aa, Mycobacterium bovis
LGVPEVIWMRQPAEYHDAARR

SEQ ID NO: 220136 - protein, 19 aa, Mycobacterium bovis
LGVVARRVRKPVFASKPTG

SEQ ID NO: 220137 - protein, 20 aa, Mycobacterium bovis
LGYDTPTGLTCPYTTPLDVT

SEQ ID NO: 220138 - protein, 21 aa, Mycobacterium bovis
LGYLLYRVGAVLRPEVSAALS

SEQ ID NO: 220139 - protein, 25 aa, Mycobacterium bovis
LHAGRYAYHPLAVSASPIKAPITPF

SEQ ID NO: 220140 - protein, 22 aa, Mycobacterium bovis
LHAPTRLALLTGLAPHQVTDDD

SEQ ID NO: 220141 - protein, 31 aa, Mycobacterium bovis
LHDCFSANELLLYEALGLCGPGEAPELIDDN

SEQ ID NO: 220142 - protein, 23 aa, Mycobacterium bovis
LHDHVIQRLFAIGLALQGAVPHE

SEQ ID NO: 220143 - protein, 18 aa, Mycobacterium bovis
LHEEMMSELRWPGDPSLD

SEQ ID NO: 220144 - protein, 37 aa, Mycobacterium bovis
LHEMAHMWFGDLVTMTWWDDLWLNESFATFASVLCQS

SEQ ID NO: 220145 - protein, 27 aa, Mycobacterium bovis
LHEVRIMLDQYWPSVPHVLIEPGVRTG

SEQ ID NO: 220146 - protein, 19 aa, Mycobacterium bovis
LHFTALPDKLAAIETNLFV

SEQ ID NO: 220147 - protein, 20 aa, Mycobacterium bovis
LHGMLTDRDIVIKGLAAGLD

SEQ ID NO: 220148 - protein, 26 aa, Mycobacterium bovis
LHLQNGFILPSFPPFSTPDVFQNAFH

SEQ ID NO: 220149 - protein, 19 aa, Mycobacterium bovis
LHLVDFPVTLGIRPNIPQE

SEQ ID NO: 220150 - protein, 18 aa, Mycobacterium bovis
LHNDIVAPYLLALATEEQ

SEQ ID NO: 220151 - protein, 25 aa, Mycobacterium bovis
LHNMRTMRFLPPEKQARKARETLEV

SEQ ID NO: 220152 - protein, 23 aa, Mycobacterium bovis
LHNSQPWRWIAEDHTVALFLDKD

SEQ ID NO: 220153 - protein, 29 aa, Mycobacterium bovis
LHPEYRTMPMVWYIPPLSPVVDAVSRDGH

SEQ ID NO: 220154 - protein, 25 aa, Mycobacterium bovis
LHPTNLGRLVLGTPAPLPCTPRGIV

SEQ ID NO: 220155 - protein, 22 aa, Mycobacterium bovis
LHQKWFNLYDEATRVPFVIARI

SEQ ID NO: 220156 - protein, 18 aa, Mycobacterium bovis
LHRFLPGASTRRSPNCSP

SEQ ID NO: 220157 - protein, 18 aa, Mycobacterium bovis
LHRLGIQAFEPMLVEGKA

SEQ ID NO: 220158 - protein, 19 aa, Mycobacterium bovis
LHRLPLAIMRLRMLRRRSV

SEQ ID NO: 220159 - protein, 18 aa, Mycobacterium bovis
LHSRLVRAIALISSPHPA

SEQ ID NO: 220160 - protein, 17 aa, Mycobacterium bovis
LHTWNRIVFPTGAGQAA

SEQ ID NO: 220161 - protein, 20 aa, Mycobacterium bovis
LHTYGASVLSRPVAKIMSTT

SEQ ID NO: 220162 - protein, 18 aa, Mycobacterium bovis
LIAMPAMVPPYANARDDY

SEQ ID NO: 220163 - protein, 18 aa, Mycobacterium bovis
LIDELGTLTWRQLDERGN

SEQ ID NO: 220164 - protein, 18 aa, Mycobacterium bovis
LIDFRDITVRPVAFDPDA

SEQ ID NO: 220165 - protein, 20 aa, Mycobacterium bovis
LIDFVLSNLVNARYLRICVL

SEQ ID NO: 220166 - protein, 23 aa, Mycobacterium bovis
LIDGMDLVVLGLGGRRVTRARAR

SEQ ID NO: 220167 - protein, 19 aa, Mycobacterium bovis
LIDQHVHGCWLTEGNRRRF

SEQ ID NO: 220168 - protein, 17 aa, Mycobacterium bovis
LIEFCAPIGHRDADAGE

SEQ ID NO: 220169 - protein, 32 aa, Mycobacterium bovis
LIELDIHFRIEDDLYYPALSAAGKPITGTHAE

SEQ ID NO: 220170 - protein, 18 aa, Mycobacterium bovis
LIERPRGMSYLVVRGRRG

SEQ ID NO: 220171 - protein, 23 aa, Mycobacterium bovis
LIGDRLPMDKLLAGVAHVVHEMH

SEQ ID NO: 220172 - protein, 26 aa, Mycobacterium bovis
LIGGATMLRMLLYPDDMLDDAWVDQT

SEQ ID NO: 220173 - protein, 19 aa, Mycobacterium bovis
LIGLPDPDIAQLVKWGYAA

SEQ ID NO: 220174 - protein, 26 aa, Mycobacterium bovis
LIGPEWFPDSYPWVPSINPGLNFYFG

SEQ ID NO: 220175 - protein, 29 aa, Mycobacterium bovis
LIGSACRPLYYLEMPPALFAPIVENLANV

SEQ ID NO: 220176 - protein, 18 aa, Mycobacterium bovis
LIIDLSRFAVNPRVHLFF

SEQ ID NO: 220177 - protein, 27 aa, Mycobacterium bovis
LIKAILSLRHGVVPPLLHFNRLPDELS

SEQ ID NO: 220178 - protein, 25 aa, Mycobacterium bovis
LIKSIGLRLGVPWYAYDTVTFSGEV

SEQ ID NO: 220179 - protein, 18 aa, Mycobacterium bovis
LILDHDEHMRPDTTKEGL

SEQ ID NO: 220180 - protein, 19 aa, Mycobacterium bovis
LILFDIYRQAAEGTLAAVH

SEQ ID NO: 220181 - protein, 17 aa, Mycobacterium bovis
LILGPWNHTGGWRVDPL

SEQ ID NO: 220182 - protein, 19 aa, Mycobacterium bovis
LIQQTLPYVQWLTTTAEHA

SEQ ID NO: 220183 - protein, 19 aa, Mycobacterium bovis
LIQVMLAWQDNPVGQLNLG

SEQ ID NO: 220184 - protein, 18 aa, Mycobacterium bovis
LIRDVGIPGYLRATTGLA

SEQ ID NO: 220185 - protein, 17 aa, Mycobacterium bovis
LIRKSGAWFTYEGEQLG

SEQ ID NO: 220186 - protein, 25 aa, Mycobacterium bovis
LISPENKAYYFAAAFPSACGKTNLA

SEQ ID NO: 220187 - protein, 20 aa, Mycobacterium bovis
LIVERMFAQLVAIAIKRGSD

SEQ ID NO: 220188 - protein, 25 aa, Mycobacterium bovis
LIYSQQRLHPLPPQTVVGIPSSAGS

SEQ ID NO: 220189 - protein, 19 aa, Mycobacterium bovis
LIYTGAGPGPLLAAAAAWD

SEQ ID NO: 220190 - protein, 25 aa, Mycobacterium bovis
LKAATLPIYVHAPYLINLASANNRV

SEQ ID NO: 220191 - protein, 17 aa, Mycobacterium bovis
LKAEFFKTLAHPARIRI

SEQ ID NO: 220192 - protein, 20 aa, Mycobacterium bovis
LKAMGVYPGLDGAAPVIGGE

SEQ ID NO: 220193 - protein, 17 aa, Mycobacterium bovis
LKAVAVKGPYFGDRRKA

SEQ ID NO: 220194 - protein, 19 aa, Mycobacterium bovis
LKCAKGFRYYAENAEALLA

SEQ ID NO: 220195 - protein, 27 aa, Mycobacterium bovis
LKEIRSRLGFLLDVGLEYLSLSRAAAT

SEQ ID NO: 220196 - protein, 23 aa, Mycobacterium bovis
LKGHPLFAHITLLRSERSPIAAL

SEQ ID NO: 220197 - protein, 18 aa, Mycobacterium bovis
LKGTWNGTRLAAAIMRER

SEQ ID NO: 220198 - protein, 30 aa, Mycobacterium bovis
LKIGPITGLFNTPIGLTPLALSQIVIGASS

SEQ ID NO: 220199 - protein, 18 aa, Mycobacterium bovis
LKLLAKLAELVAAAIADI

SEQ ID NO: 220200 - protein, 20 aa, Mycobacterium bovis
LKNVFAIAVGMGYSLGIGEN

SEQ ID NO: 220201 - protein, 30 aa, Mycobacterium bovis
LKPITHPLRADIPIMLGAEGPKNVALAAEI

SEQ ID NO: 220202 - protein, 18 aa, Mycobacterium bovis
LKQFIAHNRMMTGGFAIS

SEQ ID NO: 220203 - protein, 32 aa, Mycobacterium bovis
LKRHGEWIVPTRLALVRRLGSIELDLVKARFA

SEQ ID NO: 220204 - protein, 17 aa, Mycobacterium bovis
LKVAVVCKSLFGKAHTV

SEQ ID NO: 220205 - protein, 24 aa, Mycobacterium bovis
LKVNRLLVRNISVVGVGWGEYLNA

SEQ ID NO: 220206 - protein, 18 aa, Mycobacterium bovis
LKVTHPAAIVWAAQMGTI

SEQ ID NO: 220207 - protein, 17 aa, Mycobacterium bovis
LLAALRPELGCVLQPLS

SEQ ID NO: 220208 - protein, 41 aa, Mycobacterium bovis
LLADCARLLLQIPAVLGLAFDGGWWVLGIRTPTAAECLRAV

SEQ ID NO: 220209 - protein, 27 aa, Mycobacterium bovis
LLAELDRVWGHLPFGAQWYSANELARH

SEQ ID NO: 220210 - protein, 19 aa, Mycobacterium bovis
LLAGHYRADRFWSQQVLDE

SEQ ID NO: 220211 - protein, 20 aa, Mycobacterium bovis
LLAHSAGYVELFYGRPRTQS

SEQ ID NO: 220212 - protein, 17 aa, Mycobacterium bovis
LLALRQLGQRPRVEPLR

SEQ ID NO: 220213 - protein, 23 aa, Mycobacterium bovis
LLARGSGLLPRMEPFVGELIGRG

SEQ ID NO: 220214 - protein, 18 aa, Mycobacterium bovis
LLATIRYVRDRTGDPNAW

SEQ ID NO: 220215 - protein, 27 aa, Mycobacterium bovis
LLAVNRIGAHILLLNTSFAGPALAEVV

SEQ ID NO: 220216 - protein, 20 aa, Mycobacterium bovis
LLCAGIIGYRSLLRTELPPG

SEQ ID NO: 220217 - protein, 17 aa, Mycobacterium bovis
LLDAEGLFDPRLKRPIP

SEQ ID NO: 220218 - protein, 20 aa, Mycobacterium bovis
LLDALLSTVPWRAERRQMYD

SEQ ID NO: 220219 - protein, 28 aa, Mycobacterium bovis
LLDDDDFAKHPFLVKGYIGPKALRENNV

SEQ ID NO: 220220 - protein, 27 aa, Mycobacterium bovis
LLDLGLRNYWGYNTFGFFAPHHQYAST

SEQ ID NO: 220221 - protein, 24 aa, Mycobacterium bovis
LLDRAPLAVLALGGEALGAATWRM

SEQ ID NO: 220222 - protein, 20 aa, Mycobacterium bovis
LLFEPLRAALADHARLDFLA

SEQ ID NO: 220223 - protein, 18 aa, Mycobacterium bovis
LLFSVFEGGLRHGLFHGD

SEQ ID NO: 220224 - protein, 17 aa, Mycobacterium bovis
LLGFIKFGDRKWHEAEL

SEQ ID NO: 220225 - protein, 17 aa, Mycobacterium bovis
LLGILGSGSSWLDKLWA

SEQ ID NO: 220226 - protein, 18 aa, Mycobacterium bovis
LLGLIREGEGVAAQVLVK

SEQ ID NO: 220227 - protein, 20 aa, Mycobacterium bovis
LLGRDGFNAPASTPLHTLQQ

SEQ ID NO: 220228 - protein, 20 aa, Mycobacterium bovis
LLIANVVHEALLQRASRKLP

SEQ ID NO: 220229 - protein, 18 aa, Mycobacterium bovis
LLIKAEAIGVNFIDTYFR

SEQ ID NO: 220230 - protein, 18 aa, Mycobacterium bovis
LLKDTYGAALRFAPPLVI

SEQ ID NO: 220231 - protein, 21 aa, Mycobacterium bovis
LLMAPTYAVPRLLARNGLSLQ

SEQ ID NO: 220232 - protein, 17 aa, Mycobacterium bovis
LLMLHPPSETTPSLPEC

SEQ ID NO: 220233 - protein, 25 aa, Mycobacterium bovis
LLMLTDIDGLYTRWPDRDSLVSEID

SEQ ID NO: 220234 - protein, 29 aa, Mycobacterium bovis
LLMSTFGPRTALWLLLAKGGGDTEVSAQA

SEQ ID NO: 220235 - protein, 26 aa, Mycobacterium bovis
LLNGPRYWLMNAIEKAPQGPPVTKTF

SEQ ID NO: 220236 - protein, 36 aa, Mycobacterium bovis
LLPGIRSILDTLPPHPAHFLWLNWGPCPPRQDMAYS

SEQ ID NO: 220237 - protein, 19 aa, Mycobacterium bovis
LLPLIRPHEHMPDSVRRLL

SEQ ID NO: 220238 - protein, 21 aa, Mycobacterium bovis
LLPQSALPNTYPYLPSANPGL

SEQ ID NO: 220239 - protein, 22 aa, Mycobacterium bovis
LLPTYHPLRNYLTKARDLLSDS

SEQ ID NO: 220240 - protein, 28 aa, Mycobacterium bovis
LLPVYDKPMIYYPLTTLMMAGIRDIQLI

SEQ ID NO: 220241 - protein, 24 aa, Mycobacterium bovis
LLQGYTGFIYGGERWAKDIHEGIA

SEQ ID NO: 220242 - protein, 17 aa, Mycobacterium bovis
LLQPATMALIADRLVPS

SEQ ID NO: 220243 - protein, 18 aa, Mycobacterium bovis
LLQPLRTLFEPIMLQSNE

SEQ ID NO: 220244 - protein, 27 aa, Mycobacterium bovis
LLREARLFRAELTIPLILLGGITNRTT

SEQ ID NO: 220245 - protein, 25 aa, Mycobacterium bovis
LLRGRVERMHRACLILTFGGGTNEV

SEQ ID NO: 220246 - protein, 20 aa, Mycobacterium bovis
LLRGSPCAIGWVAGWLSAEF

SEQ ID NO: 220247 - protein, 21 aa, Mycobacterium bovis
LLRKELAWLRRGAPARTCKPK

SEQ ID NO: 220248 - protein, 17 aa, Mycobacterium bovis
LLRLSFGRFGDEPALTA

SEQ ID NO: 220249 - protein, 18 aa, Mycobacterium bovis
LLRPVIDTVARVAARAYD

SEQ ID NO: 220250 - protein, 19 aa, Mycobacterium bovis
LLRQRRALRQTGGDPREAV

SEQ ID NO: 220251 - protein, 27 aa, Mycobacterium bovis
LLRRPDLLVSLLTYWQRHPSLSYLFAG

SEQ ID NO: 220252 - protein, 24 aa, Mycobacterium bovis
LLSLPNIPLLEYAARFITPVHPGY

SEQ ID NO: 220253 - protein, 28 aa, Mycobacterium bovis
LLSSDELIGLLARLGYRFAPTQIPGTVD

SEQ ID NO: 220254 - protein, 17 aa, Mycobacterium bovis
LLSVDRFVRRDSPLPVD

SEQ ID NO: 220255 - protein, 18 aa, Mycobacterium bovis
LLTDNLAAGRLRFTTDYD

SEQ ID NO: 220256 - protein, 20 aa, Mycobacterium bovis
LLVDMAHFAGLVAAGLHPSP

SEQ ID NO: 220257 - protein, 20 aa, Mycobacterium bovis
LLVDVIGLPWEEVHAEACRW

SEQ ID NO: 220258 - protein, 21 aa, Mycobacterium bovis
LLVESGMAPLFPLVVVVHADV

SEQ ID NO: 220259 - protein, 34 aa, Mycobacterium bovis
LLVNLDKAKAAPLWRVLVALSIRHVGPTAARALA

SEQ ID NO: 220260 - protein, 25 aa, Mycobacterium bovis
LMDSVTVLLHRLGIAYAAILTPVFD

SEQ ID NO: 220261 - protein, 18 aa, Mycobacterium bovis
LMEALRMERSQVAVLAAA

SEQ ID NO: 220262 - protein, 19 aa, Mycobacterium bovis
LMEFQSMYTALIMGEPPIG

SEQ ID NO: 220263 - protein, 31 aa, Mycobacterium bovis
LMERLRARLPAPDWMPPLTVAQQLGFGEANV

SEQ ID NO: 220264 - protein, 19 aa, Mycobacterium bovis
LMNHGRPAAILISAERYES

SEQ ID NO: 220265 - protein, 17 aa, Mycobacterium bovis
LMPAFTRAALRGYRDMI

SEQ ID NO: 220266 - protein, 26 aa, Mycobacterium bovis
LMPRFVREFPFNLMLWDLDRRMRRGR

SEQ ID NO: 220267 - protein, 17 aa, Mycobacterium bovis
LMRHTGPAMSAFNAWVL

SEQ ID NO: 220268 - protein, 21 aa, Mycobacterium bovis
LMRPILAYLADGQAKSAKDVI

SEQ ID NO: 220269 - protein, 27 aa, Mycobacterium bovis
LMRRSGMIFIRRNIGNDPLYKYVLKEY

SEQ ID NO: 220270 - protein, 20 aa, Mycobacterium bovis
LMRSCTGWPSGVWIDQPRRT

SEQ ID NO: 220271 - protein, 26 aa, Mycobacterium bovis
LNAINAPTQALLGRPLIGDGADGTAP

SEQ ID NO: 220272 - protein, 25 aa, Mycobacterium bovis
LNAQAAAFHHSFVQTLNAAGGAYSS

SEQ ID NO: 220273 - protein, 34 aa, Mycobacterium bovis
LNIGTIEDYALTEWQRILDVNLTGVFLGIRAVVK

SEQ ID NO: 220274 - protein, 28 aa, Mycobacterium bovis
LNINFFVHDPFTLEPYSRDPRNIARKAE

SEQ ID NO: 220275 - protein, 22 aa, Mycobacterium bovis
LNKPVISWAGDNGIYFTRFRPY

SEQ ID NO: 220276 - protein, 18 aa, Mycobacterium bovis
LNLEYKLEVWDSPNSAGV

SEQ ID NO: 220277 - protein, 26 aa, Mycobacterium bovis
LNLKLQPARYRQLLQHILQHVADGKL

SEQ ID NO: 220278 - protein, 17 aa, Mycobacterium bovis
LNLLVHKVDAENGVLLI

SEQ ID NO: 220279 - protein, 34 aa, Mycobacterium bovis
LNMVLIAAWGHPLPNQLYVRWAGQDEWAAVPLHP

SEQ ID NO: 220280 - protein, 17 aa, Mycobacterium bovis
LNNLQTYDKTFGLETMC

SEQ ID NO: 220281 - protein, 20 aa, Mycobacterium bovis
LNNRLWSRLRRRIEEADALL

SEQ ID NO: 220282 - protein, 19 aa, Mycobacterium bovis
LNRAPTLHRLGIQAFEPML

SEQ ID NO: 220283 - protein, 19 aa, Mycobacterium bovis
LNRVPVGVFDIGLNKAMIA

SEQ ID NO: 220284 - protein, 18 aa, Mycobacterium bovis
LNVLLSADGGIWPRQRVR

SEQ ID NO: 220285 - protein, 18 aa, Mycobacterium bovis
LPAAWAYKRFRDLDDKES

SEQ ID NO: 220286 - protein, 19 aa, Mycobacterium bovis
LPAGLALAASFNPVLARSS

SEQ ID NO: 220287 - protein, 29 aa, Mycobacterium bovis
LPAMRRAFPSWMAWSPFAPAMRQAVVSVD

SEQ ID NO: 220288 - protein, 19 aa, Mycobacterium bovis
LPAVGINWGPWADVGRAQF

SEQ ID NO: 220289 - protein, 17 aa, Mycobacterium bovis
LPAVLDAGARRIVVVRA

SEQ ID NO: 220290 - protein, 18 aa, Mycobacterium bovis
LPDAMGALLARSIVGIVE

SEQ ID NO: 220291 - protein, 26 aa, Mycobacterium bovis
LPDDLKFTLVEPLRLLFKDEVRAVGR

SEQ ID NO: 220292 - protein, 18 aa, Mycobacterium bovis
LPDRPRTYVYRRAGEPCR

SEQ ID NO: 220293 - protein, 26 aa, Mycobacterium bovis
LPDVPWTRFFGVRPVSILYRLYRPLI

SEQ ID NO: 220294 - protein, 24 aa, Mycobacterium bovis
LPEAQLDRFLLKLNVTLPARDSEI

SEQ ID NO: 220295 - protein, 21 aa, Mycobacterium bovis
LPEIWPEPTEFRPLRWDPNAA

SEQ ID NO: 220296 - protein, 22 aa, Mycobacterium bovis
LPEPTFAPVLGRIAAGGPILAE

SEQ ID NO: 220297 - protein, 34 aa, Mycobacterium bovis
LPESDFPTLIDLYLQGRLPLQRFVSERIGLEDVE

SEQ ID NO: 220298 - protein, 17 aa, Mycobacterium bovis
LPGIGKTTVCYQPKGVV

SEQ ID NO: 220299 - protein, 17 aa, Mycobacterium bovis
LPGLRLIGLDRDPTALD

SEQ ID NO: 220300 - protein, 32 aa, Mycobacterium bovis
LPGPDLVDLFPAHRPRPGYLPVLRAYDYAGDE

SEQ ID NO: 220301 - protein, 24 aa, Mycobacterium bovis
LPGVAMMVVLISRGGWCTVTVRYD

SEQ ID NO: 220302 - protein, 18 aa, Mycobacterium bovis
LPHVRATVLDALRRARVT

SEQ ID NO: 220303 - protein, 18 aa, Mycobacterium bovis
LPLAERVDWLYAKASQHA

SEQ ID NO: 220304 - protein, 18 aa, Mycobacterium bovis
LPNGLQLRQQRVPLGVVG

SEQ ID NO: 220305 - protein, 28 aa, Mycobacterium bovis
LPPPRPAVPPLMRGYLRLGARACGEPAH

SEQ ID NO: 220306 - protein, 25 aa, Mycobacterium bovis
LPPSHHYLAAYRWLDTGFSNGFGAH

SEQ ID NO: 220307 - protein, 21 aa, Mycobacterium bovis
LPPVAEPPPPAAPPVAEPPPP

SEQ ID NO: 220308 - protein, 23 aa, Mycobacterium bovis
LPQDEWAGRLRRLLVEQASVILR

SEQ ID NO: 220309 - protein, 21 aa, Mycobacterium bovis
LPQLVVHPYTLTGPIVIGSFF

SEQ ID NO: 220310 - protein, 29 aa, Mycobacterium bovis
LPREEWPDRLRRLLSKQVGLILRRTIDTD

SEQ ID NO: 220311 - protein, 21 aa, Mycobacterium bovis
LPSMVVLQPATSAVAASRAAI

SEQ ID NO: 220312 - protein, 25 aa, Mycobacterium bovis
LPSTALMDVLLRRPPRTRSGAALPR

SEQ ID NO: 220313 - protein, 32 aa, Mycobacterium bovis
LPTIRSRTHHYPFRLLPPRTMRALLARICEQE

SEQ ID NO: 220314 - protein, 25 aa, Mycobacterium bovis
LPTLADAVLPLRWTDGGMSRVRVLR

SEQ ID NO: 220315 - protein, 26 aa, Mycobacterium bovis
LPVKLCYAGPFFRYERPQAGRYRQLQ

SEQ ID NO: 220316 - protein, 31 aa, Mycobacterium bovis
LPVLTMVCAYSRWLLAMLLPSRCAEDLFAGW

SEQ ID NO: 220317 - protein, 20 aa, Mycobacterium bovis
LPVLTVRSLVTRPITAEQLR

SEQ ID NO: 220318 - protein, 19 aa, Mycobacterium bovis
LPVPARKVGRLILVDELAS

SEQ ID NO: 220319 - protein, 39 aa, Mycobacterium bovis
LPVSLTIPGFTIPGGTLIPTLPLGLALSNGIPPVDIPAI

SEQ ID NO: 220320 - protein, 18 aa, Mycobacterium bovis
LPVTFDPMQVVPASVPRW

SEQ ID NO: 220321 - protein, 22 aa, Mycobacterium bovis
LQAAAAWDGLAAELGTAASSFS

SEQ ID NO: 220322 - protein, 18 aa, Mycobacterium bovis
LQAFPQIAQYYRRRFRHV

SEQ ID NO: 220323 - protein, 28 aa, Mycobacterium bovis
LQAKANLVWTPQPALPPQLRAVTNWVGP

SEQ ID NO: 220324 - protein, 17 aa, Mycobacterium bovis
LQEVSTARRLVRERLEP

SEQ ID NO: 220325 - protein, 18 aa, Mycobacterium bovis
LQFRPEVSDGLFLRLAIT

SEQ ID NO: 220326 - protein, 24 aa, Mycobacterium bovis
LQHISSGVFLLKASVRELRECVGS

SEQ ID NO: 220327 - protein, 18 aa, Mycobacterium bovis
LQIDYPPLADFRKRVRMA

SEQ ID NO: 220328 - protein, 19 aa, Mycobacterium bovis
LQIHGAIAFTWEHDLHLYY

SEQ ID NO: 220329 - protein, 18 aa, Mycobacterium bovis
LQLITTDSAPIITRASAR

SEQ ID NO: 220330 - protein, 21 aa, Mycobacterium bovis
LQLMFVKFRYRLGYESLCREV

SEQ ID NO: 220331 - protein, 30 aa, Mycobacterium bovis
LQLPNGCQFAVALFALLRAGAIPVMCLPGH

SEQ ID NO: 220332 - protein, 24 aa, Mycobacterium bovis
LQLQRVFVLTFETEFFARHGFTEI

SEQ ID NO: 220333 - protein, 50 aa, Mycobacterium bovis
LQLVPKMLRMLRPDLTIGFFLHIPFPPVELFMQMPWRTEIIQGLLGADLV

SEQ ID NO: 220334 - protein, 18 aa, Mycobacterium bovis
LQNKTRALQVLAARLQAM

SEQ ID NO: 220335 - protein, 18 aa, Mycobacterium bovis
LQNRLLILAKEKTEQLYL

SEQ ID NO: 220336 - protein, 18 aa, Mycobacterium bovis
LQPEIPYYSATSFDPREE

SEQ ID NO: 220337 - protein, 21 aa, Mycobacterium bovis
LQPIWFGRAHLREGLSWFNSI

SEQ ID NO: 220338 - protein, 26 aa, Mycobacterium bovis
LQPQQWGGLQCDPALFFEATRRLASV

SEQ ID NO: 220339 - protein, 23 aa, Mycobacterium bovis
LQPYASFFYNTEGLPYFSIGMGN

SEQ ID NO: 220340 - protein, 17 aa, Mycobacterium bovis
LQQLGEFAVIDRLVRGR

SEQ ID NO: 220341 - protein, 30 aa, Mycobacterium bovis
LQQLSSTSLIPWYSALQQWLAENLLGLTPD

SEQ ID NO: 220342 - protein, 19 aa, Mycobacterium bovis
LQRKAEIVLQYYRGDEPLK

SEQ ID NO: 220343 - protein, 22 aa, Mycobacterium bovis
LQRPARWLQLMAREGQAFSAAP

SEQ ID NO: 220344 - protein, 18 aa, Mycobacterium bovis
LQRRVATLAGLPATVIDD

SEQ ID NO: 220345 - protein, 18 aa, Mycobacterium bovis
LQRTAPWVESLGLDHVRE

SEQ ID NO: 220346 - protein, 23 aa, Mycobacterium bovis
LQSLPAHLRPGLDELSFTLTGNP

SEQ ID NO: 220347 - protein, 17 aa, Mycobacterium bovis
LQVAMPILPQQALLYRL

SEQ ID NO: 220348 - protein, 19 aa, Mycobacterium bovis
LQVIFRPRVAVDPYAIGVP

SEQ ID NO: 220349 - protein, 18 aa, Mycobacterium bovis
LQVLAARLQAMAEEQALA

SEQ ID NO: 220350 - protein, 19 aa, Mycobacterium bovis
LRAAFTERGWLDLTHTRRE

SEQ ID NO: 220351 - protein, 18 aa, Mycobacterium bovis
LRAIVESPLPVVGAINGH

SEQ ID NO: 220352 - protein, 25 aa, Mycobacterium bovis
LRAQGRHCVAVKWGLWQAPKAGEPA

SEQ ID NO: 220353 - protein, 31 aa, Mycobacterium bovis
LRASIDPFGWYRSWEEMLTGMAPLAGLGGEN

SEQ ID NO: 220354 - protein, 31 aa, Mycobacterium bovis
LRDDRLVLSPQWPEALGPLEFPFVYRRHQLS

SEQ ID NO: 220355 - protein, 24 aa, Mycobacterium bovis
LRDLLKFEFLFSGRAQFEKDLANE

SEQ ID NO: 220356 - protein, 20 aa, Mycobacterium bovis
LRDRAFYAPVQSRYRVFIVD

SEQ ID NO: 220357 - protein, 27 aa, Mycobacterium bovis
LRDSVLDAMRDLLLTRDWSAITLSDVA

SEQ ID NO: 220358 - protein, 26 aa, Mycobacterium bovis
LRDWRQWWDWVPGACWRHPFGRDSDI

SEQ ID NO: 220359 - protein, 22 aa, Mycobacterium bovis
LRDYLLTLRRKSAHGGPFEYRS

SEQ ID NO: 220360 - protein, 27 aa, Mycobacterium bovis
LREANGDRYLPIWIGQSEAAAIALEQQ

SEQ ID NO: 220361 - protein, 20 aa, Mycobacterium bovis
LREELGDLLLQVLFHARIAE

SEQ ID NO: 220362 - protein, 28 aa, Mycobacterium bovis
LRELDEVAYLRFASVYRSFSSADDFARE

SEQ ID NO: 220363 - protein, 18 aa, Mycobacterium bovis
LRELVIMRIGWLTDCDYE

SEQ ID NO: 220364 - protein, 36 aa, Mycobacterium bovis
LREYCMGRIARFKIPRYLWIVDEFPMTVTGKVRKVE

SEQ ID NO: 220365 - protein, 26 aa, Mycobacterium bovis
LRGGPDYLMFLYKTKGPVVFGDSAVL

SEQ ID NO: 220366 - protein, 18 aa, Mycobacterium bovis
LRGLLRVISSEHPMLRTT

SEQ ID NO: 220367 - protein, 25 aa, Mycobacterium bovis
LRGQLFPLATLLTPNLDEARLLVDI

SEQ ID NO: 220368 - protein, 27 aa, Mycobacterium bovis
LRGSTRGWFMCWLARAHPELVSRYREL

SEQ ID NO: 220369 - protein, 19 aa, Mycobacterium bovis
LRGYTLPNGLQLRQQRVPL

SEQ ID NO: 220370 - protein, 21 aa, Mycobacterium bovis
LRITLPTPRPPFHEELPRITS

SEQ ID NO: 220371 - protein, 18 aa, Mycobacterium bovis
LRIVAAMRREGMGFTAGF

SEQ ID NO: 220372 - protein, 26 aa, Mycobacterium bovis
LRKRQHIAFKLWRIGRGTAAHPCRRR

SEQ ID NO: 220373 - protein, 28 aa, Mycobacterium bovis
LRKSRSEMAWAFPAVPMVARAPAAQPAQ

SEQ ID NO: 220374 - protein, 21 aa, Mycobacterium bovis
LRLFKALVDAASGYAGRQSQA

SEQ ID NO: 220375 - protein, 18 aa, Mycobacterium bovis
LRMGLPVLAVVAFAQSFG

SEQ ID NO: 220376 - protein, 26 aa, Mycobacterium bovis
LRMPKVARSLLDYRYRRLPAARRAAH

SEQ ID NO: 220377 - protein, 26 aa, Mycobacterium bovis
LRMVARPMINVFPSGRKEVFRLRLAS

SEQ ID NO: 220378 - protein, 18 aa, Mycobacterium bovis
LRNLGRCGRVVVVGGTPE

SEQ ID NO: 220379 - protein, 32 aa, Mycobacterium bovis
LRNLPHAQVRFVWLRGRRATSHWLTLPALKAF

SEQ ID NO: 220380 - protein, 18 aa, Mycobacterium bovis
LRNRDQWDLLQRDPSLLP

SEQ ID NO: 220381 - protein, 17 aa, Mycobacterium bovis
LRPAPLRNPRFVVDVNL

SEQ ID NO: 220382 - protein, 22 aa, Mycobacterium bovis
LRPCTRFGQRLRLRPFDLGAPK

SEQ ID NO: 220383 - protein, 21 aa, Mycobacterium bovis
LRPGERHWMAFRQLASDVDAN

SEQ ID NO: 220384 - protein, 18 aa, Mycobacterium bovis
LRPIQKVLRSPLGPVAAR

SEQ ID NO: 220385 - protein, 24 aa, Mycobacterium bovis
LRPSDLARAIAFVAETPRGCVVVN

SEQ ID NO: 220386 - protein, 19 aa, Mycobacterium bovis
LRPYQPGHIPFIEPTERLG

SEQ ID NO: 220387 - protein, 27 aa, Mycobacterium bovis
LRPYQQRGLAWLAFLSSLGLGSCLADD

SEQ ID NO: 220388 - protein, 25 aa, Mycobacterium bovis
LRQGEPAVSFLLISSGSAEVSHVGD

SEQ ID NO: 220389 - protein, 18 aa, Mycobacterium bovis
LRQKDPAVTARRRLRMIC

SEQ ID NO: 220390 - protein, 17 aa, Mycobacterium bovis
LRQVGIKIWVDGSPWVG

SEQ ID NO: 220391 - protein, 20 aa, Mycobacterium bovis
LRRILDTVARQEPGLSWAAG

SEQ ID NO: 220392 - protein, 18 aa, Mycobacterium bovis
LRRQRVWTPVLMLTARGA

SEQ ID NO: 220393 - protein, 19 aa, Mycobacterium bovis
LRRRTLITAAQYLALGIDP

SEQ ID NO: 220394 - protein, 19 aa, Mycobacterium bovis
LRRRWSPDGKPIVGFVGRL

SEQ ID NO: 220395 - protein, 22 aa, Mycobacterium bovis
LRRVRSRLARLAGIGLGCGDPA

SEQ ID NO: 220396 - protein, 24 aa, Mycobacterium bovis
LRRWRAVVRSAARQSRRARIPPVD

SEQ ID NO: 220397 - protein, 21 aa, Mycobacterium bovis
LRRWVPPHLDGYKPLFEAVQE

SEQ ID NO: 220398 - protein, 19 aa, Mycobacterium bovis
LRRWWPRRYRRSSVYWRLM

SEQ ID NO: 220399 - protein, 18 aa, Mycobacterium bovis
LRSDVRLDFKPVVQTRYE

SEQ ID NO: 220400 - protein, 24 aa, Mycobacterium bovis
LRSKPGDWYVVHSYAGYENKVKAN

SEQ ID NO: 220401 - protein, 25 aa, Mycobacterium bovis
LRSSRRHSLRYSAYTGGPDPLAPPV

SEQ ID NO: 220402 - protein, 19 aa, Mycobacterium bovis
LRTRLFAAPGWLVSPGVRT

SEQ ID NO: 220403 - protein, 18 aa, Mycobacterium bovis
LRVFGKVVELAFLAVPDE

SEQ ID NO: 220404 - protein, 32 aa, Mycobacterium bovis
LRVHGWPNQQFALLFVDWLAANPGAREDYLTV

SEQ ID NO: 220405 - protein, 19 aa, Mycobacterium bovis
LRVHPTGKAVLRLSVQTQG

SEQ ID NO: 220406 - protein, 20 aa, Mycobacterium bovis
LRWDSLGEFLALGAGFEDIG

SEQ ID NO: 220407 - protein, 17 aa, Mycobacterium bovis
LRYNFPGTGLTDDALRT

SEQ ID NO: 220408 - protein, 29 aa, Mycobacterium bovis
LRYTMPLGEIIFDFFDALKSRTRGYASLD

SEQ ID NO: 220409 - protein, 17 aa, Mycobacterium bovis
LSAAGLPAPKYGTATTF

SEQ ID NO: 220410 - protein, 26 aa, Mycobacterium bovis
LSAAVFNGFLPAVARMRALDPVTSEL

SEQ ID NO: 220411 - protein, 18 aa, Mycobacterium bovis
LSADRAFAAVPAALLRWG

SEQ ID NO: 220412 - protein, 23 aa, Mycobacterium bovis
LSALAARFYGDASLYPLIAAVNG

SEQ ID NO: 220413 - protein, 23 aa, Mycobacterium bovis
LSAPRVVWVMVPAGNITTAVIEE

SEQ ID NO: 220414 - protein, 27 aa, Mycobacterium bovis
LSAQAAAFHQQFVQTLAGGAGAYAAAE

SEQ ID NO: 220415 - protein, 25 aa, Mycobacterium bovis
LSAQAATFHIQFVQALTAGAGSYAA

SEQ ID NO: 220416 - protein, 30 aa, Mycobacterium bovis
LSAVCALEPYWEALRKVYAPFESGLPGPTG

SEQ ID NO: 220417 - protein, 27 aa, Mycobacterium bovis
LSDDELFFFAVLLLVAGYESTAHMIST

SEQ ID NO: 220418 - protein, 26 aa, Mycobacterium bovis
LSDQEIMAFLFLMVIAGNETTTKLLA

SEQ ID NO: 220419 - protein, 24 aa, Mycobacterium bovis
LSDSPLQVTIWTKRLRAVDFTLGY

SEQ ID NO: 220420 - protein, 24 aa, Mycobacterium bovis
LSEAEFLARREAVERVMVVRDRVR

SEQ ID NO: 220421 - protein, 19 aa, Mycobacterium bovis
LSELDTLREAATTARATLC

SEQ ID NO: 220422 - protein, 22 aa, Mycobacterium bovis
LSETVADLMRRGLAANRPTALS

SEQ ID NO: 220423 - protein, 17 aa, Mycobacterium bovis
LSFQDRTYLVTGGGSGI

SEQ ID NO: 220424 - protein, 26 aa, Mycobacterium bovis
LSGQERPFPLDLVPRVISAPEWTRLE

SEQ ID NO: 220425 - protein, 18 aa, Mycobacterium bovis
LSGRPFIGNGTNGAPGTG

SEQ ID NO: 220426 - protein, 28 aa, Mycobacterium bovis
LSGYVEILPTPFLPAGVFDLWGLEADDS

SEQ ID NO: 220427 - protein, 17 aa, Mycobacterium bovis
LSKYVFATPYIEAGDWR

SEQ ID NO: 220428 - protein, 18 aa, Mycobacterium bovis
LSLNPQRVDGIAAGLRQV

SEQ ID NO: 220429 - protein, 25 aa, Mycobacterium bovis
LSLPQPRQMAYRRLDLWLDDYLGTH

SEQ ID NO: 220430 - protein, 21 aa, Mycobacterium bovis
LSLSLDEACLLMFARRDLTAA

SEQ ID NO: 220431 - protein, 25 aa, Mycobacterium bovis
LSLSPTLIFDYPNSAALAGYMRREL

SEQ ID NO: 220432 - protein, 24 aa, Mycobacterium bovis
LSMHKPWNPHDYIPWSDGKNYYAL

SEQ ID NO: 220433 - protein, 32 aa, Mycobacterium bovis
LSNAGTIFWNGPMGVFEFPAYAAGTRGVAEAI

SEQ ID NO: 220434 - protein, 26 aa, Mycobacterium bovis
LSPERKSRRFAYPPNLYVVDGGAPQV

SEQ ID NO: 220435 - protein, 23 aa, Mycobacterium bovis
LSPIDYRQYVLPHSARVFAALGE

SEQ ID NO: 220436 - protein, 17 aa, Mycobacterium bovis
LSPIVLRIGIHTGEAQL

SEQ ID NO: 220437 - protein, 18 aa, Mycobacterium bovis
LSPPDVWTLSKLVRHHLL

SEQ ID NO: 220438 - protein, 26 aa, Mycobacterium bovis
LSRDGVFPLAAFRKIVDINLVGTFNV

SEQ ID NO: 220439 - protein, 28 aa, Mycobacterium bovis
LSRFSALTRDWFTSTFAAPTAAQASAWA

SEQ ID NO: 220440 - protein, 25 aa, Mycobacterium bovis
LSRGMLEVLPLTHIRGRSLHDSFVI

SEQ ID NO: 220441 - protein, 26 aa, Mycobacterium bovis
LSRGTWLARRLGLKRLLRSDILPISF

SEQ ID NO: 220442 - protein, 18 aa, Mycobacterium bovis
LSRRRLVRIPWDLDSYGI

SEQ ID NO: 220443 - protein, 24 aa, Mycobacterium bovis
LSRRYRVPVLSVHAPCLLISQRVW

SEQ ID NO: 220444 - protein, 20 aa, Mycobacterium bovis
LSRYLAGPLVPTIFGRDARL

SEQ ID NO: 220445 - protein, 21 aa, Mycobacterium bovis
LSRYVDAIVWRTFGQERLDAM

SEQ ID NO: 220446 - protein, 23 aa, Mycobacterium bovis
LSSRAEWLPAWEEGLRRASAAID

SEQ ID NO: 220447 - protein, 18 aa, Mycobacterium bovis
LSTARFEFRWNDQFALSL

SEQ ID NO: 220448 - protein, 20 aa, Mycobacterium bovis
LSTKFTRLTGRSPILLAGMT

SEQ ID NO: 220449 - protein, 26 aa, Mycobacterium bovis
LSTYFNEQVFPVLTPLAVDPAHPFPF

SEQ ID NO: 220450 - protein, 17 aa, Mycobacterium bovis
LSVITWPAKYGGRDAPL

SEQ ID NO: 220451 - protein, 18 aa, Mycobacterium bovis
LSVLRLADRLIPHRAWIF

SEQ ID NO: 220452 - protein, 19 aa, Mycobacterium bovis
LSVPPAWAAANQAVTPAAR

SEQ ID NO: 220453 - protein, 26 aa, Mycobacterium bovis
LSVPPSWTAAAPLASPLGSALGGTPM

SEQ ID NO: 220454 - protein, 21 aa, Mycobacterium bovis
LSVREVTGVPILFASTGEKLE

SEQ ID NO: 220455 - protein, 17 aa, Mycobacterium bovis
LSWRGLIAQSTDLDTLA

SEQ ID NO: 220456 - protein, 18 aa, Mycobacterium bovis
LTAAMRLPTGLGALSRRY

SEQ ID NO: 220457 - protein, 26 aa, Mycobacterium bovis
LTAGAVFERIWLRTTLLGAELQPFAA

SEQ ID NO: 220458 - protein, 19 aa, Mycobacterium bovis
LTALGLAAPRVSPPASLAA

SEQ ID NO: 220459 - protein, 21 aa, Mycobacterium bovis
LTALMPMVWRACEREDFVVEV

SEQ ID NO: 220460 - protein, 28 aa, Mycobacterium bovis
LTALPDAVRRRVIRGWLLAGGATGLTDR

SEQ ID NO: 220461 - protein, 18 aa, Mycobacterium bovis
LTAPVDGAVWMRVHERGV

SEQ ID NO: 220462 - protein, 17 aa, Mycobacterium bovis
LTARDFGDWALDLWPAI

SEQ ID NO: 220463 - protein, 23 aa, Mycobacterium bovis
LTARLAMPTAPFNVSGNPAICLP

SEQ ID NO: 220464 - protein, 17 aa, Mycobacterium bovis
LTAYRARSTGQRPSWAP

SEQ ID NO: 220465 - protein, 25 aa, Mycobacterium bovis
LTDERGRRFLIHTARIAYVEIGVAD

SEQ ID NO: 220466 - protein, 19 aa, Mycobacterium bovis
LTDERLRPYQPGHIPFIEP

SEQ ID NO: 220467 - protein, 17 aa, Mycobacterium bovis
LTDIPVRVYWPPVVRDN

SEQ ID NO: 220468 - protein, 19 aa, Mycobacterium bovis
LTDLAICDIGELEWLYSAR

SEQ ID NO: 220469 - protein, 28 aa, Mycobacterium bovis
LTDPEVLEWRYPVLLREFAVRQGSGGAG

SEQ ID NO: 220470 - protein, 19 aa, Mycobacterium bovis
LTEALAEYWHRRIREELKF

SEQ ID NO: 220471 - protein, 20 aa, Mycobacterium bovis
LTEFSVWVVFMMESGSRRAD

SEQ ID NO: 220472 - protein, 18 aa, Mycobacterium bovis
LTEGMRFDKGYISGYFVT

SEQ ID NO: 220473 - protein, 27 aa, Mycobacterium bovis
LTETELMAWAIPRAANRFWMLNEPERA

SEQ ID NO: 220474 - protein, 31 aa, Mycobacterium bovis
LTFEHPYREPLWTQLITAYYLSDRQSDALGA

SEQ ID NO: 220475 - protein, 18 aa, Mycobacterium bovis
LTFIDKAYEFVKETVAHG

SEQ ID NO: 220476 - protein, 19 aa, Mycobacterium bovis
LTFIHWPVLPESVAGSYPP

SEQ ID NO: 220477 - protein, 19 aa, Mycobacterium bovis
LTGATGFLGRYLVLELLRR

SEQ ID NO: 220478 - protein, 23 aa, Mycobacterium bovis
LTGGVLKPILWGPGKATAVQRFA

SEQ ID NO: 220479 - protein, 21 aa, Mycobacterium bovis
LTGLRIEDGLLKKLGAEAVAQ

SEQ ID NO: 220480 - protein, 20 aa, Mycobacterium bovis
LTGQAWQGPASAAMAAAAAP

SEQ ID NO: 220481 - protein, 29 aa, Mycobacterium bovis
LTHPHGQIYAYPYLTPRTAAMLRQARRHR

SEQ ID NO: 220482 - protein, 20 aa, Mycobacterium bovis
LTIQDLRRIAKRRTPRAAFD

SEQ ID NO: 220483 - protein, 20 aa, Mycobacterium bovis
LTLAVLPGMIERKAGGILIS

SEQ ID NO: 220484 - protein, 21 aa, Mycobacterium bovis
LTLEALAAQQVSCAGLVIGSW

SEQ ID NO: 220485 - protein, 22 aa, Mycobacterium bovis
LTLEDFLEQMLAVRKMGPIGNL

SEQ ID NO: 220486 - protein, 18 aa, Mycobacterium bovis
LTLFETTPGLEACDAVLA

SEQ ID NO: 220487 - protein, 18 aa, Mycobacterium bovis
LTLMARLAEAVRPGARLI

SEQ ID NO: 220488 - protein, 30 aa, Mycobacterium bovis
LTLNLDTTPWTLFPNGFTIPAQTPVTVGME

SEQ ID NO: 220489 - protein, 22 aa, Mycobacterium bovis
LTLPDVFPNGLANKYTFGPIGE

SEQ ID NO: 220490 - protein, 24 aa, Mycobacterium bovis
LTLPPLQIPGISVPAFSLPAITLP

SEQ ID NO: 220491 - protein, 26 aa, Mycobacterium bovis
LTMPRPNFPVVNFLDAGAAPLSVLLT

SEQ ID NO: 220492 - protein, 20 aa, Mycobacterium bovis
LTMPVRIRTANLHSAMFSVP

SEQ ID NO: 220493 - protein, 22 aa, Mycobacterium bovis
LTNDFFVNLLDMGITWEPSPAD

SEQ ID NO: 220494 - protein, 28 aa, Mycobacterium bovis
LTPDNRMTIVRLLGISYFDEGLLQFEAS

SEQ ID NO: 220495 - protein, 24 aa, Mycobacterium bovis
LTPEAFYLQYFGCRPYFAERVGGF

SEQ ID NO: 220496 - protein, 19 aa, Mycobacterium bovis
LTPEERLLRAIFGEKAREV

SEQ ID NO: 220497 - protein, 24 aa, Mycobacterium bovis
LTPQALIDLVASRSYCITSPAQVR

SEQ ID NO: 220498 - protein, 20 aa, Mycobacterium bovis
LTPQEFHVLRRAGTERPFTG

SEQ ID NO: 220499 - protein, 27 aa, Mycobacterium bovis
LTPQQRAWLNLVQPLTIVEGFALLSVP

SEQ ID NO: 220500 - protein, 18 aa, Mycobacterium bovis
LTQETFIRVFRSVQNYQP

SEQ ID NO: 220501 - protein, 27 aa, Mycobacterium bovis
LTRAKARLRWREKELVGVGLARLNPAD

SEQ ID NO: 220502 - protein, 19 aa, Mycobacterium bovis
LTREELLEALLKDAERAYA

SEQ ID NO: 220503 - protein, 20 aa, Mycobacterium bovis
LTRFHIFSHSWGGMLAQQYV

SEQ ID NO: 220504 - protein, 19 aa, Mycobacterium bovis
LTRLQNGWLSRDGVWHTDT

SEQ ID NO: 220505 - protein, 17 aa, Mycobacterium bovis
LTRQDIDDIFWLQATIA

SEQ ID NO: 220506 - protein, 20 aa, Mycobacterium bovis
LTRSGGHCWFLGGVADSVEE

SEQ ID NO: 220507 - protein, 19 aa, Mycobacterium bovis
LTSPDRMYFPKLGSHGTKR

SEQ ID NO: 220508 - protein, 24 aa, Mycobacterium bovis
LTSTRWRDPYAGTPWHKHVPAAIR

SEQ ID NO: 220509 - protein, 18 aa, Mycobacterium bovis
LTTIFRTPVRLRAAGRTD

SEQ ID NO: 220510 - protein, 29 aa, Mycobacterium bovis
LTTRVIDLIMPIGKGQRALIVSPPKAGKT

SEQ ID NO: 220511 - protein, 18 aa, Mycobacterium bovis
LTTYPNHDIATVVDWMLL

SEQ ID NO: 220512 - protein, 26 aa, Mycobacterium bovis
LTVCYDIRFPALYTELARRGAQLIAV

SEQ ID NO: 220513 - protein, 27 aa, Mycobacterium bovis
LTVHSARWRPWRSYATQHLWTTLEHPV

SEQ ID NO: 220514 - protein, 18 aa, Mycobacterium bovis
LTVLWQREARYLNEDDRT

SEQ ID NO: 220515 - protein, 21 aa, Mycobacterium bovis
LTVTPPSWRPDLRQPADLVEE

SEQ ID NO: 220516 - protein, 26 aa, Mycobacterium bovis
LTVVNPLVDATWRFMTLDTDGKIRMD

SEQ ID NO: 220517 - protein, 17 aa, Mycobacterium bovis
LVAAEGPFASVYFDDSH

SEQ ID NO: 220518 - protein, 19 aa, Mycobacterium bovis
LVAANRALVAWLAGSNVFG

SEQ ID NO: 220519 - protein, 26 aa, Mycobacterium bovis
LVADLQSWLVLITGYDAVSLQPNAGS

SEQ ID NO: 220520 - protein, 22 aa, Mycobacterium bovis
LVADRVVAWLTERYARRRAGDT

SEQ ID NO: 220521 - protein, 17 aa, Mycobacterium bovis
LVADVVNKVWFLDAVRG

SEQ ID NO: 220522 - protein, 25 aa, Mycobacterium bovis
LVAGDVRLLLPMPADWSYAEAAAIS

SEQ ID NO: 220523 - protein, 23 aa, Mycobacterium bovis
LVAHPQSWKLLRGKVTLPSHDQL

SEQ ID NO: 220524 - protein, 19 aa, Mycobacterium bovis
LVAQAWHWVDPARAIPEVA

SEQ ID NO: 220525 - protein, 31 aa, Mycobacterium bovis
LVARIAALPVNQLIMVKLALNSALLQQGVAT

SEQ ID NO: 220526 - protein, 18 aa, Mycobacterium bovis
LVARRRGISVLGDRPPMV

SEQ ID NO: 220527 - protein, 25 aa, Mycobacterium bovis
LVARTRSISLPGMPFRMPADYHNAS

SEQ ID NO: 220528 - protein, 20 aa, Mycobacterium bovis
LVATAMRIVNAIPAVVAAEP

SEQ ID NO: 220529 - protein, 22 aa, Mycobacterium bovis
LVAVPRTEESRFRGMCEARGLP

SEQ ID NO: 220530 - protein, 21 aa, Mycobacterium bovis
LVAYVGLERFLAGLRDYFRTH

SEQ ID NO: 220531 - protein, 27 aa, Mycobacterium bovis
LVDDIRINWVWNPPWGPDKITEDGREQ

SEQ ID NO: 220532 - protein, 19 aa, Mycobacterium bovis
LVDFAAGLAFALRGSFDKV

SEQ ID NO: 220533 - protein, 19 aa, Mycobacterium bovis
LVDGDIIWAPAIDGAFVLT

SEQ ID NO: 220534 - protein, 17 aa, Mycobacterium bovis
LVDLPREEWPDRLRRLL

SEQ ID NO: 220535 - protein, 27 aa, Mycobacterium bovis
LVEHFILEDWWGRWLGRWTAEEHLHAI

SEQ ID NO: 220536 - protein, 17 aa, Mycobacterium bovis
LVEHLRPPESFPGWLHD

SEQ ID NO: 220537 - protein, 19 aa, Mycobacterium bovis
LVELAFALGQLASAGIGVG

SEQ ID NO: 220538 - protein, 18 aa, Mycobacterium bovis
LVEMYREAKTRLGDPVLA

SEQ ID NO: 220539 - protein, 29 aa, Mycobacterium bovis
LVEPYTEYQPLWEPKIPLGRLGRPEELAG

SEQ ID NO: 220540 - protein, 18 aa, Mycobacterium bovis
LVEQFLTQFYGDQAALDD

SEQ ID NO: 220541 - protein, 20 aa, Mycobacterium bovis
LVEYARKYRQTIAAAAVVLE

SEQ ID NO: 220542 - protein, 17 aa, Mycobacterium bovis
LVFTRDSSIWIGPRVVI

SEQ ID NO: 220543 - protein, 23 aa, Mycobacterium bovis
LVFVADGILGGAISFGGHVWDHA

SEQ ID NO: 220544 - protein, 26 aa, Mycobacterium bovis
LVGRADLVLPMWQRLEPVWGPARDVR

SEQ ID NO: 220545 - protein, 24 aa, Mycobacterium bovis
LVGSVSMTAQWWLDAREPKKEVVA

SEQ ID NO: 220546 - protein, 23 aa, Mycobacterium bovis
LVHPGDLVILIAYATMDDARART

SEQ ID NO: 220547 - protein, 26 aa, Mycobacterium bovis
LVHRERAGLLILPGPAPMVARTIVEL

SEQ ID NO: 220548 - protein, 17 aa, Mycobacterium bovis
LVKALLFSVFEGGLRHG

SEQ ID NO: 220549 - protein, 38 aa, Mycobacterium bovis
LVKTLLEQTLALLPAALPLLAAPLAPLTLAPASAAGGF

SEQ ID NO: 220550 - protein, 19 aa, Mycobacterium bovis
LVLDFYRCAMLPASPDWKP

SEQ ID NO: 220551 - protein, 23 aa, Mycobacterium bovis
LVLDYERAMLRLSDGEDGEPQLF

SEQ ID NO: 220552 - protein, 20 aa, Mycobacterium bovis
LVLPALLAQRGIGGRDAAFA

SEQ ID NO: 220553 - protein, 18 aa, Mycobacterium bovis
LVLTAHVLAMDPASWRIV

SEQ ID NO: 220554 - protein, 17 aa, Mycobacterium bovis
LVMAAAVADFRPAQVAT

SEQ ID NO: 220555 - protein, 22 aa, Mycobacterium bovis
LVNLVIALLSTRGYITAEKIRS

SEQ ID NO: 220556 - protein, 25 aa, Mycobacterium bovis
LVNYNTMYFALARRAALRPGDTVLV

SEQ ID NO: 220557 - protein, 20 aa, Mycobacterium bovis
LVPAIELIDTRIKDWQIKIC

SEQ ID NO: 220558 - protein, 19 aa, Mycobacterium bovis
LVPDDFVGAVLGDLSSRRG

SEQ ID NO: 220559 - protein, 17 aa, Mycobacterium bovis
LVQFEITVDPQVPLPGF

SEQ ID NO: 220560 - protein, 19 aa, Mycobacterium bovis
LVQGGGFAGPLFDGFDNLY

SEQ ID NO: 220561 - protein, 17 aa, Mycobacterium bovis
LVQLLLACLARGVMAFL

SEQ ID NO: 220562 - protein, 18 aa, Mycobacterium bovis
LVQLSRARALLLGRDYVI

SEQ ID NO: 220563 - protein, 18 aa, Mycobacterium bovis
LVRATMKVSWRLYAYVSK

SEQ ID NO: 220564 - protein, 23 aa, Mycobacterium bovis
LVRGIPPGHVGVAWRGTWHGGLQ

SEQ ID NO: 220565 - protein, 18 aa, Mycobacterium bovis
LVRQLLTQQYHLLASVEQ

SEQ ID NO: 220566 - protein, 21 aa, Mycobacterium bovis
LVRRGSSFCGLLYVGLAITAR

SEQ ID NO: 220567 - protein, 40 aa, Mycobacterium bovis
LVRSLQRWRPFGLPPHRWRLAPWYWRGLQVTLEPGSAIAW

SEQ ID NO: 220568 - protein, 19 aa, Mycobacterium bovis
LVRTDELLDLWAAAYPGGL

SEQ ID NO: 220569 - protein, 27 aa, Mycobacterium bovis
LVRWQHPTRGLLAPGCFIPVAESINLA

SEQ ID NO: 220570 - protein, 38 aa, Mycobacterium bovis
LVSCMVALPTQLFRSTGIPVCLWFFAKDKAAGKQGSID

SEQ ID NO: 220571 - protein, 20 aa, Mycobacterium bovis
LVSEFVCRLLNYMDDNGFDT

SEQ ID NO: 220572 - protein, 24 aa, Mycobacterium bovis
LVSFDETFKLVKVNPLAAWTDQDV

SEQ ID NO: 220573 - protein, 17 aa, Mycobacterium bovis
LVSLRRFVQTHPVPATP

SEQ ID NO: 220574 - protein, 28 aa, Mycobacterium bovis
LVSQIVPLLGPMIQDMLFMQLRHMMETE

SEQ ID NO: 220575 - protein, 18 aa, Mycobacterium bovis
LVTAMGRARRRLLVTAVD

SEQ ID NO: 220576 - protein, 20 aa, Mycobacterium bovis
LVTGDIPMAGFPVLGGHEGA

SEQ ID NO: 220577 - protein, 18 aa, Mycobacterium bovis
LVVDYRLIPKHSIGMALD

SEQ ID NO: 220578 - protein, 26 aa, Mycobacterium bovis
LVVPGRPAVMVLPGPPRELQPIWSKA

SEQ ID NO: 220579 - protein, 19 aa, Mycobacterium bovis
LVVPVLNARFALNAANARW

SEQ ID NO: 220580 - protein, 27 aa, Mycobacterium bovis
LVVSHVTPIKMLLRLALDAGSGVLYRL

SEQ ID NO: 220581 - protein, 33 aa, Mycobacterium bovis
LVVSQPCVLFPKLNPRIPRIWNITSLPSEMALA

SEQ ID NO: 220582 - protein, 17 aa, Mycobacterium bovis
LVYKGMLTTPQLKAFYL

SEQ ID NO: 220583 - protein, 22 aa, Mycobacterium bovis
LWAPDYPVGAQVRRADPFLTVA

SEQ ID NO: 220584 - protein, 21 aa, Mycobacterium bovis
LWCRHPWPEVHGLAESVAAWL

SEQ ID NO: 220585 - protein, 25 aa, Mycobacterium bovis
LWGDRYGVVADPFGHHWSLGQPVRE

SEQ ID NO: 220586 - protein, 17 aa, Mycobacterium bovis
LWSSEMACLVGDELLQI

SEQ ID NO: 220587 - protein, 24 aa, Mycobacterium bovis
LWYCGPWTLWVMAGRGVASGAGVW

SEQ ID NO: 220588 - protein, 22 aa, Mycobacterium bovis
LYDAPEVVIPMLVPDGAHSYPD

SEQ ID NO: 220589 - protein, 28 aa, Mycobacterium bovis
LYDSSYHAELFWWTGAFETSEGIPHSSL

SEQ ID NO: 220590 - protein, 26 aa, Mycobacterium bovis
LYEIRTLFGVLFQDGALFGSMNLYDN

SEQ ID NO: 220591 - protein, 32 aa, Mycobacterium bovis
LYGGNNNWFAAYAYWYFKLYGHEKVKLLDGGR

SEQ ID NO: 220592 - protein, 18 aa, Mycobacterium bovis
LYGRVALFERMSLEAFQS

SEQ ID NO: 220593 - protein, 22 aa, Mycobacterium bovis
LYGSLKMWAHLQRQGFRWPSAT

SEQ ID NO: 220594 - protein, 19 aa, Mycobacterium bovis
LYLDTLADWPVDGLPAVDL

SEQ ID NO: 220595 - protein, 25 aa, Mycobacterium bovis
LYLRFRATGPDDFHLAYAAALASTG

SEQ ID NO: 220596 - protein, 19 aa, Mycobacterium bovis
LYQYAWTRDRLLIVTLADV

SEQ ID NO: 220597 - protein, 28 aa, Mycobacterium bovis
LYTYNDVPFYFHYLGPGAQLDGPEIMTD

SEQ ID NO: 220598 - protein, 18 aa, Mycobacterium bovis
LYVDTPAPGLPADLLIHN

SEQ ID NO: 220599 - protein, 18 aa, Mycobacterium bovis
LYYEAYPAMVHRTLMDII

SEQ ID NO: 220600 - protein, 22 aa, Mycobacterium bovis
MAAAAAPYAGWLAAAATQAEQA

SEQ ID NO: 220601 - protein, 23 aa, Mycobacterium bovis
MAAAAAPYAGWLSAAAASAESAA

SEQ ID NO: 220602 - protein, 24 aa, Mycobacterium bovis
MAAAAAPYVAWMSATAALAREAAA

SEQ ID NO: 220603 - protein, 38 aa, Mycobacterium bovis
MAADLVVLGPGSWFTSVIPHVLVPGLAAALRATSARRA

SEQ ID NO: 220604 - protein, 33 aa, Mycobacterium bovis
MAAGLQEIAGGRLILRFFPTPACARLTEQNLQG

SEQ ID NO: 220605 - protein, 26 aa, Mycobacterium bovis
MAAKRTSDLIPLCHQLALTGVDVDFT

SEQ ID NO: 220606 - protein, 17 aa, Mycobacterium bovis
MAALRRWARDRGLNPSE

SEQ ID NO: 220607 - protein, 22 aa, Mycobacterium bovis
MAAQYRIRLGGTWKKPGTSDIE

SEQ ID NO: 220608 - protein, 17 aa, Mycobacterium bovis
MAARLGLAGWPRAAEES

SEQ ID NO: 220609 - protein, 17 aa, Mycobacterium bovis
MAARLKGYRLICVMPEN

SEQ ID NO: 220610 - protein, 17 aa, Mycobacterium bovis
MACLVGDELLQIRGGRG

SEQ ID NO: 220611 - protein, 24 aa, Mycobacterium bovis
MADFHLRVQPGCDAWCLAALAAVL

SEQ ID NO: 220612 - protein, 22 aa, Mycobacterium bovis
MADGGLLLPLGVRRLRSYGSAR

SEQ ID NO: 220613 - protein, 26 aa, Mycobacterium bovis
MADLFHARVALWFIREVFEVMRATPQ

SEQ ID NO: 220614 - protein, 26 aa, Mycobacterium bovis
MADLQARVDLLRYALHGIAEQGRLEL

SEQ ID NO: 220615 - protein, 26 aa, Mycobacterium bovis
MAEEVMAPLGPILVAAAGIGPGVRVL

SEQ ID NO: 220616 - protein, 18 aa, Mycobacterium bovis
MAFGVPLTGSISAAGDHA

SEQ ID NO: 220617 - protein, 30 aa, Mycobacterium bovis
MAGTNVWWGHAEAALLRLVEERHIPVLMNG

SEQ ID NO: 220618 - protein, 22 aa, Mycobacterium bovis
MAGWYFTKWQRVLNDGLDAVMH

SEQ ID NO: 220619 - protein, 20 aa, Mycobacterium bovis
MAILRPLQRQVKDQGLWAAH

SEQ ID NO: 220620 - protein, 25 aa, Mycobacterium bovis
MAIYDTMVLAPCDIATYAMGMAASM

SEQ ID NO: 220621 - protein, 29 aa, Mycobacterium bovis
MAKQAQYVAQLHVWARREHPTYEDIVGLE

SEQ ID NO: 220622 - protein, 26 aa, Mycobacterium bovis
MALGKNLLVAIMPWEGHNYEDAIILS

SEQ ID NO: 220623 - protein, 24 aa, Mycobacterium bovis
MALSPLQQGLFSRATLVAAESGSE

SEQ ID NO: 220624 - protein, 33 aa, Mycobacterium bovis
MAMVQSLLVRSLVAWFWDQPLRAPLIRHGANLH

SEQ ID NO: 220625 - protein, 23 aa, Mycobacterium bovis
MANTWQGRFPYRNDGALGWVGTS

SEQ ID NO: 220626 - protein, 17 aa, Mycobacterium bovis
MAPALADDRLYRVGAAY

SEQ ID NO: 220627 - protein, 24 aa, Mycobacterium bovis
MAPRQWRGLRRWLGEPEDFQDPKY

SEQ ID NO: 220628 - protein, 25 aa, Mycobacterium bovis
MARAVAPYLGWLISATAQAEQAAAQ

SEQ ID NO: 220629 - protein, 20 aa, Mycobacterium bovis
MARFVETFARVLGDPALPHL

SEQ ID NO: 220630 - protein, 26 aa, Mycobacterium bovis
MASNANHYLALFDGAKPLALYHTKRL

SEQ ID NO: 220631 - protein, 19 aa, Mycobacterium bovis
MASVKWELEDLSFAILHPK

SEQ ID NO: 220632 - protein, 26 aa, Mycobacterium bovis
MAVIDGLMIQWIADPSATPRSTEVIR

SEQ ID NO: 220633 - protein, 18 aa, Mycobacterium bovis
MCGPKFCSMRITQDVREY

SEQ ID NO: 220634 - protein, 25 aa, Mycobacterium bovis
MDAHARVLVWELIDALRRDGVTVVL

SEQ ID NO: 220635 - protein, 38 aa, Mycobacterium bovis
MDDALKQLFGYLVWRDTKAAILLFIRNKDVTAVIDNAI

SEQ ID NO: 220636 - protein, 21 aa, Mycobacterium bovis
MDDWLDASRALLTRIGDHAFG

SEQ ID NO: 220637 - protein, 23 aa, Mycobacterium bovis
MDGKPFIETFVLTAALGAVTTRL

SEQ ID NO: 220638 - protein, 20 aa, Mycobacterium bovis
MDLDWRAVVGEAQFVELPTY

SEQ ID NO: 220639 - protein, 27 aa, Mycobacterium bovis
MDLPAKLAIPMRVIASVGAILCQLDAH

SEQ ID NO: 220640 - protein, 21 aa, Mycobacterium bovis
MDPQQRLLLEVSWEALERTGI

SEQ ID NO: 220641 - protein, 19 aa, Mycobacterium bovis
MDQLFRTVAGLGSKSDSAG

SEQ ID NO: 220642 - protein, 27 aa, Mycobacterium bovis
MDSAVTVFIPAFLRYDLRPVTGEWQIA

SEQ ID NO: 220643 - protein, 38 aa, Mycobacterium bovis
MDTIDGPYYLFGVLAKLAVLPSFTPMLLPDIGRTNIVP

SEQ ID NO: 220644 - protein, 22 aa, Mycobacterium bovis
MDVRFLPNPHWVDELRPLTGQH

SEQ ID NO: 220645 - protein, 19 aa, Mycobacterium bovis
MDYLKEGIGLRAMAQRDPL

SEQ ID NO: 220646 - protein, 24 aa, Mycobacterium bovis
MEAAKPFVRWLTDLCVQLSEVERQ

SEQ ID NO: 220647 - protein, 18 aa, Mycobacterium bovis
MEALGALGGLDRAALHSQ

SEQ ID NO: 220648 - protein, 23 aa, Mycobacterium bovis
MENRWLPMKRTALALHHLVCTRF

SEQ ID NO: 220649 - protein, 17 aa, Mycobacterium bovis
MEWCAMVGCPIVGINDS

SEQ ID NO: 220650 - protein, 17 aa, Mycobacterium bovis
MFAVGIDRWKPAPAPDM

SEQ ID NO: 220651 - protein, 35 aa, Mycobacterium bovis
MFDVMGFGKPMDQIPMLLQPGVLSLAWGSVVRQLA

SEQ ID NO: 220652 - protein, 17 aa, Mycobacterium bovis
MFHRGTFVGTATPRAYP

SEQ ID NO: 220653 - protein, 18 aa, Mycobacterium bovis
MFRLIRGQVAIATTPGKV

SEQ ID NO: 220654 - protein, 21 aa, Mycobacterium bovis
MFSLHVKATMMKVSHPIVFGH

SEQ ID NO: 220655 - protein, 20 aa, Mycobacterium bovis
MGAAYFHDLTAYAAPQQGIE

SEQ ID NO: 220656 - protein, 27 aa, Mycobacterium bovis
MGARKSPRLWIVTRGAAQFDAGESVTL

SEQ ID NO: 220657 - protein, 25 aa, Mycobacterium bovis
MGEVRVPAKALWRAQTQRAVENFPI

SEQ ID NO: 220658 - protein, 17 aa, Mycobacterium bovis
MGFLDAALLADRPVVVA

SEQ ID NO: 220659 - protein, 34 aa, Mycobacterium bovis
MGGGRVLMDTWYRIPAFYFACPSTVLGPYDDAPT

SEQ ID NO: 220660 - protein, 30 aa, Mycobacterium bovis
MGGSAVRLVRQIPYTLACDLLLTGRHITAA

SEQ ID NO: 220661 - protein, 18 aa, Mycobacterium bovis
MGLDIGPGSIKRFSTLLS

SEQ ID NO: 220662 - protein, 17 aa, Mycobacterium bovis
MGMLFRKHLVMFGPREV

SEQ ID NO: 220663 - protein, 20 aa, Mycobacterium bovis
MGNTVIWKPSITQTLAAYLT

SEQ ID NO: 220664 - protein, 20 aa, Mycobacterium bovis
MGPVVNLTRWMEAAGCLVFE

SEQ ID NO: 220665 - protein, 18 aa, Mycobacterium bovis
MGRHAGWIALNAGLASGA

SEQ ID NO: 220666 - protein, 24 aa, Mycobacterium bovis
MGRLAARGFAAYGTAKAALAHYTR

SEQ ID NO: 220667 - protein, 24 aa, Mycobacterium bovis
MGSEGYLLNQFLAPRTNKRTDSWG

SEQ ID NO: 220668 - protein, 23 aa, Mycobacterium bovis
MGSNAEFVVALLAASRADLVVVP

SEQ ID NO: 220669 - protein, 22 aa, Mycobacterium bovis
MGTEIFETMFGPSDFRIVGNVR

SEQ ID NO: 220670 - protein, 20 aa, Mycobacterium bovis
MGVTWMLRPSAENVTIVEHG

SEQ ID NO: 220671 - protein, 17 aa, Mycobacterium bovis
MGYSGVYSSFLKHAVRQ

SEQ ID NO: 220672 - protein, 27 aa, Mycobacterium bovis
MHEPSLMQNICFLYHLVGGGTGVWHVP

SEQ ID NO: 220673 - protein, 25 aa, Mycobacterium bovis
MIALRRLRELIDRYPLRGIKGPMGT

SEQ ID NO: 220674 - protein, 18 aa, Mycobacterium bovis
MIKLGLTGLLYRSQSTFD

SEQ ID NO: 220675 - protein, 34 aa, Mycobacterium bovis
MIQTFAKHPGYVHSFPPMPLQPKGFMTPDEISDV

SEQ ID NO: 220676 - protein, 20 aa, Mycobacterium bovis
MISTLFLTLADYPDQLTLLA

SEQ ID NO: 220677 - protein, 18 aa, Mycobacterium bovis
MIVDPRRRIEVARSLERE

SEQ ID NO: 220678 - protein, 20 aa, Mycobacterium bovis
MKLARNMLTFVSYAAAAEAQ

SEQ ID NO: 220679 - protein, 22 aa, Mycobacterium bovis
MKLFNTIWSGPETLPLPAEIEN

SEQ ID NO: 220680 - protein, 19 aa, Mycobacterium bovis
MLAAAAAWDGLAEELGTAA

SEQ ID NO: 220681 - protein, 17 aa, Mycobacterium bovis
MLAALHVLAALGEQSRP

SEQ ID NO: 220682 - protein, 22 aa, Mycobacterium bovis
MLAELFRRRVLVPPEGACPGPF

SEQ ID NO: 220683 - protein, 18 aa, Mycobacterium bovis
MLAKVRRAPALIKVESVV

SEQ ID NO: 220684 - protein, 23 aa, Mycobacterium bovis
MLARFPDLTLPTLDLTFYGATPS

SEQ ID NO: 220685 - protein, 18 aa, Mycobacterium bovis
MLAVLKAGGMIVPLDPAM

SEQ ID NO: 220686 - protein, 17 aa, Mycobacterium bovis
MLFDHVGALAATVMGMP

SEQ ID NO: 220687 - protein, 19 aa, Mycobacterium bovis
MLFRKHLVMFGPREVLLTS

SEQ ID NO: 220688 - protein, 29 aa, Mycobacterium bovis
MLPADRVLAALHGWLAPLPPEGASAIVFR

SEQ ID NO: 220689 - protein, 17 aa, Mycobacterium bovis
MLPRATFCQPNVASFGL

SEQ ID NO: 220690 - protein, 25 aa, Mycobacterium bovis
MLQAFIGRMSGVPPSVWGGLAAARF

SEQ ID NO: 220691 - protein, 18 aa, Mycobacterium bovis
MLTIVLRGEGFDTAVIGD

SEQ ID NO: 220692 - protein, 18 aa, Mycobacterium bovis
MLTLQPVTAHRIMTGAPV

SEQ ID NO: 220693 - protein, 26 aa, Mycobacterium bovis
MLVAGEDPRFIARRLMILASEDIGMA

SEQ ID NO: 220694 - protein, 26 aa, Mycobacterium bovis
MLYVQSLLDDWSFPATDPSVRARWER

SEQ ID NO: 220695 - protein, 22 aa, Mycobacterium bovis
MMPALLDFWMDADSVYLSPAPM

SEQ ID NO: 220696 - protein, 19 aa, Mycobacterium bovis
MNAMMWVRGFASDYDEWAA

SEQ ID NO: 220697 - protein, 36 aa, Mycobacterium bovis
MNDHNFFVMTTPDDPIRYPARLAPLHGWGSDGADTI

SEQ ID NO: 220698 - protein, 32 aa, Mycobacterium bovis
MNSLWELNVPRRDLRMLAARLGSDVPFALHGG

SEQ ID NO: 220699 - protein, 27 aa, Mycobacterium bovis
MNVDNPHPLLLLTHPVPNTGAVVVQGN

SEQ ID NO: 220700 - protein, 17 aa, Mycobacterium bovis
MPAVITAADRRLRQLRA

SEQ ID NO: 220701 - protein, 21 aa, Mycobacterium bovis
MPDGRNYLWVARTVELRAARY

SEQ ID NO: 220702 - protein, 24 aa, Mycobacterium bovis
MPEGTRFLVLAPVVRTRKGEFADL

SEQ ID NO: 220703 - protein, 25 aa, Mycobacterium bovis
MPGFTTISMYPRMWAASGVDYPTLL

SEQ ID NO: 220704 - protein, 39 aa, Mycobacterium bovis
MPGSVMTIPGMRLPFTSIVPFVVYYGPVELPQSTLTLPT

SEQ ID NO: 220705 - protein, 36 aa, Mycobacterium bovis
MPGVTPAMWAWWFGWHGSDTRRYKLWHPRAHLSARW

SEQ ID NO: 220706 - protein, 20 aa, Mycobacterium bovis
MPQRIWDQKLAEVPMGRAGE

SEQ ID NO: 220707 - protein, 26 aa, Mycobacterium bovis
MPSTPSNYFHLLRRHALDGIQRPLIV

SEQ ID NO: 220708 - protein, 23 aa, Mycobacterium bovis
MPYAQVHYPFENLDWFQGHYPGD

SEQ ID NO: 220709 - protein, 26 aa, Mycobacterium bovis
MQLALTELWRSYGVIPDAVIGHSMGE

SEQ ID NO: 220710 - protein, 21 aa, Mycobacterium bovis
MQMRLTFARSLINDPELLFLD

SEQ ID NO: 220711 - protein, 25 aa, Mycobacterium bovis
MQNGYLLLMQVGDGSALAALAATGC

SEQ ID NO: 220712 - protein, 23 aa, Mycobacterium bovis
MQRLAPLGPVYQAGTLSGNPVAV

SEQ ID NO: 220713 - protein, 17 aa, Mycobacterium bovis
MRALTGRSWRAGLRQRA

SEQ ID NO: 220714 - protein, 18 aa, Mycobacterium bovis
MREFVAALRAIWLAWQDG

SEQ ID NO: 220715 - protein, 24 aa, Mycobacterium bovis
MRGEFLWCQLFSEPGAGSDLASLR

SEQ ID NO: 220716 - protein, 19 aa, Mycobacterium bovis
MRIADASGIPYVGRILVNV

SEQ ID NO: 220717 - protein, 19 aa, Mycobacterium bovis
MRMMAVLPTIVAIDMRRRR

SEQ ID NO: 220718 - protein, 22 aa, Mycobacterium bovis
MRNDMLRVYPSLDPNLVHVIRN

SEQ ID NO: 220719 - protein, 26 aa, Mycobacterium bovis
MRPMNPPSGFLRRTPTRRFRDRRDAG

SEQ ID NO: 220720 - protein, 25 aa, Mycobacterium bovis
MRQAAVQLAVYRLAWAALRGCPTSS

SEQ ID NO: 220721 - protein, 22 aa, Mycobacterium bovis
MRRLRGRFYDGMRALHGAPDEV

SEQ ID NO: 220722 - protein, 19 aa, Mycobacterium bovis
MRRVGDIAALPEAIEAASR

SEQ ID NO: 220723 - protein, 27 aa, Mycobacterium bovis
MRSGERPMVWSLDERLRMVARPMINVF

SEQ ID NO: 220724 - protein, 21 aa, Mycobacterium bovis
MRVARQLGFLRVADSDLIDIA

SEQ ID NO: 220725 - protein, 25 aa, Mycobacterium bovis
MSAGVIEVAPLAYMRGRTLNDAFIV

SEQ ID NO: 220726 - protein, 26 aa, Mycobacterium bovis
MSATFKLPLGEVPGQVFIGLRTTDVL

SEQ ID NO: 220727 - protein, 24 aa, Mycobacterium bovis
MSATLGVLLRRLEPNWSITLIERL

SEQ ID NO: 220728 - protein, 35 aa, Mycobacterium bovis
MSDSLLHLFNAGGKRFRPLFTVLSAQIGPQPDAAA

SEQ ID NO: 220729 - protein, 17 aa, Mycobacterium bovis
MSDVIRLASHANHYLRI

SEQ ID NO: 220730 - protein, 23 aa, Mycobacterium bovis
MSENPACIARLPDQGRPLEVGEP

SEQ ID NO: 220731 - protein, 25 aa, Mycobacterium bovis
MSGTRITLHAALQLARRGSGVGVAA

SEQ ID NO: 220732 - protein, 25 aa, Mycobacterium bovis
MSHATEFIMLIAENHWRVAEEPVEV

SEQ ID NO: 220733 - protein, 25 aa, Mycobacterium bovis
MSLERRMLLRAYGAELILTPGADGM

SEQ ID NO: 220734 - protein, 26 aa, Mycobacterium bovis
MSPNALQHYSVFGLLPIAVGQKTGAL

SEQ ID NO: 220735 - protein, 17 aa, Mycobacterium bovis
MSQALRKMTGALNNSGT

SEQ ID NO: 220736 - protein, 18 aa, Mycobacterium bovis
MSQLPDALQALGLADGLV

SEQ ID NO: 220737 - protein, 24 aa, Mycobacterium bovis
MSQMTWRSMIRDGLTMRHGKELTW

SEQ ID NO: 220738 - protein, 25 aa, Mycobacterium bovis
MSRGAIFHHFRDKDALFFALAREDT

SEQ ID NO: 220739 - protein, 20 aa, Mycobacterium bovis
MSRRQFGQTLFEHQALRLRM

SEQ ID NO: 220740 - protein, 24 aa, Mycobacterium bovis
MSVGPWQGIAAWDVSTGEPIAPWP

SEQ ID NO: 220741 - protein, 19 aa, Mycobacterium bovis
MSVIEKYLYGYFGGSVRSE

SEQ ID NO: 220742 - protein, 25 aa, Mycobacterium bovis
MTAAPNFAYALLAKRLRRQAKPGDF

SEQ ID NO: 220743 - protein, 23 aa, Mycobacterium bovis
MTDFTFYIPLAKAAEAAGYSSMT

SEQ ID NO: 220744 - protein, 20 aa, Mycobacterium bovis
MTEAEVVAHLLELVTRRSEA

SEQ ID NO: 220745 - protein, 22 aa, Mycobacterium bovis
MTELPLLVIDVQRGGPSTGLPT

SEQ ID NO: 220746 - protein, 20 aa, Mycobacterium bovis
MTFPQWRTQLRLQHALVLLA

SEQ ID NO: 220747 - protein, 20 aa, Mycobacterium bovis
MTLGSYRWLRPSGRRTAKEI

SEQ ID NO: 220748 - protein, 23 aa, Mycobacterium bovis
MTLPLISMRFEGEDWILGSTAAI

SEQ ID NO: 220749 - protein, 18 aa, Mycobacterium bovis
MTLRWLTDRFAGKPLTDH

SEQ ID NO: 220750 - protein, 18 aa, Mycobacterium bovis
MTMFTSPDPFHANEYAER

SEQ ID NO: 220751 - protein, 29 aa, Mycobacterium bovis
MTMLSLQHRWAQTPWRRFKRRLSTELSSL

SEQ ID NO: 220752 - protein, 37 aa, Mycobacterium bovis
MTQKTRIQPLPPKRAGLLIRALYRIAKRRFGEVPEPF

SEQ ID NO: 220753 - protein, 19 aa, Mycobacterium bovis
MTRPRFGSWLRNSTRGALA

SEQ ID NO: 220754 - protein, 27 aa, Mycobacterium bovis
MTVFEHLGRLLIIDCGVLFPGHDEPGV

SEQ ID NO: 220755 - protein, 19 aa, Mycobacterium bovis
MTYAAPLFVTAEFINNNTG

SEQ ID NO: 220756 - protein, 19 aa, Mycobacterium bovis
MVAACLKWEGGYVWACKNY

SEQ ID NO: 220757 - protein, 21 aa, Mycobacterium bovis
MVAAITVGLSRGWSLIKSVRL

SEQ ID NO: 220758 - protein, 22 aa, Mycobacterium bovis
MVAPGLLSWRDIARVMSENPAC

SEQ ID NO: 220759 - protein, 29 aa, Mycobacterium bovis
MVDHGLPLTLWLARFLKFIATEIFPGGQP

SEQ ID NO: 220760 - protein, 26 aa, Mycobacterium bovis
MVELLPRFETITYRELWARAGTLATA

SEQ ID NO: 220761 - protein, 17 aa, Mycobacterium bovis
MVGFFAYDMVRRLERLP

SEQ ID NO: 220762 - protein, 18 aa, Mycobacterium bovis
MVLAMRKAGVPADVSDAA

SEQ ID NO: 220763 - protein, 24 aa, Mycobacterium bovis
MVLRPITGAIPPDGPWGIWASRRI

SEQ ID NO: 220764 - protein, 17 aa, Mycobacterium bovis
MVRYTSGYLCVPLDGAI

SEQ ID NO: 220765 - protein, 17 aa, Mycobacterium bovis
MVTNWTVAPAGPGSSVT

SEQ ID NO: 220766 - protein, 18 aa, Mycobacterium bovis
MVYRHSGYPGGLHKRTIG

SEQ ID NO: 220767 - protein, 18 aa, Mycobacterium bovis
MWAQDTMAMFGYASSSAT

SEQ ID NO: 220768 - protein, 22 aa, Mycobacterium bovis
MWDIRNRGVIPAGALPRVRAFV

SEQ ID NO: 220769 - protein, 29 aa, Mycobacterium bovis
MWFTEAHWPAFRHVDFLRALRDYSARHRR

SEQ ID NO: 220770 - protein, 25 aa, Mycobacterium bovis
MYRESQVMSFWRKSSGWFEPSGYPS

SEQ ID NO: 220771 - protein, 30 aa, Mycobacterium bovis
NAAANWRSAFLRMPYQRDALVRRGVIAETF

SEQ ID NO: 220772 - protein, 24 aa, Mycobacterium bovis
NAAGPYASWLTAAGAQAELAARQA

SEQ ID NO: 220773 - protein, 17 aa, Mycobacterium bovis
NAALHRIALTQIRMTDS

SEQ ID NO: 220774 - protein, 26 aa, Mycobacterium bovis
NADAWRPVFAGLAGLGLFGVAVPEDC

SEQ ID NO: 220775 - protein, 30 aa, Mycobacterium bovis
NADVERPHYMPLFVAPQPIPEPLADDEDVD

SEQ ID NO: 220776 - protein, 24 aa, Mycobacterium bovis
NAEVERPLAVSLPTRQCTFDKVSA

SEQ ID NO: 220777 - protein, 19 aa, Mycobacterium bovis
NAGGPRKVSPLAVQMIMPN

SEQ ID NO: 220778 - protein, 24 aa, Mycobacterium bovis
NAGKLIVVVLPDFGERYLSTPLFA

SEQ ID NO: 220779 - protein, 18 aa, Mycobacterium bovis
NAGNVNTGFWNGGSTNTG

SEQ ID NO: 220780 - protein, 21 aa, Mycobacterium bovis
NAGSRFLLDQAITSAGRHPDS

SEQ ID NO: 220781 - protein, 24 aa, Mycobacterium bovis
NAGVYAFDIAALRSALSRLSSNNA

SEQ ID NO: 220782 - protein, 20 aa, Mycobacterium bovis
NAHMYYVLLAPSADREEVLA

SEQ ID NO: 220783 - protein, 17 aa, Mycobacterium bovis
NAHRLFPTLNYAVSVAE

SEQ ID NO: 220784 - protein, 25 aa, Mycobacterium bovis
NAKTPFFLHRHDGALLFTAGLWSVW

SEQ ID NO: 220785 - protein, 29 aa, Mycobacterium bovis
NALPEWPQMLLRALMFRLAVYALHPRSTA

SEQ ID NO: 220786 - protein, 20 aa, Mycobacterium bovis
NAMLGLLCDAAFDELTRPDV

SEQ ID NO: 220787 - protein, 20 aa, Mycobacterium bovis
NANPFALLVGMLLDQQVPME

SEQ ID NO: 220788 - protein, 21 aa, Mycobacterium bovis
NAPEIRYMLDRRRALGGFVPE

SEQ ID NO: 220789 - protein, 38 aa, Mycobacterium bovis
NAPGVPMVFPLWLERLQVKYINRALKPIARYLPGTATI

SEQ ID NO: 220790 - protein, 30 aa, Mycobacterium bovis
NAPHLVHAMPQLVPLLPSMGHTKRALVRAG

SEQ ID NO: 220791 - protein, 26 aa, Mycobacterium bovis
NAPTIDAVLPMFFEFAGDSVLVAHNA

SEQ ID NO: 220792 - protein, 20 aa, Mycobacterium bovis
NAPVFLISLKPAASGWTSNL

SEQ ID NO: 220793 - protein, 22 aa, Mycobacterium bovis
NAPVLAATGRPLIGNGANGAPG

SEQ ID NO: 220794 - protein, 22 aa, Mycobacterium bovis
NARTRFVLVGRPGPPPARTGAD

SEQ ID NO: 220795 - protein, 30 aa, Mycobacterium bovis
NASLDKARRLLWPVKKKYGKKLSWADLIVF

SEQ ID NO: 220796 - protein, 39 aa, Mycobacterium bovis
NASPLQQALNVINAPTQTLLGRPLIGNGTNGAPGTGQAG

SEQ ID NO: 220797 - protein, 38 aa, Mycobacterium bovis
NASPLQVALDVINAPAQTLLGRPLIGNGADGSTPGQAG

SEQ ID NO: 220798 - protein, 19 aa, Mycobacterium bovis
NASTFGDENSIGGAGGTGG

SEQ ID NO: 220799 - protein, 22 aa, Mycobacterium bovis
NATLRYLMFSVFSVSPGALGDQ

SEQ ID NO: 220800 - protein, 27 aa, Mycobacterium bovis
NATLWPLYHDVIVKPLYHREWWDRYVD

SEQ ID NO: 220801 - protein, 20 aa, Mycobacterium bovis
NAVLHLLAIAHEANVALSLQ

SEQ ID NO: 220802 - protein, 25 aa, Mycobacterium bovis
NAVNAPTQTLLGRPLVGDGADGASG

SEQ ID NO: 220803 - protein, 23 aa, Mycobacterium bovis
NAVVLRQRLLLRGIAAEIVEITL

SEQ ID NO: 220804 - protein, 25 aa, Mycobacterium bovis
NAWDVPSALAYLAEGFTAIGTTSFG

SEQ ID NO: 220805 - protein, 24 aa, Mycobacterium bovis
NCDVLLTQLEIPVATALAAARAAQ

SEQ ID NO: 220806 - protein, 25 aa, Mycobacterium bovis
NCLGGSLMDYLIPTALEVPHLETGH

SEQ ID NO: 220807 - protein, 24 aa, Mycobacterium bovis
NCPDILDVPLMAEVLRGLGATVEL

SEQ ID NO: 220808 - protein, 17 aa, Mycobacterium bovis
NCRAAVSGGAPLGARLG

SEQ ID NO: 220809 - protein, 24 aa, Mycobacterium bovis
NDAARPWLTRLCDERTVVAVLQNG

SEQ ID NO: 220810 - protein, 24 aa, Mycobacterium bovis
NDAEKRWVLKNPSHLFALDALMAT

SEQ ID NO: 220811 - protein, 20 aa, Mycobacterium bovis
NDCPVVIDFIVGADAQVWPM

SEQ ID NO: 220812 - protein, 17 aa, Mycobacterium bovis
NDELRAPMEQATPLRRL

SEQ ID NO: 220813 - protein, 32 aa, Mycobacterium bovis
NDGLDRVKPFRPFQLNSRLLALADSDAIVLHC

SEQ ID NO: 220814 - protein, 19 aa, Mycobacterium bovis
NDITYNRLIQGLKAAGVEV

SEQ ID NO: 220815 - protein, 21 aa, Mycobacterium bovis
NDIYRCHPALWSLDTTPEGYS

SEQ ID NO: 220816 - protein, 20 aa, Mycobacterium bovis
NDLQLWRQIEFPGTNGQVSA

SEQ ID NO: 220817 - protein, 28 aa, Mycobacterium bovis
NDQRPITVPVLLLLTERFDLSAQYFSSD

SEQ ID NO: 220818 - protein, 27 aa, Mycobacterium bovis
NDQVAALFRMWLRDAVRRVATGVLDVV

SEQ ID NO: 220819 - protein, 23 aa, Mycobacterium bovis
NDSRGFFTSRVIGTFVNEALAML

SEQ ID NO: 220820 - protein, 21 aa, Mycobacterium bovis
NDTLFLSTGLRRPGDQPGKWS

SEQ ID NO: 220821 - protein, 22 aa, Mycobacterium bovis
NDTRVYYVEPAKWVAALRHAKT

SEQ ID NO: 220822 - protein, 23 aa, Mycobacterium bovis
NDWTYPKWAKQVTRVLIAIENAI

SEQ ID NO: 220823 - protein, 24 aa, Mycobacterium bovis
NDYDLSSLFLLASTAALFSPSIKE

SEQ ID NO: 220824 - protein, 29 aa, Mycobacterium bovis
NEAADLAAVWQLPVVILVENIRGALSVHL

SEQ ID NO: 220825 - protein, 24 aa, Mycobacterium bovis
NEARRLRWAAPYLAVPRVLGVGVD

SEQ ID NO: 220826 - protein, 22 aa, Mycobacterium bovis
NEELISILGGETRELAFAKTPP

SEQ ID NO: 220827 - protein, 24 aa, Mycobacterium bovis
NEGVKGAWVLARYDDGRPSQVRLD

SEQ ID NO: 220828 - protein, 27 aa, Mycobacterium bovis
NENDPRLWYYRFQTSAIGWNPGVNVLL

SEQ ID NO: 220829 - protein, 18 aa, Mycobacterium bovis
NEPALFDEVWSWSTKALK

SEQ ID NO: 220830 - protein, 25 aa, Mycobacterium bovis
NERRTNWLNNFYFGGDHGVPDSVAR

SEQ ID NO: 220831 - protein, 25 aa, Mycobacterium bovis
NETEALLRRIGLAAAKYWVCKRSTA

SEQ ID NO: 220832 - protein, 27 aa, Mycobacterium bovis
NETGTLIWNELLTDKPDLALAFYEAVV

SEQ ID NO: 220833 - protein, 32 aa, Mycobacterium bovis
NFAAKVLGLAQMIELWPLRPDVRTLLCSSVMG

SEQ ID NO: 220834 - protein, 18 aa, Mycobacterium bovis
NFDAWRFENRCELLAFRH

SEQ ID NO: 220835 - protein, 18 aa, Mycobacterium bovis
NFEYGLECILDHAGRLIE

SEQ ID NO: 220836 - protein, 20 aa, Mycobacterium bovis
NFGGGASGFWNLASATSGLS

SEQ ID NO: 220837 - protein, 17 aa, Mycobacterium bovis
NFLPAPGPVTKFHPPSG

SEQ ID NO: 220838 - protein, 28 aa, Mycobacterium bovis
NFPLGIVPLLLLDMWEHAFYLQYKNVKV

SEQ ID NO: 220839 - protein, 21 aa, Mycobacterium bovis
NFPTKKHWRAPSKLAYIDAGL

SEQ ID NO: 220840 - protein, 25 aa, Mycobacterium bovis
NFSNGILWRGNYEGLFSYSYSLDVP

SEQ ID NO: 220841 - protein, 21 aa, Mycobacterium bovis
NFTPKIRFWHVESAPRVRSLA

SEQ ID NO: 220842 - protein, 19 aa, Mycobacterium bovis
NFVAPLLYITDRNNVIVVA

SEQ ID NO: 220843 - protein, 17 aa, Mycobacterium bovis
NFWAWLIAQVKTVDPDV

SEQ ID NO: 220844 - protein, 20 aa, Mycobacterium bovis
NFYALDRLWGDCPVVPVDLS

SEQ ID NO: 220845 - protein, 31 aa, Mycobacterium bovis
NGAHGTVGAQFVPATSLPTPNGGAGGNGGTG

SEQ ID NO: 220846 - protein, 17 aa, Mycobacterium bovis
NGALWTGDYHGLVGFSF

SEQ ID NO: 220847 - protein, 24 aa, Mycobacterium bovis
NGCKTWISNARRSGLFAVLCKTDP

SEQ ID NO: 220848 - protein, 26 aa, Mycobacterium bovis
NGDCVAFFWFADAPDRVPGLSSPVAI

SEQ ID NO: 220849 - protein, 23 aa, Mycobacterium bovis
NGEIAFPARLPAPLVRSTITAID

SEQ ID NO: 220850 - protein, 29 aa, Mycobacterium bovis
NGFSPAAIKALWDTILPFADYAFNKSHAA

SEQ ID NO: 220851 - protein, 21 aa, Mycobacterium bovis
NGFWPVYRRVADPVKPRGNLV

SEQ ID NO: 220852 - protein, 30 aa, Mycobacterium bovis
NGGAGGQAALLFGRGGTGGAGGYGGDGGGG

SEQ ID NO: 220853 - protein, 29 aa, Mycobacterium bovis
NGGAGGTAGWFFGFGGNGGAGGIGVAGIN

SEQ ID NO: 220854 - protein, 27 aa, Mycobacterium bovis
NGGHGGNGGWLLGNGGNGGLGGDGDGG

SEQ ID NO: 220855 - protein, 23 aa, Mycobacterium bovis
NGGSARILLLVPSISLLSQTLRE

SEQ ID NO: 220856 - protein, 19 aa, Mycobacterium bovis
NGGTGWNGGKGDTGSGGGA

SEQ ID NO: 220857 - protein, 28 aa, Mycobacterium bovis
NGGVLERYVGLYLTFLDMSFNGATPPDS

SEQ ID NO: 220858 - protein, 23 aa, Mycobacterium bovis
NGHNPIAIIVPCHRVIGASGKLT

SEQ ID NO: 220859 - protein, 26 aa, Mycobacterium bovis
NGHRRKFLALLRDPSVKRIVVEHRDR

SEQ ID NO: 220860 - protein, 27 aa, Mycobacterium bovis
NGIDAPALWPGLPIRPVKGEVLRLRWR

SEQ ID NO: 220861 - protein, 17 aa, Mycobacterium bovis
NGINLWRVDADHVSVAC

SEQ ID NO: 220862 - protein, 24 aa, Mycobacterium bovis
NGKLLFNQAGALPPAALESLVQQL

SEQ ID NO: 220863 - protein, 29 aa, Mycobacterium bovis
NGLDGAYLLVWTTTPWTLPSNLAVAVSPD

SEQ ID NO: 220864 - protein, 26 aa, Mycobacterium bovis
NGLKELWDKLTGWVTGLFSRGWSNLE

SEQ ID NO: 220865 - protein, 26 aa, Mycobacterium bovis
NGNNRSSGSFLAAGGTGGAAGDGGQG

SEQ ID NO: 220866 - protein, 18 aa, Mycobacterium bovis
NGPAIAAHAGHRANPVAT

SEQ ID NO: 220867 - protein, 27 aa, Mycobacterium bovis
NGQKMWTSLIQYADYVWLAVRTNPESS

SEQ ID NO: 220868 - protein, 34 aa, Mycobacterium bovis
NGRAVIERAATLGPWTLVLDECHHLLATWGALVS

SEQ ID NO: 220869 - protein, 17 aa, Mycobacterium bovis
NGRIHRIWETTWPSWRN

SEQ ID NO: 220870 - protein, 21 aa, Mycobacterium bovis
NGTPLLNWLRQRGVDEVDVVG

SEQ ID NO: 220871 - protein, 31 aa, Mycobacterium bovis
NGVARVTAYRWFHAGLLPVPARKVGRLILVD

SEQ ID NO: 220872 - protein, 24 aa, Mycobacterium bovis
NHERVALVSPAPIFGCLREVREWA

SEQ ID NO: 220873 - protein, 19 aa, Mycobacterium bovis
NHLAFHVPAERFDAYRQRL

SEQ ID NO: 220874 - protein, 19 aa, Mycobacterium bovis
NHNYIGTEHILLGLIHEGE

SEQ ID NO: 220875 - protein, 25 aa, Mycobacterium bovis
NHRKRIGELWARFSAVAADNPHAWI

SEQ ID NO: 220876 - protein, 21 aa, Mycobacterium bovis
NHRQPRCLPQRIAVPVTKLKT

SEQ ID NO: 220877 - protein, 28 aa, Mycobacterium bovis
NHYQKLTGYENLRFFASLYAGATADPMQ

SEQ ID NO: 220878 - protein, 19 aa, Mycobacterium bovis
NIAARRALVGDLLTPGMQT

SEQ ID NO: 220879 - protein, 18 aa, Mycobacterium bovis
NIARRAMDLIGERCPILI

SEQ ID NO: 220880 - protein, 18 aa, Mycobacterium bovis
NIFIGECKVWSGPRTMDD

SEQ ID NO: 220881 - protein, 20 aa, Mycobacterium bovis
NIKRQWWRSVVTGRDDVVGI

SEQ ID NO: 220882 - protein, 18 aa, Mycobacterium bovis
NILALRFANQLFDPIWNA

SEQ ID NO: 220883 - protein, 19 aa, Mycobacterium bovis
NIPMVYQYRHTYGRRLWEL

SEQ ID NO: 220884 - protein, 17 aa, Mycobacterium bovis
NIVNMLHGVRDGLVRDA

SEQ ID NO: 220885 - protein, 30 aa, Mycobacterium bovis
NKASRRIKLAWFLLNAARYMPAQVFAADPR

SEQ ID NO: 220886 - protein, 20 aa, Mycobacterium bovis
NKFGRMIFIGSVSGSWGIGN

SEQ ID NO: 220887 - protein, 27 aa, Mycobacterium bovis
NKGGEVRYFIDRLAGWYVITSSDRMSR

SEQ ID NO: 220888 - protein, 25 aa, Mycobacterium bovis
NKLLGSFELTGIPPAPRGIPQIEVT

SEQ ID NO: 220889 - protein, 21 aa, Mycobacterium bovis
NKRHAYFRSISKTPHIRARGV

SEQ ID NO: 220890 - protein, 27 aa, Mycobacterium bovis
NKVPIYPGYVCAIVASLLLDKPVKWME

SEQ ID NO: 220891 - protein, 24 aa, Mycobacterium bovis
NKVPNAAALPFRYTVNGYRGCSHA

SEQ ID NO: 220892 - protein, 21 aa, Mycobacterium bovis
NKVSRILLTSGKLYYELAARK

SEQ ID NO: 220893 - protein, 17 aa, Mycobacterium bovis
NLAARLVAAAAPGQILA

SEQ ID NO: 220894 - protein, 25 aa, Mycobacterium bovis
NLAHRSEVTLLWPPSDPSGYSLIVD

SEQ ID NO: 220895 - protein, 21 aa, Mycobacterium bovis
NLAIAQELLKAAAAAKIILEI

SEQ ID NO: 220896 - protein, 17 aa, Mycobacterium bovis
NLANLPGYRVGGTIHII

SEQ ID NO: 220897 - protein, 22 aa, Mycobacterium bovis
NLDHTVLGIFRHISRPTYDDAA

SEQ ID NO: 220898 - protein, 27 aa, Mycobacterium bovis
NLDRPAYVYPIFEQALRIAYGESIENH

SEQ ID NO: 220899 - protein, 19 aa, Mycobacterium bovis
NLGKLLTKRARVIGTTLRA

SEQ ID NO: 220900 - protein, 28 aa, Mycobacterium bovis
NLGMTEFKVFWQPPPAPEIPKSSLGAGL

SEQ ID NO: 220901 - protein, 24 aa, Mycobacterium bovis
NLHGRYLLPHFLIHDIADVAADLR

SEQ ID NO: 220902 - protein, 19 aa, Mycobacterium bovis
NLHHALALAGRHLRRHAGA

SEQ ID NO: 220903 - protein, 19 aa, Mycobacterium bovis
NLIGMGVIPLQFPEGKSAS

SEQ ID NO: 220904 - protein, 17 aa, Mycobacterium bovis
NLMLWDLDRRMRRGRPL

SEQ ID NO: 220905 - protein, 26 aa, Mycobacterium bovis
NLPDMFTRLMLSLAATGIAPGSFYEL

SEQ ID NO: 220906 - protein, 24 aa, Mycobacterium bovis
NLQGFRSMLWPRVYADLRTAGVRG

SEQ ID NO: 220907 - protein, 24 aa, Mycobacterium bovis
NLRCSYCMPERGLRWLPGEQLLRP

SEQ ID NO: 220908 - protein, 22 aa, Mycobacterium bovis
NLRGAWLCTKHAAPRMIERGGG

SEQ ID NO: 220909 - protein, 19 aa, Mycobacterium bovis
NLRLVVSLAKRYTGRGMAF

SEQ ID NO: 220910 - protein, 22 aa, Mycobacterium bovis
NLRQMERVIPGSEFAFSLVYEV

SEQ ID NO: 220911 - protein, 26 aa, Mycobacterium bovis
NLTAAPIERILLRYKAINRVAVYAVP

SEQ ID NO: 220912 - protein, 23 aa, Mycobacterium bovis
NLTYPYGAYFCVVDIDPGTAVVK

SEQ ID NO: 220913 - protein, 18 aa, Mycobacterium bovis
NLVEITLPDNTPWGGKPV

SEQ ID NO: 220914 - protein, 23 aa, Mycobacterium bovis
NLVLFGRLWGLSKSAARKRAAEL

SEQ ID NO: 220915 - protein, 23 aa, Mycobacterium bovis
NLVNARYLRICVLTQYKSHSLDR

SEQ ID NO: 220916 - protein, 18 aa, Mycobacterium bovis
NMGVVPPGPGFNAALRAI

SEQ ID NO: 220917 - protein, 18 aa, Mycobacterium bovis
NMPRPLVAVAAILAPLMQ

SEQ ID NO: 220918 - protein, 17 aa, Mycobacterium bovis
NMTLLADAMGTVGGAAP

SEQ ID NO: 220919 - protein, 22 aa, Mycobacterium bovis
NMVDTFVLLTLARTGDQLQGIK

SEQ ID NO: 220920 - protein, 23 aa, Mycobacterium bovis
NMVRSLVTAYAPPDVREFVLGKL

SEQ ID NO: 220921 - protein, 27 aa, Mycobacterium bovis
NNANYAWIQHILYKLAPGGRAGVVMAN

SEQ ID NO: 220922 - protein, 22 aa, Mycobacterium bovis
NNDFKPGFSTALMNKDLGLAMD

SEQ ID NO: 220923 - protein, 29 aa, Mycobacterium bovis
NNELGHPWTVLRATRRTDYLILEMAARHH

SEQ ID NO: 220924 - protein, 17 aa, Mycobacterium bovis
NNGLVEIVPLGISKATG

SEQ ID NO: 220925 - protein, 35 aa, Mycobacterium bovis
NNPLLALIASDIPPLSWFLGNSPPPLLNSLLGQTV

SEQ ID NO: 220926 - protein, 31 aa, Mycobacterium bovis
NPEHLIAADLTWLLSRWACVFGTPACQGTVA

SEQ ID NO: 220927 - protein, 31 aa, Mycobacterium bovis
NPESRFLREIPQELIDWRRTAPKPSFSAPVS

SEQ ID NO: 220928 - protein, 23 aa, Mycobacterium bovis
NPGQWYLHLFDTEQPDLNSDNPE

SEQ ID NO: 220929 - protein, 25 aa, Mycobacterium bovis
NPIQRLWAGWLPAFAILEHVGRRSG

SEQ ID NO: 220930 - protein, 18 aa, Mycobacterium bovis
NPLYYWRTQQDAELDLYV

SEQ ID NO: 220931 - protein, 18 aa, Mycobacterium bovis
NPNHYLAVAIEYLYTHRP

SEQ ID NO: 220932 - protein, 33 aa, Mycobacterium bovis
NPQIDLTIRWDTPPITLFPNGISAPDNPLGLLV

SEQ ID NO: 220933 - protein, 25 aa, Mycobacterium bovis
NPSRLAALYGLQLAHESQCCQMHNL

SEQ ID NO: 220934 - protein, 19 aa, Mycobacterium bovis
NPTSSYLWRNIMPHLEGLG

SEQ ID NO: 220935 - protein, 21 aa, Mycobacterium bovis
NPVCAAAALAVLRVLASDGLV

SEQ ID NO: 220936 - protein, 24 aa, Mycobacterium bovis
NPVLRGILALDQAGGRPGPTNRRK

SEQ ID NO: 220937 - protein, 22 aa, Mycobacterium bovis
NPVNWPRVLTVWRANLIGSSGK

SEQ ID NO: 220938 - protein, 18 aa, Mycobacterium bovis
NPVRLAEAIRRFGPIFAQ

SEQ ID NO: 220939 - protein, 21 aa, Mycobacterium bovis
NQFVVALRRRGHLDDLEAMRV

SEQ ID NO: 220940 - protein, 23 aa, Mycobacterium bovis
NQQRAVLEGRLEQLRTFEREYRT

SEQ ID NO: 220941 - protein, 22 aa, Mycobacterium bovis
NQRQKFNPLVRLDSINGGSVED

SEQ ID NO: 220942 - protein, 24 aa, Mycobacterium bovis
NQSSGVIPIMKLLEDAFSYANQLG

SEQ ID NO: 220943 - protein, 22 aa, Mycobacterium bovis
NQVQEWLQWLQKIGYTDFYNNV

SEQ ID NO: 220944 - protein, 17 aa, Mycobacterium bovis
NRAGSARAWWVLTAAGI

SEQ ID NO: 220945 - protein, 26 aa, Mycobacterium bovis
NRDKRSLVFPVKRLADLGFRVLATEG

SEQ ID NO: 220946 - protein, 25 aa, Mycobacterium bovis
NREDVYRFLLRRNRRLYGVAYTLDN

SEQ ID NO: 220947 - protein, 27 aa, Mycobacterium bovis
NRGKLEALLRVLEPFGIREIAQSGMVS

SEQ ID NO: 220948 - protein, 22 aa, Mycobacterium bovis
NRGRLRSLVASNLLGQNAPAIA

SEQ ID NO: 220949 - protein, 18 aa, Mycobacterium bovis
NRHLSMHKPWNPHDYIPW

SEQ ID NO: 220950 - protein, 19 aa, Mycobacterium bovis
NRIEIVIAMLGIVKAGAIL

SEQ ID NO: 220951 - protein, 22 aa, Mycobacterium bovis
NRLMVYRRPHTRRWAGPAFLLN

SEQ ID NO: 220952 - protein, 17 aa, Mycobacterium bovis
NRMFLQRLKDKLGNHAN

SEQ ID NO: 220953 - protein, 19 aa, Mycobacterium bovis
NRMVSWPYTKLMNSNNMVD

SEQ ID NO: 220954 - protein, 23 aa, Mycobacterium bovis
NRPRIFDRRIVLPEMLYERVVEV

SEQ ID NO: 220955 - protein, 25 aa, Mycobacterium bovis
NRPRRAFRRITGSALQALLVDQESP

SEQ ID NO: 220956 - protein, 23 aa, Mycobacterium bovis
NRSVRAQTLPPGRGLLVGADGDV

SEQ ID NO: 220957 - protein, 22 aa, Mycobacterium bovis
NRVDLIVGHGRFIDPHTILVED

SEQ ID NO: 220958 - protein, 20 aa, Mycobacterium bovis
NRVKVDGLWLAGSHGFELVA

SEQ ID NO: 220959 - protein, 17 aa, Mycobacterium bovis
NRVRAMFPHAIGLSAGM

SEQ ID NO: 220960 - protein, 33 aa, Mycobacterium bovis
NRVYTGYAPVIGAPWLVAFAERSRFFEVFSSSN

SEQ ID NO: 220961 - protein, 18 aa, Mycobacterium bovis
NRYLVYTSADIRALYAFK

SEQ ID NO: 220962 - protein, 22 aa, Mycobacterium bovis
NRYWGTPIPVWKSDDPAYPRID

SEQ ID NO: 220963 - protein, 22 aa, Mycobacterium bovis
NSARLRLLRDRLVEGVLAEIDD

SEQ ID NO: 220964 - protein, 24 aa, Mycobacterium bovis
NSDPYGAGWLLDIQVDSSDVAALE

SEQ ID NO: 220965 - protein, 27 aa, Mycobacterium bovis
NSGNYSNGFFWRGDYQGLGGFAYQSAV

SEQ ID NO: 220966 - protein, 24 aa, Mycobacterium bovis
NSGTGNWGLWNPGTGNMGVANVGT

SEQ ID NO: 220967 - protein, 20 aa, Mycobacterium bovis
NSLITSWRALGWIGPEAAEA

SEQ ID NO: 220968 - protein, 19 aa, Mycobacterium bovis
NSLLDINVFGRRAGIAAAS

SEQ ID NO: 220969 - protein, 21 aa, Mycobacterium bovis
NSWPMARLTLALSPATLPKMG

SEQ ID NO: 220970 - protein, 25 aa, Mycobacterium bovis
NTAYYRLMDHDLRFYKDFTGTGNSL

SEQ ID NO: 220971 - protein, 25 aa, Mycobacterium bovis
NTDPKRKVRFLPYGIAVSVLDDPVD

SEQ ID NO: 220972 - protein, 29 aa, Mycobacterium bovis
NTEELRLVRLHLLHLLQTISPHTAELDAG

SEQ ID NO: 220973 - protein, 29 aa, Mycobacterium bovis
NTFHGLLLLRHVADLVMTGWPVLMALSNK

SEQ ID NO: 220974 - protein, 18 aa, Mycobacterium bovis
NTGGEDVLFFVASRGHHA

SEQ ID NO: 220975 - protein, 21 aa, Mycobacterium bovis
NTGIALAMVCAARGYRCVLTM

SEQ ID NO: 220976 - protein, 19 aa, Mycobacterium bovis
NTGIFDIGLANLGSYNIGL

SEQ ID NO: 220977 - protein, 17 aa, Mycobacterium bovis
NTISRTAAFSRMLSLFF

SEQ ID NO: 220978 - protein, 17 aa, Mycobacterium bovis
NTKIRLLTRIAFGFRSP

SEQ ID NO: 220979 - protein, 30 aa, Mycobacterium bovis
NTPNSAGRYRPFYLRNLLDAVQGRNLNDAV

SEQ ID NO: 220980 - protein, 25 aa, Mycobacterium bovis
NTSRATLYVAMTPARESNTAYLCER

SEQ ID NO: 220981 - protein, 24 aa, Mycobacterium bovis
NTTAAALAGLKPAFRGDGTITAGS

SEQ ID NO: 220982 - protein, 24 aa, Mycobacterium bovis
NTVEILCIACLWHVEAKVLLQVGR

SEQ ID NO: 220983 - protein, 22 aa, Mycobacterium bovis
NTVRYRLKRITDFTGRDPTQPR

SEQ ID NO: 220984 - protein, 25 aa, Mycobacterium bovis
NVADGDAALALLRAELRPGDVVLVK

SEQ ID NO: 220985 - protein, 18 aa, Mycobacterium bovis
NVARIVHVLGGCSTALFP

SEQ ID NO: 220986 - protein, 25 aa, Mycobacterium bovis
NVETVPRIFKRIRPAFTYRRSLGVL

SEQ ID NO: 220987 - protein, 18 aa, Mycobacterium bovis
NVFALYEPPAPPGMTDNP

SEQ ID NO: 220988 - protein, 23 aa, Mycobacterium bovis
NVGNFYEAFLQGFRSFFAESAAD

SEQ ID NO: 220989 - protein, 32 aa, Mycobacterium bovis
NVGVPLSTYLYTTSLMHCMTVSLALDGAGLGT

SEQ ID NO: 220990 - protein, 25 aa, Mycobacterium bovis
NVHGKPDGLPLFRECLAPGTSISHR

SEQ ID NO: 220991 - protein, 18 aa, Mycobacterium bovis
NVILLDCGTPVNGPLFSN

SEQ ID NO: 220992 - protein, 25 aa, Mycobacterium bovis
NVLAHPCPMCYGSLYYCSPDEVVFL

SEQ ID NO: 220993 - protein, 27 aa, Mycobacterium bovis
NVLKETLRLHPPLIILMRVAKGEFEVQ

SEQ ID NO: 220994 - protein, 33 aa, Mycobacterium bovis
NVLSQLPRAQALAVSLLLLSPAALNTLPGLAKA

SEQ ID NO: 220995 - protein, 18 aa, Mycobacterium bovis
NVMTFRYVIKEVALEEGA

SEQ ID NO: 220996 - protein, 21 aa, Mycobacterium bovis
NVNVPLMIIAVGTPAQVAVAA

SEQ ID NO: 220997 - protein, 24 aa, Mycobacterium bovis
NVPASLVEYVIMGQVLTAGAGQMP

SEQ ID NO: 220998 - protein, 25 aa, Mycobacterium bovis
NVPEARLVVIKPYEANQLRAIETAI

SEQ ID NO: 220999 - protein, 29 aa, Mycobacterium bovis
NVPGPQGALYWNGARLDALYLLSAPVDGA

SEQ ID NO: 221000 - protein, 35 aa, Mycobacterium bovis
NVQQTLLNAINAPTQTLLGRPLIGNGADGGPGQNG

SEQ ID NO: 221001 - protein, 20 aa, Mycobacterium bovis
NVRALLQMAVVLTYGASMPV

SEQ ID NO: 221002 - protein, 26 aa, Mycobacterium bovis
NVRRDPMAMLPFLGYNVGDYFQHWIN

SEQ ID NO: 221003 - protein, 22 aa, Mycobacterium bovis
NVSKLLWANWHRNLGELAMDVI

SEQ ID NO: 221004 - protein, 19 aa, Mycobacterium bovis
NVVDAYRYWTREAIIADID

SEQ ID NO: 221005 - protein, 24 aa, Mycobacterium bovis
NVVNEPFQTLTGRPLIGNGANGTP

SEQ ID NO: 221006 - protein, 17 aa, Mycobacterium bovis
NVYGVILGSKLAAQRMV

SEQ ID NO: 221007 - protein, 22 aa, Mycobacterium bovis
NWPRRMGRIPKQLLSGVPAHVD

SEQ ID NO: 221008 - protein, 30 aa, Mycobacterium bovis
NWQRDFFDFGHVSALYLELIKAGKLSPGMQ

SEQ ID NO: 221009 - protein, 22 aa, Mycobacterium bovis
NYARVPLIVLSANRPYELLGTG

SEQ ID NO: 221010 - protein, 26 aa, Mycobacterium bovis
NYGAAKLGLVGLINTLALEGAKYNIH

SEQ ID NO: 221011 - protein, 26 aa, Mycobacterium bovis
NYGVDVTIVEFLPRALPNEDADVSKE

SEQ ID NO: 221012 - protein, 17 aa, Mycobacterium bovis
NYHLRRITPAQTGPFFL

SEQ ID NO: 221013 - protein, 48 aa, Mycobacterium bovis
NYSNGVLWRGDYQGLLGFSYRPAVLPQTPFLDLTLTGGLGSVVIPAID

SEQ ID NO: 221014 - protein, 23 aa, Mycobacterium bovis
NYVAPIVVCHMSFWVDGKQSALA

SEQ ID NO: 221015 - protein, 22 aa, Mycobacterium bovis
NYVELCAIMQRRDRPEISRLVD

SEQ ID NO: 221016 - protein, 17 aa, Mycobacterium bovis
PAAAWQRCRTHYAANHG

SEQ ID NO: 221017 - protein, 21 aa, Mycobacterium bovis
PAAFLNVDIPVNIPITGDITN

SEQ ID NO: 221018 - protein, 18 aa, Mycobacterium bovis
PAAIVWAAQMGTITLHPW

SEQ ID NO: 221019 - protein, 17 aa, Mycobacterium bovis
PAALTILRDITAGSTNA

SEQ ID NO: 221020 - protein, 17 aa, Mycobacterium bovis
PAALVQALFNLGEMVTA

SEQ ID NO: 221021 - protein, 29 aa, Mycobacterium bovis
PAANPLARAWLPGADLRAPCALPVLVIDG

SEQ ID NO: 221022 - protein, 17 aa, Mycobacterium bovis
PAAQRLVSALRSRFDLP

SEQ ID NO: 221023 - protein, 23 aa, Mycobacterium bovis
PAAWTHLVGIKPQRGRISTWPLP

SEQ ID NO: 221024 - protein, 24 aa, Mycobacterium bovis
PADAKPFDFVFHGGSGSLKSEIEE

SEQ ID NO: 221025 - protein, 28 aa, Mycobacterium bovis
PADFPDDIAHYLWTWTDRSAGSLRARMF

SEQ ID NO: 221026 - protein, 21 aa, Mycobacterium bovis
PADFYALLRQTGQHHGPAFAA

SEQ ID NO: 221027 - protein, 32 aa, Mycobacterium bovis
PADLREQWSIRQVPLHILLDGLDLRDGVDEIP

SEQ ID NO: 221028 - protein, 22 aa, Mycobacterium bovis
PADNIPPLVAVAQQLGVCGAEL

SEQ ID NO: 221029 - protein, 20 aa, Mycobacterium bovis
PADWHMLQPQWLADLSESRR

SEQ ID NO: 221030 - protein, 30 aa, Mycobacterium bovis
PADYAHHIDKWNFTVPFVCGATNLGEALRR

SEQ ID NO: 221031 - protein, 24 aa, Mycobacterium bovis
PAEGFLPALLDWCRKNHVVFIADE

SEQ ID NO: 221032 - protein, 25 aa, Mycobacterium bovis
PAELACALGLFPPTAEQAAVIAAPP

SEQ ID NO: 221033 - protein, 26 aa, Mycobacterium bovis
PAELHFLGATLWRSGIQRVLRGFVER

SEQ ID NO: 221034 - protein, 24 aa, Mycobacterium bovis
PAELRPALERAFASGLPAVVNVLT

SEQ ID NO: 221035 - protein, 24 aa, Mycobacterium bovis
PAERRKIVQLLIDGAPISREHAEA

SEQ ID NO: 221036 - protein, 21 aa, Mycobacterium bovis
PAFALALMRRSLAGSNIGGIA

SEQ ID NO: 221037 - protein, 18 aa, Mycobacterium bovis
PAGALYAFPRLDPEVYDI

SEQ ID NO: 221038 - protein, 22 aa, Mycobacterium bovis
PAGFTETVTWWQVHRRAMIVAE

SEQ ID NO: 221039 - protein, 20 aa, Mycobacterium bovis
PAGLFLARYPDQYGKRLKRA

SEQ ID NO: 221040 - protein, 21 aa, Mycobacterium bovis
PAGLRLPLDSISWRPPRASFD

SEQ ID NO: 221041 - protein, 23 aa, Mycobacterium bovis
PAGMTGMPMVPPGALGAGAEGAN

SEQ ID NO: 221042 - protein, 17 aa, Mycobacterium bovis
PAGVKLAPTSKLAPVTP

SEQ ID NO: 221043 - protein, 20 aa, Mycobacterium bovis
PAHLQLVLHKLHDAGATVTQ

SEQ ID NO: 221044 - protein, 27 aa, Mycobacterium bovis
PAHMIPRHVTLLDRIPFTDSGKIDRAE

SEQ ID NO: 221045 - protein, 30 aa, Mycobacterium bovis
PAIDMLRGGFELAYRLLSYPKPVVMACTGH

SEQ ID NO: 221046 - protein, 29 aa, Mycobacterium bovis
PAIIAEYLGLPQLTHLRKVSIEGGKITGE

SEQ ID NO: 221047 - protein, 17 aa, Mycobacterium bovis
PAILAGEAHFAIGYTEP

SEQ ID NO: 221048 - protein, 18 aa, Mycobacterium bovis
PAITFPRIDASGSVDIGI

SEQ ID NO: 221049 - protein, 19 aa, Mycobacterium bovis
PAKYPAGFFGVFTGSYDIE

SEQ ID NO: 221050 - protein, 17 aa, Mycobacterium bovis
PALACGNAFVLKPSERD

SEQ ID NO: 221051 - protein, 25 aa, Mycobacterium bovis
PALASLRRLIESPSHDVIAVLTRPD

SEQ ID NO: 221052 - protein, 20 aa, Mycobacterium bovis
PALTINKMCLSGIDAIALAD

SEQ ID NO: 221053 - protein, 33 aa, Mycobacterium bovis
PAMGPLLAEADVPWVLMHWRAVSADTPHVPVRY

SEQ ID NO: 221054 - protein, 25 aa, Mycobacterium bovis
PAMSAFNAWVLLKGLETLAIRVQHS

SEQ ID NO: 221055 - protein, 20 aa, Mycobacterium bovis
PAMVFRLIAEEALTLMAGAA

SEQ ID NO: 221056 - protein, 18 aa, Mycobacterium bovis
PANSLLNLDVFVGTPGAT

SEQ ID NO: 221057 - protein, 25 aa, Mycobacterium bovis
PAPDHLRLVTLPWSRDLAAAIERLG

SEQ ID NO: 221058 - protein, 25 aa, Mycobacterium bovis
PAPDTMTYLTALLPVAQGVSVYAAL

SEQ ID NO: 221059 - protein, 25 aa, Mycobacterium bovis
PAPFRHIPQAPQRPAPLPGQDSVQI

SEQ ID NO: 221060 - protein, 25 aa, Mycobacterium bovis
PAPLLEPLAVERLYLDNYFSIAKAR

SEQ ID NO: 221061 - protein, 17 aa, Mycobacterium bovis
PAPMYHTAPSVWTMSAL

SEQ ID NO: 221062 - protein, 19 aa, Mycobacterium bovis
PAPQRLRVLALALAGERTV

SEQ ID NO: 221063 - protein, 23 aa, Mycobacterium bovis
PAPRALLALLTGPPPDSPRDVIV

SEQ ID NO: 221064 - protein, 21 aa, Mycobacterium bovis
PAPVTFVDIAGLIKGASEGAG

SEQ ID NO: 221065 - protein, 21 aa, Mycobacterium bovis
PAQAIAQVCELTWQLRGQATG

SEQ ID NO: 221066 - protein, 24 aa, Mycobacterium bovis
PAQLLDVWRRKDMPTKPAPVLIFV

SEQ ID NO: 221067 - protein, 32 aa, Mycobacterium bovis
PARAWERGRFAAPYLRDSLLAAGALCETLETA

SEQ ID NO: 221068 - protein, 18 aa, Mycobacterium bovis
PAREALAWGLISAVYPDS

SEQ ID NO: 221069 - protein, 22 aa, Mycobacterium bovis
PARGSRHLGFAKALVYEMPHTL

SEQ ID NO: 221070 - protein, 30 aa, Mycobacterium bovis
PARPALFVFRPLLNLALRRFLRNLRRYTDA

SEQ ID NO: 221071 - protein, 19 aa, Mycobacterium bovis
PARPRAGLIGCAFADLAEV

SEQ ID NO: 221072 - protein, 34 aa, Mycobacterium bovis
PARRVGRPRIRLAYRLTPRRVLGQRRAGGVQFSV

SEQ ID NO: 221073 - protein, 18 aa, Mycobacterium bovis
PARWFLDHARVALSSGHV

SEQ ID NO: 221074 - protein, 21 aa, Mycobacterium bovis
PASTYANYLPRFFRGISDDAD

SEQ ID NO: 221075 - protein, 20 aa, Mycobacterium bovis
PATDVAILFRLGCRSVGESR

SEQ ID NO: 221076 - protein, 25 aa, Mycobacterium bovis
PATGLPWMADLVGEFALRAPPAEQI

SEQ ID NO: 221077 - protein, 21 aa, Mycobacterium bovis
PAVDSRWVWVLDPIDGTINHA

SEQ ID NO: 221078 - protein, 20 aa, Mycobacterium bovis
PAVIARYPAPPGAPTVLLYA

SEQ ID NO: 221079 - protein, 28 aa, Mycobacterium bovis
PAVIKNAIDWLSRPFGDGALKDKPLAVI

SEQ ID NO: 221080 - protein, 18 aa, Mycobacterium bovis
PAVISVNEKINEPRFPSF

SEQ ID NO: 221081 - protein, 18 aa, Mycobacterium bovis
PAVLAAIPAGYRALVVDN

SEQ ID NO: 221082 - protein, 26 aa, Mycobacterium bovis
PAVNKLGTMGLILRGSEELKKQVLPA

SEQ ID NO: 221083 - protein, 22 aa, Mycobacterium bovis
PAVPHLVSLPGYPFARQRHWVE

SEQ ID NO: 221084 - protein, 18 aa, Mycobacterium bovis
PAVRRAVAATRNGRIGVI

SEQ ID NO: 221085 - protein, 18 aa, Mycobacterium bovis
PAVTARRRLRMICHGLGH

SEQ ID NO: 221086 - protein, 24 aa, Mycobacterium bovis
PAVTLSWIREFPSLGAAAYPVQRR

SEQ ID NO: 221087 - protein, 29 aa, Mycobacterium bovis
PAVVQANRVRTWLLAVSNVFGQNAPAIAA

SEQ ID NO: 221088 - protein, 29 aa, Mycobacterium bovis
PAVYDLANRGLLPPTFSLVGFARRDWSTQ

SEQ ID NO: 221089 - protein, 20 aa, Mycobacterium bovis
PAWVTLLRSAGAHDTYLRTY

SEQ ID NO: 221090 - protein, 23 aa, Mycobacterium bovis
PAYTGRMFTAPVPALRMPDESMD

SEQ ID NO: 221091 - protein, 24 aa, Mycobacterium bovis
PCAELSMLLLDTAAMADLHMRWMD

SEQ ID NO: 221092 - protein, 26 aa, Mycobacterium bovis
PCQVRVPVPTLLLADVLAAAPAEFVP

SEQ ID NO: 221093 - protein, 33 aa, Mycobacterium bovis
PCRTFAAFLDLRYWIKTFTRAAKPGAYLRVIAP

SEQ ID NO: 221094 - protein, 26 aa, Mycobacterium bovis
PCTPRGIVHLLRRYDISIAGAHVVVI

SEQ ID NO: 221095 - protein, 19 aa, Mycobacterium bovis
PCWLVGLLFPSADGCAGHS

SEQ ID NO: 221096 - protein, 32 aa, Mycobacterium bovis
PDAHGFAAFYRRCRLVTARLWPTLIEPLRTRE

SEQ ID NO: 221097 - protein, 23 aa, Mycobacterium bovis
PDAHGLHLFATLLAAGERAFGAG

SEQ ID NO: 221098 - protein, 23 aa, Mycobacterium bovis
PDAHYHKIHLYDAFGFTESRTVA

SEQ ID NO: 221099 - protein, 18 aa, Mycobacterium bovis
PDAKTVFMVLRDPAADMS

SEQ ID NO: 221100 - protein, 26 aa, Mycobacterium bovis
PDALQVYSQLKRLLTGRRPAVFLDFD

SEQ ID NO: 221101 - protein, 25 aa, Mycobacterium bovis
PDAPTLSGFWHWAVANLPANVTELP

SEQ ID NO: 221102 - protein, 17 aa, Mycobacterium bovis
PDAVVPTVLPLAGTATP

SEQ ID NO: 221103 - protein, 26 aa, Mycobacterium bovis
PDDGDIGLIIAVKRLAAAKTRLAPVF

SEQ ID NO: 221104 - protein, 24 aa, Mycobacterium bovis
PDEFAIVHKLRRVLSGLDSHQAID

SEQ ID NO: 221105 - protein, 25 aa, Mycobacterium bovis
PDEVARYLFRRVVSWGRSSNVFLRN

SEQ ID NO: 221106 - protein, 22 aa, Mycobacterium bovis
PDFSLVELPAKLPRATLKKLAQ

SEQ ID NO: 221107 - protein, 18 aa, Mycobacterium bovis
PDFVSSQWQWQTGMWVGG

SEQ ID NO: 221108 - protein, 27 aa, Mycobacterium bovis
PDGARELIRAFWPGALSLVVVQAPSLQ

SEQ ID NO: 221109 - protein, 25 aa, Mycobacterium bovis
PDGEDLSWLWDVRFEHFETTRVVAA

SEQ ID NO: 221110 - protein, 28 aa, Mycobacterium bovis
PDGISRLRFRLRWRGFRLIVDANHTDVT

SEQ ID NO: 221111 - protein, 24 aa, Mycobacterium bovis
PDGKYLYIADYSGTITRTAVASTI

SEQ ID NO: 221112 - protein, 18 aa, Mycobacterium bovis
PDGVWSRMKFEGGVHRVQ

SEQ ID NO: 221113 - protein, 21 aa, Mycobacterium bovis
PDIDIRWRTVTFALVTHAVGG

SEQ ID NO: 221114 - protein, 30 aa, Mycobacterium bovis
PDIGPIIVPSFVLSVPTFAIAVGGPTTAIN

SEQ ID NO: 221115 - protein, 20 aa, Mycobacterium bovis
PDISVPSIHLGLDPAVHVGS

SEQ ID NO: 221116 - protein, 18 aa, Mycobacterium bovis
PDIVLRAAAKLPGVRIIV

SEQ ID NO: 221117 - protein, 28 aa, Mycobacterium bovis
PDKGRVLTAMSAFFFGLVDAPNHLAGPP

SEQ ID NO: 221118 - protein, 18 aa, Mycobacterium bovis
PDLEDRAKMMALLEPERI

SEQ ID NO: 221119 - protein, 23 aa, Mycobacterium bovis
PDLEVVALLSRGKLLYGVIDDEN

SEQ ID NO: 221120 - protein, 20 aa, Mycobacterium bovis
PDLFPVLRVLVDRPVMPARF

SEQ ID NO: 221121 - protein, 27 aa, Mycobacterium bovis
PDLIDPALLRPGRLERLVFVEPPDAAA

SEQ ID NO: 221122 - protein, 20 aa, Mycobacterium bovis
PDLQSILDRGWLHPGSIVVA

SEQ ID NO: 221123 - protein, 18 aa, Mycobacterium bovis
PDLVLRWAALLHDIGKPA

SEQ ID NO: 221124 - protein, 23 aa, Mycobacterium bovis
PDQASRLLLRVLGIEPPDHELDV

SEQ ID NO: 221125 - protein, 27 aa, Mycobacterium bovis
PDQDVFASRLPRYFPTALRERFTPEIR

SEQ ID NO: 221126 - protein, 17 aa, Mycobacterium bovis
PDQLRIRELLSRIGERV

SEQ ID NO: 221127 - protein, 24 aa, Mycobacterium bovis
PDRPIELRLLEIEPALQALEGVVM

SEQ ID NO: 221128 - protein, 21 aa, Mycobacterium bovis
PDRVLAYGDCAIIPNPTVEQL

SEQ ID NO: 221129 - protein, 24 aa, Mycobacterium bovis
PDSAQVRLKRMYPGAHYRATTATV

SEQ ID NO: 221130 - protein, 24 aa, Mycobacterium bovis
PDSFLRAAELLGVTPDAAAVFEDA

SEQ ID NO: 221131 - protein, 31 aa, Mycobacterium bovis
PDTAVPVKLHVPIFLDIPVTGTLGTFTVHGF

SEQ ID NO: 221132 - protein, 20 aa, Mycobacterium bovis
PDTQLVTIIVSWLSGELPQR

SEQ ID NO: 221133 - protein, 24 aa, Mycobacterium bovis
PDVDRLARSMLLLHGDHHDHNDSP

SEQ ID NO: 221134 - protein, 19 aa, Mycobacterium bovis
PDVGKLVELAFALGQLASA

SEQ ID NO: 221135 - protein, 18 aa, Mycobacterium bovis
PDVRLSPYLALHGICRWG

SEQ ID NO: 221136 - protein, 19 aa, Mycobacterium bovis
PDVVQRLSALGLLVSITVT

SEQ ID NO: 221137 - protein, 31 aa, Mycobacterium bovis
PDVWTLSKLVRHHLLLPITATRRDLNDPKTI

SEQ ID NO: 221138 - protein, 18 aa, Mycobacterium bovis
PDWAARARWANPAAWRLP

SEQ ID NO: 221139 - protein, 20 aa, Mycobacterium bovis
PDYLQTCRVTFPSGRMADAL

SEQ ID NO: 221140 - protein, 18 aa, Mycobacterium bovis
PDYPASTYANYLPRFFRG

SEQ ID NO: 221141 - protein, 24 aa, Mycobacterium bovis
PDYRFNFGVAYDRSLLFGYALDEV

SEQ ID NO: 221142 - protein, 47 aa, Mycobacterium bovis
PEATFFNFEFPRNGFQLRRPLFPPLPGTLPEPEIWARLVRALGVVDE

SEQ ID NO: 221143 - protein, 26 aa, Mycobacterium bovis
PECQQAVRFGLFHLLQASARAERRAI

SEQ ID NO: 221144 - protein, 23 aa, Mycobacterium bovis
PEEDGPIAVMPPAPGMVVAANSV

SEQ ID NO: 221145 - protein, 21 aa, Mycobacterium bovis
PEEIKRAYRKLARDLHPDANP

SEQ ID NO: 221146 - protein, 28 aa, Mycobacterium bovis
PEELVPVAMPNWHYLHIHNDVIPALKQH

SEQ ID NO: 221147 - protein, 24 aa, Mycobacterium bovis
PEETFPVIVALMTNVFDGAAIVRG

SEQ ID NO: 221148 - protein, 19 aa, Mycobacterium bovis
PEETLRWLYEMMVVTRELD

SEQ ID NO: 221149 - protein, 19 aa, Mycobacterium bovis
PEFAEDWVNLVALAVNEEN

SEQ ID NO: 221150 - protein, 25 aa, Mycobacterium bovis
PEFVENFFMFIAEEVREYLAQLGFR

SEQ ID NO: 221151 - protein, 20 aa, Mycobacterium bovis
PEGIEGRVPFRGPLSSVIHQ

SEQ ID NO: 221152 - protein, 30 aa, Mycobacterium bovis
PEGKMAAVAKRRGWPILKFNSRGGVGIRRQ

SEQ ID NO: 221153 - protein, 30 aa, Mycobacterium bovis
PEHPVAAFPQWFGRSWRRVAMLRYGENPHQ

SEQ ID NO: 221154 - protein, 19 aa, Mycobacterium bovis
PEILLLDEGIGAVDADFLR

SEQ ID NO: 221155 - protein, 25 aa, Mycobacterium bovis
PEINSLRMYLGAGSAPMLQAAAAWD

SEQ ID NO: 221156 - protein, 18 aa, Mycobacterium bovis
PEINSTRIYLGPGSGPIL

SEQ ID NO: 221157 - protein, 26 aa, Mycobacterium bovis
PEISEQLLRVLARRLRRTNNNLADLI

SEQ ID NO: 221158 - protein, 26 aa, Mycobacterium bovis
PEITIPQLPLGLALSGATPAFAFPLE

SEQ ID NO: 221159 - protein, 25 aa, Mycobacterium bovis
PEKLATFRDAQGLTFPLLSDPDREV

SEQ ID NO: 221160 - protein, 35 aa, Mycobacterium bovis
PELLRVLDFAPTPKARLRPPIRREGLGLVFETPTD

SEQ ID NO: 221161 - protein, 17 aa, Mycobacterium bovis
PELPDLAEVWFGTGRNA

SEQ ID NO: 221162 - protein, 33 aa, Mycobacterium bovis
PELSLYALRDSIGTPFLLLAGLEPDLKWERFIT

SEQ ID NO: 221163 - protein, 23 aa, Mycobacterium bovis
PENATAWGLLLTALTGPDVTLLG

SEQ ID NO: 221164 - protein, 24 aa, Mycobacterium bovis
PEPHPTIPTTPWQHTHHWIATTHP

SEQ ID NO: 221165 - protein, 24 aa, Mycobacterium bovis
PEPHPVLPTTPWQHTQHWITATSA

SEQ ID NO: 221166 - protein, 17 aa, Mycobacterium bovis
PEPVVYPLDQAAAAIAS

SEQ ID NO: 221167 - protein, 18 aa, Mycobacterium bovis
PEQFWDLLCAGRSGIVRV

SEQ ID NO: 221168 - protein, 19 aa, Mycobacterium bovis
PEQIRPWVPGTYLTLGTDG

SEQ ID NO: 221169 - protein, 21 aa, Mycobacterium bovis
PERERTVLVLRFFDSMTQTQI

SEQ ID NO: 221170 - protein, 26 aa, Mycobacterium bovis
PERKALLDRLLAQKLPDGWDADLPHW

SEQ ID NO: 221171 - protein, 25 aa, Mycobacterium bovis
PERSASWVVPLLWRRWSPGYHAEED

SEQ ID NO: 221172 - protein, 25 aa, Mycobacterium bovis
PESHAMFVALAYAKLNGVRKEKYLA

SEQ ID NO: 221173 - protein, 19 aa, Mycobacterium bovis
PETMAYTAVRWKNVLRQAA

SEQ ID NO: 221174 - protein, 27 aa, Mycobacterium bovis
PETRIDPSLTRISALMDLLGSPQRSYP

SEQ ID NO: 221175 - protein, 21 aa, Mycobacterium bovis
PETYQQAFYARDLAGTVVLVG

SEQ ID NO: 221176 - protein, 19 aa, Mycobacterium bovis
PEVAEVVAMLRLVADPTAG

SEQ ID NO: 221177 - protein, 30 aa, Mycobacterium bovis
PEVRNFLVANALYWLQEFHIDGLRVDAVAS

SEQ ID NO: 221178 - protein, 19 aa, Mycobacterium bovis
PEVRSQLAMTWGTETFIVP

SEQ ID NO: 221179 - protein, 20 aa, Mycobacterium bovis
PEYKFVLAEVDYLKPYWDTH

SEQ ID NO: 221180 - protein, 24 aa, Mycobacterium bovis
PEYKQVALFSATMPPAIRKLSAKY

SEQ ID NO: 221181 - protein, 26 aa, Mycobacterium bovis
PFAGHPTVGASWWLRERGTPINTLQV

SEQ ID NO: 221182 - protein, 30 aa, Mycobacterium bovis
PFAPEIYRAPLSYPYRDGLLDKQLATNGEL

SEQ ID NO: 221183 - protein, 18 aa, Mycobacterium bovis
PFGMDEFLARLRAAVRRN

SEQ ID NO: 221184 - protein, 18 aa, Mycobacterium bovis
PFKRRLFGQIVAAAVRAT

SEQ ID NO: 221185 - protein, 19 aa, Mycobacterium bovis
PFLEHFVMRSRYVDNPGLF

SEQ ID NO: 221186 - protein, 18 aa, Mycobacterium bovis
PFLPIRAGLGSSVPQFWA

SEQ ID NO: 221187 - protein, 19 aa, Mycobacterium bovis
PFLSIERAVYRLTGELAEW

SEQ ID NO: 221188 - protein, 23 aa, Mycobacterium bovis
PFPVRAVAIRVAGWIDKLGAVWV

SEQ ID NO: 221189 - protein, 29 aa, Mycobacterium bovis
PFSKPLQNLAGLPAWLASGAPAAAMTAAA

SEQ ID NO: 221190 - protein, 38 aa, Mycobacterium bovis
PFTLENGLLTGIRKLARPQLKKFYGERLERLYTELADS

SEQ ID NO: 221191 - protein, 20 aa, Mycobacterium bovis
PFYIMDEVEAALDDVNLRRL

SEQ ID NO: 221192 - protein, 27 aa, Mycobacterium bovis
PGAAALAFPSLSSSVPILGPYEDLIAN

SEQ ID NO: 221193 - protein, 28 aa, Mycobacterium bovis
PGAEASWVVGITWWSAVVGGFQMSFVIA

SEQ ID NO: 221194 - protein, 22 aa, Mycobacterium bovis
PGALLGAKPFTFDPAALAAAQA

SEQ ID NO: 221195 - protein, 19 aa, Mycobacterium bovis
PGALRRFLDDVLGPNDDIT

SEQ ID NO: 221196 - protein, 20 aa, Mycobacterium bovis
PGARVLLVWDAPNLDMGLGS

SEQ ID NO: 221197 - protein, 24 aa, Mycobacterium bovis
PGASYFVLVFDRAAIPEGPINAVT

SEQ ID NO: 221198 - protein, 25 aa, Mycobacterium bovis
PGDALFAFLRSMVLQWGATDRGLVE

SEQ ID NO: 221199 - protein, 28 aa, Mycobacterium bovis
PGDTYLAGAKILRQYGIGPLPGVAMMVV

SEQ ID NO: 221200 - protein, 19 aa, Mycobacterium bovis
PGDWSVFDALAKMAGEVMP

SEQ ID NO: 221201 - protein, 23 aa, Mycobacterium bovis
PGDYFGEIGVLFHLPRSATVRAR

SEQ ID NO: 221202 - protein, 17 aa, Mycobacterium bovis
PGELLLYVFGRRAVARV

SEQ ID NO: 221203 - protein, 17 aa, Mycobacterium bovis
PGELSVHYPFPIADLVA

SEQ ID NO: 221204 - protein, 25 aa, Mycobacterium bovis
PGEPSWPTPWGRGRPGWHLECSAMA

SEQ ID NO: 221205 - protein, 19 aa, Mycobacterium bovis
PGETVLAASLTRTPGGKGA

SEQ ID NO: 221206 - protein, 29 aa, Mycobacterium bovis
PGFFGVVTSFYLKLYPRPATCGTSVYVYP

SEQ ID NO: 221207 - protein, 23 aa, Mycobacterium bovis
PGFGDRRKAMLQDMAILTGGQVI

SEQ ID NO: 221208 - protein, 18 aa, Mycobacterium bovis
PGFGLVMFGAIREASTLA

SEQ ID NO: 221209 - protein, 27 aa, Mycobacterium bovis
PGFNPYNRGWFPQVFSIIDGQKVGVTI

SEQ ID NO: 221210 - protein, 18 aa, Mycobacterium bovis
PGGFRYGPAFGVELQFWV

SEQ ID NO: 221211 - protein, 24 aa, Mycobacterium bovis
PGGGQFTLPGRSLMFVRNVGHLMT

SEQ ID NO: 221212 - protein, 23 aa, Mycobacterium bovis
PGGIGAIRKLGMWPVFVQEETVE

SEQ ID NO: 221213 - protein, 24 aa, Mycobacterium bovis
PGGIWRDGVYAHGDYPRSFLDAAG

SEQ ID NO: 221214 - protein, 28 aa, Mycobacterium bovis
PGGNGGNAGWLYGRGGVGGAGGIGGGTG

SEQ ID NO: 221215 - protein, 18 aa, Mycobacterium bovis
PGGQGGKGGLIGLPGQNG

SEQ ID NO: 221216 - protein, 17 aa, Mycobacterium bovis
PGGRRRALLTGTVAVVG

SEQ ID NO: 221217 - protein, 22 aa, Mycobacterium bovis
PGGTEVTLRFPDGEVVTMHVIS

SEQ ID NO: 221218 - protein, 18 aa, Mycobacterium bovis
PGGYGAALLLDSWALLGR

SEQ ID NO: 221219 - protein, 19 aa, Mycobacterium bovis
PGHLTRYLARRWPGAVIEA

SEQ ID NO: 221220 - protein, 28 aa, Mycobacterium bovis
PGKEGHEVLIFRLFHAPPPSVCSRRRVR

SEQ ID NO: 221221 - protein, 25 aa, Mycobacterium bovis
PGKFRQLGPVNWLVAKLAARAVGAP

SEQ ID NO: 221222 - protein, 17 aa, Mycobacterium bovis
PGKFWSGDSLPLAPGYR

SEQ ID NO: 221223 - protein, 22 aa, Mycobacterium bovis
PGKKITRLSLLSGGEKALTAVA

SEQ ID NO: 221224 - protein, 22 aa, Mycobacterium bovis
PGKWGEYLLASRATTIYGGTSE

SEQ ID NO: 221225 - protein, 22 aa, Mycobacterium bovis
PGLFTLVLHTHLPWLAHHGRWP

SEQ ID NO: 221226 - protein, 25 aa, Mycobacterium bovis
PGLGADLLAVVARLNRLATQRIQMP

SEQ ID NO: 221227 - protein, 20 aa, Mycobacterium bovis
PGLLTILHDGGYRDTEIMRW

SEQ ID NO: 221228 - protein, 26 aa, Mycobacterium bovis
PGLPGMGSLLLPPWTVTRYGTDGVEM

SEQ ID NO: 221229 - protein, 23 aa, Mycobacterium bovis
PGLPRLLRVVGHYYKPGFHPSQL

SEQ ID NO: 221230 - protein, 17 aa, Mycobacterium bovis
PGMLITARALLDRNPDP

SEQ ID NO: 221231 - protein, 32 aa, Mycobacterium bovis
PGNDGRGYVLRRLLRRVIRSAKLLGIDAAIVG

SEQ ID NO: 221232 - protein, 26 aa, Mycobacterium bovis
PGPFDAYLTMRGLKTLVLRMQRHSEN

SEQ ID NO: 221233 - protein, 19 aa, Mycobacterium bovis
PGPHLLVLARGPEGYRRLS

SEQ ID NO: 221234 - protein, 24 aa, Mycobacterium bovis
PGPPPPGTVSPPLPPSAPAVGVGG

SEQ ID NO: 221235 - protein, 22 aa, Mycobacterium bovis
PGQPLWGHGWDESAWPENAAPS

SEQ ID NO: 221236 - protein, 24 aa, Mycobacterium bovis
PGQRDLLYEGPWWVAVSPGTGRPA

SEQ ID NO: 221237 - protein, 19 aa, Mycobacterium bovis
PGRHQLFMHACDLSRLPDG

SEQ ID NO: 221238 - protein, 20 aa, Mycobacterium bovis
PGRLTLVEGAGGLLVELAEP

SEQ ID NO: 221239 - protein, 31 aa, Mycobacterium bovis
PGRTYQFNALFLDPYLWKLQVGGKRLVQKAR

SEQ ID NO: 221240 - protein, 22 aa, Mycobacterium bovis
PGSFLARQLGVPQPETLRRYRA

SEQ ID NO: 221241 - protein, 18 aa, Mycobacterium bovis
PGSGMRGVIAKKGNIPVG

SEQ ID NO: 221242 - protein, 19 aa, Mycobacterium bovis
PGSLPVLNRAAVESAIRIG

SEQ ID NO: 221243 - protein, 24 aa, Mycobacterium bovis
PGSPAHHVLSLVQLPVVGADTEDI

SEQ ID NO: 221244 - protein, 18 aa, Mycobacterium bovis
PGSRFDTRRILWGDPSQK

SEQ ID NO: 221245 - protein, 26 aa, Mycobacterium bovis
PGTFEGWLHRITTNLFLDMVRRRARI

SEQ ID NO: 221246 - protein, 19 aa, Mycobacterium bovis
PGTIASVAAVALYIGDVLG

SEQ ID NO: 221247 - protein, 28 aa, Mycobacterium bovis
PGTIEMADWWAYLNGVRKTYPLSYGPQS

SEQ ID NO: 221248 - protein, 27 aa, Mycobacterium bovis
PGTPPATLLDYFPEDFLLVIDESHVTV

SEQ ID NO: 221249 - protein, 17 aa, Mycobacterium bovis
PGTRMRVALSALTMAEW

SEQ ID NO: 221250 - protein, 28 aa, Mycobacterium bovis
PGTTFGDYWYANLRHTVRFDRAVESAIR

SEQ ID NO: 221251 - protein, 25 aa, Mycobacterium bovis
PGTTRLLLRAVGDWLVRPGAQLQAV

SEQ ID NO: 221252 - protein, 24 aa, Mycobacterium bovis
PGTVFALEMAFFGALVQAGSGTFT

SEQ ID NO: 221253 - protein, 20 aa, Mycobacterium bovis
PGVGLRYEFTSYRGDRIGIV

SEQ ID NO: 221254 - protein, 32 aa, Mycobacterium bovis
PGVPARRTLVFPPGMYWRTPDMLSGAPALAAT

SEQ ID NO: 221255 - protein, 19 aa, Mycobacterium bovis
PGVWHSSGMNRIRLSTTVD

SEQ ID NO: 221256 - protein, 28 aa, Mycobacterium bovis
PGYANFAIADPPLKLVLLENPGTGGTLN

SEQ ID NO: 221257 - protein, 17 aa, Mycobacterium bovis
PGYIFSGVAPVVTEMLW

SEQ ID NO: 221258 - protein, 17 aa, Mycobacterium bovis
PGYIPRSTEYRIHQRVL

SEQ ID NO: 221259 - protein, 20 aa, Mycobacterium bovis
PGYSWTPIILADGAHHTNAT

SEQ ID NO: 221260 - protein, 18 aa, Mycobacterium bovis
PHAAITTDLIVGFPGETE

SEQ ID NO: 221261 - protein, 24 aa, Mycobacterium bovis
PHAGGAAAAYRWLAKSLVANDVDT

SEQ ID NO: 221262 - protein, 18 aa, Mycobacterium bovis
PHALSMLRGFNLMKQLEE

SEQ ID NO: 221263 - protein, 26 aa, Mycobacterium bovis
PHFVNALQPIEWRYANDPAWIMRDKG

SEQ ID NO: 221264 - protein, 24 aa, Mycobacterium bovis
PHGDKLFQLVRRVPVTTIIVDTPQ

SEQ ID NO: 221265 - protein, 23 aa, Mycobacterium bovis
PHGGIAFGWDRTTALLAGMDSIR

SEQ ID NO: 221266 - protein, 19 aa, Mycobacterium bovis
PHHQLATTGGWITRKRKDG

SEQ ID NO: 221267 - protein, 25 aa, Mycobacterium bovis
PHHTRLRKIISRGFTPRAVGRLHDE

SEQ ID NO: 221268 - protein, 18 aa, Mycobacterium bovis
PHIAMTAAMLRQAGVDID

SEQ ID NO: 221269 - protein, 22 aa, Mycobacterium bovis
PHIEKRFSMPWGHPARRMREFV

SEQ ID NO: 221270 - protein, 17 aa, Mycobacterium bovis
PHLTAAIIAKYISNLRL

SEQ ID NO: 221271 - protein, 28 aa, Mycobacterium bovis
PHPATVALFRLPRALKYKAKPGRSVDLL

SEQ ID NO: 221272 - protein, 23 aa, Mycobacterium bovis
PHQPLLCNALIALCDFTADNGAT

SEQ ID NO: 221273 - protein, 26 aa, Mycobacterium bovis
PHRDMEIVTWVLRGALRHQDSAGNSG

SEQ ID NO: 221274 - protein, 19 aa, Mycobacterium bovis
PHVTFDPLHALRAIERHRI

SEQ ID NO: 221275 - protein, 18 aa, Mycobacterium bovis
PIAAIERFCQITDPAAAL

SEQ ID NO: 221276 - protein, 19 aa, Mycobacterium bovis
PIAPHSGLGYAQNFLHMCF

SEQ ID NO: 221277 - protein, 19 aa, Mycobacterium bovis
PIAVKEAVLPFHRFRRADG

SEQ ID NO: 221278 - protein, 18 aa, Mycobacterium bovis
PICAFSHCRDVVAAVSNA

SEQ ID NO: 221279 - protein, 23 aa, Mycobacterium bovis
PIDIAYPVLWRNLTAIVASVLDA

SEQ ID NO: 221280 - protein, 25 aa, Mycobacterium bovis
PIEKKPLNHFLPGSATLSFGTAGCN

SEQ ID NO: 221281 - protein, 24 aa, Mycobacterium bovis
PIEPRLSLQWWVRVESLAKAAGDA

SEQ ID NO: 221282 - protein, 17 aa, Mycobacterium bovis
PIEQWLAAKKAASDAIM

SEQ ID NO: 221283 - protein, 25 aa, Mycobacterium bovis
PIGAPSFVEALRWGAEVYHALKSVL

SEQ ID NO: 221284 - protein, 20 aa, Mycobacterium bovis
PIGKRNGWLSGLHATELLGA

SEQ ID NO: 221285 - protein, 20 aa, Mycobacterium bovis
PIHRALVHRLMQSETARGAT

SEQ ID NO: 221286 - protein, 26 aa, Mycobacterium bovis
PINAQLFSMPIHQVMVMPGSVMTIPG

SEQ ID NO: 221287 - protein, 17 aa, Mycobacterium bovis
PIPFSGPARKVLELTFR

SEQ ID NO: 221288 - protein, 23 aa, Mycobacterium bovis
PIRRIDDFAEWLQRFEASLGALP

SEQ ID NO: 221289 - protein, 18 aa, Mycobacterium bovis
PITAVSLAWLPAGDYERA

SEQ ID NO: 221290 - protein, 24 aa, Mycobacterium bovis
PITSPTFVLARMHRPRRPGTPAMV

SEQ ID NO: 221291 - protein, 19 aa, Mycobacterium bovis
PITTPPWDTKAPKDNVIGW

SEQ ID NO: 221292 - protein, 27 aa, Mycobacterium bovis
PIVMVDPWGHFDGLRAWLNGLLDTGYV

SEQ ID NO: 221293 - protein, 24 aa, Mycobacterium bovis
PIVPGAVIFDLPVGGWNCRPTADF

SEQ ID NO: 221294 - protein, 18 aa, Mycobacterium bovis
PIVWQRHTLDFWDHVVDS

SEQ ID NO: 221295 - protein, 24 aa, Mycobacterium bovis
PKDDPLGPIIKLFDDAGYIGVVAT

SEQ ID NO: 221296 - protein, 28 aa, Mycobacterium bovis
PKDKLDSYVRPLLAISAQRVSKGGNPLF

SEQ ID NO: 221297 - protein, 23 aa, Mycobacterium bovis
PKGLWEWIRLRRLGRREKFGKPG

SEQ ID NO: 221298 - protein, 26 aa, Mycobacterium bovis
PKGVAVPHRPVAEYFVWFKGEYDVDD

SEQ ID NO: 221299 - protein, 36 aa, Mycobacterium bovis
PKGYQPLLDVAFAHDIRLIASALGPPPPDLVERAHN

SEQ ID NO: 221300 - protein, 18 aa, Mycobacterium bovis
PKHNGITYFLLDMKSEGV

SEQ ID NO: 221301 - protein, 18 aa, Mycobacterium bovis
PKLRHWVKEVKAAMAALD

SEQ ID NO: 221302 - protein, 26 aa, Mycobacterium bovis
PKPPPRRITLTLPAIQRSREVWLLVS

SEQ ID NO: 221303 - protein, 23 aa, Mycobacterium bovis
PKRGPDLPATLRDYLLTLRRKSA

SEQ ID NO: 221304 - protein, 18 aa, Mycobacterium bovis
PKSNFYPSPDRESAYASP

SEQ ID NO: 221305 - protein, 24 aa, Mycobacterium bovis
PLAAILLGLLHDGVPVAGLTWMPF

SEQ ID NO: 221306 - protein, 17 aa, Mycobacterium bovis
PLAALQAQILHIETLAA

SEQ ID NO: 221307 - protein, 18 aa, Mycobacterium bovis
PLALGRLLDNPTVTSIAS

SEQ ID NO: 221308 - protein, 27 aa, Mycobacterium bovis
PLALRDRLIVELLYATGIRVSELCGLD

SEQ ID NO: 221309 - protein, 23 aa, Mycobacterium bovis
PLASALMRVGIAPTLIGTRGTRP

SEQ ID NO: 221310 - protein, 25 aa, Mycobacterium bovis
PLATMAGYHLGWWNADRSTAAGSSG

SEQ ID NO: 221311 - protein, 26 aa, Mycobacterium bovis
PLAVDPAHPFPFVSGLSLNLAVTVRQ

SEQ ID NO: 221312 - protein, 19 aa, Mycobacterium bovis
PLCLGIDPHPELLRGWDLA

SEQ ID NO: 221313 - protein, 26 aa, Mycobacterium bovis
PLDSPELIRLAPRPAARTDPMLLAWT

SEQ ID NO: 221314 - protein, 26 aa, Mycobacterium bovis
PLFQRRHLLLSGWIKMQEGQLPSASA

SEQ ID NO: 221315 - protein, 18 aa, Mycobacterium bovis
PLGLDRYGVRFRIEARDG

SEQ ID NO: 221316 - protein, 19 aa, Mycobacterium bovis
PLHNPPAVLGIKVARRLLA

SEQ ID NO: 221317 - protein, 18 aa, Mycobacterium bovis
PLHPGFAASWQRLRTAPA

SEQ ID NO: 221318 - protein, 17 aa, Mycobacterium bovis
PLHPMRVYAELAALLER

SEQ ID NO: 221319 - protein, 18 aa, Mycobacterium bovis
PLIAVASAATRWVWVSDA

SEQ ID NO: 221320 - protein, 26 aa, Mycobacterium bovis
PLIRERLTRAWTGLRAMRSYALATME

SEQ ID NO: 221321 - protein, 19 aa, Mycobacterium bovis
PLKIALSTHFPYTGFRAKL

SEQ ID NO: 221322 - protein, 19 aa, Mycobacterium bovis
PLLADPPVLHLYDDRLLYL

SEQ ID NO: 221323 - protein, 26 aa, Mycobacterium bovis
PLLAGDFVRWCRQVLDLLDQVRNAAP

SEQ ID NO: 221324 - protein, 19 aa, Mycobacterium bovis
PLLIVSSDLRRAYDTAVKL

SEQ ID NO: 221325 - protein, 34 aa, Mycobacterium bovis
PLLQSSNGPLSWLWQILFGTPNFPTSISALLTDL

SEQ ID NO: 221326 - protein, 21 aa, Mycobacterium bovis
PLLVACDLQRPAAVNQLQVVG

SEQ ID NO: 221327 - protein, 20 aa, Mycobacterium bovis
PLLVSVFLEKDFAFVVSSEA

SEQ ID NO: 221328 - protein, 17 aa, Mycobacterium bovis
PLMLCAKMIHALARLPQ

SEQ ID NO: 221329 - protein, 24 aa, Mycobacterium bovis
PLNTVGFHEPPIAPSLPTPVPHNE

SEQ ID NO: 221330 - protein, 26 aa, Mycobacterium bovis
PLPPTVGITLHLPFDGILVPPHPVTA

SEQ ID NO: 221331 - protein, 20 aa, Mycobacterium bovis
PLQWDCFLFGIIQSDDHFTF

SEQ ID NO: 221332 - protein, 17 aa, Mycobacterium bovis
PLRMLRAARFVSQLGFA

SEQ ID NO: 221333 - protein, 22 aa, Mycobacterium bovis
PLRPASPRLRSSRRHSLRYSAY

SEQ ID NO: 221334 - protein, 17 aa, Mycobacterium bovis
PLSLGRLDRGWVVASET

SEQ ID NO: 221335 - protein, 26 aa, Mycobacterium bovis
PLSPQHVVSLVQFLASPAAAEVNGQV

SEQ ID NO: 221336 - protein, 21 aa, Mycobacterium bovis
PLTGSLLIGGAGRVVEPLRAA

SEQ ID NO: 221337 - protein, 22 aa, Mycobacterium bovis
PLTTILDPSLPLTVTEWDEWGN

SEQ ID NO: 221338 - protein, 17 aa, Mycobacterium bovis
PLVAVAAILAPLMQDAE

SEQ ID NO: 221339 - protein, 23 aa, Mycobacterium bovis
PLVGRLLMYEALDATYHQIRIAK

SEQ ID NO: 221340 - protein, 33 aa, Mycobacterium bovis
PLVVLLHGFPESWYSWRHQIPALAGAGYRVVAI

SEQ ID NO: 221341 - protein, 17 aa, Mycobacterium bovis
PLYCCANGKALLAALPP

SEQ ID NO: 221342 - protein, 29 aa, Mycobacterium bovis
PMGSEAMALLRLPLVLPAVQIAGRIVGKA

SEQ ID NO: 221343 - protein, 17 aa, Mycobacterium bovis
PMHRYYSTIKDLTRLLG

SEQ ID NO: 221344 - protein, 18 aa, Mycobacterium bovis
PMHYFPPRSHRFTRSALD

SEQ ID NO: 221345 - protein, 17 aa, Mycobacterium bovis
PMMFDRSYFLEPDSKSS

SEQ ID NO: 221346 - protein, 28 aa, Mycobacterium bovis
PMMPVIADQPIITAIKPAARPAPHFCDV

SEQ ID NO: 221347 - protein, 24 aa, Mycobacterium bovis
PMSARFRSLPAGDSVLYCGNDKYG

SEQ ID NO: 221348 - protein, 17 aa, Mycobacterium bovis
PMVGAELPGDPLALIAP

SEQ ID NO: 221349 - protein, 24 aa, Mycobacterium bovis
PNAHILPVPMMNILNGGAHADTAV

SEQ ID NO: 221350 - protein, 26 aa, Mycobacterium bovis
PNDQVALFLRHLWSAGGSVRWDPTNG

SEQ ID NO: 221351 - protein, 23 aa, Mycobacterium bovis
PNGPAQQALLAKALTSSKLTAAD

SEQ ID NO: 221352 - protein, 24 aa, Mycobacterium bovis
PNGYTCHFVRPGWRLPRRTAESAL

SEQ ID NO: 221353 - protein, 24 aa, Mycobacterium bovis
PNIQQRTYYLPSEGRRIRLRVSTK

SEQ ID NO: 221354 - protein, 34 aa, Mycobacterium bovis
PNLLFVNAGMVQFVPFFLGQRTPPYPTATSIQKC

SEQ ID NO: 221355 - protein, 26 aa, Mycobacterium bovis
PNRIEGWMPFGRVFETLAWGRRHVVM

SEQ ID NO: 221356 - protein, 35 aa, Mycobacterium bovis
PNRTARIALLHYLDGEKRYIIAPNGLSQGDVVESG

SEQ ID NO: 221357 - protein, 30 aa, Mycobacterium bovis
PNSTVCSYLNKLLWILTGNFAKKGGQHLHS

SEQ ID NO: 221358 - protein, 22 aa, Mycobacterium bovis
PNVLLILLDDVGFGASSAFGGP

SEQ ID NO: 221359 - protein, 25 aa, Mycobacterium bovis
PPAAAPAGPLPAYGADLRPPVTTPP

SEQ ID NO: 221360 - protein, 25 aa, Mycobacterium bovis
PPAAPPVAEPPPPVAAPAPPGAPEP

SEQ ID NO: 221361 - protein, 17 aa, Mycobacterium bovis
PPALFIGGQYDVGTIWG

SEQ ID NO: 221362 - protein, 18 aa, Mycobacterium bovis
PPALRRLVLEGQAAVQRS

SEQ ID NO: 221363 - protein, 17 aa, Mycobacterium bovis
PPASTIKVLLALVALDE

SEQ ID NO: 221364 - protein, 24 aa, Mycobacterium bovis
PPDPDDAISWLYGGARLLVDAVEQ

SEQ ID NO: 221365 - protein, 39 aa, Mycobacterium bovis
PPETNSLRMYLGAGSRPLLAAAGAWDGLAEELHAAASSF

SEQ ID NO: 221366 - protein, 24 aa, Mycobacterium bovis
PPFAWREYLLQCWFVARVSTLPGV

SEQ ID NO: 221367 - protein, 18 aa, Mycobacterium bovis
PPFDLPTVVIDRIPVELH

SEQ ID NO: 221368 - protein, 17 aa, Mycobacterium bovis
PPGVRRPAGIPADAPVI

SEQ ID NO: 221369 - protein, 25 aa, Mycobacterium bovis
PPLPGQWPFVRGGDPLRDVHSGWKV

SEQ ID NO: 221370 - protein, 19 aa, Mycobacterium bovis
PPLSGGMVGFFAYDMVRRL

SEQ ID NO: 221371 - protein, 27 aa, Mycobacterium bovis
PPPSEGWRRLLYLLSGRLINAGEGPRA

SEQ ID NO: 221372 - protein, 17 aa, Mycobacterium bovis
PPRPLTHDLIRDLIAAL

SEQ ID NO: 221373 - protein, 19 aa, Mycobacterium bovis
PPSALLEALMRHYERTRSP

SEQ ID NO: 221374 - protein, 25 aa, Mycobacterium bovis
PPSQANFVWLPLGSRTQDFVEQAAD

SEQ ID NO: 221375 - protein, 25 aa, Mycobacterium bovis
PPTDTRAYFRGECLRRFGADIAAAS

SEQ ID NO: 221376 - protein, 20 aa, Mycobacterium bovis
PPTIPIISTTYADLGISLGS

SEQ ID NO: 221377 - protein, 22 aa, Mycobacterium bovis
PPTLDTAAWLGAAGFIDVGIKR

SEQ ID NO: 221378 - protein, 22 aa, Mycobacterium bovis
PPTLEELFLRHYSLGPEVAAEQ

SEQ ID NO: 221379 - protein, 17 aa, Mycobacterium bovis
PPVLTYRCPTQDGPLTA

SEQ ID NO: 221380 - protein, 20 aa, Mycobacterium bovis
PPVPLDAAILFAPVGDLVLP

SEQ ID NO: 221381 - protein, 24 aa, Mycobacterium bovis
PQAACDGPRFRWVNGMRVSFENGF

SEQ ID NO: 221382 - protein, 26 aa, Mycobacterium bovis
PQAGLLLVHHPLLLRGVDTVAANTPK

SEQ ID NO: 221383 - protein, 27 aa, Mycobacterium bovis
PQAIDPVLLDLLRLGTYQLLRTRVDAH

SEQ ID NO: 221384 - protein, 31 aa, Mycobacterium bovis
PQAIFDHGTPLALYHTKRLASPAQRIMLFAN

SEQ ID NO: 221385 - protein, 32 aa, Mycobacterium bovis
PQAIFDHGTPLALYHTKRLASPAQRIMLFAND

SEQ ID NO: 221386 - protein, 33 aa, Mycobacterium bovis
PQAPNAFAPLFKHYRHIYLRPFRYYVAYRTTDE

SEQ ID NO: 221387 - protein, 20 aa, Mycobacterium bovis
PQARYILPSFIEHSSFGVKE

SEQ ID NO: 221388 - protein, 25 aa, Mycobacterium bovis
PQATQAIPAYEPEPGKPAPAAVSAG

SEQ ID NO: 221389 - protein, 19 aa, Mycobacterium bovis
PQDPEALRRRTLITAAQYL

SEQ ID NO: 221390 - protein, 23 aa, Mycobacterium bovis
PQDRLDFILADCDAKLVLRTPVR

SEQ ID NO: 221391 - protein, 19 aa, Mycobacterium bovis
PQEARPRWRRMANGLLHSK

SEQ ID NO: 221392 - protein, 21 aa, Mycobacterium bovis
PQELHELLTLPFRSASEFIDA

SEQ ID NO: 221393 - protein, 26 aa, Mycobacterium bovis
PQEPPPDPVPFPPYQPKVWAACRARG

SEQ ID NO: 221394 - protein, 19 aa, Mycobacterium bovis
PQILGRLTDNRDLARGQAA

SEQ ID NO: 221395 - protein, 22 aa, Mycobacterium bovis
PQITAMLRRLGIEGDFKGGFRV

SEQ ID NO: 221396 - protein, 17 aa, Mycobacterium bovis
PQLIASHTAFAAKAGLM

SEQ ID NO: 221397 - protein, 17 aa, Mycobacterium bovis
PQLSIPAITTPAFTIDP

SEQ ID NO: 221398 - protein, 32 aa, Mycobacterium bovis
PQPSSTPPPPPPLPPVPFPKECPAPGVMQGCL

SEQ ID NO: 221399 - protein, 21 aa, Mycobacterium bovis
PQQRVGLRVAWRTLENSGINP

SEQ ID NO: 221400 - protein, 36 aa, Mycobacterium bovis
PQRWIDYLHRWDPARWPLPVLPSSRSGPAPQSLSEL

SEQ ID NO: 221401 - protein, 19 aa, Mycobacterium bovis
PQVDKGVKWDPAELGPVVS

SEQ ID NO: 221402 - protein, 17 aa, Mycobacterium bovis
PQWHLRMQAAVQRHVEA

SEQ ID NO: 221403 - protein, 35 aa, Mycobacterium bovis
PRADRYRMYPLVRRLLFLIPPEHAHKLVFAVLRGV

SEQ ID NO: 221404 - protein, 18 aa, Mycobacterium bovis
PRARARFLAITGGGGFLL

SEQ ID NO: 221405 - protein, 20 aa, Mycobacterium bovis
PRAVRLPRALAAAGVPVAPP

SEQ ID NO: 221406 - protein, 22 aa, Mycobacterium bovis
PRDPLLRLSNFFDDGSVELLHE

SEQ ID NO: 221407 - protein, 25 aa, Mycobacterium bovis
PRELHVVNVLPRRGIGKVDRAALVR

SEQ ID NO: 221408 - protein, 19 aa, Mycobacterium bovis
PREWRRRKPYSWLRQVLPD

SEQ ID NO: 221409 - protein, 24 aa, Mycobacterium bovis
PRGALLQIAVGERPPLARVLGGPS

SEQ ID NO: 221410 - protein, 24 aa, Mycobacterium bovis
PRGDGLALALSYAKAIGGTRAGVI

SEQ ID NO: 221411 - protein, 26 aa, Mycobacterium bovis
PRGGRRLFVFLGSTIGNLTPGPRAQF

SEQ ID NO: 221412 - protein, 18 aa, Mycobacterium bovis
PRGYRAMAGIPRLQFAHA

SEQ ID NO: 221413 - protein, 25 aa, Mycobacterium bovis
PRHTLWAAWQRSGLQRRWLAASEHG

SEQ ID NO: 221414 - protein, 24 aa, Mycobacterium bovis
PRIAGMGFDVVYLPPIHPIGKVHR

SEQ ID NO: 221415 - protein, 22 aa, Mycobacterium bovis
PRKRPYHTIIPGFVTRDGAPVM

SEQ ID NO: 221416 - protein, 26 aa, Mycobacterium bovis
PRNLKTELWMLMSPTMIARGVKGTNA

SEQ ID NO: 221417 - protein, 28 aa, Mycobacterium bovis
PRNQAPLSFPIPGWNICVDFPIKDGLGK

SEQ ID NO: 221418 - protein, 21 aa, Mycobacterium bovis
PRQLIEHLGVCGVFDAKWATD

SEQ ID NO: 221419 - protein, 23 aa, Mycobacterium bovis
PRRMRKMFLSLIQRQLPEGYDVR

SEQ ID NO: 221420 - protein, 22 aa, Mycobacterium bovis
PRSDILAFALPGFATGEHTKNN

SEQ ID NO: 221421 - protein, 19 aa, Mycobacterium bovis
PRTMKEGWIVYARSTTIQA

SEQ ID NO: 221422 - protein, 19 aa, Mycobacterium bovis
PRVEVEVGFILAADLPGAG

SEQ ID NO: 221423 - protein, 18 aa, Mycobacterium bovis
PRVIFLHGGGQNAHTWDT

SEQ ID NO: 221424 - protein, 24 aa, Mycobacterium bovis
PRVVRLYRRRIAPGGFRYGPAFGV

SEQ ID NO: 221425 - protein, 18 aa, Mycobacterium bovis
PRWAKLVEMLGPESDTLR

SEQ ID NO: 221426 - protein, 18 aa, Mycobacterium bovis
PRWQVTVSVVFDDWAAAV

SEQ ID NO: 221427 - protein, 18 aa, Mycobacterium bovis
PRYRIGCKRILNSSTYYP

SEQ ID NO: 221428 - protein, 23 aa, Mycobacterium bovis
PSADLILLYLIQHCPDLSVDAAA

SEQ ID NO: 221429 - protein, 27 aa, Mycobacterium bovis
PSASFGTLWIKSPANMLGYWNNPERTA

SEQ ID NO: 221430 - protein, 29 aa, Mycobacterium bovis
PSAWIAEGLLIYLPATAQERLFTGIDALA

SEQ ID NO: 221431 - protein, 23 aa, Mycobacterium bovis
PSAWSVEGLLPYLTGDAQYALFA

SEQ ID NO: 221432 - protein, 20 aa, Mycobacterium bovis
PSFAHVVRAVHRCLLAGRFA

SEQ ID NO: 221433 - protein, 19 aa, Mycobacterium bovis
PSFLKVLAGMHNEIVGDIK

SEQ ID NO: 221434 - protein, 25 aa, Mycobacterium bovis
PSGNVEYFLWLRTQTDRALSAKGLE

SEQ ID NO: 221435 - protein, 18 aa, Mycobacterium bovis
PSHLFPAELAKRAKTLSE

SEQ ID NO: 221436 - protein, 18 aa, Mycobacterium bovis
PSIQFPAIPLDLSATGHI

SEQ ID NO: 221437 - protein, 26 aa, Mycobacterium bovis
PSKPCAWLAEGLVRYLPARAQDLLFE

SEQ ID NO: 221438 - protein, 24 aa, Mycobacterium bovis
PSLAWAETYPGTLSYYLASAFGEV

SEQ ID NO: 221439 - protein, 28 aa, Mycobacterium bovis
PSPLVERVPGMRAKLFDAARLAASAIGY

SEQ ID NO: 221440 - protein, 32 aa, Mycobacterium bovis
PSQIVESVPMYKLRRYFPPDNRPGQPPVGPPV

SEQ ID NO: 221441 - protein, 23 aa, Mycobacterium bovis
PSQWSWRPWSLTVDVEPGPLGIT

SEQ ID NO: 221442 - protein, 33 aa, Mycobacterium bovis
PSRCAEDLFAGWWRLIEALGAVPRVLVWDGEGA

SEQ ID NO: 221443 - protein, 23 aa, Mycobacterium bovis
PSRGVWQFIAPTFAAITSRARRP

SEQ ID NO: 221444 - protein, 19 aa, Mycobacterium bovis
PSRIIVTMRGDPYADRPRL

SEQ ID NO: 221445 - protein, 20 aa, Mycobacterium bovis
PSRRRAWFDNYLTTATQSVI

SEQ ID NO: 221446 - protein, 21 aa, Mycobacterium bovis
PSSGFLNWGAGSASGLLNFGN

SEQ ID NO: 221447 - protein, 18 aa, Mycobacterium bovis
PSVLLGRRDGLSRVDEFE

SEQ ID NO: 221448 - protein, 25 aa, Mycobacterium bovis
PSVRELAVFWTARSIGCSWCVDFGA

SEQ ID NO: 221449 - protein, 25 aa, Mycobacterium bovis
PSYSALSSRQWALAGLTPLRHWRSA

SEQ ID NO: 221450 - protein, 22 aa, Mycobacterium bovis
PTACILCECNCGIVVQVDDRRL

SEQ ID NO: 221451 - protein, 23 aa, Mycobacterium bovis
PTAHAEILAMRLAAGVLGDGWRL

SEQ ID NO: 221452 - protein, 26 aa, Mycobacterium bovis
PTAWLAEGLLIYLKPQTQDRLFDNIT

SEQ ID NO: 221453 - protein, 19 aa, Mycobacterium bovis
PTEFRPLRWDPNAADYRKP

SEQ ID NO: 221454 - protein, 23 aa, Mycobacterium bovis
PTELTATLRDYFAGRDPEQSFSA

SEQ ID NO: 221455 - protein, 26 aa, Mycobacterium bovis
PTEPNALVFPSYRGGHLPIEEYRRAF

SEQ ID NO: 221456 - protein, 24 aa, Mycobacterium bovis
PTGDAELLLIGWGSSYGPIGEACR

SEQ ID NO: 221457 - protein, 20 aa, Mycobacterium bovis
PTGIPLPPPSMLTPPIRCRS

SEQ ID NO: 221458 - protein, 20 aa, Mycobacterium bovis
PTGLLDHLAALFGAPKTALL

SEQ ID NO: 221459 - protein, 26 aa, Mycobacterium bovis
PTGSGKTLAAFLWALDSLAGSEPMSE

SEQ ID NO: 221460 - protein, 20 aa, Mycobacterium bovis
PTIAVLYYRAQHLAGNTGYV

SEQ ID NO: 221461 - protein, 22 aa, Mycobacterium bovis
PTIPPVLVRPEVMVGTGFLGAH

SEQ ID NO: 221462 - protein, 32 aa, Mycobacterium bovis
PTITARFPKFDWPRIDAPYMRPGLDEPAMAAL

SEQ ID NO: 221463 - protein, 26 aa, Mycobacterium bovis
PTLDYVVVKAPRFAFEKFPGADPTLT

SEQ ID NO: 221464 - protein, 19 aa, Mycobacterium bovis
PTLYIFPHAGGTAKDYVAF

SEQ ID NO: 221465 - protein, 25 aa, Mycobacterium bovis
PTMYVNQPWTIRQYAGFSTAADSNA

SEQ ID NO: 221466 - protein, 19 aa, Mycobacterium bovis
PTNRHPWPAPARCCRHEWR

SEQ ID NO: 221467 - protein, 30 aa, Mycobacterium bovis
PTPDMRLDMPLVDFFSHGGALKSSWYGDCL

SEQ ID NO: 221468 - protein, 23 aa, Mycobacterium bovis
PTPLLDFIAPKVAGLSFSGLLGA

SEQ ID NO: 221469 - protein, 26 aa, Mycobacterium bovis
PTPSANSIAWLLWHSARVQDIQVAHV

SEQ ID NO: 221470 - protein, 20 aa, Mycobacterium bovis
PTQYDTLRRALYTTLRDYLG

SEQ ID NO: 221471 - protein, 19 aa, Mycobacterium bovis
PTRGAPLCGFRQTSRILAG

SEQ ID NO: 221472 - protein, 21 aa, Mycobacterium bovis
PTRRGNWWYYARTFEGKQYGV

SEQ ID NO: 221473 - protein, 29 aa, Mycobacterium bovis
PTRRVRLMRWGLIPSWIKAGPGGAPDAKG

SEQ ID NO: 221474 - protein, 19 aa, Mycobacterium bovis
PTRVPFTRGLHEVADRVWA

SEQ ID NO: 221475 - protein, 55 aa, Mycobacterium bovis
PTTLHFPGFTIPTGPIHIGLPLSLTIPGFTIPGGTLIPQLPLGLGLSGGTPPFDL

SEQ ID NO: 221476 - protein, 18 aa, Mycobacterium bovis
PTVADWVRWISGDGTKPE

SEQ ID NO: 221477 - protein, 22 aa, Mycobacterium bovis
PTVDFPVFPDYGEDVYYSVSSV

SEQ ID NO: 221478 - protein, 26 aa, Mycobacterium bovis
PTVTTPQMFTYRLLQQARSDLMRIVL

SEQ ID NO: 221479 - protein, 19 aa, Mycobacterium bovis
PTYGFARQRFWLGDNGELS

SEQ ID NO: 221480 - protein, 22 aa, Mycobacterium bovis
PTYLYRYDYAPRTLRWSGFGAT

SEQ ID NO: 221481 - protein, 37 aa, Mycobacterium bovis
PVAEAIAYLLEILPALSYLHSIGLVYNDLKPENIMLT

SEQ ID NO: 221482 - protein, 33 aa, Mycobacterium bovis
PVAELRAMLLERLPRYLVPHHIVVLDELPLTPH

SEQ ID NO: 221483 - protein, 18 aa, Mycobacterium bovis
PVAITPRRYRCYTDRLTR

SEQ ID NO: 221484 - protein, 17 aa, Mycobacterium bovis
PVANWPALGGMGNASWT

SEQ ID NO: 221485 - protein, 24 aa, Mycobacterium bovis
PVAVLRELVLLYDAGRREPLPLPL

SEQ ID NO: 221486 - protein, 30 aa, Mycobacterium bovis
PVAVRAHLAPFLPGHPFAPELPKGYPVSSA

SEQ ID NO: 221487 - protein, 20 aa, Mycobacterium bovis
PVAWIHGTALRTEPLAFAGR

SEQ ID NO: 221488 - protein, 21 aa, Mycobacterium bovis
PVDCPSYAEVMLWHADLAAEV

SEQ ID NO: 221489 - protein, 19 aa, Mycobacterium bovis
PVDPLPRRRADLDNGVFEH

SEQ ID NO: 221490 - protein, 26 aa, Mycobacterium bovis
PVDVRVRRWIEAMPQYGPGHADVVAE

SEQ ID NO: 221491 - protein, 20 aa, Mycobacterium bovis
PVEGGLLISFDRMNKVLEVD

SEQ ID NO: 221492 - protein, 29 aa, Mycobacterium bovis
PVGEEWLYQSWAAAYLPLLQVLAALADEN

SEQ ID NO: 221493 - protein, 25 aa, Mycobacterium bovis
PVGGFPVTFGWIHASRRGHARLHRG

SEQ ID NO: 221494 - protein, 26 aa, Mycobacterium bovis
PVGILCLEFLVHAWDFAIATGSQVIA

SEQ ID NO: 221495 - protein, 19 aa, Mycobacterium bovis
PVHFVQMWVIPDATGITAS

SEQ ID NO: 221496 - protein, 18 aa, Mycobacterium bovis
PVHLVALSRFPEPSSAVE

SEQ ID NO: 221497 - protein, 33 aa, Mycobacterium bovis
PVIGIDPAAVSPWWLQRRLLLCGIRATCPAVDV

SEQ ID NO: 221498 - protein, 25 aa, Mycobacterium bovis
PVIVEPHRVLTLPLVRAGQPVADTS

SEQ ID NO: 221499 - protein, 26 aa, Mycobacterium bovis
PVKLEEPIQIPPPGTGAPEVHRWWTS

SEQ ID NO: 221500 - protein, 28 aa, Mycobacterium bovis
PVLAVGSYLPHAPWPWGVIDQAARVLLP

SEQ ID NO: 221501 - protein, 25 aa, Mycobacterium bovis
PVLDRYDYVLIDCQPSLGLLTVNGL

SEQ ID NO: 221502 - protein, 20 aa, Mycobacterium bovis
PVLELLTSWRNPPQALRVAN

SEQ ID NO: 221503 - protein, 19 aa, Mycobacterium bovis
PVLEPLVAVHREIYPKADL

SEQ ID NO: 221504 - protein, 17 aa, Mycobacterium bovis
PVLGVSVITAVLRGFGE

SEQ ID NO: 221505 - protein, 21 aa, Mycobacterium bovis
PVLKMLLDTFPVTFTAADGVE

SEQ ID NO: 221506 - protein, 22 aa, Mycobacterium bovis
PVLLAWVTPIVTALADVVPAEQ

SEQ ID NO: 221507 - protein, 28 aa, Mycobacterium bovis
PVNFVPVIDQDVRRWWRSDSLWQAHDAR

SEQ ID NO: 221508 - protein, 26 aa, Mycobacterium bovis
PVNRWLMEQLIMIDALKRGSAKRITA

SEQ ID NO: 221509 - protein, 18 aa, Mycobacterium bovis
PVPEPMVKMLLNNVLEHL

SEQ ID NO: 221510 - protein, 34 aa, Mycobacterium bovis
PVPTEVRLRLLDTLDLFGIALGMAAFRPGRPSRT

SEQ ID NO: 221511 - protein, 22 aa, Mycobacterium bovis
PVPVPIHHLLYDGSFAVAVPVD

SEQ ID NO: 221512 - protein, 19 aa, Mycobacterium bovis
PVREPVRSLVWIRGCLHQI

SEQ ID NO: 221513 - protein, 25 aa, Mycobacterium bovis
PVRRQFYWHRFFSHQPDLNYDNPAV

SEQ ID NO: 221514 - protein, 20 aa, Mycobacterium bovis
PVRWIETQDLLFIEEAAGGL

SEQ ID NO: 221515 - protein, 35 aa, Mycobacterium bovis
PVSALVVFEVMVRPLIRLSLGKRHPMRRIVSARTL

SEQ ID NO: 221516 - protein, 27 aa, Mycobacterium bovis
PVSGAALFVLDSWLRPVPAGVAGELYI

SEQ ID NO: 221517 - protein, 25 aa, Mycobacterium bovis
PVTAAFLSIHNMCAWMIDSFGTDEQ

SEQ ID NO: 221518 - protein, 20 aa, Mycobacterium bovis
PVTGLVFVTNFDSNTVSVID

SEQ ID NO: 221519 - protein, 26 aa, Mycobacterium bovis
PVTIPGFAINPFGLNVPLSGGTSPVT

SEQ ID NO: 221520 - protein, 21 aa, Mycobacterium bovis
PVTVDARRIGRWRFVTLHHQV

SEQ ID NO: 221521 - protein, 20 aa, Mycobacterium bovis
PVVEQALVKVPYMPTDLPAW

SEQ ID NO: 221522 - protein, 21 aa, Mycobacterium bovis
PVVRDPLSRLPMIPGTSLKGK

SEQ ID NO: 221523 - protein, 18 aa, Mycobacterium bovis
PVVVIKNLTFDSSVAQGA

SEQ ID NO: 221524 - protein, 17 aa, Mycobacterium bovis
PVWASLIALLEDGVPSV

SEQ ID NO: 221525 - protein, 21 aa, Mycobacterium bovis
PVWRARCIVSAPWMGLAGVPS

SEQ ID NO: 221526 - protein, 17 aa, Mycobacterium bovis
PVWTERGGPATIVPMFL

SEQ ID NO: 221527 - protein, 17 aa, Mycobacterium bovis
PVYSYARPLFLALPESA

SEQ ID NO: 221528 - protein, 17 aa, Mycobacterium bovis
PWDTLADAKALAGAHPD

SEQ ID NO: 221529 - protein, 28 aa, Mycobacterium bovis
PWGGSYYVEWLTHRLARRARAHIAEVAE

SEQ ID NO: 221530 - protein, 18 aa, Mycobacterium bovis
PWHERAKRLAPKGTGAVL

SEQ ID NO: 221531 - protein, 23 aa, Mycobacterium bovis
PWMRGDGLGSQRRKFGFYDDDRE

SEQ ID NO: 221532 - protein, 20 aa, Mycobacterium bovis
PWRDIPDIWQWGITDADLES

SEQ ID NO: 221533 - protein, 34 aa, Mycobacterium bovis
PYCALACAELLYRAGLPRALYAIVPGPGSVVGTA

SEQ ID NO: 221534 - protein, 17 aa, Mycobacterium bovis
PYESAEVLAWRQRSLTG

SEQ ID NO: 221535 - protein, 20 aa, Mycobacterium bovis
PYGVRPLSLGRLDRGWVVAS

SEQ ID NO: 221536 - protein, 17 aa, Mycobacterium bovis
PYLLIRNHKNRPVLAIN

SEQ ID NO: 221537 - protein, 18 aa, Mycobacterium bovis
PYLSQVERGLRKPSADVL

SEQ ID NO: 221538 - protein, 28 aa, Mycobacterium bovis
PYPELATTTLLRPVKPPPSEGWRRLLYL

SEQ ID NO: 221539 - protein, 24 aa, Mycobacterium bovis
PYRAAEIGLLVLATSTGFIAPGVD

SEQ ID NO: 221540 - protein, 24 aa, Mycobacterium bovis
PYRANMWALRALGVRRVFGPCAVG

SEQ ID NO: 221541 - protein, 17 aa, Mycobacterium bovis
PYRPPDAARRHNGGKPR

SEQ ID NO: 221542 - protein, 28 aa, Mycobacterium bovis
PYRVGYFRFELDAGLWLLATGSESELGL

SEQ ID NO: 221543 - protein, 18 aa, Mycobacterium bovis
PYSARELIARIRAVLRRG

SEQ ID NO: 221544 - protein, 20 aa, Mycobacterium bovis
PYSLLMGSIRVADEVSVAFT

SEQ ID NO: 221545 - protein, 18 aa, Mycobacterium bovis
PYVLPRLVPVAGDSAGGV

SEQ ID NO: 221546 - protein, 34 aa, Mycobacterium bovis
PYVWGSIYRFNGQTSVFWPGRGPCYRCLHPAPPP

SEQ ID NO: 221547 - protein, 21 aa, Mycobacterium bovis
QAAIVPPRDLVFAFVADEEHG

SEQ ID NO: 221548 - protein, 19 aa, Mycobacterium bovis
QAALGFLLDNGCHHLQLIV

SEQ ID NO: 221549 - protein, 25 aa, Mycobacterium bovis
QAASAFAMWFPIEGGSKYGGYGRAK

SEQ ID NO: 221550 - protein, 23 aa, Mycobacterium bovis
QAAVDLSTIRRKAAKRLAKEVSA

SEQ ID NO: 221551 - protein, 22 aa, Mycobacterium bovis
QADLGLTYLFISHDLAVIRQIA

SEQ ID NO: 221552 - protein, 24 aa, Mycobacterium bovis
QADYRAVLAAVNPPGANQREIATT

SEQ ID NO: 221553 - protein, 21 aa, Mycobacterium bovis
QAEALVPQLLAFGATDVYAAD

SEQ ID NO: 221554 - protein, 34 aa, Mycobacterium bovis
QAEAYRAISLLLRRPPGREAYPGDVFYLHSRLLE

SEQ ID NO: 221555 - protein, 17 aa, Mycobacterium bovis
QAFVQWRAQSRSELTEV

SEQ ID NO: 221556 - protein, 23 aa, Mycobacterium bovis
QAGAISALRWGGSAPRVIFLHGG

SEQ ID NO: 221557 - protein, 34 aa, Mycobacterium bovis
QAGIYGKLAWEKTIPNWFFEPDIAADIVGNLLFG

SEQ ID NO: 221558 - protein, 22 aa, Mycobacterium bovis
QAGLIAVPLPVPQFGIHDERIS

SEQ ID NO: 221559 - protein, 24 aa, Mycobacterium bovis
QAGLRTDYLFRIANQRGGIVLGTG

SEQ ID NO: 221560 - protein, 23 aa, Mycobacterium bovis
QAGRLLAHLTADDGLTALDVGWS

SEQ ID NO: 221561 - protein, 21 aa, Mycobacterium bovis
QAHALARHFGARRKAYNWTVA

SEQ ID NO: 221562 - protein, 24 aa, Mycobacterium bovis
QAKALARHFGARRKAYNWTVATLK

SEQ ID NO: 221563 - protein, 21 aa, Mycobacterium bovis
QALAIITFSTVVHGWDLAVAT

SEQ ID NO: 221564 - protein, 32 aa, Mycobacterium bovis
QALARTVYGHLPGYALPLFVRVVGSLAHTTTF

SEQ ID NO: 221565 - protein, 20 aa, Mycobacterium bovis
QALGDKRGIRRFGDAFIPMD

SEQ ID NO: 221566 - protein, 17 aa, Mycobacterium bovis
QALLFGNGGLGGAGGAG

SEQ ID NO: 221567 - protein, 22 aa, Mycobacterium bovis
QALRGLLKPIYEENQLGRAEIR

SEQ ID NO: 221568 - protein, 28 aa, Mycobacterium bovis
QALSAQAALFHEQFVRALTAGAGSYAAA

SEQ ID NO: 221569 - protein, 19 aa, Mycobacterium bovis
QALTFHAAAYRQLRYFWSR

SEQ ID NO: 221570 - protein, 17 aa, Mycobacterium bovis
QAMGFLDAALLADRPVV

SEQ ID NO: 221571 - protein, 28 aa, Mycobacterium bovis
QAMKSLHLILSHFQMPGFQVPEFRRKAV

SEQ ID NO: 221572 - protein, 19 aa, Mycobacterium bovis
QAMRHGVMPATLHVDEPSP

SEQ ID NO: 221573 - protein, 23 aa, Mycobacterium bovis
QANHLIAGLIAAGAIDVGIACGI

SEQ ID NO: 221574 - protein, 22 aa, Mycobacterium bovis
QANSWQSLAGIGPKTAKVIAQA

SEQ ID NO: 221575 - protein, 17 aa, Mycobacterium bovis
QARAALDALPYLIDNRY

SEQ ID NO: 221576 - protein, 24 aa, Mycobacterium bovis
QARALARHFGARRKAYNWAVATLK

SEQ ID NO: 221577 - protein, 23 aa, Mycobacterium bovis
QARALARHFGARRKAYNWTVATL

SEQ ID NO: 221578 - protein, 25 aa, Mycobacterium bovis
QAREELPYLPDRQPRRALATLIDHA

SEQ ID NO: 221579 - protein, 27 aa, Mycobacterium bovis
QAREKLFPLICRYAVAYHVVFIPSAEV

SEQ ID NO: 221580 - protein, 21 aa, Mycobacterium bovis
QASLMRIPAPASNTTGLTETS

SEQ ID NO: 221581 - protein, 28 aa, Mycobacterium bovis
QASPPDMKLPISLALGWPRRVSGAAAAC

SEQ ID NO: 221582 - protein, 37 aa, Mycobacterium bovis
QATARPPTFVLFTTGFLEAGYRRFLERRLRETFGFDG

SEQ ID NO: 221583 - protein, 20 aa, Mycobacterium bovis
QATFPVDRMLARLSSTVAVV

SEQ ID NO: 221584 - protein, 26 aa, Mycobacterium bovis
QATGARIAFLIRFGTGVLPEPKTVLQ

SEQ ID NO: 221585 - protein, 25 aa, Mycobacterium bovis
QATIPIVYAVSRIVEVPYAEIVASV

SEQ ID NO: 221586 - protein, 23 aa, Mycobacterium bovis
QATLAQLPPGILSDILSALAANA

SEQ ID NO: 221587 - protein, 23 aa, Mycobacterium bovis
QAVAASVWPMIAANRVRPVIGTR

SEQ ID NO: 221588 - protein, 37 aa, Mycobacterium bovis
QAVEQQVLGLINGPAQTLLGRPLIGNGADGAPGTGQP

SEQ ID NO: 221589 - protein, 26 aa, Mycobacterium bovis
QAVHTLPMLYALREQTPDTSRLRELL

SEQ ID NO: 221590 - protein, 26 aa, Mycobacterium bovis
QAVLAAFPEAAVVRTAWVYTGGTGKD

SEQ ID NO: 221591 - protein, 19 aa, Mycobacterium bovis
QAVPVTRLWLSKQQTSDLM

SEQ ID NO: 221592 - protein, 24 aa, Mycobacterium bovis
QAVTPAARALPLTSLTSAAERGPG

SEQ ID NO: 221593 - protein, 24 aa, Mycobacterium bovis
QAVTPAARALPLTSLTSAAQTAPG

SEQ ID NO: 221594 - protein, 25 aa, Mycobacterium bovis
QAVTPAARALPLTSLTSAAQTAPGH

SEQ ID NO: 221595 - protein, 17 aa, Mycobacterium bovis
QAVVELLRRGITARDIL

SEQ ID NO: 221596 - protein, 17 aa, Mycobacterium bovis
QAWIEDEFIPTVAKRGA

SEQ ID NO: 221597 - protein, 26 aa, Mycobacterium bovis
QAYDPVFFPGLAAEWSDRRPFVGPLT

SEQ ID NO: 221598 - protein, 24 aa, Mycobacterium bovis
QCAAGSLFVFDSTLWHAAGRNTSG

SEQ ID NO: 221599 - protein, 20 aa, Mycobacterium bovis
QCGRRMVVQVRPDGWWARCS

SEQ ID NO: 221600 - protein, 28 aa, Mycobacterium bovis
QDAFGDKVLPLYLPSGDGLIGLLSQALY

SEQ ID NO: 221601 - protein, 24 aa, Mycobacterium bovis
QDDLLGALTVIRPLSRSASDEVTV

SEQ ID NO: 221602 - protein, 18 aa, Mycobacterium bovis
QDFGPIQTLFTDAGLLDN

SEQ ID NO: 221603 - protein, 24 aa, Mycobacterium bovis
QDKLRLLLEFANELPALPSHLAES

SEQ ID NO: 221604 - protein, 26 aa, Mycobacterium bovis
QDLGIEVFLVMPFTTDFMKLTPDRFI

SEQ ID NO: 221605 - protein, 18 aa, Mycobacterium bovis
QDLPATSIAWGAWGQIGR

SEQ ID NO: 221606 - protein, 23 aa, Mycobacterium bovis
QDMVTLLRSGFAPVAFVMGNCVF

SEQ ID NO: 221607 - protein, 19 aa, Mycobacterium bovis
QDPQTFQRCKLNWAEAGSG

SEQ ID NO: 221608 - protein, 22 aa, Mycobacterium bovis
QDQVFDLLMPTAVEGSLSLDEL

SEQ ID NO: 221609 - protein, 19 aa, Mycobacterium bovis
QDRRKLLETLANATSLTVP

SEQ ID NO: 221610 - protein, 19 aa, Mycobacterium bovis
QDTFYIAPEDSRQLLRTHT

SEQ ID NO: 221611 - protein, 24 aa, Mycobacterium bovis
QDVLVDYGAFLRSLVDTSGLRPLR

SEQ ID NO: 221612 - protein, 18 aa, Mycobacterium bovis
QDYQLQLVPKMLRMLRPD

SEQ ID NO: 221613 - protein, 27 aa, Mycobacterium bovis
QEAVLEDPYILLVSSKVSTVKDLLPLL

SEQ ID NO: 221614 - protein, 26 aa, Mycobacterium bovis
QEDIYNPLRFLRAAMKWCRKAQELGT

SEQ ID NO: 221615 - protein, 17 aa, Mycobacterium bovis
QEDPWRHFARTHAIGQI

SEQ ID NO: 221616 - protein, 21 aa, Mycobacterium bovis
QEELRALKPWEGPRHFVLIDD

SEQ ID NO: 221617 - protein, 18 aa, Mycobacterium bovis
QEGFLVRPFTQQCQIIHT

SEQ ID NO: 221618 - protein, 22 aa, Mycobacterium bovis
QEGLDKVFQVLRAPHTEEPTNW

SEQ ID NO: 221619 - protein, 27 aa, Mycobacterium bovis
QEIMTELEIAPTRRLRGLGDRQRKALL

SEQ ID NO: 221620 - protein, 34 aa, Mycobacterium bovis
QEKIADSWIQIEQFRLLVLRTAWLIDKHHDYQKV

SEQ ID NO: 221621 - protein, 27 aa, Mycobacterium bovis
QELHANEIMLLAYYIAAVNIESTYHAL

SEQ ID NO: 221622 - protein, 20 aa, Mycobacterium bovis
QELPLIEEWLQFVGEKLPTG

SEQ ID NO: 221623 - protein, 24 aa, Mycobacterium bovis
QENVMNPATWSGAGVVASHMTATE

SEQ ID NO: 221624 - protein, 19 aa, Mycobacterium bovis
QEQLWGTLLASAAATRNPQ

SEQ ID NO: 221625 - protein, 24 aa, Mycobacterium bovis
QERARIMFMIGTLTPDRVTRDADA

SEQ ID NO: 221626 - protein, 26 aa, Mycobacterium bovis
QEWHYYFENTKRWRNLRKITIAQVHG

SEQ ID NO: 221627 - protein, 20 aa, Mycobacterium bovis
QFARIFYARPETRKFRVEFL

SEQ ID NO: 221628 - protein, 25 aa, Mycobacterium bovis
QFASASRWRIVSRYLPVGVAPEQGL

SEQ ID NO: 221629 - protein, 17 aa, Mycobacterium bovis
QFCYLQLSGKRSRRGQP

SEQ ID NO: 221630 - protein, 25 aa, Mycobacterium bovis
QFDHRTLSRVYGWMLDGVPVVAMHR

SEQ ID NO: 221631 - protein, 22 aa, Mycobacterium bovis
QFGPYQLLRLLGRGGMGEVYEA

SEQ ID NO: 221632 - protein, 18 aa, Mycobacterium bovis
QFLAALDREFGITSPRAH

SEQ ID NO: 221633 - protein, 18 aa, Mycobacterium bovis
QFRQELIPLLNDAYPPRA

SEQ ID NO: 221634 - protein, 24 aa, Mycobacterium bovis
QFRRFAACPICHLHLRSFANRHQE

SEQ ID NO: 221635 - protein, 18 aa, Mycobacterium bovis
QFRYYVRDAPIISDAEFD

SEQ ID NO: 221636 - protein, 18 aa, Mycobacterium bovis
QFTEFAELLVPHLAARFG

SEQ ID NO: 221637 - protein, 31 aa, Mycobacterium bovis
QFTGQRFFRIRGGQLYGQLRDVAYQSSTTDF

SEQ ID NO: 221638 - protein, 17 aa, Mycobacterium bovis
QFVAVRDGLLAAARQAG

SEQ ID NO: 221639 - protein, 25 aa, Mycobacterium bovis
QFWSQIHGFVMLELAGFYGDRGAAV

SEQ ID NO: 221640 - protein, 20 aa, Mycobacterium bovis
QFYAAMLAGLGLDAAELPPQ

SEQ ID NO: 221641 - protein, 27 aa, Mycobacterium bovis
QGALFDTPILVPPQAAMLGTGAIVKRP

SEQ ID NO: 221642 - protein, 38 aa, Mycobacterium bovis
QGAPFSFVLAPWQIHDWILLTPWGLLSWPQINQQLGIA

SEQ ID NO: 221643 - protein, 18 aa, Mycobacterium bovis
QGDFLIRGLLGADPTTGA

SEQ ID NO: 221644 - protein, 27 aa, Mycobacterium bovis
QGDPPYVAVPYLDRMELAYAAADLVIC

SEQ ID NO: 221645 - protein, 21 aa, Mycobacterium bovis
QGDPRRFFQMVYNERWARATE

SEQ ID NO: 221646 - protein, 30 aa, Mycobacterium bovis
QGELLKPFARRYFQAIPGVWARRSSEVAQS

SEQ ID NO: 221647 - protein, 31 aa, Mycobacterium bovis
QGGGNPCLLTPPPWYPILRGTTQQALFEVAR

SEQ ID NO: 221648 - protein, 22 aa, Mycobacterium bovis
QGGGPHAWYLSDGILARDDYNG

SEQ ID NO: 221649 - protein, 19 aa, Mycobacterium bovis
QGGLLFGDGGNGGAGGAGG

SEQ ID NO: 221650 - protein, 20 aa, Mycobacterium bovis
QGGLLPIAYTQGIDFRPAKR

SEQ ID NO: 221651 - protein, 21 aa, Mycobacterium bovis
QGITDLITTPGLINVDFADVK

SEQ ID NO: 221652 - protein, 25 aa, Mycobacterium bovis
QGIVLLQNRGLLPLAPESAGRIAVI

SEQ ID NO: 221653 - protein, 27 aa, Mycobacterium bovis
QGLEYIIAFMGVLQAGLIAVPLPVPQF

SEQ ID NO: 221654 - protein, 18 aa, Mycobacterium bovis
QGLQDQVFDLLMPTAVEG

SEQ ID NO: 221655 - protein, 17 aa, Mycobacterium bovis
QGMADGGLLLPLGVRRL

SEQ ID NO: 221656 - protein, 17 aa, Mycobacterium bovis
QGRLMRDNATPQSPRHC

SEQ ID NO: 221657 - protein, 24 aa, Mycobacterium bovis
QGRNPFWDRLSRAMYRLARPTAAA

SEQ ID NO: 221658 - protein, 23 aa, Mycobacterium bovis
QGRPLQHRWPDRQLPGEGVTRGA

SEQ ID NO: 221659 - protein, 33 aa, Mycobacterium bovis
QGSKPVIGTVMRQGYQLGEQVLRHALVGVVDTV

SEQ ID NO: 221660 - protein, 22 aa, Mycobacterium bovis
QGVPFVLPNAWDVPSALAYLAE

SEQ ID NO: 221661 - protein, 17 aa, Mycobacterium bovis
QGWQWAVVVASYSGADH

SEQ ID NO: 221662 - protein, 22 aa, Mycobacterium bovis
QGWRHLPDWPPATTERAWYLQP

SEQ ID NO: 221663 - protein, 24 aa, Mycobacterium bovis
QGWVPVIGPFFHRGLMLLDFEEHM

SEQ ID NO: 221664 - protein, 26 aa, Mycobacterium bovis
QGYHMTTFGFILGEVFRRVTGRTVGQ

SEQ ID NO: 221665 - protein, 37 aa, Mycobacterium bovis
QGYQAAAAQVAAFHSRFVQALTAGAGAYAFAEAANAS

SEQ ID NO: 221666 - protein, 19 aa, Mycobacterium bovis
QHGHDVLWLACTHGDVIKA

SEQ ID NO: 221667 - protein, 20 aa, Mycobacterium bovis
QHGPAFQGIVGLAVTQAGVA

SEQ ID NO: 221668 - protein, 31 aa, Mycobacterium bovis
QHMDQMFITAPPYPPSILLTGIIVNKLGQRF

SEQ ID NO: 221669 - protein, 21 aa, Mycobacterium bovis
QHPLPEALVGDAARFLLEGMP

SEQ ID NO: 221670 - protein, 25 aa, Mycobacterium bovis
QHQMWAAQFIRYEKPRSWLNSGGLG

SEQ ID NO: 221671 - protein, 19 aa, Mycobacterium bovis
QHTVVVLNAIQKTRSLVDC

SEQ ID NO: 221672 - protein, 21 aa, Mycobacterium bovis
QIAIDLSVTTPFIPINEQMVI

SEQ ID NO: 221673 - protein, 30 aa, Mycobacterium bovis
QIARTGHMPVRRLDLIWISARNAARRELDL

SEQ ID NO: 221674 - protein, 17 aa, Mycobacterium bovis
QIAYYKDRNRHDPRRVM

SEQ ID NO: 221675 - protein, 27 aa, Mycobacterium bovis
QICASFDIPWLVIRALSDLAGADSGVD

SEQ ID NO: 221676 - protein, 19 aa, Mycobacterium bovis
QIDAVLWQSEAFTDRLRAA

SEQ ID NO: 221677 - protein, 25 aa, Mycobacterium bovis
QIDRGQGFLALVDYAHKPEALRSVL

SEQ ID NO: 221678 - protein, 23 aa, Mycobacterium bovis
QIEWSKVHLFWGDERYVPEDDDE

SEQ ID NO: 221679 - protein, 18 aa, Mycobacterium bovis
QIHPRVLRAIGDVGYESP

SEQ ID NO: 221680 - protein, 25 aa, Mycobacterium bovis
QIKEQMIHWWGPIIDEYYASSEASG

SEQ ID NO: 221681 - protein, 22 aa, Mycobacterium bovis
QIKLAVLVATNFFGINTIPIAI

SEQ ID NO: 221682 - protein, 22 aa, Mycobacterium bovis
QIKRFRILPTLWEPGGDEITLT

SEQ ID NO: 221683 - protein, 20 aa, Mycobacterium bovis
QILRALRINLTVRGYQVITA

SEQ ID NO: 221684 - protein, 25 aa, Mycobacterium bovis
QIRLGGDMALFAGLGRLLLEAEERV

SEQ ID NO: 221685 - protein, 17 aa, Mycobacterium bovis
QISEHVRRFSLGTNPMV

SEQ ID NO: 221686 - protein, 28 aa, Mycobacterium bovis
QITKHPIRVLTLAALAPRPGQRLWDVGA

SEQ ID NO: 221687 - protein, 29 aa, Mycobacterium bovis
QITSVLPGRPPLATYFLPNNRGKKSVTVD

SEQ ID NO: 221688 - protein, 22 aa, Mycobacterium bovis
QIVPGKVTKLVPFGAFVRVEEG

SEQ ID NO: 221689 - protein, 20 aa, Mycobacterium bovis
QIWMRPHAVPGLRRLTEAIH

SEQ ID NO: 221690 - protein, 19 aa, Mycobacterium bovis
QIYQMYRLLAVAKYEERYV

SEQ ID NO: 221691 - protein, 24 aa, Mycobacterium bovis
QKANLKLIVVDYLQLMTSGKKYES

SEQ ID NO: 221692 - protein, 24 aa, Mycobacterium bovis
QKISELYDRVGFAAAGKFNEFDNL

SEQ ID NO: 221693 - protein, 20 aa, Mycobacterium bovis
QKLLIGLLRDHGGQATVWDK

SEQ ID NO: 221694 - protein, 25 aa, Mycobacterium bovis
QKMTGAIIILIRLTNTVPSTVRLFP

SEQ ID NO: 221695 - protein, 25 aa, Mycobacterium bovis
QKQRIGIARALALQPKILALDEPVS

SEQ ID NO: 221696 - protein, 18 aa, Mycobacterium bovis
QKRLTEELAWVRSGAKAR

SEQ ID NO: 221697 - protein, 17 aa, Mycobacterium bovis
QKVFARTGGLHAAALFG

SEQ ID NO: 221698 - protein, 19 aa, Mycobacterium bovis
QLAALVDHTLLKPETTRAD

SEQ ID NO: 221699 - protein, 25 aa, Mycobacterium bovis
QLADEIFVIADLARQKARASQYTFM

SEQ ID NO: 221700 - protein, 26 aa, Mycobacterium bovis
QLAEVHPHWIVLRTVIDVINPIELPS

SEQ ID NO: 221701 - protein, 18 aa, Mycobacterium bovis
QLAFDERRLRQVLSALDC

SEQ ID NO: 221702 - protein, 18 aa, Mycobacterium bovis
QLAGFKRDDWSLPLAVLV

SEQ ID NO: 221703 - protein, 22 aa, Mycobacterium bovis
QLAGLARYPQPMAPAAAAEHAG

SEQ ID NO: 221704 - protein, 24 aa, Mycobacterium bovis
QLAKAMDRKVWLPSGGTLVIDRTE

SEQ ID NO: 221705 - protein, 18 aa, Mycobacterium bovis
QLAKRGYPEDIGNRVLDR

SEQ ID NO: 221706 - protein, 18 aa, Mycobacterium bovis
QLAPPDLLAWAHEGRRGY

SEQ ID NO: 221707 - protein, 25 aa, Mycobacterium bovis
QLAQRLPGYLVPAAVVVIDALPLTV

SEQ ID NO: 221708 - protein, 18 aa, Mycobacterium bovis
QLAWSLRNDPRVVVLERT

SEQ ID NO: 221709 - protein, 19 aa, Mycobacterium bovis
QLEEQYVFPKLEQAGKLTD

SEQ ID NO: 221710 - protein, 18 aa, Mycobacterium bovis
QLEFDAWARREPERKALL

SEQ ID NO: 221711 - protein, 21 aa, Mycobacterium bovis
QLELVVPILTAALTGAPDAGA

SEQ ID NO: 221712 - protein, 21 aa, Mycobacterium bovis
QLEMRLNRQLADIEKLQVNVR

SEQ ID NO: 221713 - protein, 20 aa, Mycobacterium bovis
QLGEFAVIDRLVRGRRQPAT

SEQ ID NO: 221714 - protein, 17 aa, Mycobacterium bovis
QLGFTLSGATPADAYPT

SEQ ID NO: 221715 - protein, 28 aa, Mycobacterium bovis
QLGKGGGRLPITLWIVDTNASTPAPAAN

SEQ ID NO: 221716 - protein, 26 aa, Mycobacterium bovis
QLGRAEIRALFRSSKVGLIAGCLVTS

SEQ ID NO: 221717 - protein, 17 aa, Mycobacterium bovis
QLGVRNVAIPRKSKPSA

SEQ ID NO: 221718 - protein, 26 aa, Mycobacterium bovis
QLHNQARLPYLVYLRHPTTGGVFASW

SEQ ID NO: 221719 - protein, 18 aa, Mycobacterium bovis
QLHRATADQPLDWFCSFS

SEQ ID NO: 221720 - protein, 32 aa, Mycobacterium bovis; identical to SEQ ID NO: 116847

SEQ ID NO: 221721 - protein, 18 aa, Mycobacterium bovis
QLLCLARTLAVNPEVLLL

SEQ ID NO: 221722 - protein, 19 aa, Mycobacterium bovis
QLLHEVWGYDFFGGTRTVD

SEQ ID NO: 221723 - protein, 18 aa, Mycobacterium bovis
QLLIIISAGRTIANDISA

SEQ ID NO: 221724 - protein, 21 aa, Mycobacterium bovis
QLPSGWMVTAAKFEVEWPADP

SEQ ID NO: 221725 - protein, 26 aa, Mycobacterium bovis
QLPTMFADVRRELAIRAAVEAATVTD

SEQ ID NO: 221726 - protein, 17 aa, Mycobacterium bovis
QLPVGMLDGLVAADWPP

SEQ ID NO: 221727 - protein, 32 aa, Mycobacterium bovis
QLQVASLDHAMWFMRPFRADEWLLYDQSSPSA

SEQ ID NO: 221728 - protein, 19 aa, Mycobacterium bovis
QLRGSPLYTLRTKGKADLL

SEQ ID NO: 221729 - protein, 20 aa, Mycobacterium bovis
QLRPPRTPLLSNLTGSWMSD

SEQ ID NO: 221730 - protein, 19 aa, Mycobacterium bovis
QLRTSVAMLSYADDLYFGI

SEQ ID NO: 221731 - protein, 26 aa, Mycobacterium bovis
QLTLSPFTAIALSKWSALSPTGRCNS

SEQ ID NO: 221732 - protein, 20 aa, Mycobacterium bovis
QLVERFFEARKMMSSMLGGM

SEQ ID NO: 221733 - protein, 32 aa, Mycobacterium bovis
QLVEVPVGFKWFVDGLIGATLGFGGEESAGAS

SEQ ID NO: 221734 - protein, 27 aa, Mycobacterium bovis
QLVGPRTLPVMRALIVVAGLRMSRTPP

SEQ ID NO: 221735 - protein, 32 aa, Mycobacterium bovis
QLVNRVKTWLQFPQWFYLNIPVNTMVAPRLTP

SEQ ID NO: 221736 - protein, 19 aa, Mycobacterium bovis
QMDAYFARFGGVRDYLRAV

SEQ ID NO: 221737 - protein, 25 aa, Mycobacterium bovis
QMEYMLPRLRGWGESMSRQAGGRAG

SEQ ID NO: 221738 - protein, 18 aa, Mycobacterium bovis
QMFGIDYPIVSAPMDLIA

SEQ ID NO: 221739 - protein, 24 aa, Mycobacterium bovis
QMGRDGWLALGWPKEYGGQGRSAM

SEQ ID NO: 221740 - protein, 17 aa, Mycobacterium bovis
QMKHIGIYGLAIDEQYG

SEQ ID NO: 221741 - protein, 17 aa, Mycobacterium bovis
QMLAPLAPHIAEELWLR

SEQ ID NO: 221742 - protein, 18 aa, Mycobacterium bovis
QMPGFQVPEFRRKAVVIA

SEQ ID NO: 221743 - protein, 31 aa, Mycobacterium bovis
QMRIPKPRFVLMPTPIWDQLFKPLIAGQRWI

SEQ ID NO: 221744 - protein, 20 aa, Mycobacterium bovis
QMRYDLSAGFPLLTTKKVHF

SEQ ID NO: 221745 - protein, 18 aa, Mycobacterium bovis
QMVSVATAMIPFLEHDDA

SEQ ID NO: 221746 - protein, 18 aa, Mycobacterium bovis
QNEWLVEAMYRKFRDDPS

SEQ ID NO: 221747 - protein, 19 aa, Mycobacterium bovis
QNIAFPLTLAKMRKADIAQ

SEQ ID NO: 221748 - protein, 22 aa, Mycobacterium bovis
QNISAFGPLQRPTRQMFGVRGS

SEQ ID NO: 221749 - protein, 25 aa, Mycobacterium bovis
QNKIAAMRVLQAKLLERKRLEERAE

SEQ ID NO: 221750 - protein, 25 aa, Mycobacterium bovis
QNLTQFYHPLDMFGEWNRAYGPAGF

SEQ ID NO: 221751 - protein, 17 aa, Mycobacterium bovis
QNPLINRVIAVDAIAPS

SEQ ID NO: 221752 - protein, 17 aa, Mycobacterium bovis
QNWVVRALTPEAPGIAG

SEQ ID NO: 221753 - protein, 23 aa, Mycobacterium bovis
QPADHILAILRQLNAVVIHADSS

SEQ ID NO: 221754 - protein, 20 aa, Mycobacterium bovis
QPALAVRRLVAVLAAAFDAQ

SEQ ID NO: 221755 - protein, 32 aa, Mycobacterium bovis
QPALFAVEVALFRLLGSWGVRPDFVMGHSIGE

SEQ ID NO: 221756 - protein, 37 aa, Mycobacterium bovis
QPDPDLLEEAKRWAYYPWRRMVVAILGPRGFRAVRLD

SEQ ID NO: 221757 - protein, 34 aa, Mycobacterium bovis
QPGLRKLLAQEWLRFGWFFLVTRRDPKGLWEWIR

SEQ ID NO: 221758 - protein, 21 aa, Mycobacterium bovis
QPILAPLTPAAIFLVATIGAD

SEQ ID NO: 221759 - protein, 19 aa, Mycobacterium bovis
QPKGVVGVISPWNYPMTLT

SEQ ID NO: 221760 - protein, 18 aa, Mycobacterium bovis
QPLLNGVNIIFDGFLRGR

SEQ ID NO: 221761 - protein, 18 aa, Mycobacterium bovis
QPLLPGIGKTTVCYQPKG

SEQ ID NO: 221762 - protein, 18 aa, Mycobacterium bovis
QPMTPQLGMMEPLTLTVG

SEQ ID NO: 221763 - protein, 22 aa, Mycobacterium bovis
QPPAPTLAPRRATRQLMVGNVG

SEQ ID NO: 221764 - protein, 31 aa, Mycobacterium bovis
QPQRVLGLHFFNPVPVLPLVELVRTLVTDEA

SEQ ID NO: 221765 - protein, 29 aa, Mycobacterium bovis
QPTEPVLKLLKITGDWQKFKGLPGAQGRL

SEQ ID NO: 221766 - protein, 17 aa, Mycobacterium bovis
QPTLRRRMKLGVLAALD

SEQ ID NO: 221767 - protein, 26 aa, Mycobacterium bovis
QPWDRDHIHRLFDDLEFRVLRDRLFD

SEQ ID NO: 221768 - protein, 19 aa, Mycobacterium bovis
QQAERIIEVLWAPSPSSVF

SEQ ID NO: 221769 - protein, 21 aa, Mycobacterium bovis
QQAFGSPALMRALDRLDAHLQ

SEQ ID NO: 221770 - protein, 17 aa, Mycobacterium bovis
QQELYLTDVIAILRSDG

SEQ ID NO: 221771 - protein, 25 aa, Mycobacterium bovis
QQHDWSLEVIDLRSLAPLDFDTIAA

SEQ ID NO: 221772 - protein, 17 aa, Mycobacterium bovis
QQKLVEFAEAGFPGLAV

SEQ ID NO: 221773 - protein, 21 aa, Mycobacterium bovis
QQRLALACALVGRPQLVFLDE

SEQ ID NO: 221774 - protein, 21 aa, Mycobacterium bovis
QQRRFEWLLSVLRLADRLIPH

SEQ ID NO: 221775 - protein, 23 aa, Mycobacterium bovis
QQTRQVRFKIWDAGYQASVTALR

SEQ ID NO: 221776 - protein, 27 aa, Mycobacterium bovis
QQVAAELVPVLRPRGLFAHDVDLAGEA

SEQ ID NO: 221777 - protein, 24 aa, Mycobacterium bovis
QQVAPWWRRRPHRSLTSLGQWSWR

SEQ ID NO: 221778 - protein, 30 aa, Mycobacterium bovis; identical to SEQ ID NO: 116893

SEQ ID NO: 221779 - protein, 25 aa, Mycobacterium bovis
QQVRAGLKAIYLSGWQVAGDANLSG

SEQ ID NO: 221780 - protein, 18 aa, Mycobacterium bovis
QRAFSVVPLMLHGDAAFA

SEQ ID NO: 221781 - protein, 19 aa, Mycobacterium bovis
QRAGLELLAFGGRFVEIGK

SEQ ID NO: 221782 - protein, 22 aa, Mycobacterium bovis
QRAHWPLGTLQLTAIAACCAPR

SEQ ID NO: 221783 - protein, 23 aa, Mycobacterium bovis
QRALHRVVTLLAAGRPVLTHCFA

SEQ ID NO: 221784 - protein, 24 aa, Mycobacterium bovis
QRALRLPFSRLLATLPISATPDGV

SEQ ID NO: 221785 - protein, 19 aa, Mycobacterium bovis
QRCESLRDNLWQLVDSKVA

SEQ ID NO: 221786 - protein, 18 aa, Mycobacterium bovis
QRCRIPVFVELAARIKRH

SEQ ID NO: 221787 - protein, 23 aa, Mycobacterium bovis
QREAFAWHIDLAKRTGKPLMIHN

SEQ ID NO: 221788 - protein, 25 aa, Mycobacterium bovis
QREALLLTQLLGLSYADAAAVCGCP

SEQ ID NO: 221789 - protein, 19 aa, Mycobacterium bovis
QRGGAGGAAGLIGNGGNGG

SEQ ID NO: 221790 - protein, 22 aa, Mycobacterium bovis
QRGIYALGAGPLGFSTAWVVFD

SEQ ID NO: 221791 - protein, 21 aa, Mycobacterium bovis
QRGLPLLDLKDLRAVITHLTS

SEQ ID NO: 221792 - protein, 20 aa, Mycobacterium bovis
QRGMPVLGICRGTQVLNVAL

SEQ ID NO: 221793 - protein, 20 aa, Mycobacterium bovis
QRIFHWTNVILGFGDPDLAT

SEQ ID NO: 221794 - protein, 25 aa, Mycobacterium bovis
QRIRPSLDWLIKNVGPHALASQDLC

SEQ ID NO: 221795 - protein, 29 aa, Mycobacterium bovis
QRLYSFKDILVLKIVKRLLDTGISLHNIR

SEQ ID NO: 221796 - protein, 25 aa, Mycobacterium bovis
QRNGERYQFLRWGQGAFDDFKVVPP

SEQ ID NO: 221797 - protein, 26 aa, Mycobacterium bovis
QRPGAQIKYLVRMRSWPGGHARVLGE

SEQ ID NO: 221798 - protein, 24 aa, Mycobacterium bovis
QRPRQRGIPFIFVRTDKAGNISKR

SEQ ID NO: 221799 - protein, 19 aa, Mycobacterium bovis
QRQGWLVRRQGLGTFVADP

SEQ ID NO: 221800 - protein, 25 aa, Mycobacterium bovis
QRRAFGGALIDKPLMRRKLAEMVVD

SEQ ID NO: 221801 - protein, 25 aa, Mycobacterium bovis
QRRAPTPPLHITLDATINAARTVRA

SEQ ID NO: 221802 - protein, 21 aa, Mycobacterium bovis
QRRARLYDQLAATGDFRRGSI

SEQ ID NO: 221803 - protein, 31 aa, Mycobacterium bovis
QRRCGSPAWNLPVVFGPIAVTYNLNSVSSLN

SEQ ID NO: 221804 - protein, 24 aa, Mycobacterium bovis
QRSLLGQMLTSRPCPTCRGVGVVI

SEQ ID NO: 221805 - protein, 18 aa, Mycobacterium bovis
QRTGLPHVTWKYATSIDG

SEQ ID NO: 221806 - protein, 32 aa, Mycobacterium bovis
QRTMQLNYLGAVQLILKFIPGMRERHFGHIVN

SEQ ID NO: 221807 - protein, 29 aa, Mycobacterium bovis
QRVSARVYPALVPLSHPLAAVNGAFNAVV

SEQ ID NO: 221808 - protein, 23 aa, Mycobacterium bovis
QRVVDWLVDKFKGTSGIDLTKDK

SEQ ID NO: 221809 - protein, 27 aa, Mycobacterium bovis
QRWAELVYDGLWYSPLKAALEAFVAKT

SEQ ID NO: 221810 - protein, 29 aa, Mycobacterium bovis
QRWEGSPDALLTWATYRAPFLAAVEDGAL

SEQ ID NO: 221811 - protein, 22 aa, Mycobacterium bovis
QRWLADHVIAGVVLLAGAAFVE

SEQ ID NO: 221812 - protein, 25 aa, Mycobacterium bovis
QRYRDRYIFAGLQPGQRIPSRWLDS

SEQ ID NO: 221813 - protein, 30 aa, Mycobacterium bovis
QSAFPQLLSAVPRALQGLALPTASQSASAT

SEQ ID NO: 221814 - protein, 36 aa, Mycobacterium bovis
QSAMGAVSASAQTLLSRPLIGNGANATTPGGNGGDG

SEQ ID NO: 221815 - protein, 24 aa, Mycobacterium bovis
QSAMLRAMARMLRQSRPAKTARRP

SEQ ID NO: 221816 - protein, 27 aa, Mycobacterium bovis
QSAPGRWTLIRWGPAGSLVLRITLCRV

SEQ ID NO: 221817 - protein, 31 aa, Mycobacterium bovis
QSAQPILLAHHLLAHAHPLLRDLDRIVDFDK

SEQ ID NO: 221818 - protein, 17 aa, Mycobacterium bovis
QSAQYAFILDRMSQQVD

SEQ ID NO: 221819 - protein, 28 aa, Mycobacterium bovis
QSDSRTKLLRLFPTIFKGAHVELDEVST

SEQ ID NO: 221820 - protein, 17 aa, Mycobacterium bovis
QSEHLRRWFDDKVLRIF

SEQ ID NO: 221821 - protein, 27 aa, Mycobacterium bovis
QSGDGPPIFLLSLKAGGTGLNLTAANH

SEQ ID NO: 221822 - protein, 24 aa, Mycobacterium bovis
QSGKYRRVLALAWEKQSESNAMWA

SEQ ID NO: 221823 - protein, 18 aa, Mycobacterium bovis
QSGLACTGYPFACDHGGV

SEQ ID NO: 221824 - protein, 25 aa, Mycobacterium bovis
QSGLSWLIILRKRENFRRAFSGFDI

SEQ ID NO: 221825 - protein, 20 aa, Mycobacterium bovis
QSGRFEFRAGPIFTNLLLAD

SEQ ID NO: 221826 - protein, 19 aa, Mycobacterium bovis
QSIVFAALAVRTGLNTKQV

SEQ ID NO: 221827 - protein, 29 aa, Mycobacterium bovis
QSLEAMRVIGLPVYLLPGNHDPLDASSVY

SEQ ID NO: 221828 - protein, 24 aa, Mycobacterium bovis
QSLQTYMRTKLIEGVRGRDKAEVI

SEQ ID NO: 221829 - protein, 24 aa, Mycobacterium bovis
QSNNISRVAWLTAGLPEHVGATTV

SEQ ID NO: 221830 - protein, 21 aa, Mycobacterium bovis
QSNYGVKPYSLLMGSIRVADE

SEQ ID NO: 221831 - protein, 28 aa, Mycobacterium bovis
QSPKETWLRLLLINAGFPRPSTQIPLLG

SEQ ID NO: 221832 - protein, 22 aa, Mycobacterium bovis
QSQVPAHTQLAWVLGCFTGFGQ

SEQ ID NO: 221833 - protein, 25 aa, Mycobacterium bovis
QSRPSHWRRNLMACSGIEFCKLSFA

SEQ ID NO: 221834 - protein, 23 aa, Mycobacterium bovis
QSVPPVTLRQALLGKVMTVGDAV

SEQ ID NO: 221835 - protein, 24 aa, Mycobacterium bovis
QTDSERVFALITASIRARDGNESA

SEQ ID NO: 221836 - protein, 24 aa, Mycobacterium bovis
QTEGAGFDWVSWVTALGSAPDAMT

SEQ ID NO: 221837 - protein, 23 aa, Mycobacterium bovis
QTERPKVLILGSGPNRIGQGIEF

SEQ ID NO: 221838 - protein, 18 aa, Mycobacterium bovis
QTGAPLPTLADAVLPLRW

SEQ ID NO: 221839 - protein, 17 aa, Mycobacterium bovis
QTGFPRRSKSCWSAVMT

SEQ ID NO: 221840 - protein, 22 aa, Mycobacterium bovis
QTGGYSPPTNLLINGQAVTIDQ

SEQ ID NO: 221841 - protein, 24 aa, Mycobacterium bovis
QTGRPFFEALYADPRRLEAFMAAM

SEQ ID NO: 221842 - protein, 29 aa, Mycobacterium bovis
QTIAEQLMPHWMLSLRAADMRRGGTVPEV

SEQ ID NO: 221843 - protein, 33 aa, Mycobacterium bovis
QTLANLYLALDRDLHIIPVLNKIDLPAADPDRY

SEQ ID NO: 221844 - protein, 33 aa, Mycobacterium bovis
QTLFDRFGTELPPLEGIYLAAFAGRPALLSEMT

SEQ ID NO: 221845 - protein, 32 aa, Mycobacterium bovis
QTLGTQAAAFHERFIQALSTAAGAYGSAEAAN

SEQ ID NO: 221846 - protein, 32 aa, Mycobacterium bovis
QTLSTQAAAFHSRFVQALTTAAASYASVEAAN

SEQ ID NO: 221847 - protein, 26 aa, Mycobacterium bovis
QTPAARVLAIWPDWVRRWPTPSATAT

SEQ ID NO: 221848 - protein, 28 aa, Mycobacterium bovis
QTREHVLLARQVGVPYILVALNKADAVD

SEQ ID NO: 221849 - protein, 27 aa, Mycobacterium bovis
QTRRWNPKMKRFIFTDRNGIYIIDLQQ

SEQ ID NO: 221850 - protein, 26 aa, Mycobacterium bovis
QTTSRQAYALLLLGSLTVADALPLLG

SEQ ID NO: 221851 - protein, 23 aa, Mycobacterium bovis
QTTYGGRWVVNPSGGLISKGHPL

SEQ ID NO: 221852 - protein, 26 aa, Mycobacterium bovis
QVAEIPADRPALPAALTILRDITAGS

SEQ ID NO: 221853 - protein, 24 aa, Mycobacterium bovis
QVAKNMMQAFFFDLQAINAGGSRP

SEQ ID NO: 221854 - protein, 17 aa, Mycobacterium bovis
QVAPMTTAVRPPAADLV

SEQ ID NO: 221855 - protein, 28 aa, Mycobacterium bovis
QVARYQRLLHPWVNMAMDTVVAIEPEIV

SEQ ID NO: 221856 - protein, 31 aa, Mycobacterium bovis
QVASRIRSAGAIFVGPWSPVSLGDYCAGSNH

SEQ ID NO: 221857 - protein, 23 aa, Mycobacterium bovis
QVAVAISALQWRGSQTSDPVETP

SEQ ID NO: 221858 - protein, 23 aa, Mycobacterium bovis
QVCPVCLGLPGSLPVLNRAAVES

SEQ ID NO: 221859 - protein, 17 aa, Mycobacterium bovis
QVDLWTFGDTGRSIIVL

SEQ ID NO: 221860 - protein, 18 aa, Mycobacterium bovis
QVEVFHYTRKWLQKMTVS

SEQ ID NO: 221861 - protein, 18 aa, Mycobacterium bovis
QVGLILRRTIDTDRLLSE

SEQ ID NO: 221862 - protein, 25 aa, Mycobacterium bovis
QVGQKFAREIFFLGRTYTAEQMHQM

SEQ ID NO: 221863 - protein, 17 aa, Mycobacterium bovis
QVHLRLISGDRITTLAL

SEQ ID NO: 221864 - protein, 17 aa, Mycobacterium bovis
QVHRLAVPSLPVGSVLT

SEQ ID NO: 221865 - protein, 27 aa, Mycobacterium bovis
QVIAELYEKFFRIGFKKQAEALGIVYT

SEQ ID NO: 221866 - protein, 18 aa, Mycobacterium bovis
QVIAVYRLRASRAGKVLD

SEQ ID NO: 221867 - protein, 25 aa, Mycobacterium bovis
QVINDALRRALAPPVKRQEQYRLEP

SEQ ID NO: 221868 - protein, 21 aa, Mycobacterium bovis
QVIVLTCSPTRYGGVKGAHRI

SEQ ID NO: 221869 - protein, 21 aa, Mycobacterium bovis
QVLAPVVFTSALGLGDLFCPD

SEQ ID NO: 221870 - protein, 17 aa, Mycobacterium bovis
QVLPDRNLLVPLNFHLG

SEQ ID NO: 221871 - protein, 22 aa, Mycobacterium bovis
QVLRRQPLPLSLLATHPIDLSR

SEQ ID NO: 221872 - protein, 25 aa, Mycobacterium bovis
QVLVNEHLIGPPPATVIRLSDYPYV

SEQ ID NO: 221873 - protein, 27 aa, Mycobacterium bovis
QVNRKVLPGYILVRMDLTDDSWAAVRN

SEQ ID NO: 221874 - protein, 23 aa, Mycobacterium bovis
QVPAAVRFLSCEPLLGPLDGINL

SEQ ID NO: 221875 - protein, 19 aa, Mycobacterium bovis
QVPFVDPLTTILDPSLPLT

SEQ ID NO: 221876 - protein, 17 aa, Mycobacterium bovis
QVRIPMLAGRRSLNLSN

SEQ ID NO: 221877 - protein, 24 aa, Mycobacterium bovis
QVTGWAAYAAGAIWALRGAGHPVP

SEQ ID NO: 221878 - protein, 22 aa, Mycobacterium bovis
QVVAGIRRWLDSPSLMVADMFA

SEQ ID NO: 221879 - protein, 35 aa, Mycobacterium bovis
QVVNDYYDRSGLWPYLEKLGFYLVGYGCTTCIGNS

SEQ ID NO: 221880 - protein, 19 aa, Mycobacterium bovis
QVWQPQPAAELPMTQRYFL

SEQ ID NO: 221881 - protein, 19 aa, Mycobacterium bovis
QWGCFRFGIVQGCDHFTFF

SEQ ID NO: 221882 - protein, 18 aa, Mycobacterium bovis
QWRLSPKAMRRLGETALR

SEQ ID NO: 221883 - protein, 19 aa, Mycobacterium bovis
QWRVLERAFSRHSALILIG

SEQ ID NO: 221884 - protein, 21 aa, Mycobacterium bovis
QWWQQQVVLGLQRSGFPRLAI

SEQ ID NO: 221885 - protein, 19 aa, Mycobacterium bovis
QYAFILDRMSQQVDADEHR

SEQ ID NO: 221886 - protein, 27 aa, Mycobacterium bovis
QYCTAGHPPPLLVTADASARYVEPTGA

SEQ ID NO: 221887 - protein, 19 aa, Mycobacterium bovis
QYDPLPWPDDFEVPPMPAP

SEQ ID NO: 221888 - protein, 19 aa, Mycobacterium bovis
QYRDYVLMLAALDLAATVE

SEQ ID NO: 221889 - protein, 27 aa, Mycobacterium bovis
QYRHTYGRRLWELPAGLLDVAGEPPHL

SEQ ID NO: 221890 - protein, 19 aa, Mycobacterium bovis
QYRYFHAPYPEPIERLKQA

SEQ ID NO: 221891 - protein, 25 aa, Mycobacterium bovis
QYTPEQWWPFIGNLSLDQSIAQGVT

SEQ ID NO: 221892 - protein, 18 aa, Mycobacterium bovis
QYWSEICQIPISFITETV

SEQ ID NO: 221893 - protein, 27 aa, Mycobacterium bovis
RAAAIEPQLALLPPADRRVLADAVDVL

SEQ ID NO: 221894 - protein, 32 aa, Mycobacterium bovis
RAADPVFMLTGPIPATRYALDKTGLAIDDIDT

SEQ ID NO: 221895 - protein, 26 aa, Mycobacterium bovis
RAAEAPTTGLLAAGADEVSAAIASLF

SEQ ID NO: 221896 - protein, 21 aa, Mycobacterium bovis
RAAEILVYGHVPFELVSYVCC

SEQ ID NO: 221897 - protein, 21 aa, Mycobacterium bovis
RAAGIGELTFFSKIHYGGGAA

SEQ ID NO: 221898 - protein, 21 aa, Mycobacterium bovis
RAAKPGAYLRVIAPGTVRAGD

SEQ ID NO: 221899 - protein, 18 aa, Mycobacterium bovis
RAALQRWSLMRSDHPVTS

SEQ ID NO: 221900 - protein, 21 aa, Mycobacterium bovis
RAALTRAIHKLPIKARIITRE

SEQ ID NO: 221901 - protein, 17 aa, Mycobacterium bovis
RAAPILADLRQLEAIAV

SEQ ID NO: 221902 - protein, 25 aa, Mycobacterium bovis
RAARVVVPDFQLSLAIGKEGQNARL

SEQ ID NO: 221903 - protein, 34 aa, Mycobacterium bovis
RAAVSKYWIIDEIKPARLYARFPAGFAGMPALLD

SEQ ID NO: 221904 - protein, 18 aa, Mycobacterium bovis
RAAWVNIPEVVSAATVTG

SEQ ID NO: 221905 - protein, 33 aa, Mycobacterium bovis
RACESLYHFAWDEFCDWYLELAKTQLAQGLTHT

SEQ ID NO: 221906 - protein, 21 aa, Mycobacterium bovis
RADDIAHRRLAITGVNEYPNL

SEQ ID NO: 221907 - protein, 17 aa, Mycobacterium bovis
RADFLVGDRDILLGVLD

SEQ ID NO: 221908 - protein, 17 aa, Mycobacterium bovis
RADGERRPGWVGLPLAG

SEQ ID NO: 221909 - protein, 21 aa, Mycobacterium bovis
RADGWLGDLLAGAAAASLQPL

SEQ ID NO: 221910 - protein, 18 aa, Mycobacterium bovis
RADLVIGAVLVPGAKAPK

SEQ ID NO: 221911 - protein, 23 aa, Mycobacterium bovis
RADTPLLFLHNTTGYMVGKDYEE

SEQ ID NO: 221912 - protein, 18 aa, Mycobacterium bovis
RAEHLMLVDLGRNDLGRV

SEQ ID NO: 221913 - protein, 25 aa, Mycobacterium bovis
RAELRKRYRLGERPTVVCLSRLVPR

SEQ ID NO: 221914 - protein, 28 aa, Mycobacterium bovis
RAEMEMKVLLWAVQRLIGGLSTIGAERD

SEQ ID NO: 221915 - protein, 27 aa, Mycobacterium bovis
RAEPALPRLLRRLVIMGGMFDGQPITE

SEQ ID NO: 221916 - protein, 26 aa, Mycobacterium bovis
RAEQSRPLWYLMPDSVVQYVSKCRLY

SEQ ID NO: 221917 - protein, 24 aa, Mycobacterium bovis
RAFAADMAFLRNCGIHPVVVHGGG

SEQ ID NO: 221918 - protein, 50 aa, Mycobacterium bovis
RAFFHNNTMPLYFISPTPFNLLGIYRWIRNFFYLTYYDSFEGEHSRVFVP

SEQ ID NO: 221919 - protein, 17 aa, Mycobacterium bovis
RAGFPRPQTQIPVYDEY

SEQ ID NO: 221920 - protein, 23 aa, Mycobacterium bovis
RAGHRLKFWTPGGSSTPLLTDEH

SEQ ID NO: 221921 - protein, 18 aa, Mycobacterium bovis
RAGPIFTNLLLADEINRT

SEQ ID NO: 221922 - protein, 30 aa, Mycobacterium bovis
RAGRKRGHWMWFVFPQLRGLGSSPLAVRYG

SEQ ID NO: 221923 - protein, 23 aa, Mycobacterium bovis
RAGRLLIFSAYVTHRLPEIWPEP

SEQ ID NO: 221924 - protein, 26 aa, Mycobacterium bovis
RAGVARSGFYFYFDSKYSVLAQILAE

SEQ ID NO: 221925 - protein, 21 aa, Mycobacterium bovis
RAGVLRFVVLDGLAKPGRMVG

SEQ ID NO: 221926 - protein, 23 aa, Mycobacterium bovis
RAGYRLLYSVRQYALEKLSESGE

SEQ ID NO: 221927 - protein, 24 aa, Mycobacterium bovis
RAHDLVDLQLLEGLLLDADLMPTR

SEQ ID NO: 221928 - protein, 24 aa, Mycobacterium bovis
RAHREPQLLLNYLGSLHVGVGDLA

SEQ ID NO: 221929 - protein, 29 aa, Mycobacterium bovis
RAIAANFRDIMITLGMFTHDALLGGEGAG

SEQ ID NO: 221930 - protein, 25 aa, Mycobacterium bovis
RAIDDKWTLCQILYWRGVGTCISGD

SEQ ID NO: 221931 - protein, 24 aa, Mycobacterium bovis
RAIDPGFFSARKLPDGLSFDPANC

SEQ ID NO: 221932 - protein, 17 aa, Mycobacterium bovis
RAIWIPAGCWHQHKFHG

SEQ ID NO: 221933 - protein, 25 aa, Mycobacterium bovis
RAKADGDHWILNGAKCWITNGGKST

SEQ ID NO: 221934 - protein, 17 aa, Mycobacterium bovis
RAKSVVALAYAGGVLFV

SEQ ID NO: 221935 - protein, 17 aa, Mycobacterium bovis
RAKWLVAADGLHSAVRR

SEQ ID NO: 221936 - protein, 26 aa, Mycobacterium bovis
RALADKAMLSTWLATSPVGATDIIAP

SEQ ID NO: 221937 - protein, 28 aa, Mycobacterium bovis
RALGEIRAIWRINELLNWQVASAGEDIN

SEQ ID NO: 221938 - protein, 18 aa, Mycobacterium bovis
RALGRPNPLAQWSSSWTT

SEQ ID NO: 221939 - protein, 20 aa, Mycobacterium bovis
RALILVSPEDRPALKKAGFL

SEQ ID NO: 221940 - protein, 18 aa, Mycobacterium bovis
RALKYSKQMIDDISQLVY

SEQ ID NO: 221941 - protein, 19 aa, Mycobacterium bovis
RALLALARAEYRILGPQYK

SEQ ID NO: 221942 - protein, 19 aa, Mycobacterium bovis
RALMHAWVGYLERDVFPGG

SEQ ID NO: 221943 - protein, 17 aa, Mycobacterium bovis
RALPSTFATWRERRKLI

SEQ ID NO: 221944 - protein, 17 aa, Mycobacterium bovis
RALRRACAAGVLATLVS

SEQ ID NO: 221945 - protein, 28 aa, Mycobacterium bovis
RALVDLKTWTLLKWLDQPCSFYDWRRSA

SEQ ID NO: 221946 - protein, 27 aa, Mycobacterium bovis
RALYDEHAAVLWRYALRLTGDAAQAED

SEQ ID NO: 221947 - protein, 20 aa, Mycobacterium bovis
RAMDLIGERCPILIQLSTGV

SEQ ID NO: 221948 - protein, 21 aa, Mycobacterium bovis
RAMIVAEELWIYASSGDRVAI

SEQ ID NO: 221949 - protein, 18 aa, Mycobacterium bovis
RAMWADHLNGLDGPTLLS

SEQ ID NO: 221950 - protein, 23 aa, Mycobacterium bovis
RANLKSIYQHAIGCKLHLEVPMY

SEQ ID NO: 221951 - protein, 21 aa, Mycobacterium bovis
RANLVYWAAANLRDPGARVPA

SEQ ID NO: 221952 - protein, 27 aa, Mycobacterium bovis
RANVVAVYQEALRKARLLLGSGHSVIL

SEQ ID NO: 221953 - protein, 18 aa, Mycobacterium bovis
RAPLYRRVATMRVDTNRR

SEQ ID NO: 221954 - protein, 17 aa, Mycobacterium bovis
RAQAPLVPGTPDPVKGA

SEQ ID NO: 221955 - protein, 21 aa, Mycobacterium bovis
RAQARSWWRIGEPYEGVDVAT

SEQ ID NO: 221956 - protein, 32 aa, Mycobacterium bovis
RAQHPWPPRVATLPHWPLIYAGALEGLDHLEL

SEQ ID NO: 221957 - protein, 17 aa, Mycobacterium bovis
RAQLREWLAEIGADHSD

SEQ ID NO: 221958 - protein, 20 aa, Mycobacterium bovis
RAQRRLPDTPVLPPLDVAAS

SEQ ID NO: 221959 - protein, 21 aa, Mycobacterium bovis
RAQWRMPMGPVVNLTRWMEAA

SEQ ID NO: 221960 - protein, 26 aa, Mycobacterium bovis
RAREHGLPFLFFTDQATGRGQLLYSR

SEQ ID NO: 221961 - protein, 23 aa, Mycobacterium bovis
RARFGDVLPFLVKVLAADEPLSL

SEQ ID NO: 221962 - protein, 32 aa, Mycobacterium bovis
RARIEFKLRDWLFARQRYWGEPFPIVYDSDGR

SEQ ID NO: 221963 - protein, 17 aa, Mycobacterium bovis
RARLAAAIGLPGNRVVW

SEQ ID NO: 221964 - protein, 28 aa, Mycobacterium bovis
RARPCGHSPLVLWALGPARLDEVAPRAA

SEQ ID NO: 221965 - protein, 24 aa, Mycobacterium bovis
RARQKGCTLLVTDGDWQGVSTRLA

SEQ ID NO: 221966 - protein, 20 aa, Mycobacterium bovis
RARSTLRRNLTLMVAAETER

SEQ ID NO: 221967 - protein, 23 aa, Mycobacterium bovis
RARVLHSAALRRLADKTQVVGPR

SEQ ID NO: 221968 - protein, 23 aa, Mycobacterium bovis
RARWVVRMLTSLLMFPGRDEADE

SEQ ID NO: 221969 - protein, 22 aa, Mycobacterium bovis
RARYLLDGLDILPLTEPVIGLA

SEQ ID NO: 221970 - protein, 27 aa, Mycobacterium bovis
RASCKYMKMITPAALLRCLVEGADEVH

SEQ ID NO: 221971 - protein, 28 aa, Mycobacterium bovis
RASFELTQKALMAGIPVLAAVSAPSSLA

SEQ ID NO: 221972 - protein, 23 aa, Mycobacterium bovis
RASGRRKAWLRQAINHLEKLIGR

SEQ ID NO: 221973 - protein, 20 aa, Mycobacterium bovis
RASLDAVTKYPWMRGDGLGS

SEQ ID NO: 221974 - protein, 25 aa, Mycobacterium bovis
RASQNLIPRVFWMTYQNSRDDVLPF

SEQ ID NO: 221975 - protein, 26 aa, Mycobacterium bovis
RASQQAFLFGPPPLGPDAPPLDRLIA

SEQ ID NO: 221976 - protein, 29 aa, Mycobacterium bovis
RASQTWRYPAFFHAMLDAGVYPPCSAFEA

SEQ ID NO: 221977 - protein, 18 aa, Mycobacterium bovis
RASTGSIFAIPVVVAPDV

SEQ ID NO: 221978 - protein, 22 aa, Mycobacterium bovis
RATAFVYIGEICRYLLNQPAKP

SEQ ID NO: 221979 - protein, 27 aa, Mycobacterium bovis
RATDFSLPLARMVLTSAPVTVLEVSGE

SEQ ID NO: 221980 - protein, 20 aa, Mycobacterium bovis
RATHIVVWATLDKSLGRPAI

SEQ ID NO: 221981 - protein, 27 aa, Mycobacterium bovis
RATIPPNLHFSQWNPAIDAASTRFFVP

SEQ ID NO: 221982 - protein, 21 aa, Mycobacterium bovis
RATLDVVDLPEPLDLDAGVEL

SEQ ID NO: 221983 - protein, 26 aa, Mycobacterium bovis
RATPMPIPIGLWMFQTKLHVNAGGAD

SEQ ID NO: 221984 - protein, 26 aa, Mycobacterium bovis
RATQPLSVFFFDILHRDGTDLLEAPT

SEQ ID NO: 221985 - protein, 23 aa, Mycobacterium bovis
RATRLARAFPLYDGLEEWSLVGR

SEQ ID NO: 221986 - protein, 22 aa, Mycobacterium bovis
RATSHWLTLPALKAFGAIPVAD

SEQ ID NO: 221987 - protein, 24 aa, Mycobacterium bovis
RAVARLRIAVVRAIRTALQRRGFL

SEQ ID NO: 221988 - protein, 20 aa, Mycobacterium bovis
RAVGLAQRWGSRNPIPWSGL

SEQ ID NO: 221989 - protein, 34 aa, Mycobacterium bovis
RAVLMSPMSFLRRPARWMQLLATSGRCFSAAPNF

SEQ ID NO: 221990 - protein, 17 aa, Mycobacterium bovis
RAVLRAADRLELAEGLR

SEQ ID NO: 221991 - protein, 17 aa, Mycobacterium bovis
RAVLSRAVLWHCQDRVI

SEQ ID NO: 221992 - protein, 25 aa, Mycobacterium bovis
RAVPMWAHPEPLPPVSGLTIAVERW

SEQ ID NO: 221993 - protein, 19 aa, Mycobacterium bovis
RAYLDFGEPLPLRKRLQEM

SEQ ID NO: 221994 - protein, 20 aa, Mycobacterium bovis
RAYLGLLDVLGRRGDIACDG

SEQ ID NO: 221995 - protein, 20 aa, Mycobacterium bovis
RAYRRCRRALRQIGVLERPV

SEQ ID NO: 221996 - protein, 20 aa, Mycobacterium bovis
RAYVHPHRRVTTGPKVVSRI

SEQ ID NO: 221997 - protein, 28 aa, Mycobacterium bovis
RCESTHVLLPAALQPRLGRGGGGQLRPG

SEQ ID NO: 221998 - protein, 27 aa, Mycobacterium bovis
RCGGKRLDRPGWFYPPTVITDISKDMA

SEQ ID NO: 221999 - protein, 17 aa, Mycobacterium bovis
RCGLSVAALWAGNAGGP

SEQ ID NO: 222000 - protein, 18 aa, Mycobacterium bovis
RCGVARRVPLIRDETGSV

SEQ ID NO: 222001 - protein, 17 aa, Mycobacterium bovis
RCRRTLRAIIAAARLNP

SEQ ID NO: 222002 - protein, 30 aa, Mycobacterium bovis
RCRSRARLLGLRLRRLRYLRTAAARRPQVT

SEQ ID NO: 222003 - protein, 26 aa, Mycobacterium bovis
RCSFEQVAFLLWRGELPTDAELALFS

SEQ ID NO: 222004 - protein, 32 aa, Mycobacterium bovis
RCSGRLRKLFNAVGVVFKGTGFYRTDSRESGK

SEQ ID NO: 222005 - protein, 27 aa, Mycobacterium bovis
RCSKGSFYLRPIVRPVILVAGGTGLSA

SEQ ID NO: 222006 - protein, 28 aa, Mycobacterium bovis
RCVLERFRAIKPWLVGGRVHAPFWEVHA

SEQ ID NO: 222007 - protein, 34 aa, Mycobacterium bovis
RDAGAMAYLVKPFSISDLIPAIELAVSRFREITA

SEQ ID NO: 222008 - protein, 26 aa, Mycobacterium bovis
RDAIDGRPRGHLRKFGLSRVRVRQLA

SEQ ID NO: 222009 - protein, 23 aa, Mycobacterium bovis
RDALRRIEIALGQAGATLADVVR

SEQ ID NO: 222010 - protein, 17 aa, Mycobacterium bovis
RDATRVFRLSRIGAQVT

SEQ ID NO: 222011 - protein, 18 aa, Mycobacterium bovis
RDCFARIAPGLPSSVIRI

SEQ ID NO: 222012 - protein, 24 aa, Mycobacterium bovis
RDCTAGLPFLIHAVSARAQAPAQA

SEQ ID NO: 222013 - protein, 29 aa, Mycobacterium bovis
RDDDHMQGHWLLARLGKRVLRPGGVELTR

SEQ ID NO: 222014 - protein, 23 aa, Mycobacterium bovis
RDDGYRFMLLGRAIERVDMTVRL

SEQ ID NO: 222015 - protein, 25 aa, Mycobacterium bovis
RDDLQAVIAMLKKADLDVALQFVNY

SEQ ID NO: 222016 - protein, 25 aa, Mycobacterium bovis
RDDWAVHIALWRRSSNGQPEITDAA

SEQ ID NO: 222017 - protein, 25 aa, Mycobacterium bovis
RDEATRPLVICDLGMPRDVDPAVAR

SEQ ID NO: 222018 - protein, 23 aa, Mycobacterium bovis
RDEDKVVWLSQTTLSVDETMEIV

SEQ ID NO: 222019 - protein, 33 aa, Mycobacterium bovis
RDEGITAMHFVPSLLGLFLSLPGVSQWRTLQRV

SEQ ID NO: 222020 - protein, 18 aa, Mycobacterium bovis
RDEMVARFQSGDGPPIFL

SEQ ID NO: 222021 - protein, 29 aa, Mycobacterium bovis
RDEQGQDVLLFIDNIFRFTQAGSEVSTLL

SEQ ID NO: 222022 - protein, 19 aa, Mycobacterium bovis
RDEQGVAQLTWFLGGRTAS

SEQ ID NO: 222023 - protein, 23 aa, Mycobacterium bovis
RDETAPLLEYYRDQLKTVDAVGT

SEQ ID NO: 222024 - protein, 32 aa, Mycobacterium bovis
RDFRRHAGLDLLPRLLFRNGELDISVVRSILE

SEQ ID NO: 222025 - protein, 18 aa, Mycobacterium bovis
RDFTLWKGEKPGEPSWPT

SEQ ID NO: 222026 - protein, 33 aa, Mycobacterium bovis
RDGAFATLRREAPISFWPTIELPGFVAGNGHWA

SEQ ID NO: 222027 - protein, 22 aa, Mycobacterium bovis
RDGKPWGSRFPLISIRDQVQAD

SEQ ID NO: 222028 - protein, 33 aa, Mycobacterium bovis
RDGRGNLIRRKAGLPPATYFSGGKLQWILENVD

SEQ ID NO: 222029 - protein, 22 aa, Mycobacterium bovis
RDGRLGTVGKLLPGLQGKIAED

SEQ ID NO: 222030 - protein, 27 aa, Mycobacterium bovis
RDGVRIAIDLYLPAGLTSAARLPAILH

SEQ ID NO: 222031 - protein, 32 aa, Mycobacterium bovis
RDGVRQVLLPLWNTYSFLALYAPKVGTWRVDS

SEQ ID NO: 222032 - protein, 22 aa, Mycobacterium bovis
RDGWRISWMPGVVVVVLGGDTV

SEQ ID NO: 222033 - protein, 20 aa, Mycobacterium bovis
RDGYAAVVPVLPLSDTIKAV

SEQ ID NO: 222034 - protein, 20 aa, Mycobacterium bovis
RDIAMVFQSYALYPHMTVRQ

SEQ ID NO: 222035 - protein, 25 aa, Mycobacterium bovis
RDICRRYEVLLIFDEIATGFGRTGA

SEQ ID NO: 222036 - protein, 19 aa, Mycobacterium bovis
RDIGLGPMPLNGSGRLLVA

SEQ ID NO: 222037 - protein, 18 aa, Mycobacterium bovis
RDIRFEQMLLLDDETPIG

SEQ ID NO: 222038 - protein, 36 aa, Mycobacterium bovis
RDKPALMERLYKTSWRFAPFLWQEIEEGILPALYAA

SEQ ID NO: 222039 - protein, 20 aa, Mycobacterium bovis
RDLGGLRRGFRRRRHPAVAG

SEQ ID NO: 222040 - protein, 26 aa, Mycobacterium bovis
RDLHRGLLNRLSAFKVPHRFAVVDRL

SEQ ID NO: 222041 - protein, 18 aa, Mycobacterium bovis
RDPELHRRWLQDTSITPP

SEQ ID NO: 222042 - protein, 26 aa, Mycobacterium bovis
RDPGPLRRLIATLPALEVPRPDWPAE

SEQ ID NO: 222043 - protein, 51 aa, Mycobacterium bovis
RDPRQAKFLTLASLKWVLANRAYTPWYLVRYWRLLRFKLANPHIITRGMVF

SEQ ID NO: 222044 - protein, 27 aa, Mycobacterium bovis
RDQLQRLWTPYRMNYLAEAPVKRDPNS

SEQ ID NO: 222045 - protein, 21 aa, Mycobacterium bovis
RDQWDLLQRDPSLLPGAIEEM

SEQ ID NO: 222046 - protein, 31 aa, Mycobacterium bovis
RDRGFIPEGLLNYLALLGWSIADDHDLFGLD

SEQ ID NO: 222047 - protein, 20 aa, Mycobacterium bovis
RDRLVVIIAGYRADLDKFLD

SEQ ID NO: 222048 - protein, 26 aa, Mycobacterium bovis
RDRVRTEPPLPGTRYTQIAVLEDGIV

SEQ ID NO: 222049 - protein, 25 aa, Mycobacterium bovis
RDSEGWIYLAGRTADWMRVDGENLT

SEQ ID NO: 222050 - protein, 18 aa, Mycobacterium bovis
RDTAFFWDGVKAHELRIQ

SEQ ID NO: 222051 - protein, 20 aa, Mycobacterium bovis
RDTTYLYRDGSDFVFMDSQD

SEQ ID NO: 222052 - protein, 19 aa, Mycobacterium bovis
RDVFFAMTADVLGAALPGS

SEQ ID NO: 222053 - protein, 23 aa, Mycobacterium bovis
RDVIDAFLAWYVPGLDISDHTML

SEQ ID NO: 222054 - protein, 20 aa, Mycobacterium bovis
RDVLAVLRWVADNIAVFGGD

SEQ ID NO: 222055 - protein, 35 aa, Mycobacterium bovis; identical to SEQ ID NO: 117051

SEQ ID NO: 222056 - protein, 18 aa, Mycobacterium bovis
RDWAAKGTLLLGVRAVIA

SEQ ID NO: 222057 - protein, 20 aa, Mycobacterium bovis
RDWGVLPDFVMGHSVGELAA

SEQ ID NO: 222058 - protein, 21 aa, Mycobacterium bovis
RDYVMALGYLQAPVVVAGNDH

SEQ ID NO: 222059 - protein, 29 aa, Mycobacterium bovis
REAAHHRLFSHVPWLASQLLGAVEAYAMG

SEQ ID NO: 222060 - protein, 19 aa, Mycobacterium bovis
REALFDAFRRGEVATLVVS

SEQ ID NO: 222061 - protein, 23 aa, Mycobacterium bovis
REALLLELAYELEEARPWARIHA

SEQ ID NO: 222062 - protein, 30 aa, Mycobacterium bovis
REANDWLLENFATRLFIATGSVPLAANDLM

SEQ ID NO: 222063 - protein, 21 aa, Mycobacterium bovis
REASFFVDRLSQESMPLAGLV

SEQ ID NO: 222064 - protein, 26 aa, Mycobacterium bovis
REEERSLWLHRALLSPLLTEPDTVVS

SEQ ID NO: 222065 - protein, 22 aa, Mycobacterium bovis
REEMRDAVLAHRLAEIRKALGH

SEQ ID NO: 222066 - protein, 19 aa, Mycobacterium bovis
REEPYCDAYYWVDNLRHTV

SEQ ID NO: 222067 - protein, 20 aa, Mycobacterium bovis
REFCAPFELSRDAPLRITVV

SEQ ID NO: 222068 - protein, 21 aa, Mycobacterium bovis
REGERLVVWAKRILAEHAAFK

SEQ ID NO: 222069 - protein, 23 aa, Mycobacterium bovis
REIVGPDNYFLELMDHGLTIERR

SEQ ID NO: 222070 - protein, 24 aa, Mycobacterium bovis
RELDVWLPVHPVTRRRWPNGRVTH

SEQ ID NO: 222071 - protein, 20 aa, Mycobacterium bovis
RELELCYAAIALVTDVDAGV

SEQ ID NO: 222072 - protein, 22 aa, Mycobacterium bovis
RELIQMRRPLRDIPEPTIPDGV

SEQ ID NO: 222073 - protein, 27 aa, Mycobacterium bovis
RELKKLVPITTFLRRSPYLAAVRTAIA

SEQ ID NO: 222074 - protein, 18 aa, Mycobacterium bovis
RELREKRFMKIISLAPEV

SEQ ID NO: 222075 - protein, 33 aa, Mycobacterium bovis
RELSAAIRLIYPREALWRPPVLTMSAVEGRGLA

SEQ ID NO: 222076 - protein, 18 aa, Mycobacterium bovis
RELTADWDYSVVGGLTLG

SEQ ID NO: 222077 - protein, 19 aa, Mycobacterium bovis
REMGMAHHRKWHKSFPLTC

SEQ ID NO: 222078 - protein, 29 aa, Mycobacterium bovis
RENLLDIWRRPDLAPGRRAPVLIQVPGGA

SEQ ID NO: 222079 - protein, 21 aa, Mycobacterium bovis
RENLLIVHWHDLGRYLGVYHH

SEQ ID NO: 222080 - protein, 25 aa, Mycobacterium bovis
REQLAEIVGAYFPRGWQIACHVHGD

SEQ ID NO: 222081 - protein, 17 aa, Mycobacterium bovis
REQPLPHGLRGLLTELH

SEQ ID NO: 222082 - protein, 19 aa, Mycobacterium bovis
REQSRPELGYRLLQRLGAD

SEQ ID NO: 222083 - protein, 17 aa, Mycobacterium bovis
REQSVEIPLGPAAPQRL

SEQ ID NO: 222084 - protein, 25 aa, Mycobacterium bovis
REQTYLGTRRYVRRQRSWFRRDHRV

SEQ ID NO: 222085 - protein, 18 aa, Mycobacterium bovis
REREVAELLLLGMPYRDI

SEQ ID NO: 222086 - protein, 24 aa, Mycobacterium bovis
RERGQWYYQRYIAHLPAKGEIVLF

SEQ ID NO: 222087 - protein, 17 aa, Mycobacterium bovis
RERILVTHPLQPFDRKN

SEQ ID NO: 222088 - protein, 25 aa, Mycobacterium bovis
RERLGLPGLRDWLRRQAKAGAGPPE

SEQ ID NO: 222089 - protein, 24 aa, Mycobacterium bovis
RETFGVPRVVARIYDAKRAEVYER

SEQ ID NO: 222090 - protein, 30 aa, Mycobacterium bovis
REVFGDEKAIWWQRAVAVWPDYASYQTKTD

SEQ ID NO: 222091 - protein, 24 aa, Mycobacterium bovis
REVTMPVLTPGSTPLRVLHISDLH

SEQ ID NO: 222092 - protein, 18 aa, Mycobacterium bovis
REWILRNSPVPVGTVPIY

SEQ ID NO: 222093 - protein, 26 aa, Mycobacterium bovis
REWVTAQWRWDTLAAKLADFLRGDDA

SEQ ID NO: 222094 - protein, 22 aa, Mycobacterium bovis
REYALLLRHPEPRPWLVCVHGT

SEQ ID NO: 222095 - protein, 22 aa, Mycobacterium bovis
RFAFFEQTFVRHALTPRCSRTD

SEQ ID NO: 222096 - protein, 19 aa, Mycobacterium bovis
RFALRPVIGIDPAAVSPWW

SEQ ID NO: 222097 - protein, 17 aa, Mycobacterium bovis
RFCAFAQRKGDADAYSL

SEQ ID NO: 222098 - protein, 18 aa, Mycobacterium bovis
RFDKGYISGYFVTDPERQ

SEQ ID NO: 222099 - protein, 17 aa, Mycobacterium bovis
RFEHPAMLSADRAFAAV

SEQ ID NO: 222100 - protein, 26 aa, Mycobacterium bovis
RFFREYPYRDAYLLREARLFRAELTI

SEQ ID NO: 222101 - protein, 17 aa, Mycobacterium bovis
RFGALIPRLVRQGINGE

SEQ ID NO: 222102 - protein, 26 aa, Mycobacterium bovis
RFGDYQVIVIANPLVIPGRPVARVDT

SEQ ID NO: 222103 - protein, 17 aa, Mycobacterium bovis
RFGFTAHMDFYEPAELE

SEQ ID NO: 222104 - protein, 21 aa, Mycobacterium bovis
RFGNMLSVSLIFVLETMVQQA

SEQ ID NO: 222105 - protein, 18 aa, Mycobacterium bovis
RFGSWLRNSTRGALAMDP

SEQ ID NO: 222106 - protein, 19 aa, Mycobacterium bovis
RFHRPILANDKLYFDTYLD

SEQ ID NO: 222107 - protein, 17 aa, Mycobacterium bovis
RFIGVPAAFSKLFRSEI

SEQ ID NO: 222108 - protein, 25 aa, Mycobacterium bovis
RFIRDTTWVSVRWYRPGGPLTAQQV

SEQ ID NO: 222109 - protein, 25 aa, Mycobacterium bovis
RFLEHSRILHFRAIDEFWIGSADMM

SEQ ID NO: 222110 - protein, 25 aa, Mycobacterium bovis
RFLERRLRETFGFDGSPIRVNVRVR

SEQ ID NO: 222111 - protein, 22 aa, Mycobacterium bovis
RFLHGDMFASLRRWTGGSIPET

SEQ ID NO: 222112 - protein, 18 aa, Mycobacterium bovis
RFLLGLVVSTGVGGGLVL

SEQ ID NO: 222113 - protein, 18 aa, Mycobacterium bovis
RFRAWRVGGYNEYLYTFF

SEQ ID NO: 222114 - protein, 21 aa, Mycobacterium bovis
RFRQTIRTLTLTSPPKGPNWA

SEQ ID NO: 222115 - protein, 19 aa, Mycobacterium bovis
RFRSRALPSTFATWRERRK

SEQ ID NO: 222116 - protein, 25 aa, Mycobacterium bovis
RFSEQLLPEHLHKVSLSFLVDDLVM

SEQ ID NO: 222117 - protein, 29 aa, Mycobacterium bovis
RFSTNTFPSWPLAHPFRRIAHNGEINTVT

SEQ ID NO: 222118 - protein, 18 aa, Mycobacterium bovis
RFTASRLFGAPPGYVGYE

SEQ ID NO: 222119 - protein, 20 aa, Mycobacterium bovis
RFTERFAPFNLSETAIRPSY

SEQ ID NO: 222120 - protein, 19 aa, Mycobacterium bovis
RFTTDFPLSDGTPAPVLEL

SEQ ID NO: 222121 - protein, 22 aa, Mycobacterium bovis
RFTTVHMALVRTPMISPTTIYD

SEQ ID NO: 222122 - protein, 20 aa, Mycobacterium bovis
RFVFHKPVLAGDKLWARMDI

SEQ ID NO: 222123 - protein, 27 aa, Mycobacterium bovis
RFVSRHCSLWLSLAQMWAGNLTEALEL

SEQ ID NO: 222124 - protein, 17 aa, Mycobacterium bovis
RFWHVESAPRVRSLAKS

SEQ ID NO: 222125 - protein, 18 aa, Mycobacterium bovis
RGAGWNVIKVVWGREWDA

SEQ ID NO: 222126 - protein, 17 aa, Mycobacterium bovis
RGAIAQTWWSERFIAVL

SEQ ID NO: 222127 - protein, 26 aa, Mycobacterium bovis
RGAMHRSRLEHLVAPKFFKDTAFTYD

SEQ ID NO: 222128 - protein, 27 aa, Mycobacterium bovis
RGARRVVVASFLLAEGLFQERLRASGA

SEQ ID NO: 222129 - protein, 18 aa, Mycobacterium bovis
RGARVVVVAPYEGPLRDS

SEQ ID NO: 222130 - protein, 18 aa, Mycobacterium bovis
RGASALSLSLLSISRSGN

SEQ ID NO: 222131 - protein, 19 aa, Mycobacterium bovis
RGAYLEQLLGGLLADLGVH

SEQ ID NO: 222132 - protein, 18 aa, Mycobacterium bovis
RGCEGDALLMLLDANGIE

SEQ ID NO: 222133 - protein, 25 aa, Mycobacterium bovis
RGDDGRFLWPGFGENSRVLKWIVDR

SEQ ID NO: 222134 - protein, 18 aa, Mycobacterium bovis
RGDLAQFAEAALAGGVDI

SEQ ID NO: 222135 - protein, 19 aa, Mycobacterium bovis
RGECEFIIRLLPDGVMSNY

SEQ ID NO: 222136 - protein, 18 aa, Mycobacterium bovis
RGEFEERLKAVLDDIKNS

SEQ ID NO: 222137 - protein, 25 aa, Mycobacterium bovis
RGEIARRVFATCRRLGLGTVAVYTD

SEQ ID NO: 222138 - protein, 24 aa, Mycobacterium bovis
RGEPQALIRVGIAPPLAAVPAPTP

SEQ ID NO: 222139 - protein, 19 aa, Mycobacterium bovis
RGERIWVAGYAVRDPSPRA

SEQ ID NO: 222140 - protein, 18 aa, Mycobacterium bovis
RGFDLDLTELIYFDQRND

SEQ ID NO: 222141 - protein, 19 aa, Mycobacterium bovis
RGFFGSRPFSRANELLVGM

SEQ ID NO: 222142 - protein, 18 aa, Mycobacterium bovis
RGFHRDRDLAAEWTRLAA

SEQ ID NO: 222143 - protein, 32 aa, Mycobacterium bovis
RGFSVARRLALLLTFPRFLPTTGPITMRSTAL

SEQ ID NO: 222144 - protein, 22 aa, Mycobacterium bovis
RGGDAGLLFGAAGTGGHGAAGG

SEQ ID NO: 222145 - protein, 19 aa, Mycobacterium bovis
RGGKGIDGGFGGDGGNGGS

SEQ ID NO: 222146 - protein, 27 aa, Mycobacterium bovis
RGGLRARVLRRWSVPPVRPPVTVVQAL

SEQ ID NO: 222147 - protein, 18 aa, Mycobacterium bovis
RGHDYTDLALVTDGLRAE

SEQ ID NO: 222148 - protein, 20 aa, Mycobacterium bovis
RGHVIYRTELYERATAQRFA

SEQ ID NO: 222149 - protein, 17 aa, Mycobacterium bovis
RGIDVSFPLGVLTSVTG

SEQ ID NO: 222150 - protein, 19 aa, Mycobacterium bovis
RGIDWRAIYAGRGREYMPF

SEQ ID NO: 222151 - protein, 26 aa, Mycobacterium bovis
RGIESDALRLVYLPEVDLRTGDIVGT

SEQ ID NO: 222152 - protein, 27 aa, Mycobacterium bovis
RGITVANMPNLFFLLGPNTGLGHNSVV

SEQ ID NO: 222153 - protein, 22 aa, Mycobacterium bovis
RGKSVLLNIFPSVDTPVCATSV

SEQ ID NO: 222154 - protein, 21 aa, Mycobacterium bovis
RGKVIARIIPASAGPLDSLIS

SEQ ID NO: 222155 - protein, 36 aa, Mycobacterium bovis
RGLIDRLDYLQWLGIDCIWLPPFYDSPLRDGGYDIR

SEQ ID NO: 222156 - protein, 17 aa, Mycobacterium bovis
RGLNLTGCRLRETSLVD

SEQ ID NO: 222157 - protein, 17 aa, Mycobacterium bovis
RGLTLFETTPGLEACDA

SEQ ID NO: 222158 - protein, 36 aa, Mycobacterium bovis
RGMAKLAFDVTPPAWLEPGQWWALVRVGCAGQLVYS

SEQ ID NO: 222159 - protein, 30 aa, Mycobacterium bovis
RGMALAAELCLPLVLVIDAAGPALSAAAEQ

SEQ ID NO: 222160 - protein, 30 aa, Mycobacterium bovis
RGNLAAAMQGLLALPLLAGYDIHASDPQSA

SEQ ID NO: 222161 - protein, 20 aa, Mycobacterium bovis
RGNWPPGFPKSERPSYSLAE

SEQ ID NO: 222162 - protein, 32 aa, Mycobacterium bovis
RGPEMLSFVLKHTPLKMCWVPGYSDYYPEAPG

SEQ ID NO: 222163 - protein, 18 aa, Mycobacterium bovis
RGPETTAVVLVDLLVGEM

SEQ ID NO: 222164 - protein, 20 aa, Mycobacterium bovis
RGPRALTRAAAFIHHLPVDQ

SEQ ID NO: 222165 - protein, 24 aa, Mycobacterium bovis
RGPSQWLLRMLATQTQRAELVPLL

SEQ ID NO: 222166 - protein, 25 aa, Mycobacterium bovis
RGQNVYPMTLLGTFSPYMVVHRSSV

SEQ ID NO: 222167 - protein, 25 aa, Mycobacterium bovis
RGRDRLLVLGLARGGVPVGWEVASA

SEQ ID NO: 222168 - protein, 20 aa, Mycobacterium bovis
RGRHPLPSGASLQATVRRCG

SEQ ID NO: 222169 - protein, 31 aa, Mycobacterium bovis
RGRLFGLAGDVLLWSGPPIYTLATAADELGL

SEQ ID NO: 222170 - protein, 18 aa, Mycobacterium bovis
RGRRKTRIGYVVSDKMQK

SEQ ID NO: 222171 - protein, 21 aa, Mycobacterium bovis
RGRTDTPHTPLLAGLPPLAAD

SEQ ID NO: 222172 - protein, 26 aa, Mycobacterium bovis
RGRVKQLLLKIGWPAEDLAGYVDGEA

SEQ ID NO: 222173 - protein, 30 aa, Mycobacterium bovis
RGRWNVPKKLTTFTLWGSGVLDLRYADFTS

SEQ ID NO: 222174 - protein, 25 aa, Mycobacterium bovis
RGSGDVLMVAWMNDEALARTLQTRE

SEQ ID NO: 222175 - protein, 18 aa, Mycobacterium bovis
RGSRVVLRVPRRGDKRAL

SEQ ID NO: 222176 - protein, 25 aa, Mycobacterium bovis
RGSSLDALTLSVLRSWLAATAGAGA

SEQ ID NO: 222177 - protein, 17 aa, Mycobacterium bovis
RGTAPAGRGFWFPPTVL

SEQ ID NO: 222178 - protein, 23 aa, Mycobacterium bovis
RGTPTRLLLLRHGQTELSEQRRY

SEQ ID NO: 222179 - protein, 26 aa, Mycobacterium bovis
RGVASVAFLPWPLRAVAGPFNLFATT

SEQ ID NO: 222180 - protein, 33 aa, Mycobacterium bovis
RGVHQFLGRRRFVYPWVAWLVQRGAAPGDVLVF

SEQ ID NO: 222181 - protein, 17 aa, Mycobacterium bovis
RGVPVAAPWDARRAREL

SEQ ID NO: 222182 - protein, 17 aa, Mycobacterium bovis
RGVRLVTFDAGVFTLAQ

SEQ ID NO: 222183 - protein, 30 aa, Mycobacterium bovis
RGWAVTNPARWALLYGSPVPGYHAPPDRTA

SEQ ID NO: 222184 - protein, 25 aa, Mycobacterium bovis
RGWREHGFHLDIWALNYAGPRHEVS

SEQ ID NO: 222185 - protein, 29 aa, Mycobacterium bovis
RGYHRREDKPFWWAHFDRLNYPVDEWSDS

SEQ ID NO: 222186 - protein, 19 aa, Mycobacterium bovis
RHAGLSYLLVPLDQPGVQI

SEQ ID NO: 222187 - protein, 21 aa, Mycobacterium bovis
RHCVRVIPWEITGRHFRFGPE

SEQ ID NO: 222188 - protein, 25 aa, Mycobacterium bovis
RHDRPPEWLVRQLAALLPELARYPS

SEQ ID NO: 222189 - protein, 24 aa, Mycobacterium bovis
RHDTYRSWFQYNGNGQIIRRTIQD

SEQ ID NO: 222190 - protein, 26 aa, Mycobacterium bovis
RHECLEYALAHDERFGIWGGLSERER

SEQ ID NO: 222191 - protein, 18 aa, Mycobacterium bovis
RHERLWEVLGAHPRSFTT

SEQ ID NO: 222192 - protein, 17 aa, Mycobacterium bovis
RHFGARRKAYNWTVAQL

SEQ ID NO: 222193 - protein, 18 aa, Mycobacterium bovis
RHFNWVRSWYDFAVEGIG

SEQ ID NO: 222194 - protein, 23 aa, Mycobacterium bovis
RHGRPLLRHRVELGAGSLADDVI

SEQ ID NO: 222195 - protein, 17 aa, Mycobacterium bovis
RHHDELMRLGATAPGAT

SEQ ID NO: 222196 - protein, 19 aa, Mycobacterium bovis
RHHDGLLAALRALLCSGEL

SEQ ID NO: 222197 - protein, 17 aa, Mycobacterium bovis
RHHGNIAALAEIAPPSI

SEQ ID NO: 222198 - protein, 34 aa, Mycobacterium bovis
RHLHGRSRLWLFRYQGTPIAFFLNVWGADENYIL

SEQ ID NO: 222199 - protein, 20 aa, Mycobacterium bovis
RHLLDPMPRGELSYGPLHEG

SEQ ID NO: 222200 - protein, 19 aa, Mycobacterium bovis
RHLLEHKPSTRTRRLDGRT

SEQ ID NO: 222201 - protein, 17 aa, Mycobacterium bovis
RHNLGFVVADLLAARLG

SEQ ID NO: 222202 - protein, 28 aa, Mycobacterium bovis
RHPASVGFPLHHPPMRTFLGVPVRIRDE

SEQ ID NO: 222203 - protein, 18 aa, Mycobacterium bovis
RHPDLRWVDLGRRRSHRA

SEQ ID NO: 222204 - protein, 27 aa, Mycobacterium bovis
RHPDSKFDILKLPPRNAPPAALTALVE

SEQ ID NO: 222205 - protein, 24 aa, Mycobacterium bovis
RHPGYRLHPVVLDAALQSVGAAIP

SEQ ID NO: 222206 - protein, 27 aa, Mycobacterium bovis
RHPHTLQLIMDSLRYWVIEMHVDGFRF

SEQ ID NO: 222207 - protein, 36 aa, Mycobacterium bovis
RHPRSLFPEFSELFAAFPSFAGLRPTFDTRLMRLED

SEQ ID NO: 222208 - protein, 20 aa, Mycobacterium bovis
RHPRWRGKKALLLQGRLWQG

SEQ ID NO: 222209 - protein, 17 aa, Mycobacterium bovis
RHPVTVDARRIGRWRFV

SEQ ID NO: 222210 - protein, 18 aa, Mycobacterium bovis
RHRGLDVVRLGPALWGDL

SEQ ID NO: 222211 - protein, 20 aa, Mycobacterium bovis
RHRTILSSLGLPVSYDPDAL

SEQ ID NO: 222212 - protein, 21 aa, Mycobacterium bovis
RHRVPVYTIAPFATGGLHKMS

SEQ ID NO: 222213 - protein, 25 aa, Mycobacterium bovis
RHSFLGAPFWVGRGFGLNLSVVTDP

SEQ ID NO: 222214 - protein, 26 aa, Mycobacterium bovis
RHTQTWIQKYIFPGGLLPSTQAIIDI

SEQ ID NO: 222215 - protein, 18 aa, Mycobacterium bovis
RHTRIRRLVSSGLTPRMI

SEQ ID NO: 222216 - protein, 17 aa, Mycobacterium bovis
RHVGVQLLRLHDAIYRG

SEQ ID NO: 222217 - protein, 30 aa, Mycobacterium bovis
RIAEEIGYPVLVRPSYVLGGRGMEIVYDEE

SEQ ID NO: 222218 - protein, 21 aa, Mycobacterium bovis
RIAELPEHIVIVGSGFIAAEF

SEQ ID NO: 222219 - protein, 19 aa, Mycobacterium bovis
RIALHVRVLYGRDPHHITE

SEQ ID NO: 222220 - protein, 29 aa, Mycobacterium bovis
RIAQAQLVGWLEGLFHGIQTALFAQQMAA

SEQ ID NO: 222221 - protein, 28 aa, Mycobacterium bovis
RIASPPVKWPCFYGIDFPSPAELIANAV

SEQ ID NO: 222222 - protein, 18 aa, Mycobacterium bovis
RICMDQFMVDLGPGPLDV

SEQ ID NO: 222223 - protein, 31 aa, Mycobacterium bovis
RIDAVHAAVLDLLARICDPLTGIKEVWEFLT

SEQ ID NO: 222224 - protein, 17 aa, Mycobacterium bovis
RIDTDVLAALRSAERAP

SEQ ID NO: 222225 - protein, 19 aa, Mycobacterium bovis
RIDVLINNAGVMWTPKQVT

SEQ ID NO: 222226 - protein, 26 aa, Mycobacterium bovis
RIDVTVRISGFFRDAFPHVVTMLDDA

SEQ ID NO: 222227 - protein, 19 aa, Mycobacterium bovis
RIELAPRGVQVVGVYVGLV

SEQ ID NO: 222228 - protein, 17 aa, Mycobacterium bovis
RIELSEAAFRRFVAALD

SEQ ID NO: 222229 - protein, 25 aa, Mycobacterium bovis
RIGHLAARLATLGPAATLARGYAIV

SEQ ID NO: 222230 - protein, 19 aa, Mycobacterium bovis
RIGRIVGEAARWGVRELFL

SEQ ID NO: 222231 - protein, 18 aa, Mycobacterium bovis
RIHRIWETTWPSWRNVAA

SEQ ID NO: 222232 - protein, 18 aa, Mycobacterium bovis
RILDINVYGVILGSKLAA

SEQ ID NO: 222233 - protein, 19 aa, Mycobacterium bovis
RILEEVWGFDFPTSGNALE

SEQ ID NO: 222234 - protein, 18 aa, Mycobacterium bovis
RILLTRDRGLLKRRAITH

SEQ ID NO: 222235 - protein, 17 aa, Mycobacterium bovis
RIPMLAGRRSLNLSNAA

SEQ ID NO: 222236 - protein, 22 aa, Mycobacterium bovis
RIQEEMFYQLEAPVLRACGFDT

SEQ ID NO: 222237 - protein, 25 aa, Mycobacterium bovis
RIQGGWLEFDAAIAAPDQMAKVGRI

SEQ ID NO: 222238 - protein, 21 aa, Mycobacterium bovis
RIQLRDALRAALLAFNTFDES

SEQ ID NO: 222239 - protein, 27 aa, Mycobacterium bovis
RIQRRGMADNYWSMGIPGPCGPSSEIY

SEQ ID NO: 222240 - protein, 20 aa, Mycobacterium bovis
RIRAANFAALRPWPGLTVEI

SEQ ID NO: 222241 - protein, 17 aa, Mycobacterium bovis
RIRKALIEVSPLPIPVA

SEQ ID NO: 222242 - protein, 32 aa, Mycobacterium bovis
RIRVCDWLPDDPYPRAKVRFWPDQPGHPVTAA

SEQ ID NO: 222243 - protein, 25 aa, Mycobacterium bovis
RISGKKGERIVYIRTLVTGKSSSAS

SEQ ID NO: 222244 - protein, 38 aa, Mycobacterium bovis
RISGPAVRWVMTGWQRLHFRFGFPAPLLEPLAVERLYL

SEQ ID NO: 222245 - protein, 27 aa, Mycobacterium bovis
RITEAVYFVERLVDCLAFELKMDPAEL

SEQ ID NO: 222246 - protein, 17 aa, Mycobacterium bovis
RITGWPRVSVQPADHIL

SEQ ID NO: 222247 - protein, 18 aa, Mycobacterium bovis
RITQDLLDRTRKPFQSVI

SEQ ID NO: 222248 - protein, 19 aa, Mycobacterium bovis
RITWSNWIDEQLLGPQRFT

SEQ ID NO: 222249 - protein, 26 aa, Mycobacterium bovis
RIVDIQLAQLGKRLAQRRLQLQVSLP

SEQ ID NO: 222250 - protein, 27 aa, Mycobacterium bovis
RIVVTGNYRAWRHFIAMRASEHADVEI

SEQ ID NO: 222251 - protein, 31 aa, Mycobacterium bovis
RKAKKLRVRLPLPKLIVAVENPQLLRPFVDL

SEQ ID NO: 222252 - protein, 26 aa, Mycobacterium bovis
RKALVARLYARRYLADQGPLRGIDAD

SEQ ID NO: 222253 - protein, 17 aa, Mycobacterium bovis
RKARLLLGSGHSVILDG

SEQ ID NO: 222254 - protein, 24 aa, Mycobacterium bovis
RKEIRDIVAYLRVLDNPGDAVSLR

SEQ ID NO: 222255 - protein, 18 aa, Mycobacterium bovis
RKFDCEAWIPTQGAYREL

SEQ ID NO: 222256 - protein, 20 aa, Mycobacterium bovis
RKFLAYYERDGVLVGVVGGG

SEQ ID NO: 222257 - protein, 19 aa, Mycobacterium bovis
RKGMAVLLDALPKVVQRFP

SEQ ID NO: 222258 - protein, 25 aa, Mycobacterium bovis
RKHKGACIFLNRPGFAGGAGCALHS

SEQ ID NO: 222259 - protein, 22 aa, Mycobacterium bovis
RKHRQYPAHRKPAPSWRHTACP

SEQ ID NO: 222260 - protein, 17 aa, Mycobacterium bovis
RKICRVERFTLLEHGFV

SEQ ID NO: 222261 - protein, 22 aa, Mycobacterium bovis
RKIIGRQFIRAFEGAVRDVLDG

SEQ ID NO: 222262 - protein, 27 aa, Mycobacterium bovis
RKKWFGKRDVLPGVGLYLDGGFGVGKT

SEQ ID NO: 222263 - protein, 22 aa, Mycobacterium bovis
RKLAQEYTYRYLAAALTWFVDD

SEQ ID NO: 222264 - protein, 25 aa, Mycobacterium bovis
RKLPKRRPVPLRLRDWREVYEEFDN

SEQ ID NO: 222265 - protein, 22 aa, Mycobacterium bovis
RKLQLPRDAALVTILRGPRVIV

SEQ ID NO: 222266 - protein, 17 aa, Mycobacterium bovis
RKLYQACRRWPKLMRRL

SEQ ID NO: 222267 - protein, 24 aa, Mycobacterium bovis
RKPAALRFIRSCSAPLTAQAALAL

SEQ ID NO: 222268 - protein, 23 aa, Mycobacterium bovis
RKPAPHEFIPFSGGLHRCIGAVM

SEQ ID NO: 222269 - protein, 24 aa, Mycobacterium bovis
RKRLRQWMMRITAYADRLLDDLDV

SEQ ID NO: 222270 - protein, 25 aa, Mycobacterium bovis
RKRRQPVTVLLKALGWTSEQIVERF

SEQ ID NO: 222271 - protein, 17 aa, Mycobacterium bovis
RKRRRGRIGTKRSSISD

SEQ ID NO: 222272 - protein, 23 aa, Mycobacterium bovis
RKTLPGLRALQKYAVRTGGGVNH

SEQ ID NO: 222273 - protein, 36 aa, Mycobacterium bovis; identical to SEQ ID NO: 17410

SEQ ID NO: 222274 - protein, 19 aa, Mycobacterium bovis
RKVSPLAVQMIMPNGAAAV

SEQ ID NO: 222275 - protein, 31 aa, Mycobacterium bovis
RLAADQLGLPTAPFWFVGSLGELQAVAVHAG

SEQ ID NO: 222276 - protein, 18 aa, Mycobacterium bovis
RLAALARLFAVASNPTHR

SEQ ID NO: 222277 - protein, 17 aa, Mycobacterium bovis
RLAALLRFSADRAADWY

SEQ ID NO: 222278 - protein, 18 aa, Mycobacterium bovis
RLADLLAARTRYFDAFFR

SEQ ID NO: 222279 - protein, 17 aa, Mycobacterium bovis
RLADPMLALSGLSGLIT

SEQ ID NO: 222280 - protein, 24 aa, Mycobacterium bovis
RLAELAGLPLFERLAQRIVDGERN

SEQ ID NO: 222281 - protein, 24 aa, Mycobacterium bovis
RLAELWSIMDFLNPGLLGSSERFR

SEQ ID NO: 222282 - protein, 26 aa, Mycobacterium bovis
RLAERPANLAFFLRALTDRRRARGCA

SEQ ID NO: 222283 - protein, 18 aa, Mycobacterium bovis
RLAIVYPGEHRFPLSDTV

SEQ ID NO: 222284 - protein, 20 aa, Mycobacterium bovis
RLARRFAHLTYRGEIELDTR

SEQ ID NO: 222285 - protein, 17 aa, Mycobacterium bovis
RLATLGPLLQDLEARII

SEQ ID NO: 222286 - protein, 25 aa, Mycobacterium bovis
RLAVEWPLELFGHITAMPVPAVVKL

SEQ ID NO: 222287 - protein, 17 aa, Mycobacterium bovis
RLCDAFGIPLVVVVDVP

SEQ ID NO: 222288 - protein, 21 aa, Mycobacterium bovis
RLCPAPCEPACVLGINQDPVT

SEQ ID NO: 222289 - protein, 25 aa, Mycobacterium bovis
RLCSDTLELLLRSTGYNDDVTLLAM

SEQ ID NO: 222290 - protein, 24 aa, Mycobacterium bovis
RLDAEILALVKRRAEVSKAIGKAR

SEQ ID NO: 222291 - protein, 24 aa, Mycobacterium bovis
RLDDRFQFGVLLTAAPEATPFGPT

SEQ ID NO: 222292 - protein, 23 aa, Mycobacterium bovis
RLDFRPKHKLAVLVVCAIPLAEP

SEQ ID NO: 222293 - protein, 20 aa, Mycobacterium bovis
RLDIVVANAGVLGWGRLWEL

SEQ ID NO: 222294 - protein, 24 aa, Mycobacterium bovis
RLDKARFRSHPDLEVLTHGLTLWD

SEQ ID NO: 222295 - protein, 33 aa, Mycobacterium bovis
RLDPARPPHVGVLLQNTPFFSATLVAGALSGIV

SEQ ID NO: 222296 - protein, 20 aa, Mycobacterium bovis
RLDRLAGELSVWSRAAVQIA

SEQ ID NO: 222297 - protein, 17 aa, Mycobacterium bovis
RLDRLLMLAEELGPPQK

SEQ ID NO: 222298 - protein, 18 aa, Mycobacterium bovis
RLDRQIVRASAQWCPRPW

SEQ ID NO: 222299 - protein, 17 aa, Mycobacterium bovis
RLEGYRRLAAASSDREV

SEQ ID NO: 222300 - protein, 20 aa, Mycobacterium bovis
RLELLRRRLADRGLSSAAQD

SEQ ID NO: 222301 - protein, 19 aa, Mycobacterium bovis
RLERLVFVEPPDAAARREI

SEQ ID NO: 222302 - protein, 30 aa, Mycobacterium bovis
RLFDRIAGHRRFRFYLNVEIGKHLGHAELL

SEQ ID NO: 222303 - protein, 19 aa, Mycobacterium bovis
RLFEVIWSPASAATSPGPT

SEQ ID NO: 222304 - protein, 22 aa, Mycobacterium bovis
RLFPTLNYAVSVAEACERADAV

SEQ ID NO: 222305 - protein, 18 aa, Mycobacterium bovis
RLFVVTRQAQIVKPHDSG

SEQ ID NO: 222306 - protein, 30 aa, Mycobacterium bovis
RLGALAGAMRPPAPPAAPPGAPGMPGMPGM

SEQ ID NO: 222307 - protein, 25 aa, Mycobacterium bovis
RLGDLHAVTLHRLLGAKPGARFRQD

SEQ ID NO: 222308 - protein, 17 aa, Mycobacterium bovis
RLGIALPAAVAADLLAP

SEQ ID NO: 222309 - protein, 24 aa, Mycobacterium bovis
RLGIPTIATVPWTTDRLLNALMQD

SEQ ID NO: 222310 - protein, 29 aa, Mycobacterium bovis
RLGLDYVDLYLIHWPAPPVGKYVDAWGGM

SEQ ID NO: 222311 - protein, 27 aa, Mycobacterium bovis
RLGRPEELAGLYLYLASEASSYMTGSD

SEQ ID NO: 222312 - protein, 28 aa, Mycobacterium bovis
RLGWGWARFAFTSWKTLGWVDANVWRHV

SEQ ID NO: 222313 - protein, 19 aa, Mycobacterium bovis
RLHAELARRDPAAAAAILP

SEQ ID NO: 222314 - protein, 19 aa, Mycobacterium bovis
RLHCDDEMYPLPRPHQPLL

SEQ ID NO: 222315 - protein, 18 aa, Mycobacterium bovis
RLHGYPLGILANARGVLF

SEQ ID NO: 222316 - protein, 17 aa, Mycobacterium bovis
RLIAGLDDAVVGLSADE

SEQ ID NO: 222317 - protein, 17 aa, Mycobacterium bovis
RLIAMKLVASRASDYMR

SEQ ID NO: 222318 - protein, 17 aa, Mycobacterium bovis
RLIDLATRMPRVLADTP

SEQ ID NO: 222319 - protein, 19 aa, Mycobacterium bovis
RLIQRITDRLPAKAPLLEL

SEQ ID NO: 222320 - protein, 24 aa, Mycobacterium bovis
RLKPRVFYDLVVEVALIRPGPIQG

SEQ ID NO: 222321 - protein, 26 aa, Mycobacterium bovis
RLKQALYPKLLPIARNWWAKLGREAP

SEQ ID NO: 222322 - protein, 17 aa, Mycobacterium bovis
RLKYRYLDLRRDDPAAA

SEQ ID NO: 222323 - protein, 26 aa, Mycobacterium bovis
RLLADGGILDPLPMAPIAGVNADLTI

SEQ ID NO: 222324 - protein, 21 aa, Mycobacterium bovis
RLLASFRVQPATEVIARRAGD

SEQ ID NO: 222325 - protein, 19 aa, Mycobacterium bovis
RLLDAILADLYGPRSMLTE

SEQ ID NO: 222326 - protein, 19 aa, Mycobacterium bovis
RLLDALPPRRQPPKTVPPL

SEQ ID NO: 222327 - protein, 18 aa, Mycobacterium bovis
RLLDRMKDKWRSDLTSDG

SEQ ID NO: 222328 - protein, 21 aa, Mycobacterium bovis
RLLDVHANTWRYNQLIAQQRA

SEQ ID NO: 222329 - protein, 26 aa, Mycobacterium bovis
RLLRELEARIIQWRNANPQLAANYRA

SEQ ID NO: 222330 - protein, 17 aa, Mycobacterium bovis
RLLWSELVAQFAPKSAK

SEQ ID NO: 222331 - protein, 18 aa, Mycobacterium bovis
RLMILASEDIGMADPSAL

SEQ ID NO: 222332 - protein, 20 aa, Mycobacterium bovis
RLMVALQRRISEDNPGVGRH

SEQ ID NO: 222333 - protein, 18 aa, Mycobacterium bovis
RLNIIRRLHPAFQQLRTI

SEQ ID NO: 222334 - protein, 29 aa, Mycobacterium bovis
RLNIPDPDPLRLIYFADADPVFALCEHAK

SEQ ID NO: 222335 - protein, 20 aa, Mycobacterium bovis
RLNVYVPDELAERARARGLN

SEQ ID NO: 222336 - protein, 25 aa, Mycobacterium bovis
RLPEIPQLRWRVTGAPLGLDRPWFV

SEQ ID NO: 222337 - protein, 24 aa, Mycobacterium bovis
RLPEPLAMLSPDEGLLTAGWATLR

SEQ ID NO: 222338 - protein, 18 aa, Mycobacterium bovis
RLPFHKPVDDMTGLSQAI

SEQ ID NO: 222339 - protein, 18 aa, Mycobacterium bovis
RLPIDVIATVPMAENMPS

SEQ ID NO: 222340 - protein, 17 aa, Mycobacterium bovis
RLPRLIGHSRAMDMILT

SEQ ID NO: 222341 - protein, 32 aa, Mycobacterium bovis
RLPRYLQSVLYLRFREWFLPAMHRKYGDVFSL

SEQ ID NO: 222342 - protein, 23 aa, Mycobacterium bovis
RLPSIYFAHRRKVFQRDGMLLAV

SEQ ID NO: 222343 - protein, 27 aa, Mycobacterium bovis
RLQADLLGPVDLPPGVRRPAGIPADAP

SEQ ID NO: 222344 - protein, 27 aa, Mycobacterium bovis
RLQDRVLLRFGLHQALRLGKPLQFHVG

SEQ ID NO: 222345 - protein, 17 aa, Mycobacterium bovis
RLQPGRMFLVDTAQGRI

SEQ ID NO: 222346 - protein, 20 aa, Mycobacterium bovis
RLQYFVSCLVYMPRDRYTTA

SEQ ID NO: 222347 - protein, 19 aa, Mycobacterium bovis
RLRALDYPKVVIGVSGGLD

SEQ ID NO: 222348 - protein, 18 aa, Mycobacterium bovis
RLRALEHGVEVIGYWGEA

SEQ ID NO: 222349 - protein, 24 aa, Mycobacterium bovis
RLRASTRPYILRRLKTDPAIIDDL

SEQ ID NO: 222350 - protein, 19 aa, Mycobacterium bovis
RLRGQGHTPLLVACDLQRP

SEQ ID NO: 222351 - protein, 20 aa, Mycobacterium bovis
RLRLEHVGAIRPDQLRRAAE

SEQ ID NO: 222352 - protein, 18 aa, Mycobacterium bovis
RLRLVLEVPTLREVPTWH

SEQ ID NO: 222353 - protein, 28 aa, Mycobacterium bovis
RLRMRHAPFRISLIERDAWLRCMHTAVA

SEQ ID NO: 222354 - protein, 35 aa, Mycobacterium bovis
RLRPGATVSLPCAPFLHLFVAYGRLTLEGGGELAD

SEQ ID NO: 222355 - protein, 25 aa, Mycobacterium bovis
RLRQKVVVPTLPTAAPRWVVDPDFN

SEQ ID NO: 222356 - protein, 20 aa, Mycobacterium bovis
RLRVRLADRALTQTNPLLSV

SEQ ID NO: 222357 - protein, 27 aa, Mycobacterium bovis
RLSAQAAGFHAQFVQALNAGVNSYASA

SEQ ID NO: 222358 - protein, 20 aa, Mycobacterium bovis
RLSPYLALHGICRWGGSDSC

SEQ ID NO: 222359 - protein, 20 aa, Mycobacterium bovis
RLSTCAGVTSLPPAHRLTGN

SEQ ID NO: 222360 - protein, 20 aa, Mycobacterium bovis
RLSVPASWSTAAPATAAGAA

SEQ ID NO: 222361 - protein, 21 aa, Mycobacterium bovis
RLTALLSGVYLNLAPVILDAG

SEQ ID NO: 222362 - protein, 21 aa, Mycobacterium bovis
RLTAVWIADWADDTVHLSAHH

SEQ ID NO: 222363 - protein, 24 aa, Mycobacterium bovis
RLTELPLTLFTDPAAPGLACTPFV

SEQ ID NO: 222364 - protein, 19 aa, Mycobacterium bovis
RLTGRSPILLAGMTPTTVD

SEQ ID NO: 222365 - protein, 22 aa, Mycobacterium bovis
RLTSDLYGWLTTVARSGQPVPR

SEQ ID NO: 222366 - protein, 18 aa, Mycobacterium bovis
RLTTVRRKYDPDRIMYSG

SEQ ID NO: 222367 - protein, 38 aa, Mycobacterium bovis
RLVAGWHVVALQPYGGVWLHSWLDRDLGISGRLSVRDG

SEQ ID NO: 222368 - protein, 32 aa, Mycobacterium bovis
RLVDDDLADLFLPRPLRWLAGATRSAVLRRLL

SEQ ID NO: 222369 - protein, 30 aa, Mycobacterium bovis
RLVDLPPTPWHHQRFWVTDRSAMSELAATH

SEQ ID NO: 222370 - protein, 18 aa, Mycobacterium bovis
RLVELLKQPQSQPMPVEE

SEQ ID NO: 222371 - protein, 19 aa, Mycobacterium bovis
RLVLDPGLGFAKTAQHNWA

SEQ ID NO: 222372 - protein, 23 aa, Mycobacterium bovis
RLVPADFIGFAQPLDDLPTAEGT

SEQ ID NO: 222373 - protein, 18 aa, Mycobacterium bovis
RLVRIDDPILRVPQLAIH

SEQ ID NO: 222374 - protein, 18 aa, Mycobacterium bovis
RLVRIPWDLDSYGIHPDD

SEQ ID NO: 222375 - protein, 25 aa, Mycobacterium bovis
RLVTTSRQYGIEPQQLFGYLQERNQ

SEQ ID NO: 222376 - protein, 18 aa, Mycobacterium bovis
RLVVELTPDEAAALGDEL

SEQ ID NO: 222377 - protein, 17 aa, Mycobacterium bovis
RLVVGRRGDLADQESLG

SEQ ID NO: 222378 - protein, 18 aa, Mycobacterium bovis
RLWEALLRGDDLVTEIPA

SEQ ID NO: 222379 - protein, 17 aa, Mycobacterium bovis
RLWEVLGAHPRSFTTAD

SEQ ID NO: 222380 - protein, 19 aa, Mycobacterium bovis
RLYDIELALRLGATVERVA

SEQ ID NO: 222381 - protein, 22 aa, Mycobacterium bovis
RLYERLLGWLADIQQPRPADCL

SEQ ID NO: 222382 - protein, 20 aa, Mycobacterium bovis
RLYHVLHAIADTIRHNEAAL

SEQ ID NO: 222383 - protein, 19 aa, Mycobacterium bovis
RMELLSLPQDEWAGRLRRL

SEQ ID NO: 222384 - protein, 21 aa, Mycobacterium bovis
RMGMHPAVLDAVLHALGLAVE

SEQ ID NO: 222385 - protein, 18 aa, Mycobacterium bovis
RMIDNFFAEILRGVSAGR

SEQ ID NO: 222386 - protein, 18 aa, Mycobacterium bovis
RMLIVPGSMRVRAQAEAE

SEQ ID NO: 222387 - protein, 18 aa, Mycobacterium bovis
RMLPLADRVLELMPAQVS

SEQ ID NO: 222388 - protein, 18 aa, Mycobacterium bovis
RMLRDIPGLTVTRIASGL

SEQ ID NO: 222389 - protein, 22 aa, Mycobacterium bovis
RMNELIPLALRLIEEGFALYGD

SEQ ID NO: 222390 - protein, 23 aa, Mycobacterium bovis
RMNGGFFPSVREYSVRYGLTERR

SEQ ID NO: 222391 - protein, 20 aa, Mycobacterium bovis
RMNIGQILETHLGWCAHSGW

SEQ ID NO: 222392 - protein, 17 aa, Mycobacterium bovis
RMPYTVGLLGSVPRLDA

SEQ ID NO: 222393 - protein, 32 aa, Mycobacterium bovis
RMRERMTILANRWRAYGFDLDMNELVYFGDRN

SEQ ID NO: 222394 - protein, 24 aa, Mycobacterium bovis
RMRHGMYWSGDLAYRDSEGWIYLA

SEQ ID NO: 222395 - protein, 17 aa, Mycobacterium bovis
RMVLVEVVLPRLEIPRL

SEQ ID NO: 222396 - protein, 18 aa, Mycobacterium bovis
RNAELVHIFTKDAKAFGI

SEQ ID NO: 222397 - protein, 32 aa, Mycobacterium bovis
RNDPRNPSPVYLFAYDPMAFGGKGRAAIAIGN

SEQ ID NO: 222398 - protein, 18 aa, Mycobacterium bovis
RNDWLTTMRSTTAGVAAS

SEQ ID NO: 222399 - protein, 22 aa, Mycobacterium bovis
RNELLFRHRIDPQRPGRGIGEP

SEQ ID NO: 222400 - protein, 17 aa, Mycobacterium bovis
RNELVAAPVLNAELLRR

SEQ ID NO: 222401 - protein, 20 aa, Mycobacterium bovis
RNFLLPPTWTQLDSLAGHTV

SEQ ID NO: 222402 - protein, 40 aa, Mycobacterium bovis
RNFVKTLLDRAYAKKFRFPTFLGAFKYYTSYTLKTFDGKR

SEQ ID NO: 222403 - protein, 23 aa, Mycobacterium bovis
RNGNRWRVIAVDTEHHRIAARRL

SEQ ID NO: 222404 - protein, 20 aa, Mycobacterium bovis
RNGPWIADRLLELGVELAHI

SEQ ID NO: 222405 - protein, 25 aa, Mycobacterium bovis
RNHARLLRQLGVEAARVRMLRSFDP

SEQ ID NO: 222406 - protein, 25 aa, Mycobacterium bovis
RNHIARRLFVPPPDPVAVLRELVLL

SEQ ID NO: 222407 - protein, 19 aa, Mycobacterium bovis
RNHQLPPVGDVTSPVKQRL

SEQ ID NO: 222408 - protein, 34 aa, Mycobacterium bovis
RNHRDDYLPCLVSIQFRLLPDGKDYVFHTTFYSR

SEQ ID NO: 222409 - protein, 23 aa, Mycobacterium bovis
RNIELLAKRFPFERYRRLCDVGC

SEQ ID NO: 222410 - protein, 27 aa, Mycobacterium bovis
RNLFRDMVHPLIARPLPAETGPAPFRH

SEQ ID NO: 222411 - protein, 17 aa, Mycobacterium bovis
RNLRKITIAQVHGAVLS

SEQ ID NO: 222412 - protein, 18 aa, Mycobacterium bovis
RNPIQAGDLVHLFLVQPN

SEQ ID NO: 222413 - protein, 17 aa, Mycobacterium bovis
RNPLRFAAPCPGQHGWR

SEQ ID NO: 222414 - protein, 18 aa, Mycobacterium bovis
RNQGIRVRIGTTWGARCG

SEQ ID NO: 222415 - protein, 23 aa, Mycobacterium bovis
RNQITLRRRTGGADAGWHLKLPA

SEQ ID NO: 222416 - protein, 23 aa, Mycobacterium bovis
RNRLNLALTLKQGGNLILLDEPT

SEQ ID NO: 222417 - protein, 17 aa, Mycobacterium bovis
RNRVLVEGVNRIKKHTA

SEQ ID NO: 222418 - protein, 20 aa, Mycobacterium bovis
RNTDQLLFDGLPWVSRAQDE

SEQ ID NO: 222419 - protein, 18 aa, Mycobacterium bovis
RNTHGVSWLPLYHDMGLS

SEQ ID NO: 222420 - protein, 34 aa, Mycobacterium bovis
RNTPHVPIPYVYPVDLRFVLAPPVAPTEATNLLG

SEQ ID NO: 222421 - protein, 27 aa, Mycobacterium bovis
RNVMPVHGTWRMLRANAKLAASTGVPQ

SEQ ID NO: 222422 - protein, 28 aa, Mycobacterium bovis
RNWETFHIAQLLPWIEANFRTYAEYDGR

SEQ ID NO: 222423 - protein, 27 aa, Mycobacterium bovis
RPAMPAECLLDRNALIMGYSGVYSSFL

SEQ ID NO: 222424 - protein, 20 aa, Mycobacterium bovis
RPAPGFFNATTGPSSGFLNW

SEQ ID NO: 222425 - protein, 23 aa, Mycobacterium bovis
RPARHRFLTRNRLVAAVARAAVV

SEQ ID NO: 222426 - protein, 22 aa, Mycobacterium bovis
RPARWMQLLAKHRAQISSAPNF

SEQ ID NO: 222427 - protein, 25 aa, Mycobacterium bovis
RPDAPMAGVTYWRKAAQLKRNEAND

SEQ ID NO: 222428 - protein, 22 aa, Mycobacterium bovis
RPDLRRWLPLDVYRPLKSTLVT

SEQ ID NO: 222429 - protein, 18 aa, Mycobacterium bovis
RPDQLHKLATKLADCLNP

SEQ ID NO: 222430 - protein, 19 aa, Mycobacterium bovis
RPDTLFGATYLVLAPEHDL

SEQ ID NO: 222431 - protein, 22 aa, Mycobacterium bovis
RPEFLNRIDDIIVFHQLTREEI

SEQ ID NO: 222432 - protein, 18 aa, Mycobacterium bovis
RPEIWDEFTTRFGVARVC

SEQ ID NO: 222433 - protein, 27 aa, Mycobacterium bovis
RPELGYRLLQRLGADVADYGFIETSAK

SEQ ID NO: 222434 - protein, 32 aa, Mycobacterium bovis
RPELKLPDLELIFAPAPFYDEALVPPAGHGVV

SEQ ID NO: 222435 - protein, 25 aa, Mycobacterium bovis
RPEMLLHAILKLHEKIQQMPLGINR

SEQ ID NO: 222436 - protein, 29 aa, Mycobacterium bovis
RPERYDRLAQLRDLVLLLSDSLTPRGVGQ

SEQ ID NO: 222437 - protein, 27 aa, Mycobacterium bovis
RPERYQFSVTLPRTLPGSGAGIIEKRD

SEQ ID NO: 222438 - protein, 25 aa, Mycobacterium bovis
RPEVSDGLFLRLAITSVDSLACAYA

SEQ ID NO: 222439 - protein, 18 aa, Mycobacterium bovis
RPGLARLVAVKRGREAAA

SEQ ID NO: 222440 - protein, 26 aa, Mycobacterium bovis
RPGPKGFIGQPIPIAGLYLGSAGCHG

SEQ ID NO: 222441 - protein, 27 aa, Mycobacterium bovis
RPGQKLRIVKYLAYGWSSLRSRPALRD

SEQ ID NO: 222442 - protein, 24 aa, Mycobacterium bovis
RPGQRSFTLDDLSLRYLRRELRAE

SEQ ID NO: 222443 - protein, 26 aa, Mycobacterium bovis
RPGRDAWEFALLRGALQRGMPVLGIC

SEQ ID NO: 222444 - protein, 29 aa, Mycobacterium bovis
RPHTRRWAGPAFLLNQMLVWGFTGQVISA

SEQ ID NO: 222445 - protein, 19 aa, Mycobacterium bovis
RPIGALLMDQTVIAGVGNV

SEQ ID NO: 222446 - protein, 18 aa, Mycobacterium bovis
RPINGLNLDVAAGSLVML

SEQ ID NO: 222447 - protein, 31 aa, Mycobacterium bovis
RPKRVELPTYAFQHQKFWLAPAPSVSDPTAA

SEQ ID NO: 222448 - protein, 34 aa, Mycobacterium bovis
RPLALPSELLAFIQLPIHKAYGFGLPTLPVVAEA

SEQ ID NO: 222449 - protein, 26 aa, Mycobacterium bovis
RPLTASLGLMILASGHRHGWPVARGG

SEQ ID NO: 222450 - protein, 26 aa, Mycobacterium bovis
RPLTDLPVAGYPLVPRVASPRYRCTT

SEQ ID NO: 222451 - protein, 36 aa, Mycobacterium bovis
RPLTLSAPKPMLPTAGLPFLTHLLSRIAAAGIEHVI

SEQ ID NO: 222452 - protein, 18 aa, Mycobacterium bovis
RPLTVAVLLRITEVFGVD

SEQ ID NO: 222453 - protein, 17 aa, Mycobacterium bovis
RPMTRYFPELVAAIRAE

SEQ ID NO: 222454 - protein, 24 aa, Mycobacterium bovis
RPPADPVIFLKPNTAIIGPNTPIR

SEQ ID NO: 222455 - protein, 24 aa, Mycobacterium bovis
RPQLATTLLPALLEALVRNVSRGL

SEQ ID NO: 222456 - protein, 19 aa, Mycobacterium bovis
RPQPILQLPDTNSGWRLVA

SEQ ID NO: 222457 - protein, 20 aa, Mycobacterium bovis
RPQRFQVTASRFGRSVDVAA

SEQ ID NO: 222458 - protein, 27 aa, Mycobacterium bovis
RPQYRELLQEFLFGLDLDEDTRRRAGI

SEQ ID NO: 222459 - protein, 20 aa, Mycobacterium bovis
RPRAVYRKFGLCRICLREMA

SEQ ID NO: 222460 - protein, 23 aa, Mycobacterium bovis
RPRDLRLRVLSWGAAPAPDALLR

SEQ ID NO: 222461 - protein, 35 aa, Mycobacterium bovis
RPREMARTVFIELLAWQFASPVRWIETQDLLFIEE

SEQ ID NO: 222462 - protein, 21 aa, Mycobacterium bovis
RPRPTRELSWVRGAPADAGSF

SEQ ID NO: 222463 - protein, 17 aa, Mycobacterium bovis
RPRSLYAASKTAQEHYA

SEQ ID NO: 222464 - protein, 18 aa, Mycobacterium bovis
RPSAIYVGPGPRSPESVD

SEQ ID NO: 222465 - protein, 17 aa, Mycobacterium bovis
RPSAWIAEGLLVYLSAE

SEQ ID NO: 222466 - protein, 17 aa, Mycobacterium bovis
RPSHEKLAWARRVLAAS

SEQ ID NO: 222467 - protein, 18 aa, Mycobacterium bovis
RPSWAPLPVQYADYSVWQ

SEQ ID NO: 222468 - protein, 26 aa, Mycobacterium bovis
RPTRPHPLFVAFVGAAIDYKAGELLP

SEQ ID NO: 222469 - protein, 19 aa, Mycobacterium bovis
RPVFICGPGPFMQAARDAL

SEQ ID NO: 222470 - protein, 19 aa, Mycobacterium bovis
RPVGVDALITALWEEWPPS

SEQ ID NO: 222471 - protein, 19 aa, Mycobacterium bovis
RPVVSWFDQGTRDVIGLRI

SEQ ID NO: 222472 - protein, 29 aa, Mycobacterium bovis
RPVWDVEPWDRWLRDFFGPAATTDWYRPV

SEQ ID NO: 222473 - protein, 25 aa, Mycobacterium bovis
RQAAWPERMFSLLAGFVEAGESFEV

SEQ ID NO: 222474 - protein, 29 aa, Mycobacterium bovis
RQAGTLGYFPLWGYATPPAIELAERLARY

SEQ ID NO: 222475 - protein, 17 aa, Mycobacterium bovis
RQAQLRTLTRKYAADID

SEQ ID NO: 222476 - protein, 19 aa, Mycobacterium bovis
RQCLNAGLGFGGGCLPKDI

SEQ ID NO: 222477 - protein, 21 aa, Mycobacterium bovis
RQDIDDIFWLQATIAQELATS

SEQ ID NO: 222478 - protein, 18 aa, Mycobacterium bovis
RQECERLGLPVFVKPARG

SEQ ID NO: 222479 - protein, 20 aa, Mycobacterium bovis
RQEIARIYTVLRERELGLAT

SEQ ID NO: 222480 - protein, 21 aa, Mycobacterium bovis
RQFRASVCVLGPLVGRCKRAR

SEQ ID NO: 222481 - protein, 19 aa, Mycobacterium bovis
RQFYQLGVSPIPPNKPNIR

SEQ ID NO: 222482 - protein, 26 aa, Mycobacterium bovis
RQGIAQLFDVPPLPYQELKIATAERG

SEQ ID NO: 222483 - protein, 23 aa, Mycobacterium bovis
RQGKTVLFLGRYDEPRKGMAVLL

SEQ ID NO: 222484 - protein, 22 aa, Mycobacterium bovis
RQGSFLGYRVTVCDARAVFATP

SEQ ID NO: 222485 - protein, 23 aa, Mycobacterium bovis
RQIGPLAKFYSVAPANIIVIHDD

SEQ ID NO: 222486 - protein, 25 aa, Mycobacterium bovis
RQKEFADLLTWLQETLSDHVKEVRL

SEQ ID NO: 222487 - protein, 20 aa, Mycobacterium bovis
RQLGFCRSTPPTIPHSRNQL

SEQ ID NO: 222488 - protein, 17 aa, Mycobacterium bovis
RQLLSGRDFAVGDMFAT

SEQ ID NO: 222489 - protein, 18 aa, Mycobacterium bovis
RQLPGQVLVLGGGESRDL

SEQ ID NO: 222490 - protein, 20 aa, Mycobacterium bovis
RQLPPVIAAVFRKAIGGTVH

SEQ ID NO: 222491 - protein, 30 aa, Mycobacterium bovis
RQLVLLDAPVVLGWAGFRDVAQRYSLGMTE

SEQ ID NO: 222492 - protein, 18 aa, Mycobacterium bovis
RQLWHFGLDPEEVAGFLA

SEQ ID NO: 222493 - protein, 34 aa, Mycobacterium bovis
RQMFEERAHLLPVFRLRYLPTPLGLHHPIWVEDP

SEQ ID NO: 222494 - protein, 24 aa, Mycobacterium bovis
RQPGRLRIALSTRVPTPLPVRCGK

SEQ ID NO: 222495 - protein, 27 aa, Mycobacterium bovis
RQPSTHTIFVLGRPITAGAFSAVAREV

SEQ ID NO: 222496 - protein, 18 aa, Mycobacterium bovis
RQQRVPLGVVGMIYEGRP

SEQ ID NO: 222497 - protein, 29 aa, Mycobacterium bovis
RQRFVSAIDVLLGLGWLAPSHVDQWRQGR

SEQ ID NO: 222498 - protein, 17 aa, Mycobacterium bovis
RQRIVGIAGIDTRGVVR

SEQ ID NO: 222499 - protein, 22 aa, Mycobacterium bovis
RQRPELAWFPSLAHHLQDASRG

SEQ ID NO: 222500 - protein, 19 aa, Mycobacterium bovis
RQRPEPPSWALRRVEAGPD

SEQ ID NO: 222501 - protein, 18 aa, Mycobacterium bovis
RQVAMVVLGYRGQGAVAG

SEQ ID NO: 222502 - protein, 17 aa, Mycobacterium bovis
RQVLGPNAVQAGSLNRP

SEQ ID NO: 222503 - protein, 23 aa, Mycobacterium bovis
RQVPGLWTIPHTAPGKSQIGGAS

SEQ ID NO: 222504 - protein, 19 aa, Mycobacterium bovis
RQWHDIADARWPSAGNWRY

SEQ ID NO: 222505 - protein, 23 aa, Mycobacterium bovis
RQYNPGWNLSIDLRNMLLVSECV

SEQ ID NO: 222506 - protein, 23 aa, Mycobacterium bovis
RRAEVTSLLRFAGGLHIVGGRVV

SEQ ID NO: 222507 - protein, 25 aa, Mycobacterium bovis
RRALGIQRLLAARSQRGRKIPDLLI

SEQ ID NO: 222508 - protein, 25 aa, Mycobacterium bovis
RRAPGPSWYHFTLNGAPGSILADKA

SEQ ID NO: 222509 - protein, 23 aa, Mycobacterium bovis
RRASWVYYAVVPEALTVLSNLLS

SEQ ID NO: 222510 - protein, 24 aa, Mycobacterium bovis
RRCADVRYLGSWPTGPAAGAQPPL

SEQ ID NO: 222511 - protein, 23 aa, Mycobacterium bovis
RRCGWSLGISAETLRRWAGQAEV

SEQ ID NO: 222512 - protein, 18 aa, Mycobacterium bovis
RRCRAKRWGGAAPVTRAG

SEQ ID NO: 222513 - protein, 20 aa, Mycobacterium bovis
RRDIAPRRILPDSAIIDAAI

SEQ ID NO: 222514 - protein, 25 aa, Mycobacterium bovis
RRDLRCPGLLPPGCHQPVLVVGLVG

SEQ ID NO: 222515 - protein, 17 aa, Mycobacterium bovis
RREDMLRHPAFLSKQLP

SEQ ID NO: 222516 - protein, 23 aa, Mycobacterium bovis
RREKNAYYFQDGNALVGMVVSGG

SEQ ID NO: 222517 - protein, 17 aa, Mycobacterium bovis
RRELGLPPAPAPAVRRL

SEQ ID NO: 222518 - protein, 20 aa, Mycobacterium bovis
RRELLSRRDQLTATLAGLCG

SEQ ID NO: 222519 - protein, 17 aa, Mycobacterium bovis
RREPLPLPLKTSCAWAQ

SEQ ID NO: 222520 - protein, 30 aa, Mycobacterium bovis
RRFDVGRGPLIRFLLIELPDECWHLVIVAH

SEQ ID NO: 222521 - protein, 18 aa, Mycobacterium bovis
RRFLPRCAAGAISAFLLT

SEQ ID NO: 222522 - protein, 24 aa, Mycobacterium bovis
RRGDGWVKLVGDWIDRQIGDLAPL

SEQ ID NO: 222523 - protein, 32 aa, Mycobacterium bovis
RRGDTPLPVRTPLPVHLPEPMAAQLREAAAAQ

SEQ ID NO: 222524 - protein, 21 aa, Mycobacterium bovis
RRGHTLIVTMNRPAARNALST

SEQ ID NO: 222525 - protein, 21 aa, Mycobacterium bovis
RRGQIRPLGLDRYGVRFRIEA

SEQ ID NO: 222526 - protein, 25 aa, Mycobacterium bovis
RRGQPRLRPPFPAVAGLYGCPTVIN

SEQ ID NO: 222527 - protein, 25 aa, Mycobacterium bovis
RRGRPTVWSVWGVGGAILLGDALHA

SEQ ID NO: 222528 - protein, 20 aa, Mycobacterium bovis
RRGTVWHRRVPDRYPEVIVQ

SEQ ID NO: 222529 - protein, 18 aa, Mycobacterium bovis
RRHRLLETFLVNELGYRW

SEQ ID NO: 222530 - protein, 19 aa, Mycobacterium bovis
RRIGWLVQLPVKGTWAFIP

SEQ ID NO: 222531 - protein, 18 aa, Mycobacterium bovis
RRITPIDVPLIVRGRVTN

SEQ ID NO: 222532 - protein, 23 aa, Mycobacterium bovis
RRLDLNERGTFGHFLNRLRALTH

SEQ ID NO: 222533 - protein, 19 aa, Mycobacterium bovis
RRLKRLLDDLAGESGLRAV

SEQ ID NO: 222534 - protein, 17 aa, Mycobacterium bovis
RRLPAAEHPFINKLADQ

SEQ ID NO: 222535 - protein, 24 aa, Mycobacterium bovis
RRLRKEIFELYGYTAVVHVLSASG

SEQ ID NO: 222536 - protein, 33 aa, Mycobacterium bovis
RRLRPDFATGLMPLRWGTGFMLGSAKYGPFGRN

SEQ ID NO: 222537 - protein, 19 aa, Mycobacterium bovis
RRLRSQGVRLVYETARRGT

SEQ ID NO: 222538 - protein, 20 aa, Mycobacterium bovis
RRMFVPFHDGVISQFEGYSE

SEQ ID NO: 222539 - protein, 25 aa, Mycobacterium bovis
RRMGYLQRMSTVLSRRLWENAGSPE

SEQ ID NO: 222540 - protein, 19 aa, Mycobacterium bovis
RRMWASAQNISGAGWSGQA

SEQ ID NO: 222541 - protein, 23 aa, Mycobacterium bovis
RRNRYWRRLTRSSAAAVRAAPAS

SEQ ID NO: 222542 - protein, 18 aa, Mycobacterium bovis
RRQQLWLVTITDDTDRVV

SEQ ID NO: 222543 - protein, 17 aa, Mycobacterium bovis
RRRELPVVGLASGDPLH

SEQ ID NO: 222544 - protein, 26 aa, Mycobacterium bovis
RRRFRRSIQTILLAALGRTIAQTVGE

SEQ ID NO: 222545 - protein, 17 aa, Mycobacterium bovis
RRRGAWVGWPGVNDDGA

SEQ ID NO: 222546 - protein, 24 aa, Mycobacterium bovis
RRRGENIGLTTVYRTLQSMASSGL

SEQ ID NO: 222547 - protein, 18 aa, Mycobacterium bovis
RRRIRTGDQPLALVTAYL

SEQ ID NO: 222548 - protein, 17 aa, Mycobacterium bovis
RRRRRMRFMIKAEMQRV

SEQ ID NO: 222549 - protein, 22 aa, Mycobacterium bovis
RRRRWLSKTEFLSRLRGAQADP

SEQ ID NO: 222550 - protein, 19 aa, Mycobacterium bovis
RRRSPATRAYRLPAGRRAA

SEQ ID NO: 222551 - protein, 22 aa, Mycobacterium bovis
RRSAAVWWAALAAARESPDPPE

SEQ ID NO: 222552 - protein, 18 aa, Mycobacterium bovis
RRSFIRRVGISPDQYRKA

SEQ ID NO: 222553 - protein, 25 aa, Mycobacterium bovis
RRSRGTPRIANRLLRRVRDFAEVRA

SEQ ID NO: 222554 - protein, 22 aa, Mycobacterium bovis
RRSRVVGIFPNPAAVIRLVGAV

SEQ ID NO: 222555 - protein, 20 aa, Mycobacterium bovis
RRTLRAIIAAARLNPTQLDP

SEQ ID NO: 222556 - protein, 25 aa, Mycobacterium bovis
RRTMARVFPNLFATHRVRAVDDYAS

SEQ ID NO: 222557 - protein, 22 aa, Mycobacterium bovis
RRTVYIDLRADWPAALQAAGLD

SEQ ID NO: 222558 - protein, 18 aa, Mycobacterium bovis
RRVFAPKVTGSWRLHVAT

SEQ ID NO: 222559 - protein, 19 aa, Mycobacterium bovis
RRVFHDVDILLMPSAGIAS

SEQ ID NO: 222560 - protein, 34 aa, Mycobacterium bovis
RRVGILEQLARIHAQLENIPALLESARHSETEPL

SEQ ID NO: 222561 - protein, 31 aa, Mycobacterium bovis
RRVILIHWDDFFRPLSKPLRALPYAADDLDL

SEQ ID NO: 222562 - protein, 17 aa, Mycobacterium bovis
RRVKAMSYGLAYGLSAY

SEQ ID NO: 222563 - protein, 17 aa, Mycobacterium bovis
RRYGQLEERFVALGGYG

SEQ ID NO: 222564 - protein, 27 aa, Mycobacterium bovis
RRYHATYMNYVGKPLAYILATPERDDD

SEQ ID NO: 222565 - protein, 18 aa, Mycobacterium bovis
RRYQKLVEEAPAPFLTDF

SEQ ID NO: 222566 - protein, 37 aa, Mycobacterium bovis
RRYQTGLRRSLIALRSQRYFRLLDALDALVSERAHAT

SEQ ID NO: 222567 - protein, 23 aa, Mycobacterium bovis
RSADLFLGVPFNIASYALLTHMM

SEQ ID NO: 222568 - protein, 21 aa, Mycobacterium bovis
RSALDVMLDWDPTTAYSCQQG

SEQ ID NO: 222569 - protein, 18 aa, Mycobacterium bovis
RSAQLAYEVFIHRLRKYL

SEQ ID NO: 222570 - protein, 23 aa, Mycobacterium bovis
RSAVDLALRRLVGEPLGRDEALA

SEQ ID NO: 222571 - protein, 29 aa, Mycobacterium bovis
RSDALAARLPLAYALGWQGRGREADAVLA

SEQ ID NO: 222572 - protein, 18 aa, Mycobacterium bovis
RSDEVPVVVLLWSPRSEV

SEQ ID NO: 222573 - protein, 31 aa, Mycobacterium bovis
RSELTSPLAFLQRPARWLHSLANGSPSWSAA

SEQ ID NO: 222574 - protein, 20 aa, Mycobacterium bovis
RSEMLSMLRAMLAPESLTAD

SEQ ID NO: 222575 - protein, 19 aa, Mycobacterium bovis
RSENPGLPVLLLTAKDAVE

SEQ ID NO: 222576 - protein, 20 aa, Mycobacterium bovis
RSEVRILFAFDPARQAIMLA

SEQ ID NO: 222577 - protein, 22 aa, Mycobacterium bovis
RSGDTLLIVDGLFFQQPSVRHK

SEQ ID NO: 222578 - protein, 29 aa, Mycobacterium bovis
RSGFVVNALLVPYLLSAIRMVEAGFATVE

SEQ ID NO: 222579 - protein, 27 aa, Mycobacterium bovis
RSGQPVPRLVWFYFDGTDLTVYSMPQA

SEQ ID NO: 222580 - protein, 24 aa, Mycobacterium bovis
RSGYPLELLVRAAAAGWRVVELDV

SEQ ID NO: 222581 - protein, 17 aa, Mycobacterium bovis
RSIIGFGARIGPRALIR

SEQ ID NO: 222582 - protein, 27 aa, Mycobacterium bovis
RSIPGVTEKWDLYLRGIELATGYSELS

SEQ ID NO: 222583 - protein, 18 aa, Mycobacterium bovis
RSKHDLLFADYDAGLHWF

SEQ ID NO: 222584 - protein, 29 aa, Mycobacterium bovis
RSKPIEPSPYLPTSRRFVNPLYLRVEAIP

SEQ ID NO: 222585 - protein, 17 aa, Mycobacterium bovis
RSLAADGIINAGALIAF

SEQ ID NO: 222586 - protein, 17 aa, Mycobacterium bovis
RSLAISQRLLGTREIIL

SEQ ID NO: 222587 - protein, 17 aa, Mycobacterium bovis
RSLPFPTLVSILLTDIR

SEQ ID NO: 222588 - protein, 20 aa, Mycobacterium bovis
RSLPLLECWTALAALSRDTT

SEQ ID NO: 222589 - protein, 20 aa, Mycobacterium bovis
RSLPTALGSVLRLGLRMLAQ

SEQ ID NO: 222590 - protein, 21 aa, Mycobacterium bovis
RSLVDLFEALFVPVPSGSASN

SEQ ID NO: 222591 - protein, 28 aa, Mycobacterium bovis
RSMELLDDVILMLRRLHQPVIAAVNGPA

SEQ ID NO: 222592 - protein, 17 aa, Mycobacterium bovis
RSPAPLWGDTSFHSVAP

SEQ ID NO: 222593 - protein, 24 aa, Mycobacterium bovis
RSPRRQYSWLLEQVSFIAAIEHYT

SEQ ID NO: 222594 - protein, 23 aa, Mycobacterium bovis
RSPWAAPWTIDANVSALAALLDN

SEQ ID NO: 222595 - protein, 19 aa, Mycobacterium bovis
RSQARILGIFVDGKRVPVV

SEQ ID NO: 222596 - protein, 21 aa, Mycobacterium bovis
RSRAAHMGRRYGRRLTVMADR

SEQ ID NO: 222597 - protein, 20 aa, Mycobacterium bovis
RSRATLRRLYAHPQAGALVS

SEQ ID NO: 222598 - protein, 22 aa, Mycobacterium bovis
RSRDLHDALRRRCLYHWIDYPE

SEQ ID NO: 222599 - protein, 20 aa, Mycobacterium bovis
RSREVWLLVSGPGKADAVAA

SEQ ID NO: 222600 - protein, 20 aa, Mycobacterium bovis
RSRILVQRSVYDRFMELLEP

SEQ ID NO: 222601 - protein, 28 aa, Mycobacterium bovis
RSRLTADGIWLHCLYALSGINLRESVRA

SEQ ID NO: 222602 - protein, 24 aa, Mycobacterium bovis
RSSHTWFVLRELLGHQNVNIAFGY

SEQ ID NO: 222603 - protein, 23 aa, Mycobacterium bovis
RSSNFMLWQAAYAEYIFQDKLWP

SEQ ID NO: 222604 - protein, 20 aa, Mycobacterium bovis
RSSRVLLAGHLDTVPVAGNL

SEQ ID NO: 222605 - protein, 20 aa, Mycobacterium bovis
RSSVYWRLMALDQRFGIADR

SEQ ID NO: 222606 - protein, 21 aa, Mycobacterium bovis
RSTAAAYPNPALRSLDAIHLA

SEQ ID NO: 222607 - protein, 17 aa, Mycobacterium bovis
RSTLLVQTPADVAALNL

SEQ ID NO: 222608 - protein, 31 aa, Mycobacterium bovis
RSTLTLRSLPFLPIGIGPWVAARMWQVAAFI

SEQ ID NO: 222609 - protein, 19 aa, Mycobacterium bovis
RSTTVAMHLLRRTLSGIPG

SEQ ID NO: 222610 - protein, 20 aa, Mycobacterium bovis
RSVGAQWLDLGISASGEGGY

SEQ ID NO: 222611 - protein, 18 aa, Mycobacterium bovis
RSVLQWDKDDCAAIGLVK

SEQ ID NO: 222612 - protein, 20 aa, Mycobacterium bovis
RSVPIVGNPLANLVQPNLKV

SEQ ID NO: 222613 - protein, 24 aa, Mycobacterium bovis
RSVTWLACDVPSLGWRVYRLVPAD

SEQ ID NO: 222614 - protein, 20 aa, Mycobacterium bovis
RSWDHRKLGLPHMSVGGSTA

SEQ ID NO: 222615 - protein, 21 aa, Mycobacterium bovis
RSYLLRIELADRPGSLGSLAV

SEQ ID NO: 222616 - protein, 26 aa, Mycobacterium bovis
RSYPRSALSTYLVFDALIAHGDRHDR

SEQ ID NO: 222617 - protein, 23 aa, Mycobacterium bovis
RSYRYIDYWGTAVTAFDLHAPHT

SEQ ID NO: 222618 - protein, 22 aa, Mycobacterium bovis
RSYVNIGFWSSVPVGATEGATN

SEQ ID NO: 222619 - protein, 19 aa, Mycobacterium bovis
RSYVTALRDLLRALDVSDV

SEQ ID NO: 222620 - protein, 24 aa, Mycobacterium bovis
RTAEQVFIPLTVGGGVRTVADVDS

SEQ ID NO: 222621 - protein, 18 aa, Mycobacterium bovis
RTAFKPSYGIAEATLLVA

SEQ ID NO: 222622 - protein, 23 aa, Mycobacterium bovis
RTAGYLAIGLAIGAGAPVCVAMT

SEQ ID NO: 222623 - protein, 23 aa, Mycobacterium bovis
RTAQIVWGARALGGPVPIPEDVC

SEQ ID NO: 222624 - protein, 24 aa, Mycobacterium bovis
RTARQRLAAFVSPIPVRLADGTQL

SEQ ID NO: 222625 - protein, 21 aa, Mycobacterium bovis
RTAVLDFIDRLRCAERAIAVA

SEQ ID NO: 222626 - protein, 23 aa, Mycobacterium bovis
RTDLAYLRAIHRQLFQDIYVWAG

SEQ ID NO: 222627 - protein, 21 aa, Mycobacterium bovis
RTDQLPLVRALVDMAGLPPQA

SEQ ID NO: 222628 - protein, 30 aa, Mycobacterium bovis
RTDRLPFDSPMYWHLFEPALRDAVDKDVAM

SEQ ID NO: 222629 - protein, 17 aa, Mycobacterium bovis
RTEFALLEMLIANPRRV

SEQ ID NO: 222630 - protein, 18 aa, Mycobacterium bovis
RTELGTYLFFVDCVGHID

SEQ ID NO: 222631 - protein, 17 aa, Mycobacterium bovis
RTFLGVPVRIRDEVFGN

SEQ ID NO: 222632 - protein, 21 aa, Mycobacterium bovis
RTFNVAWPKVFRPPVIAATVT

SEQ ID NO: 222633 - protein, 32 aa, Mycobacterium bovis
RTFVPSKGFGLLPPIVTPPGLLRRLLTGTDNA

SEQ ID NO: 222634 - protein, 20 aa, Mycobacterium bovis
RTFYRHFRSKHDLLFADYDA

SEQ ID NO: 222635 - protein, 22 aa, Mycobacterium bovis
RTGEKFVPFDPAADYHTYVDGK

SEQ ID NO: 222636 - protein, 19 aa, Mycobacterium bovis
RTGHPWWTLSQLSDESAIE

SEQ ID NO: 222637 - protein, 18 aa, Mycobacterium bovis
RTGLALPGDPVVQLVSAD

SEQ ID NO: 222638 - protein, 25 aa, Mycobacterium bovis
RTGLRPFDVQLLGALRMLAGDVIEM

SEQ ID NO: 222639 - protein, 17 aa, Mycobacterium bovis
RTGPTPWSGSETLPGGT

SEQ ID NO: 222640 - protein, 25 aa, Mycobacterium bovis
RTGRITPFAFMTPVKVAGSTVGQAT

SEQ ID NO: 222641 - protein, 21 aa, Mycobacterium bovis
RTHARSWHRYPEPSPGAIAMV

SEQ ID NO: 222642 - protein, 19 aa, Mycobacterium bovis
RTHLHIEIVPGLAASSAVP

SEQ ID NO: 222643 - protein, 23 aa, Mycobacterium bovis
RTHRKALAAFTKSGGRLVESVSA

SEQ ID NO: 222644 - protein, 26 aa, Mycobacterium bovis
RTHRPKMIIAGWSAYPRQLDFARFRA

SEQ ID NO: 222645 - protein, 26 aa, Mycobacterium bovis
RTICRRAGLSVRYFYESFTDKDEFVG

SEQ ID NO: 222646 - protein, 23 aa, Mycobacterium bovis
RTILQSLWANFYELLADAYGRGI

SEQ ID NO: 222647 - protein, 24 aa, Mycobacterium bovis
RTITDACEILLILKDNLAGHHREL

SEQ ID NO: 222648 - protein, 22 aa, Mycobacterium bovis
RTKYFDDYLLNATAGGIRQVAI

SEQ ID NO: 222649 - protein, 18 aa, Mycobacterium bovis
RTLATRLAARRRRARAGS

SEQ ID NO: 222650 - protein, 19 aa, Mycobacterium bovis
RTLIARDLDAAYRSVDVLV

SEQ ID NO: 222651 - protein, 18 aa, Mycobacterium bovis
RTLMETTLARHTGKDAGV

SEQ ID NO: 222652 - protein, 22 aa, Mycobacterium bovis
RTLVGPLDWAVELDERWVIVGP

SEQ ID NO: 222653 - protein, 24 aa, Mycobacterium bovis
RTNAMGLLLTDDRTRRPMTASVVA

SEQ ID NO: 222654 - protein, 21 aa, Mycobacterium bovis
RTNLYTPLQAAKLAKETSSTK

SEQ ID NO: 222655 - protein, 21 aa, Mycobacterium bovis
RTPASFIAFDLLALGDDDYTG

SEQ ID NO: 222656 - protein, 24 aa, Mycobacterium bovis
RTPGRGWEHRWALSVLHTALGGGL

SEQ ID NO: 222657 - protein, 18 aa, Mycobacterium bovis
RTPIPKVYLCSAATPPGA

SEQ ID NO: 222658 - protein, 26 aa, Mycobacterium bovis
RTPRRGTPVVAMPLLRRGNKEVHGIG

SEQ ID NO: 222659 - protein, 28 aa, Mycobacterium bovis
RTQRSVRALLTGYLLYTLGGDKTYRRFA

SEQ ID NO: 222660 - protein, 20 aa, Mycobacterium bovis
RTRLTDRPVRHLPIVRGATV

SEQ ID NO: 222661 - protein, 25 aa, Mycobacterium bovis
RTRPLDAGPYTFLAADALVLKVREA

SEQ ID NO: 222662 - protein, 22 aa, Mycobacterium bovis
RTRTILTLDRRHFSALRPIGGG

SEQ ID NO: 222663 - protein, 27 aa, Mycobacterium bovis
RTRVRTRLIELFELFDPADPEVVAGRR

SEQ ID NO: 222664 - protein, 27 aa, Mycobacterium bovis
RTSFVPGVLLAVRRIAERPGLTVGLEP

SEQ ID NO: 222665 - protein, 17 aa, Mycobacterium bovis
RTTGWFTGLVPITVPVA

SEQ ID NO: 222666 - protein, 25 aa, Mycobacterium bovis
RTVYDTLIWCIYSGVHLPPPLREMQ

SEQ ID NO: 222667 - protein, 19 aa, Mycobacterium bovis
RTWQVGAMRELLLAHRDPG

SEQ ID NO: 222668 - protein, 23 aa, Mycobacterium bovis
RTYEKMSLFIVPADTPGIEIVRN

SEQ ID NO: 222669 - protein, 18 aa, Mycobacterium bovis
RVAARRLASLPTTVKDRA

SEQ ID NO: 222670 - protein, 18 aa, Mycobacterium bovis
RVAGILAAAGWPLAGVDV

SEQ ID NO: 222671 - protein, 23 aa, Mycobacterium bovis
RVAGLIARVQLPPSPAGAVQELR

SEQ ID NO: 222672 - protein, 19 aa, Mycobacterium bovis
RVALLRKTVGETWGLPSPE

SEQ ID NO: 222673 - protein, 18 aa, Mycobacterium bovis
RVALPLHPEYRTMPMVWY

SEQ ID NO: 222674 - protein, 18 aa, Mycobacterium bovis
RVAMFPAVEPDDVSALTE

SEQ ID NO: 222675 - protein, 18 aa, Mycobacterium bovis
RVAMTPDILARLASVCGS

SEQ ID NO: 222676 - protein, 18 aa, Mycobacterium bovis
RVAWWALCTDFDVPRSMG

SEQ ID NO: 222677 - protein, 23 aa, Mycobacterium bovis
RVCGYEITPALRGVPTPGLGRIS

SEQ ID NO: 222678 - protein, 23 aa, Mycobacterium bovis
RVCRDCGFFLPLAGSLGAMFGVC

SEQ ID NO: 222679 - protein, 21 aa, Mycobacterium bovis
RVDHDWVRIDNLLLHGTRYEA

SEQ ID NO: 222680 - protein, 23 aa, Mycobacterium bovis
RVDHPLFARIWPVVAAHEAEAIR

SEQ ID NO: 222681 - protein, 25 aa, Mycobacterium bovis
RVDKQANLHFVIGKASFDEKLLAEN

SEQ ID NO: 222682 - protein, 22 aa, Mycobacterium bovis
RVDQLPLIWQRLVDGGMESGHA

SEQ ID NO: 222683 - protein, 18 aa, Mycobacterium bovis
RVDTALTPWPVADEPRRA

SEQ ID NO: 222684 - protein, 28 aa, Mycobacterium bovis
RVEELRRRLDDLPVLYELAAEEAGAAAA

SEQ ID NO: 222685 - protein, 17 aa, Mycobacterium bovis
RVEVMQANLAELPLPDA

SEQ ID NO: 222686 - protein, 21 aa, Mycobacterium bovis
RVEVSLPADLALSNGGGCDPV

SEQ ID NO: 222687 - protein, 20 aa, Mycobacterium bovis
RVFQELAGLATLPGLPEVMR

SEQ ID NO: 222688 - protein, 18 aa, Mycobacterium bovis
RVFSFRHAQLGTDAAYRE

SEQ ID NO: 222689 - protein, 30 aa, Mycobacterium bovis
RVGEGFVGLRVVPWLWGAPPTDRRYYPLFA

SEQ ID NO: 222690 - protein, 23 aa, Mycobacterium bovis
RVGISQMHVSRLLAKSLARLRDQ

SEQ ID NO: 222691 - protein, 21 aa, Mycobacterium bovis
RVGSYLRYGAYPYAIAVREYV

SEQ ID NO: 222692 - protein, 20 aa, Mycobacterium bovis
RVGVIMGSDSDWPVMADAAA

SEQ ID NO: 222693 - protein, 17 aa, Mycobacterium bovis
RVHLFFGARYACELYDL

SEQ ID NO: 222694 - protein, 27 aa, Mycobacterium bovis
RVHTTSRLWAFQLQSILARLGHYATVE

SEQ ID NO: 222695 - protein, 46 aa, Mycobacterium bovis
RVIADEGLLGALRFAGNLLIHRAARRRVLLMRHTFRRHRERLTAVA

SEQ ID NO: 222696 - protein, 27 aa, Mycobacterium bovis
RVIEPIDMDAYRQFLTEIGYLLPEPDD

SEQ ID NO: 222697 - protein, 27 aa, Mycobacterium bovis
RVILVDLSLARLLAPVLPKLDTVHTVI

SEQ ID NO: 222698 - protein, 18 aa, Mycobacterium bovis
RVKDLPGVRYKIIRGSLD

SEQ ID NO: 222699 - protein, 29 aa, Mycobacterium bovis
RVKGKWEHSAPIKWPPPQTLHELRSHVRA

SEQ ID NO: 222700 - protein, 17 aa, Mycobacterium bovis
RVLAPLGLVFDENSPWL

SEQ ID NO: 222701 - protein, 23 aa, Mycobacterium bovis
RVLIAIENAIWPDLFIAGGGISR

SEQ ID NO: 222702 - protein, 24 aa, Mycobacterium bovis
RVLQNIYRALRPGGVLLMVDIKAS

SEQ ID NO: 222703 - protein, 18 aa, Mycobacterium bovis
RVLRVGVAEFRRSLDRVM

SEQ ID NO: 222704 - protein, 18 aa, Mycobacterium bovis
RVPTLARVAAAGVALALL

SEQ ID NO: 222705 - protein, 27 aa, Mycobacterium bovis
RVPTPQRRRPYRPPPRPNSEALKAVVA

SEQ ID NO: 222706 - protein, 22 aa, Mycobacterium bovis
RVQLLRDYGSAASPFNAFLVAQ

SEQ ID NO: 222707 - protein, 23 aa, Mycobacterium bovis
RVQLPTYAFQRRRFWETPGADGP

SEQ ID NO: 222708 - protein, 17 aa, Mycobacterium bovis
RVQPSGKGGLRPGVDLS

SEQ ID NO: 222709 - protein, 26 aa, Mycobacterium bovis
RVQTTVLKAINWFGQFSTRIADKEAD

SEQ ID NO: 222710 - protein, 25 aa, Mycobacterium bovis
RVRPVSSAQFPRPAPRPSYSALSSR

SEQ ID NO: 222711 - protein, 17 aa, Mycobacterium bovis
RVRVAMSVGPWQGIAAW

SEQ ID NO: 222712 - protein, 26 aa, Mycobacterium bovis
RVSLRTQVPLLLDEYTRNASTGSFIL

SEQ ID NO: 222713 - protein, 24 aa, Mycobacterium bovis
RVSMGHALLVPYARAADWPTELMT

SEQ ID NO: 222714 - protein, 28 aa, Mycobacterium bovis
RVSPRERSRWRFTFKRLAAEAQDALRAE

SEQ ID NO: 222715 - protein, 22 aa, Mycobacterium bovis
RVSPYPAVFQDVSLVVAADIPA

SEQ ID NO: 222716 - protein, 25 aa, Mycobacterium bovis
RVSRRLVAMLARRGYGQTLACEVVI

SEQ ID NO: 222717 - protein, 26 aa, Mycobacterium bovis
RVSSKYALVIYAAKRARQINDYYNQL

SEQ ID NO: 222718 - protein, 18 aa, Mycobacterium bovis
RVSYFDSLPLLIKVVKHP

SEQ ID NO: 222719 - protein, 29 aa, Mycobacterium bovis
RVTIDRILGEPITLLGYAPETIIAEKGVT

SEQ ID NO: 222720 - protein, 19 aa, Mycobacterium bovis
RVVAPHRLTDPKAGPLIAV

SEQ ID NO: 222721 - protein, 23 aa, Mycobacterium bovis
RVVDDSFLLCFNAHDHDVEFVMP

SEQ ID NO: 222722 - protein, 24 aa, Mycobacterium bovis
RVVDKLLHAPTVRIKQLASAPGGD

SEQ ID NO: 222723 - protein, 17 aa, Mycobacterium bovis
RVVPLRDELAAIRHRCA

SEQ ID NO: 222724 - protein, 25 aa, Mycobacterium bovis
RVVSFLERYFPIPAPWEKIAADVSR

SEQ ID NO: 222725 - protein, 19 aa, Mycobacterium bovis
RVWESELDPDLLWLADHVI

SEQ ID NO: 222726 - protein, 24 aa, Mycobacterium bovis
RVWSRATIGLAYASALIIADRHDE

SEQ ID NO: 222727 - protein, 20 aa, Mycobacterium bovis
RVYAAPYFHQFDAYRSIYVR

SEQ ID NO: 222728 - protein, 20 aa, Mycobacterium bovis
RVYAKSTNLPRVLGGLGVAI

SEQ ID NO: 222729 - protein, 27 aa, Mycobacterium bovis
RVYRFGGSLHLDWWYDTRRIPAATAEA

SEQ ID NO: 222730 - protein, 32 aa, Mycobacterium bovis; identical to SEQ ID NO: 122352

SEQ ID NO: 222731 - protein, 40 aa, Mycobacterium bovis
RWPHGRMRYYIAMLAELSRLRPLPFRLVLDGTEEIVADLT

SEQ ID NO: 222732 - protein, 20 aa, Mycobacterium bovis
RWPKMRISGPAVRWVMTGWQ

SEQ ID NO: 222733 - protein, 25 aa, Mycobacterium bovis
RWSALLVGAWWPARPDAPMAGVTYW

SEQ ID NO: 222734 - protein, 27 aa, Mycobacterium bovis
RWTLLIVRELLFGPLRFTEIERGLPGI

SEQ ID NO: 222735 - protein, 21 aa, Mycobacterium bovis
RWVLTKGKLPTSLWIEIVTTA

SEQ ID NO: 222736 - protein, 20 aa, Mycobacterium bovis
RWVRPIVDALGFAPMAVCAN

SEQ ID NO: 222737 - protein, 21 aa, Mycobacterium bovis
RWYQPMFRGVYVSRRSVPTLW

SEQ ID NO: 222738 - protein, 22 aa, Mycobacterium bovis
RYADALIWTPAHLAVDVAVEVR

SEQ ID NO: 222739 - protein, 18 aa, Mycobacterium bovis
RYAPGQFLTLRVPSERTG

SEQ ID NO: 222740 - protein, 23 aa, Mycobacterium bovis
RYEAWSFPDFATGVAALRTITQT

SEQ ID NO: 222741 - protein, 18 aa, Mycobacterium bovis
RYEFTSYRGDRIGIVARR

SEQ ID NO: 222742 - protein, 18 aa, Mycobacterium bovis
RYFLDNVAEWILELDRGR

SEQ ID NO: 222743 - protein, 20 aa, Mycobacterium bovis
RYGIVWGAMGAARSAWQCAL

SEQ ID NO: 222744 - protein, 21 aa, Mycobacterium bovis
RYINDRFLPDKAIDLIDEAGA

SEQ ID NO: 222745 - protein, 23 aa, Mycobacterium bovis
RYITARFLPDKAIDLVDEAASRL

SEQ ID NO: 222746 - protein, 17 aa, Mycobacterium bovis
RYLKKITVSTTTGPGIP

SEQ ID NO: 222747 - protein, 19 aa, Mycobacterium bovis
RYMVHSLHGYFLRPGDAKE

SEQ ID NO: 222748 - protein, 25 aa, Mycobacterium bovis
RYSGRAYLIQIRRAEAGTVLIDPVS

SEQ ID NO: 222749 - protein, 27 aa, Mycobacterium bovis
RYTGRGMPLLDLIQEGNLGLIRAMEKF

SEQ ID NO: 222750 - protein, 19 aa, Mycobacterium bovis
RYVAAMLAVLKAGGMIVPL

SEQ ID NO: 222751 - protein, 25 aa, Mycobacterium bovis
SAAAAALPAFSPPAQALGGGVGAFL

SEQ ID NO: 222752 - protein, 31 aa, Mycobacterium bovis
SAAAAQLASWQPALPNINLGVGNIGNLNVGN

SEQ ID NO: 222753 - protein, 32 aa, Mycobacterium bovis
SAAADEVSTAVAALFSQHAQGYQAAAAQVAAF

SEQ ID NO: 222754 - protein, 24 aa, Mycobacterium bovis
SAAASQLPPFTPPPATTSGAGSLS

SEQ ID NO: 222755 - protein, 21 aa, Mycobacterium bovis
SAACQGFITQLGRNFQVIYEQ

SEQ ID NO: 222756 - protein, 29 aa, Mycobacterium bovis
SAAGVLELAWTTGLIRWEDDPQPGWYDTE

SEQ ID NO: 222757 - protein, 26 aa, Mycobacterium bovis
SAAKKFYTSLFGWGYDDNPVPGGGGV

SEQ ID NO: 222758 - protein, 24 aa, Mycobacterium bovis
SAAKLATALQSAAPWLAKSGGEFI

SEQ ID NO: 222759 - protein, 24 aa, Mycobacterium bovis
SAAPVITAVVPPAADPVSLQTAAG

SEQ ID NO: 222760 - protein, 22 aa, Mycobacterium bovis
SAASDLLGLASGGLLPAAEEAA

SEQ ID NO: 222761 - protein, 27 aa, Mycobacterium bovis
SAAVAQLAPWQQVLRNLGIDIGKNGQI

SEQ ID NO: 222762 - protein, 26 aa, Mycobacterium bovis
SACNPYLTFAVLLAAGLRGVEKGYVL

SEQ ID NO: 222763 - protein, 24 aa, Mycobacterium bovis
SADDALALLIYTSGSTGAPKGAMY

SEQ ID NO: 222764 - protein, 23 aa, Mycobacterium bovis
SADFINLELIDSPTLPTCERIAV

SEQ ID NO: 222765 - protein, 27 aa, Mycobacterium bovis
SADGSPPYVVRWLVNGHETTVYPGSDA

SEQ ID NO: 222766 - protein, 25 aa, Mycobacterium bovis
SADIPQFLAIAREAAERRTGLRPFD

SEQ ID NO: 222767 - protein, 27 aa, Mycobacterium bovis
SADSAHAAILPLYYLRRAGIAESDLQV

SEQ ID NO: 222768 - protein, 21 aa, Mycobacterium bovis
SADTHLLRYPLPAAWCTDVDV

SEQ ID NO: 222769 - protein, 25 aa, Mycobacterium bovis
SADVVVGLPMRCVFALTAMGFLPQS

SEQ ID NO: 222770 - protein, 27 aa, Mycobacterium bovis
SAEEFFDLIWRLMRFDKHGPLDLILYH

SEQ ID NO: 222771 - protein, 23 aa, Mycobacterium bovis
SAEFRKLLADWKAAGRASKDVDD

SEQ ID NO: 222772 - protein, 21 aa, Mycobacterium bovis
SAEQVFRMIKLGLTGLLYRSQ

SEQ ID NO: 222773 - protein, 21 aa, Mycobacterium bovis
SAESYLDFAKILDAAAKSGAN

SEQ ID NO: 222774 - protein, 20 aa, Mycobacterium bovis
SAEVLAWRQRSLTGRRWFDE

SEQ ID NO: 222775 - protein, 37 aa, Mycobacterium bovis
SAGDLRAFLADKVVRWWLPERWAFVDEIPRTSVGKYD

SEQ ID NO: 222776 - protein, 19 aa, Mycobacterium bovis
SAGIWNRPFDVDLDGDGRL

SEQ ID NO: 222777 - protein, 20 aa, Mycobacterium bovis
SAGLMLAWCCDLIVASEDTV

SEQ ID NO: 222778 - protein, 24 aa, Mycobacterium bovis
SAGPLNIPIIDIPAAPGFGNSTQM

SEQ ID NO: 222779 - protein, 24 aa, Mycobacterium bovis
SAGRQLWEALLGWGAGRGATRGYV

SEQ ID NO: 222780 - protein, 28 aa, Mycobacterium bovis
SAHPASIGFPPYHPPMRTFLGVPVRVRD

SEQ ID NO: 222781 - protein, 31 aa, Mycobacterium bovis
SAIAAQVVPWASLLQRFPGLGAGATGATGGE

SEQ ID NO: 222782 - protein, 23 aa, Mycobacterium bovis
SAKGKELVWAPAAFRYVMMVLRH

SEQ ID NO: 222783 - protein, 28 aa, Mycobacterium bovis
SAKGSALAWLLTMAHRRAVDRVRCEQAG

SEQ ID NO: 222784 - protein, 25 aa, Mycobacterium bovis
SAKRITAVMPFYPYARQDKKHRGRE

SEQ ID NO: 222785 - protein, 19 aa, Mycobacterium bovis
SALAAANRAAEAPTTGLLA

SEQ ID NO: 222786 - protein, 19 aa, Mycobacterium bovis
SALALRFYGDAELYRLIAA

SEQ ID NO: 222787 - protein, 22 aa, Mycobacterium bovis
SALGPKLPELWGGSADLAGSNN

SEQ ID NO: 222788 - protein, 18 aa, Mycobacterium bovis
SALGVRVTLVIRGSCLLR

SEQ ID NO: 222789 - protein, 17 aa, Mycobacterium bovis
SALLFPALCTPTGDPPR

SEQ ID NO: 222790 - protein, 20 aa, Mycobacterium bovis
SALTCEFLFLCSGYYNYDEG

SEQ ID NO: 222791 - protein, 25 aa, Mycobacterium bovis
SALTHALAMFPGPLCRCTRRRTTTA

SEQ ID NO: 222792 - protein, 19 aa, Mycobacterium bovis
SALTMAEWFRDEQGQDVLL

SEQ ID NO: 222793 - protein, 35 aa, Mycobacterium bovis
SALVSFEVFIRPPLRMAMGLPDPYRPHRSAVLTAS

SEQ ID NO: 222794 - protein, 20 aa, Mycobacterium bovis
SALWEASLFEEHGFGDIKIS

SEQ ID NO: 222795 - protein, 17 aa, Mycobacterium bovis
SALWGREAYVTGLLGDG

SEQ ID NO: 222796 - protein, 19 aa, Mycobacterium bovis
SALYLAGEGAFPAERVKIL

SEQ ID NO: 222797 - protein, 21 aa, Mycobacterium bovis
SAMAAWLFGRPAAVPEIARSR

SEQ ID NO: 222798 - protein, 21 aa, Mycobacterium bovis
SAMARSYLGPEFDIHCGGMDL

SEQ ID NO: 222799 - protein, 22 aa, Mycobacterium bovis
SAMLPYLPVEYDDPVRRLRTVH

SEQ ID NO: 222800 - protein, 26 aa, Mycobacterium bovis
SANFAAGRLAYILGARGPAVVIDTAC

SEQ ID NO: 222801 - protein, 27 aa, Mycobacterium bovis
SANSNVLVYFWAPLCAPCDLFTPTYEA

SEQ ID NO: 222802 - protein, 24 aa, Mycobacterium bovis
SAPALQRRWWAARGRGAFASVDGA

SEQ ID NO: 222803 - protein, 26 aa, Mycobacterium bovis
SAPERLRSGWLNGIKHWQVDYTGRCP

SEQ ID NO: 222804 - protein, 24 aa, Mycobacterium bovis
SAPQGLEYVVAFLGALQAGRIAVP

SEQ ID NO: 222805 - protein, 23 aa, Mycobacterium bovis
SAPRRLLEQLPSVTGPVEALARV

SEQ ID NO: 222806 - protein, 19 aa, Mycobacterium bovis
SAPSLVFLDELDALAPRRG

SEQ ID NO: 222807 - protein, 35 aa, Mycobacterium bovis
SAQAAAFHDQFVHTLTAAARWYTATEIANAAAMRV

SEQ ID NO: 222808 - protein, 22 aa, Mycobacterium bovis
SAQACAWLASAIETAYCAPPPV

SEQ ID NO: 222809 - protein, 26 aa, Mycobacterium bovis
SAQVPDYLMQVLARFARYLRESRSID

SEQ ID NO: 222810 - protein, 20 aa, Mycobacterium bovis
SARLNLLADLLPPLSHKPRV

SEQ ID NO: 222811 - protein, 24 aa, Mycobacterium bovis
SARPIRVLHLDDLVRFLVLALNTD

SEQ ID NO: 222812 - protein, 19 aa, Mycobacterium bovis
SARPLWAPDYPVGAQVRRA

SEQ ID NO: 222813 - protein, 28 aa, Mycobacterium bovis
SARTRIRPHFFPFTEPSAEVDVWFANKI

SEQ ID NO: 222814 - protein, 21 aa, Mycobacterium bovis
SASRLIPFAAPPKTTNSAGVV

SEQ ID NO: 222815 - protein, 19 aa, Mycobacterium bovis
SATAWYGLQDLARIKAGDK

SEQ ID NO: 222816 - protein, 36 aa, Mycobacterium bovis
SATGILPNLDFPTGPAYYLMGFDIASFTPIFVMSRI

SEQ ID NO: 222817 - protein, 18 aa, Mycobacterium bovis
SATLRVAPSASWMLEYYP

SEQ ID NO: 222818 - protein, 19 aa, Mycobacterium bovis
SATPIPRTLEMSLAGIREM

SEQ ID NO: 222819 - protein, 19 aa, Mycobacterium bovis
SAVAQDYLKVIWTAQEWSQ

SEQ ID NO: 222820 - protein, 23 aa, Mycobacterium bovis
SAVKAFTAWAVRRGLLAGDPAAR

SEQ ID NO: 222821 - protein, 24 aa, Mycobacterium bovis
SAVQLVDFFKQDGPTPPPPGAPHP

SEQ ID NO: 222822 - protein, 27 aa, Mycobacterium bovis
SAVRGRNFLGWIHPAATATAPARTEAP

SEQ ID NO: 222823 - protein, 24 aa, Mycobacterium bovis
SAYHALTFGWLMSGLARAVTGKDM

SEQ ID NO: 222824 - protein, 19 aa, Mycobacterium bovis
SAYPRVLDFAAFRSIADEV

SEQ ID NO: 222825 - protein, 20 aa, Mycobacterium bovis
SAYQVFHATRRLAAAMVASS

SEQ ID NO: 222826 - protein, 22 aa, Mycobacterium bovis
SCHQIVLPQPILRNHELAKLVS

SEQ ID NO: 222827 - protein, 27 aa, Mycobacterium bovis
SCNPQYDIVRLLRLYDAGQLMLDELVT

SEQ ID NO: 222828 - protein, 18 aa, Mycobacterium bovis
SCPGPEAALALVGAARRL

SEQ ID NO: 222829 - protein, 27 aa, Mycobacterium bovis
SCYVHPEIEFFLLKPGPEDGSVPVPVD

SEQ ID NO: 222830 - protein, 25 aa, Mycobacterium bovis
SDAIQAVGQLPLDFGASGLSAMSVA

SEQ ID NO: 222831 - protein, 26 aa, Mycobacterium bovis
SDELIDYLTMLSWSALCGIVEAGGSL

SEQ ID NO: 222832 - protein, 18 aa, Mycobacterium bovis
SDEPTNRHPWPAPARCCR

SEQ ID NO: 222833 - protein, 18 aa, Mycobacterium bovis
SDFLHGRWLVLRRGKRSI

SEQ ID NO: 222834 - protein, 25 aa, Mycobacterium bovis
SDGQARMWFVQMADPSGALLNICVS

SEQ ID NO: 222835 - protein, 24 aa, Mycobacterium bovis
SDGSPPYVVRWLETDHVATVIPGP

SEQ ID NO: 222836 - protein, 25 aa, Mycobacterium bovis
SDHPRPRLFSLLHEFVHVVLHTEGL

SEQ ID NO: 222837 - protein, 27 aa, Mycobacterium bovis
SDILPISFGFPFGFSAAIPPNLPLPAK

SEQ ID NO: 222838 - protein, 20 aa, Mycobacterium bovis
SDITFHRWCAALSTRWCSMR

SEQ ID NO: 222839 - protein, 18 aa, Mycobacterium bovis
SDIYLPLHGEHQAHNAVL

SEQ ID NO: 222840 - protein, 31 aa, Mycobacterium bovis
SDKAEPLVLKPWTMPEPLLPIAIAAHAKTDE

SEQ ID NO: 222841 - protein, 21 aa, Mycobacterium bovis
SDKTLIRFGDPPGGKALTFEV

SEQ ID NO: 222842 - protein, 27 aa, Mycobacterium bovis
SDKVVRFILGLVQRYGPGLFGANQLAL

SEQ ID NO: 222843 - protein, 26 aa, Mycobacterium bovis
SDLAEAALAIRAGALWVAANVDPTLP

SEQ ID NO: 222844 - protein, 28 aa, Mycobacterium bovis
SDLINPHPLFVPWLVGPLLTGEGIQLVK

SEQ ID NO: 222845 - protein, 23 aa, Mycobacterium bovis
SDMFGELSIFDPGPRTSSATTIT

SEQ ID NO: 222846 - protein, 18 aa, Mycobacterium bovis
SDNPARYRDAAVAGIRAL

SEQ ID NO: 222847 - protein, 20 aa, Mycobacterium bovis
SDPAYFPCYAKCVELGVPVS

SEQ ID NO: 222848 - protein, 20 aa, Mycobacterium bovis
SDPVWAKKFTDAGVPIVGDD

SEQ ID NO: 222849 - protein, 23 aa, Mycobacterium bovis
SDQVYLDLLTGWRDAWELGRAAR

SEQ ID NO: 222850 - protein, 27 aa, Mycobacterium bovis
SDRAGAITPFALLQLADRGQFFVEPGQ

SEQ ID NO: 222851 - protein, 24 aa, Mycobacterium bovis
SDRLKPWDVIAARLTAAAAADLVL

SEQ ID NO: 222852 - protein, 25 aa, Mycobacterium bovis
SDSDMYTLGFRFRPWTGRQAIADGK

SEQ ID NO: 222853 - protein, 24 aa, Mycobacterium bovis
SDSLAITWAHPELPQRAFDLGAGQ

SEQ ID NO: 222854 - protein, 27 aa, Mycobacterium bovis
SDSMVAAVLPFVGWLSTTATLAEQAAM

SEQ ID NO: 222855 - protein, 18 aa, Mycobacterium bovis
SDSSIFTLSFPYEPWTRE

SEQ ID NO: 222856 - protein, 33 aa, Mycobacterium bovis
SDTGALMSLLLLIFPHLALAPYMRGLDPILGLD

SEQ ID NO: 222857 - protein, 18 aa, Mycobacterium bovis
SDTWQPPTPRRLGPFRAS

SEQ ID NO: 222858 - protein, 25 aa, Mycobacterium bovis
SDVEYPLLGPWGTARVFAPQKGADM

SEQ ID NO: 222859 - protein, 17 aa, Mycobacterium bovis
SDYLAGRAFSFISAIDS

SEQ ID NO: 222860 - protein, 23 aa, Mycobacterium bovis
SEAQKRHFLPRILSGEHRWCQGF

SEQ ID NO: 222861 - protein, 28 aa, Mycobacterium bovis
SEARSPVLVDCLGTWLTAIMDGEALWSA

SEQ ID NO: 222862 - protein, 22 aa, Mycobacterium bovis
SEDWMTRLLLGFGSDVRVLAPE

SEQ ID NO: 222863 - protein, 20 aa, Mycobacterium bovis
SEFAVLRRQIAVGGQVLQLQ

SEQ ID NO: 222864 - protein, 30 aa, Mycobacterium bovis
SELAVLLPELLLIGQLIDRSGMAWCIQAFG

SEQ ID NO: 222865 - protein, 26 aa, Mycobacterium bovis
SELDPDLLWLADHVIDDLVVLPGAAY

SEQ ID NO: 222866 - protein, 18 aa, Mycobacterium bovis
SELLPQLLAADALAAELK

SEQ ID NO: 222867 - protein, 19 aa, Mycobacterium bovis
SELRLLYLTVTDPASGNLI

SEQ ID NO: 222868 - protein, 23 aa, Mycobacterium bovis
SELSHFSGAGISLLCILDEDCRA

SEQ ID NO: 222869 - protein, 25 aa, Mycobacterium bovis
SELWPDLNLGLPFTYHQGYQSSPVP

SEQ ID NO: 222870 - protein, 24 aa, Mycobacterium bovis
SEPLTEAIPLWKRPQDGAIITGWD

SEQ ID NO: 222871 - protein, 17 aa, Mycobacterium bovis
SERPAIHRFPGSMAKRI

SEQ ID NO: 222872 - protein, 20 aa, Mycobacterium bovis
SESFAWTHRNHLALGLDLRN

SEQ ID NO: 222873 - protein, 30 aa, Mycobacterium bovis
SESNAMWALSIPVPFTKPVGAGAGGYFAPH

SEQ ID NO: 222874 - protein, 18 aa, Mycobacterium bovis
SETAVYNVLPQWAKLAAK

SEQ ID NO: 222875 - protein, 27 aa, Mycobacterium bovis
SEVEYRQLRLERVVLVGVWTEGSAADN

SEQ ID NO: 222876 - protein, 20 aa, Mycobacterium bovis
SEVGGPLPGLGADLLAVVAR

SEQ ID NO: 222877 - protein, 22 aa, Mycobacterium bovis
SEVLLIEPFYDSYSPVVAMAGA

SEQ ID NO: 222878 - protein, 31 aa, Mycobacterium bovis
SEVLSALSCRPAIVVPAFLSRGYHVRTDLPA

SEQ ID NO: 222879 - protein, 18 aa, Mycobacterium bovis
SEVSFPKPVFHGDTLYAE

SEQ ID NO: 222880 - protein, 25 aa, Mycobacterium bovis
SFDEDPFAILAWRGREREDLLANLA

SEQ ID NO: 222881 - protein, 19 aa, Mycobacterium bovis
SFFPAILEPRRRIDQALYA

SEQ ID NO: 222882 - protein, 19 aa, Mycobacterium bovis
SFGFSTLGGWLATRSGGHF

SEQ ID NO: 222883 - protein, 23 aa, Mycobacterium bovis
SFIHRARRLLPGDPEFGDPLSTA

SEQ ID NO: 222884 - protein, 21 aa, Mycobacterium bovis
SFMQGFPNVLSPRSSLLVLGD

SEQ ID NO: 222885 - protein, 17 aa, Mycobacterium bovis
SFPLYCCANGKALLAAL

SEQ ID NO: 222886 - protein, 18 aa, Mycobacterium bovis
SFRRIDFALDPPAGDIGL

SEQ ID NO: 222887 - protein, 37 aa, Mycobacterium bovis
SFSAAAVWRIRRAAPLLPTVLLGKTPRYLTSSAATAV

SEQ ID NO: 222888 - protein, 34 aa, Mycobacterium bovis
SFSTTDVDFYRWTQWIFLQIYNAWFDTTANKARP

SEQ ID NO: 222889 - protein, 33 aa, Mycobacterium bovis
SFVNPHDIVLFPAWVWRSPLKPSPLDPPHVPAA

SEQ ID NO: 222890 - protein, 22 aa, Mycobacterium bovis
SGAKILLQILHAGRYAYHPLAV

SEQ ID NO: 222891 - protein, 22 aa, Mycobacterium bovis
SGALAWAIYALLTVPGTWESAA

SEQ ID NO: 222892 - protein, 19 aa, Mycobacterium bovis
SGAPGQRGGAGGAAGLIGN

SEQ ID NO: 222893 - protein, 27 aa, Mycobacterium bovis
SGDDALNLPWLAMGATGFISVIAHLAA

SEQ ID NO: 222894 - protein, 22 aa, Mycobacterium bovis
SGDLLVTVKVAVPPNLAGAAQE

SEQ ID NO: 222895 - protein, 22 aa, Mycobacterium bovis
SGDLRVDFPWLGTVVQAYLRRT

SEQ ID NO: 222896 - protein, 32 aa, Mycobacterium bovis
SGDNPLHPLALPLLRPQQVIMLGRPTLHRPVS

SEQ ID NO: 222897 - protein, 24 aa, Mycobacterium bovis
SGDPLLHGIGSTLIRLFGHDNVTV

SEQ ID NO: 222898 - protein, 34 aa, Mycobacterium bovis
SGDPYRLAAQLGMPPWRVQKAQKQARRWSRDTVA

SEQ ID NO: 222899 - protein, 34 aa, Mycobacterium bovis
SGELPQRHIGVGWAALRSLPPPAPQPALTVTGVD

SEQ ID NO: 222900 - protein, 31 aa, Mycobacterium bovis
SGEQRLSGFLLWQSAYSEMWFTEAHWPAFRH

SEQ ID NO: 222901 - protein, 23 aa, Mycobacterium bovis
SGEYVFWPDPRLVFQSLAQKYGA

SEQ ID NO: 222902 - protein, 26 aa, Mycobacterium bovis
SGFERFPAWMWRNTVVRDFVEWLRTR

SEQ ID NO: 222903 - protein, 21 aa, Mycobacterium bovis
SGFRLLAMTPHGNACKLPEAI

SEQ ID NO: 222904 - protein, 25 aa, Mycobacterium bovis
SGGAGSIGFNASAPGAAGSPGGNGG

SEQ ID NO: 222905 - protein, 22 aa, Mycobacterium bovis
SGGFGQFGGAGGLLYGNGGAAG

SEQ ID NO: 222906 - protein, 24 aa, Mycobacterium bovis
SGGNAGLLALGASGGAGGSGGSAL

SEQ ID NO: 222907 - protein, 26 aa, Mycobacterium bovis
SGGQRRRLQLMLTLLSEPNVLLLDEP

SEQ ID NO: 222908 - protein, 26 aa, Mycobacterium bovis
SGGRGIHVFLRIATDWDFVEVRRAGI

SEQ ID NO: 222909 - protein, 20 aa, Mycobacterium bovis
SGGRGRPRRASARPGNCVRR

SEQ ID NO: 222910 - protein, 20 aa, Mycobacterium bovis
SGGRLLAPGWPGEWVQHEST

SEQ ID NO: 222911 - protein, 20 aa, Mycobacterium bovis
SGGSALLWGDGGAGGAGGVG

SEQ ID NO: 222912 - protein, 28 aa, Mycobacterium bovis
SGGVDSTALYPPKRFLGAARNIEEGGSL

SEQ ID NO: 222913 - protein, 21 aa, Mycobacterium bovis
SGHALLLGARGRRLDVRQART

SEQ ID NO: 222914 - protein, 19 aa, Mycobacterium bovis
SGIGFGLHNDIVAPYLLAL

SEQ ID NO: 222915 - protein, 18 aa, Mycobacterium bovis
SGKSTFMRLLLAAETPTS

SEQ ID NO: 222916 - protein, 17 aa, Mycobacterium bovis
SGKTTTTYLVEAGLRAA

SEQ ID NO: 222917 - protein, 25 aa, Mycobacterium bovis
SGLDARGYRLPWPADTTVFEVDQPR

SEQ ID NO: 222918 - protein, 27 aa, Mycobacterium bovis
SGLDSRAYRLPWPTRTVVYEIDQPKVM

SEQ ID NO: 222919 - protein, 21 aa, Mycobacterium bovis
SGLLHHSVGTMTLNFGLANVG

SEQ ID NO: 222920 - protein, 33 aa, Mycobacterium bovis
SGLMQAPMSAMQPLQSMVGMFANPGALGMGGAA

SEQ ID NO: 222921 - protein, 34 aa, Mycobacterium bovis
SGLRRDYRWAEADRHLWIADERGTWHLREAEEHK

SEQ ID NO: 222922 - protein, 21 aa, Mycobacterium bovis
SGLTAGVWQGAAAAAMAAAAA

SEQ ID NO: 222923 - protein, 24 aa, Mycobacterium bovis
SGMNRIRLSTTVDAALLTSARDMR

SEQ ID NO: 222924 - protein, 21 aa, Mycobacterium bovis
SGNFGVDGEAGFSGGAGGNGG

SEQ ID NO: 222925 - protein, 36 aa, Mycobacterium bovis
SGNFSNGLLWRGDHEGLFSLFYSLDVPRITIVDAHL

SEQ ID NO: 222926 - protein, 24 aa, Mycobacterium bovis
SGNPYLAFSAMLMAGLDGIKNKIE

SEQ ID NO: 222927 - protein, 26 aa, Mycobacterium bovis
SGNQRLPTLTDLLYQLATRAVTSEEL

SEQ ID NO: 222928 - protein, 27 aa, Mycobacterium bovis
SGNYSNGFFWRGDYQGLIGFSGTLTIP

SEQ ID NO: 222929 - protein, 27 aa, Mycobacterium bovis
SGNYSNGFFWRGDYQGLIGLSTTITIP

SEQ ID NO: 222930 - protein, 29 aa, Mycobacterium bovis
SGNYSNGILWRGDYQGLIGYSYALTIPEI

SEQ ID NO: 222931 - protein, 33 aa, Mycobacterium bovis
SGPRPFVRLEGPAVFRWAAFKMGDVGRRAMDAA

SEQ ID NO: 222932 - protein, 20 aa, Mycobacterium bovis
SGPVSFLRLYDSAAGVVSMG

SEQ ID NO: 222933 - protein, 25 aa, Mycobacterium bovis
SGQAGALRLGIARALILVSPEDRPA

SEQ ID NO: 222934 - protein, 26 aa, Mycobacterium bovis
SGRLTFGIVYTYARPNWWANANTVRS

SEQ ID NO: 222935 - protein, 29 aa, Mycobacterium bovis
SGRPLAMPRLDMVTGLYYLTTEVPGDTGE

SEQ ID NO: 222936 - protein, 20 aa, Mycobacterium bovis
SGRPPGPCPIPLSAGDDGPG

SEQ ID NO: 222937 - protein, 20 aa, Mycobacterium bovis
SGRPVGLRPSGALGADVVRA

SEQ ID NO: 222938 - protein, 29 aa, Mycobacterium bovis
SGRTVGVLANNPLRLGGCLNSESAEKAAR

SEQ ID NO: 222939 - protein, 22 aa, Mycobacterium bovis
SGRTYPVLYLFHGGGTDQDFRT

SEQ ID NO: 222940 - protein, 22 aa, Mycobacterium bovis
SGRYALIRTNGDRWLAHRLKNQ

SEQ ID NO: 222941 - protein, 19 aa, Mycobacterium bovis
SGRYPQAIFDHGTPLALYH

SEQ ID NO: 222942 - protein, 24 aa, Mycobacterium bovis
SGTDMFWPGWRMAPSPAQLAFLQQ

SEQ ID NO: 222943 - protein, 22 aa, Mycobacterium bovis
SGTRLYPITMGISKQLLPVYDK

SEQ ID NO: 222944 - protein, 32 aa, Mycobacterium bovis
SGTVTFPGFTIPLDPIDIGLPVSLTIPGFTIP

SEQ ID NO: 222945 - protein, 24 aa, Mycobacterium bovis
SGVGSLLMGIPGPGGLQFAGRVGT

SEQ ID NO: 222946 - protein, 24 aa, Mycobacterium bovis
SGVNLVMQRWVYHSTRLAVPTHTY

SEQ ID NO: 222947 - protein, 24 aa, Mycobacterium bovis
SGVNTWTAIRWTFAEDSPYVGTGL

SEQ ID NO: 222948 - protein, 22 aa, Mycobacterium bovis
SGVQAWLGPLPDDPAGLPHIPV

SEQ ID NO: 222949 - protein, 19 aa, Mycobacterium bovis
SGVVLYLRPPGPAQACGLF

SEQ ID NO: 222950 - protein, 31 aa, Mycobacterium bovis
SGYAPVIGSPWLTAFAQHSPFAEKFQSLGQN

SEQ ID NO: 222951 - protein, 22 aa, Mycobacterium bovis
SGYENIIIRGLFLGQTRKQMQA

SEQ ID NO: 222952 - protein, 22 aa, Mycobacterium bovis
SGYRRFTAYDCARLRFILTAQR

SEQ ID NO: 222953 - protein, 18 aa, Mycobacterium bovis
SHAAITAALWGVDEAISR

SEQ ID NO: 222954 - protein, 26 aa, Mycobacterium bovis
SHAFHSLLMEPMLAEFTRIAAGISVS

SEQ ID NO: 222955 - protein, 17 aa, Mycobacterium bovis
SHALASIDAFAAAVDGA

SEQ ID NO: 222956 - protein, 38 aa, Mycobacterium bovis
SHALSFASLVFYSAWFKLHHPAAFCAALLRAQPMGFYS

SEQ ID NO: 222957 - protein, 22 aa, Mycobacterium bovis
SHAPRPRMLVFGAIDFAAALAR

SEQ ID NO: 222958 - protein, 23 aa, Mycobacterium bovis
SHDIPRFVSLWQSGRLPVESLVT

SEQ ID NO: 222959 - protein, 24 aa, Mycobacterium bovis
SHGGYPWVLQACLIAWKHPNVYLE

SEQ ID NO: 222960 - protein, 18 aa, Mycobacterium bovis
SHHPIIDPILPELRSALA

SEQ ID NO: 222961 - protein, 48 aa, Mycobacterium bovis
SHLIVRMYNALLEAVFWFLSRKTPVFVKWLLRRTAIKNLPEGYDIETH

SEQ ID NO: 222962 - protein, 18 aa, Mycobacterium bovis
SHPPNPKATIALLRRVED

SEQ ID NO: 222963 - protein, 28 aa, Mycobacterium bovis
SHQLPVWTLRLYLTGKRLWHDPRRRDCA

SEQ ID NO: 222964 - protein, 24 aa, Mycobacterium bovis
SHQYPDFRGFLAEVARVLRPGGHF

SEQ ID NO: 222965 - protein, 17 aa, Mycobacterium bovis
SHRAKVYGFPAPGAPPL

SEQ ID NO: 222966 - protein, 19 aa, Mycobacterium bovis
SHSHRRTRRRWPPNIQLKA

SEQ ID NO: 222967 - protein, 20 aa, Mycobacterium bovis
SHTRGYIGTALRLLERKIAQ

SEQ ID NO: 222968 - protein, 25 aa, Mycobacterium bovis
SIAERIPLPGRRPARRSSSRSVRSQ

SEQ ID NO: 222969 - protein, 29 aa, Mycobacterium bovis
SIARVAATVPLGRLARPADIGWAAAFLAS

SEQ ID NO: 222970 - protein, 24 aa, Mycobacterium bovis
SIDGLIAILTFPPAESVFDQIIDA

SEQ ID NO: 222971 - protein, 19 aa, Mycobacterium bovis
SIDIATHAVDRTKEVFTGK

SEQ ID NO: 222972 - protein, 21 aa, Mycobacterium bovis
SIDVVLRLPGQRYLVVDYKTN

SEQ ID NO: 222973 - protein, 33 aa, Mycobacterium bovis
SIGSDGSIFLRPFLKYQIITVVAPNSPLAAGIP

SEQ ID NO: 222974 - protein, 18 aa, Mycobacterium bovis
SIGSFQNSRFLLAELATE

SEQ ID NO: 222975 - protein, 24 aa, Mycobacterium bovis
SIGVEHILPIAPPPQEARPRWRRM

SEQ ID NO: 222976 - protein, 23 aa, Mycobacterium bovis
SIHTVEAFLPRLLEQGTGGHVVF

SEQ ID NO: 222977 - protein, 17 aa, Mycobacterium bovis
SIKEKLLELLPNRVITD

SEQ ID NO: 222978 - protein, 18 aa, Mycobacterium bovis
SIKRFSTLLSNAGTIFWN

SEQ ID NO: 222979 - protein, 17 aa, Mycobacterium bovis
SILGRLPCDVGLEGDDT

SEQ ID NO: 222980 - protein, 23 aa, Mycobacterium bovis
SIMGIGFPPWTGGSAQFIVGYSG

SEQ ID NO: 222981 - protein, 21 aa, Mycobacterium bovis
SINLPYITVDADKNPLFLDEQ

SEQ ID NO: 222982 - protein, 22 aa, Mycobacterium bovis
SIPNIAIPSIHLGIDPTFDVGP

SEQ ID NO: 222983 - protein, 25 aa, Mycobacterium bovis
SIPNPFAVTYYLIKGSLQAPYGAIV

SEQ ID NO: 222984 - protein, 19 aa, Mycobacterium bovis
SIPTPPGWAPMKNPNITPN

SEQ ID NO: 222985 - protein, 25 aa, Mycobacterium bovis
SIREPLWVPSPTDRRLRHACALIAD

SEQ ID NO: 222986 - protein, 18 aa, Mycobacterium bovis
SIRHRMASVIFSLEMSKS

SEQ ID NO: 222987 - protein, 17 aa, Mycobacterium bovis
SIRKFRILPVDFTEDTG

SEQ ID NO: 222988 - protein, 19 aa, Mycobacterium bovis
SIRVFPGDHFYLNDNLPEL

SEQ ID NO: 222989 - protein, 25 aa, Mycobacterium bovis
SIVDRLMYNAFRAAYEPTLAALTTT

SEQ ID NO: 222990 - protein, 24 aa, Mycobacterium bovis
SIVPHTWLWAMPMSGPTGGEIRAV

SEQ ID NO: 222991 - protein, 21 aa, Mycobacterium bovis
SIWIGPRVVIPSLALRARVRE

SEQ ID NO: 222992 - protein, 24 aa, Mycobacterium bovis
SKAYAAYSTPFWRASGYSGQALSD

SEQ ID NO: 222993 - protein, 24 aa, Mycobacterium bovis
SKFADPWTFDLARNPNPHLGFGGG

SEQ ID NO: 222994 - protein, 21 aa, Mycobacterium bovis
SKITAVMAALRRWARDRGLNP

SEQ ID NO: 222995 - protein, 30 aa, Mycobacterium bovis
SKLRERLGFGELRWALSGAAPIPKETLAFF

SEQ ID NO: 222996 - protein, 20 aa, Mycobacterium bovis
SKLTPWKAPPPIAHSTVLVA

SEQ ID NO: 222997 - protein, 24 aa, Mycobacterium bovis
SKPSPFAWIPFGGGTRRCVGAAFA

SEQ ID NO: 222998 - protein, 26 aa, Mycobacterium bovis
SKQADALMLLYLLSSDELIGLLARLG

SEQ ID NO: 222999 - protein, 25 aa, Mycobacterium bovis
SKQAILDALIRRLDEWRCLECIRAL

SEQ ID NO: 223000 - protein, 17 aa, Mycobacterium bovis
SKRGLTLFETTPGLEAC

SEQ ID NO: 223001 - protein, 33 aa, Mycobacterium bovis
SLAEIRHWLQIFVQRFYSFSQFKRSALPNGPKV

SEQ ID NO: 223002 - protein, 21 aa, Mycobacterium bovis
SLAGHTFWPDDVPLIVGSAGD

SEQ ID NO: 223003 - protein, 20 aa, Mycobacterium bovis
SLDIGIPWRQYLRVQQGIRG

SEQ ID NO: 223004 - protein, 25 aa, Mycobacterium bovis
SLDKVLGVHNFYFSPDPRASLCDIA

SEQ ID NO: 223005 - protein, 23 aa, Mycobacterium bovis
SLDSLLTRVARLEALGGGPQAAG

SEQ ID NO: 223006 - protein, 31 aa, Mycobacterium bovis
SLETLIRRHGPLDWRETLSIGVKLAGALEAA

SEQ ID NO: 223007 - protein, 28 aa, Mycobacterium bovis
SLGITLPVALVWAYPTISDLATALCERM

SEQ ID NO: 223008 - protein, 20 aa, Mycobacterium bovis
SLGLLDDFPPYDSVFDPVNR

SEQ ID NO: 223009 - protein, 25 aa, Mycobacterium bovis
SLGLVQLTRKRLGTGLIEAFSTSCP

SEQ ID NO: 223010 - protein, 25 aa, Mycobacterium bovis
SLGNPLYLRHLIDGGGLEHVDGRWR

SEQ ID NO: 223011 - protein, 25 aa, Mycobacterium bovis
SLHCVYKPVSGERPLWDFPDGTLAG

SEQ ID NO: 223012 - protein, 20 aa, Mycobacterium bovis
SLIGEFARTLTMTDLVTGWT

SEQ ID NO: 223013 - protein, 18 aa, Mycobacterium bovis
SLIGIFQLGGAAARGGER

SEQ ID NO: 223014 - protein, 17 aa, Mycobacterium bovis
SLKLFQLITELEDEFDI

SEQ ID NO: 223015 - protein, 25 aa, Mycobacterium bovis
SLLANAIGYPIAASVALVTPAAGAN

SEQ ID NO: 223016 - protein, 21 aa, Mycobacterium bovis
SLMTLTTLYPPVAAVVSLWTQ

SEQ ID NO: 223017 - protein, 21 aa, Mycobacterium bovis
SLNDMGFRVIPSDANFVLFGE

SEQ ID NO: 223018 - protein, 26 aa, Mycobacterium bovis
SLPLFVSELLALYRAGGHVAALPAAP

SEQ ID NO: 223019 - protein, 23 aa, Mycobacterium bovis
SLPSVLPTALRELIRYVRPSWLR

SEQ ID NO: 223020 - protein, 19 aa, Mycobacterium bovis
SLPTMPVEDYPTLPTLPEE

SEQ ID NO: 223021 - protein, 24 aa, Mycobacterium bovis
SLQAPLDVLVVRKLGVPFQPELAF

SEQ ID NO: 223022 - protein, 21 aa, Mycobacterium bovis
SLQPETRLAAPLLAKGLPACP

SEQ ID NO: 223023 - protein, 19 aa, Mycobacterium bovis
SLQPHFARTLDLWAEALQA

SEQ ID NO: 223024 - protein, 29 aa, Mycobacterium bovis
SLRDPYHAYTIDWLPEGWFIEVSEVAPGC

SEQ ID NO: 223025 - protein, 20 aa, Mycobacterium bovis
SLRRGVFHNSRRLDNGNWVW

SEQ ID NO: 223026 - protein, 19 aa, Mycobacterium bovis
SLSPFVTWGTNPGQGVPLA

SEQ ID NO: 223027 - protein, 28 aa, Mycobacterium bovis
SLSPTEFTLLRYFVINAGTVLSKPKILD

SEQ ID NO: 223028 - protein, 24 aa, Mycobacterium bovis
SLTDNYVVIYDLPVTFDPMQVVPA

SEQ ID NO: 223029 - protein, 25 aa, Mycobacterium bovis
SLTKIANDIRWMGSGPLTGLAEIQL

SEQ ID NO: 223030 - protein, 26 aa, Mycobacterium bovis
SLTPLEFDLLVALARKPRQVFTRDVL

SEQ ID NO: 223031 - protein, 18 aa, Mycobacterium bovis
SLTPLVPMPGRFIYAGIA

SEQ ID NO: 223032 - protein, 17 aa, Mycobacterium bovis
SLVIRIAPPVGRQLDWM

SEQ ID NO: 223033 - protein, 17 aa, Mycobacterium bovis
SLVLLAWGAANRDPRQY

SEQ ID NO: 223034 - protein, 29 aa, Mycobacterium bovis
SLVSRISAFLRPDWTRTVRARRFAAAGLV

SEQ ID NO: 223035 - protein, 24 aa, Mycobacterium bovis
SLYDSYIRAFRWATDRIGDNGVVG

SEQ ID NO: 223036 - protein, 22 aa, Mycobacterium bovis
SLYRFHRRLASFSRVIRLDHRG

SEQ ID NO: 223037 - protein, 31 aa, Mycobacterium bovis
SMCGRAYSPRFLWMWPNARISVMGGEQAASV

SEQ ID NO: 223038 - protein, 22 aa, Mycobacterium bovis
SMDAIMFPYNNARILRQLATPI

SEQ ID NO: 223039 - protein, 24 aa, Mycobacterium bovis
SMFAQLHNAGLLDRAPLAVLALGG

SEQ ID NO: 223040 - protein, 22 aa, Mycobacterium bovis
SMGNYIFTTKVLIDAIRADADD

SEQ ID NO: 223041 - protein, 19 aa, Mycobacterium bovis
SMILPPIAHQVKVISIAQF

SEQ ID NO: 223042 - protein, 18 aa, Mycobacterium bovis
SMQRNKFGRMIFIGSVSG

SEQ ID NO: 223043 - protein, 17 aa, Mycobacterium bovis
SMVSLTLMARLAEAVRP

SEQ ID NO: 223044 - protein, 22 aa, Mycobacterium bovis
SNAIGIFHAFLDDPGVRLVGFE

SEQ ID NO: 223045 - protein, 18 aa, Mycobacterium bovis
SNDDMFFGRPLKASMFFS

SEQ ID NO: 223046 - protein, 23 aa, Mycobacterium bovis
SNEAPIQRFWRDAHAGRVHAAND

SEQ ID NO: 223047 - protein, 22 aa, Mycobacterium bovis
SNEFFKLWLDPSMTYSCAYFER

SEQ ID NO: 223048 - protein, 19 aa, Mycobacterium bovis
SNEFLARLCKTAIWIDHGV

SEQ ID NO: 223049 - protein, 18 aa, Mycobacterium bovis
SNFASYLAIVLRVDEVTD

SEQ ID NO: 223050 - protein, 18 aa, Mycobacterium bovis
SNGLLWRGGYEGLVGVRV

SEQ ID NO: 223051 - protein, 25 aa, Mycobacterium bovis
SNIAKVYPFQVLLSATTTGLQVDCK

SEQ ID NO: 223052 - protein, 31 aa, Mycobacterium bovis
SNIDIPPMDFTLGLPVLGPITGQLGPIHLEP

SEQ ID NO: 223053 - protein, 21 aa, Mycobacterium bovis
SNNHRFLPPPAPRALLALLTG

SEQ ID NO: 223054 - protein, 27 aa, Mycobacterium bovis
SNPLVGKLTTKYFLPLGTRQVGDHVVF

SEQ ID NO: 223055 - protein, 21 aa, Mycobacterium bovis
SNSPHLYAELAIPATAGGTVG

SEQ ID NO: 223056 - protein, 23 aa, Mycobacterium bovis
SNVPGPPFPLYMAGARLDSLVPL

SEQ ID NO: 223057 - protein, 21 aa, Mycobacterium bovis
SNYAWGVHTVEFYTAGTAVRR

SEQ ID NO: 223058 - protein, 24 aa, Mycobacterium bovis
SPAGAYFKGGIAPVSVWVSTEYVR

SEQ ID NO: 223059 - protein, 18 aa, Mycobacterium bovis
SPAWLRLDARFGSVYRHR

SEQ ID NO: 223060 - protein, 26 aa, Mycobacterium bovis
SPDEKPPRMYLARYASSARPRLTPPV

SEQ ID NO: 223061 - protein, 24 aa, Mycobacterium bovis
SPDQYTMVSYYRPELDGLPEMGLV

SEQ ID NO: 223062 - protein, 43 aa, Mycobacterium bovis
SPDVLTTYILLPSQDLPLLVPLRAIPLLGNPLADLIQPDLRVL

SEQ ID NO: 223063 - protein, 24 aa, Mycobacterium bovis
SPEDPGVMWQFTQAVRGLADGCAD

SEQ ID NO: 223064 - protein, 32 aa, Mycobacterium bovis
SPEGLKRNLRLRDGRWHWHWDPAMMTAPGHDP

SEQ ID NO: 223065 - protein, 21 aa, Mycobacterium bovis
SPETLIIDCGADFRLTDAAVW

SEQ ID NO: 223066 - protein, 17 aa, Mycobacterium bovis
SPEWWVANVKPGRVLFE

SEQ ID NO: 223067 - protein, 18 aa, Mycobacterium bovis
SPGFDKKAGEWFAAKGVK

SEQ ID NO: 223068 - protein, 25 aa, Mycobacterium bovis
SPGGPFDWRLPDLVGASLDSLLTRV

SEQ ID NO: 223069 - protein, 22 aa, Mycobacterium bovis
SPLAIGLFGVNPTVGSIGPGSI

SEQ ID NO: 223070 - protein, 19 aa, Mycobacterium bovis
SPLNLLRWTSARSIKETFV

SEQ ID NO: 223071 - protein, 17 aa, Mycobacterium bovis
SPLPVVAASAEGAWIAD

SEQ ID NO: 223072 - protein, 28 aa, Mycobacterium bovis
SPLQARCGWAVGWRKDAFFGRAALLAEK

SEQ ID NO: 223073 - protein, 20 aa, Mycobacterium bovis
SPLVVPQLRTITLGGAVTGL

SEQ ID NO: 223074 - protein, 36 aa, Mycobacterium bovis
SPMQAVLDVVNGPTQLLLGRPLIGDGANGGPGQNGG

SEQ ID NO: 223075 - protein, 27 aa, Mycobacterium bovis
SPNLASLIVAPYFRAPSNRRSTVGGVW

SEQ ID NO: 223076 - protein, 17 aa, Mycobacterium bovis
SPQALIALAMLTLAGHR

SEQ ID NO: 223077 - protein, 26 aa, Mycobacterium bovis
SPQAQRMLKFAFNLLDDGLVGQQLFA

SEQ ID NO: 223078 - protein, 26 aa, Mycobacterium bovis
SPQNAQWLTPVLVAAGIDLLVIQGTI

SEQ ID NO: 223079 - protein, 30 aa, Mycobacterium bovis
SPRLYGGTYNLFHYSLAKLGIEVSFVDDPD

SEQ ID NO: 223080 - protein, 19 aa, Mycobacterium bovis
SPRQRAVLLLRDVLQWKSA

SEQ ID NO: 223081 - protein, 32 aa, Mycobacterium bovis
SPVRIIGYANAYDFFNMWRVRPAGLRVIGAGY

SEQ ID NO: 223082 - protein, 20 aa, Mycobacterium bovis
SPVRSAWLDIPSLVEAAKQT

SEQ ID NO: 223083 - protein, 29 aa, Mycobacterium bovis
SPWVGNIDLTFPYLDTPATRAIGVPPGSR

SEQ ID NO: 223084 - protein, 23 aa, Mycobacterium bovis
SPYFDSMLVKLTCRGRDLPTAVS

SEQ ID NO: 223085 - protein, 26 aa, Mycobacterium bovis
SQAAKDWLCLLEAFDAPQRSGLVRAA

SEQ ID NO: 223086 - protein, 26 aa, Mycobacterium bovis
SQDAGLAMLLLSRPPTNAMTRQVYRE

SEQ ID NO: 223087 - protein, 25 aa, Mycobacterium bovis
SQDTLLAKLRRRPYLQLNTIQDIAG

SEQ ID NO: 223088 - protein, 33 aa, Mycobacterium bovis
SQHGGILLITHYTRILRYIHPEYVHVFVGGRIV

SEQ ID NO: 223089 - protein, 23 aa, Mycobacterium bovis
SQIDYWQVVGIFISGQPIPLRAA

SEQ ID NO: 223090 - protein, 21 aa, Mycobacterium bovis
SQLARLAAALQEKKACPGPDS

SEQ ID NO: 223091 - protein, 31 aa, Mycobacterium bovis
SQLPLQHASMLFLPVRILTSPITTLASMARE

SEQ ID NO: 223092 - protein, 17 aa, Mycobacterium bovis
SQLRTALRMQISTGYTV

SEQ ID NO: 223093 - protein, 23 aa, Mycobacterium bovis
SQNPYLEGFLAPVSTEVTATDLP

SEQ ID NO: 223094 - protein, 20 aa, Mycobacterium bovis
SQQQLIQRFARPLRTFFENA

SEQ ID NO: 223095 - protein, 25 aa, Mycobacterium bovis
SQRQALLFLRADRLQYFVSCLVYMP

SEQ ID NO: 223096 - protein, 23 aa, Mycobacterium bovis
SQTRRRVAVLGGNRIPFARSDGA

SEQ ID NO: 223097 - protein, 25 aa, Mycobacterium bovis
SQYKDVILGLVFLKYVSDAYDERRE

SEQ ID NO: 223098 - protein, 26 aa, Mycobacterium bovis
SRAAGDGFARYWLHNGWVTMGGEKMS

SEQ ID NO: 223099 - protein, 20 aa, Mycobacterium bovis
SRAAVQIAFALRAGANRYAE

SEQ ID NO: 223100 - protein, 25 aa, Mycobacterium bovis
SRACQVRFAIYLGDLGRDTAARARE

SEQ ID NO: 223101 - protein, 28 aa, Mycobacterium bovis
SRAGGRYSVYLWALLAMAAARCGLGPLR

SEQ ID NO: 223102 - protein, 26 aa, Mycobacterium bovis
SRALEDWCHQLAWPIRPAVSADPPST

SEQ ID NO: 223103 - protein, 23 aa, Mycobacterium bovis
SRALRRVRAVLTAAARCHRSGSL

SEQ ID NO: 223104 - protein, 22 aa, Mycobacterium bovis
SRAMPAYNWMTVAKSALESVNR

SEQ ID NO: 223105 - protein, 25 aa, Mycobacterium bovis
SRARRPTSTIWSPRRARSSTTREAT

SEQ ID NO: 223106 - protein, 24 aa, Mycobacterium bovis
SRARYLMLRLLERAGEQRVAIPAL

SEQ ID NO: 223107 - protein, 20 aa, Mycobacterium bovis
SRATLRRLYRHPRSGALVAM

SEQ ID NO: 223108 - protein, 24 aa, Mycobacterium bovis
SRAVPLRLVSVIKPTHPSPDDYDR

SEQ ID NO: 223109 - protein, 31 aa, Mycobacterium bovis
SRDALDRALIDLATYFRDALLVAAHAGGVRA

SEQ ID NO: 223110 - protein, 19 aa, Mycobacterium bovis
SRDLGVTEFMLLQAAVAVV

SEQ ID NO: 223111 - protein, 25 aa, Mycobacterium bovis
SRDRFFTALWGVRALLGGLGAASRW

SEQ ID NO: 223112 - protein, 32 aa, Mycobacterium bovis
SREPDPDVLLLFSALELLHAWALVHDDLIDRS

SEQ ID NO: 223113 - protein, 18 aa, Mycobacterium bovis
SRFRELICSRAVDIAIGP

SEQ ID NO: 223114 - protein, 25 aa, Mycobacterium bovis
SRGLGQRLLYPIHERRWRGKWHGQC

SEQ ID NO: 223115 - protein, 27 aa, Mycobacterium bovis
SRGVPPTRLRLIYLADGQLLDYSPDRD

SEQ ID NO: 223116 - protein, 18 aa, Mycobacterium bovis
SRGWSNLESFFAGVPGLT

SEQ ID NO: 223117 - protein, 26 aa, Mycobacterium bovis
SRIGAYQRRGAVSTLLLVVQRVPYFQ

SEQ ID NO: 223118 - protein, 23 aa, Mycobacterium bovis
SRKGAISSWKAFAPAHAGKVGIE

SEQ ID NO: 223119 - protein, 17 aa, Mycobacterium bovis
SRKLSLASGFALWRRSL

SEQ ID NO: 223120 - protein, 25 aa, Mycobacterium bovis
SRKRSQSHMPPRTPPRGRCLRAPES

SEQ ID NO: 223121 - protein, 23 aa, Mycobacterium bovis
SRLAIADDLAFGRLLAVDIPALN

SEQ ID NO: 223122 - protein, 25 aa, Mycobacterium bovis
SRLCTACFDGKYPIELPRETALGKN

SEQ ID NO: 223123 - protein, 18 aa, Mycobacterium bovis
SRMPDLRCLILTSYTSDE

SEQ ID NO: 223124 - protein, 24 aa, Mycobacterium bovis
SRNTVAIFLGIKDPKHSGPCDVLY

SEQ ID NO: 223125 - protein, 25 aa, Mycobacterium bovis
SRPGGPIIGYLNLSPPRGAGGAMAE

SEQ ID NO: 223126 - protein, 26 aa, Mycobacterium bovis
SRQAIWDLVASFKKLGIATLLTTQYL

SEQ ID NO: 223127 - protein, 32 aa, Mycobacterium bovis
SRQLVREWLTQWSRPGLIPVALVVVNVFVENV

SEQ ID NO: 223128 - protein, 22 aa, Mycobacterium bovis
SRQTFRLQRYPEYKANRSSTPD

SEQ ID NO: 223129 - protein, 22 aa, Mycobacterium bovis
SRRARRAGKIPAVLYGHGAEPQ

SEQ ID NO: 223130 - protein, 18 aa, Mycobacterium bovis
SRRAYDVRPIVTAILDAD

SEQ ID NO: 223131 - protein, 20 aa, Mycobacterium bovis
SRRWLLNLVITRGTPPRLEG

SEQ ID NO: 223132 - protein, 25 aa, Mycobacterium bovis
SRSLTRLAGRLLGWLLVCDPERQSS

SEQ ID NO: 223133 - protein, 25 aa, Mycobacterium bovis
SRTAKQYRFVLPGPSLTVAEQEQCL

SEQ ID NO: 223134 - protein, 29 aa, Mycobacterium bovis
SRTPTYDGVLGRLWLARGGTYALANIRGG

SEQ ID NO: 223135 - protein, 20 aa, Mycobacterium bovis
SRVFGRIDPIALSGEDYRRC

SEQ ID NO: 223136 - protein, 18 aa, Mycobacterium bovis
SRVRKAPGFALLGEKGQS

SEQ ID NO: 223137 - protein, 27 aa, Mycobacterium bovis
SSAAGLVGLPWHAAYSASKYGLRGLSE

SEQ ID NO: 223138 - protein, 20 aa, Mycobacterium bovis
SSAARHLAARWAAKEAVIKA

SEQ ID NO: 223139 - protein, 17 aa, Mycobacterium bovis
SSAGTGALLAWLTARPL

SEQ ID NO: 223140 - protein, 23 aa, Mycobacterium bovis
SSALVVAMLLTTCALIGSSPGPY

SEQ ID NO: 223141 - protein, 33 aa, Mycobacterium bovis
SSARARRLYASRGWLPWHGPTSVLAPTGPVRTP

SEQ ID NO: 223142 - protein, 35 aa, Mycobacterium bovis
SSAVGYLMPALGRPNLTLLARTRAVRLRFSATTAV

SEQ ID NO: 223143 - protein, 40 aa, Mycobacterium bovis
SSDDESIWQLLKNIPIHQLRRTGLLDKLLLLAGQPEESLA

SEQ ID NO: 223144 - protein, 28 aa, Mycobacterium bovis
SSDMVLVDYWASWCGPCRAFAPTFAESS

SEQ ID NO: 223145 - protein, 30 aa, Mycobacterium bovis
SSEAVDPLLPEVAWSWLVDALTARTDQVRA

SEQ ID NO: 223146 - protein, 24 aa, Mycobacterium bovis
SSEPGHGLALAALGLDPIVDLHMR

SEQ ID NO: 223147 - protein, 29 aa, Mycobacterium bovis
SSGLFLPSNTIAPFLGLLGGVAAADAAGD

SEQ ID NO: 223148 - protein, 18 aa, Mycobacterium bovis
SSGLTAIHLACRSLHDGE

SEQ ID NO: 223149 - protein, 25 aa, Mycobacterium bovis
SSKEWPGMLAFYRNLAMALVGDHPG

SEQ ID NO: 223150 - protein, 22 aa, Mycobacterium bovis
SSKLGGLWTAVSPHLSPLSNVS

SEQ ID NO: 223151 - protein, 22 aa, Mycobacterium bovis
SSLAFDTIFAEGQRRYVESLSA

SEQ ID NO: 223152 - protein, 29 aa, Mycobacterium bovis
SSNGALFLVLRPLLVDYVMSMPRGPQVIY

SEQ ID NO: 223153 - protein, 23 aa, Mycobacterium bovis
SSNLARFDAMRYGLRVGDDGTRS

SEQ ID NO: 223154 - protein, 23 aa, Mycobacterium bovis
SSPQLRGLWYSFTAGSVRVISLH

SEQ ID NO: 223155 - protein, 17 aa, Mycobacterium bovis
SSPVPVAITPRRYRCYT

SEQ ID NO: 223156 - protein, 17 aa, Mycobacterium bovis
SSQRDMLTATLDPELAG

SEQ ID NO: 223157 - protein, 23 aa, Mycobacterium bovis
SSREIASFFILLVVAGNETTRNA

SEQ ID NO: 223158 - protein, 23 aa, Mycobacterium bovis
SSSLVAIHWAMSSLRSGECDLAL

SEQ ID NO: 223159 - protein, 26 aa, Mycobacterium bovis
SSSLVAVHLACRSLSTWDCDIALVGG

SEQ ID NO: 223160 - protein, 26 aa, Mycobacterium bovis
SSSPFACLLIGQPTLRRRMKLGVLAA

SEQ ID NO: 223161 - protein, 18 aa, Mycobacterium bovis
SSSPWGQPLSVGLRRRWR

SEQ ID NO: 223162 - protein, 24 aa, Mycobacterium bovis
SSSQMRSWFNYRFDGPNAVNNIPF

SEQ ID NO: 223163 - protein, 22 aa, Mycobacterium bovis
SSTVLFLGRHVGYPVALEGALK

SEQ ID NO: 223164 - protein, 20 aa, Mycobacterium bovis
SSWPNLDYPGLHALSTVPQC

SEQ ID NO: 223165 - protein, 34 aa, Mycobacterium bovis
SSYRYTYAATGKPSWFLFDGLVKHDLLTGNHECY

SEQ ID NO: 223166 - protein, 24 aa, Mycobacterium bovis
STARQLLRPGANDLFWLGTAEALE

SEQ ID NO: 223167 - protein, 25 aa, Mycobacterium bovis
STAWREWAAAPDGWLAIPHGEILCR

SEQ ID NO: 223168 - protein, 27 aa, Mycobacterium bovis
STDPRSRVPALPRLGPTDALPRCRQTV

SEQ ID NO: 223169 - protein, 27 aa, Mycobacterium bovis
STEEIFTYWSMRPRGAQLGAWASQQSR

SEQ ID NO: 223170 - protein, 23 aa, Mycobacterium bovis
STEIAYLTRALKAPTLRESVSRL

SEQ ID NO: 223171 - protein, 24 aa, Mycobacterium bovis
STEQDFRLFSGMSAHYDSLPRLIR

SEQ ID NO: 223172 - protein, 24 aa, Mycobacterium bovis
STFHSTCVRILRNQAALIEGLNSN

SEQ ID NO: 223173 - protein, 27 aa, Mycobacterium bovis
STGVAYIRWLLRARPADYMLALSVAGG

SEQ ID NO: 223174 - protein, 25 aa, Mycobacterium bovis
STIAAIWDDVLDRMSWLETETSCTF

SEQ ID NO: 223175 - protein, 26 aa, Mycobacterium bovis
STIMAAAVAPFRAWIVTTASLAELVA

SEQ ID NO: 223176 - protein, 23 aa, Mycobacterium bovis
STKPAYSIVLPPPNVTGSLHMGH

SEQ ID NO: 223177 - protein, 25 aa, Mycobacterium bovis
STKTFLAQIAANYLLGLALAQARGT

SEQ ID NO: 223178 - protein, 20 aa, Mycobacterium bovis
STNIPFLQAVLDDPDFRAGR

SEQ ID NO: 223179 - protein, 17 aa, Mycobacterium bovis
STPLHTLQQQILNAINE

SEQ ID NO: 223180 - protein, 25 aa, Mycobacterium bovis
STQIAALFGAHARSYQTLSTQAAAF

SEQ ID NO: 223181 - protein, 28 aa, Mycobacterium bovis
STRAESIQHTWFGLSALAERVDATVRIA

SEQ ID NO: 223182 - protein, 20 aa, Mycobacterium bovis
STRTFPLRSSFAPSYNMTIN

SEQ ID NO: 223183 - protein, 23 aa, Mycobacterium bovis
STRYRLLETVRQYALEKLNESEE

SEQ ID NO: 223184 - protein, 25 aa, Mycobacterium bovis
STTAAAILGLLPAGGRITAGRVVFD

SEQ ID NO: 223185 - protein, 18 aa, Mycobacterium bovis
STTRSWLPNWPERCCRCT

SEQ ID NO: 223186 - protein, 24 aa, Mycobacterium bovis
STVADMMIYLGWSMAGRGAQEGRT

SEQ ID NO: 223187 - protein, 20 aa, Mycobacterium bovis
STVGGVWCRRRPNWVSRPRD

SEQ ID NO: 223188 - protein, 29 aa, Mycobacterium bovis
STVRHLEVIALTPARLLMVVITDSGRVDQ

SEQ ID NO: 223189 - protein, 18 aa, Mycobacterium bovis
STWDCDIALVGGTNVLIS

SEQ ID NO: 223190 - protein, 24 aa, Mycobacterium bovis
STWDRRPSWFRAVARMATGVKDRA

SEQ ID NO: 223191 - protein, 18 aa, Mycobacterium bovis
STYCPFKGEASYYSVTTD

SEQ ID NO: 223192 - protein, 34 aa, Mycobacterium bovis
STYHAFAGSLLRDYGLLLPLEPDTRLLSETELWQ

SEQ ID NO: 223193 - protein, 21 aa, Mycobacterium bovis
SVAATLAPFSLPPVSLAGLAA

SEQ ID NO: 223194 - protein, 31 aa, Mycobacterium bovis
SVADFWFDPLCPWCWITSRWILEVAKVRDIE

SEQ ID NO: 223195 - protein, 24 aa, Mycobacterium bovis
SVALGFGFRCGFLGLLHMEITRER

SEQ ID NO: 223196 - protein, 24 aa, Mycobacterium bovis
SVAPLIAVPPAETGLKWPNDVLAR

SEQ ID NO: 223197 - protein, 20 aa, Mycobacterium bovis
SVATAMIPFLEHDDANRALM

SEQ ID NO: 223198 - protein, 29 aa, Mycobacterium bovis
SVDELVPRSLHWLRPITPTFRPSWPDHSR

SEQ ID NO: 223199 - protein, 20 aa, Mycobacterium bovis
SVDRLRWKGYLKPGSRDDAS

SEQ ID NO: 223200 - protein, 25 aa, Mycobacterium bovis
SVDVNIPIHIPITASFTDIVYSGLD

SEQ ID NO: 223201 - protein, 24 aa, Mycobacterium bovis
SVDYAEMLLHDLVLVDAGGAVLHA

SEQ ID NO: 223202 - protein, 26 aa, Mycobacterium bovis
SVEHFNWLEGLGFQFERSYFPGKAVI

SEQ ID NO: 223203 - protein, 26 aa, Mycobacterium bovis
SVERATRLRIPAERWVYPQAGTDAHD

SEQ ID NO: 223204 - protein, 23 aa, Mycobacterium bovis
SVFDHRAVVVGADRGRLMAGLAG

SEQ ID NO: 223205 - protein, 18 aa, Mycobacterium bovis
SVHMGFSDAGAHLRNMAF

SEQ ID NO: 223206 - protein, 19 aa, Mycobacterium bovis
SVHPSLWRQSQLTAKQGLY

SEQ ID NO: 223207 - protein, 24 aa, Mycobacterium bovis
SVHRFDLFVPVFRNHLVELSAEFP

SEQ ID NO: 223208 - protein, 24 aa, Mycobacterium bovis
SVHVLDRYILAKLAVLRDDLSESM

SEQ ID NO: 223209 - protein, 26 aa, Mycobacterium bovis
SVIFDRRAILKVFRRVSSGINPDIEL

SEQ ID NO: 223210 - protein, 18 aa, Mycobacterium bovis
SVITAVLRGFGETALRGS

SEQ ID NO: 223211 - protein, 23 aa, Mycobacterium bovis
SVLAALGRIDYWFVTDGRRVHKT

SEQ ID NO: 223212 - protein, 31 aa, Mycobacterium bovis
SVLPAKYLNRLSDLLFILSRVANPDGDVLWR

SEQ ID NO: 223213 - protein, 22 aa, Mycobacterium bovis
SVPAFSLPAITLPSLTIPAATT

SEQ ID NO: 223214 - protein, 20 aa, Mycobacterium bovis
SVPILGPYEDLIANTVANLA

SEQ ID NO: 223215 - protein, 24 aa, Mycobacterium bovis
SVPSIILGGIDWFRSMGSEKSPGF

SEQ ID NO: 223216 - protein, 17 aa, Mycobacterium bovis
SVPTRRGNWWYYARTFE

SEQ ID NO: 223217 - protein, 20 aa, Mycobacterium bovis
SVPVRLAELFIEAGLPAGVF

SEQ ID NO: 223218 - protein, 26 aa, Mycobacterium bovis
SVQWLEQHLASYPGAILAVTHDRYFL

SEQ ID NO: 223219 - protein, 17 aa, Mycobacterium bovis
SVRALGRPNPLAQWSSS

SEQ ID NO: 223220 - protein, 25 aa, Mycobacterium bovis
SVRNLPGVHILAPDQLNTYDVLRAD

SEQ ID NO: 223221 - protein, 17 aa, Mycobacterium bovis
SVRTIVRQLLPTGAATL

SEQ ID NO: 223222 - protein, 20 aa, Mycobacterium bovis
SVSGRRPTPGTAAYGAAKAG

SEQ ID NO: 223223 - protein, 24 aa, Mycobacterium bovis
SVSIHRDWLLIELRTDWTVATTRY

SEQ ID NO: 223224 - protein, 19 aa, Mycobacterium bovis
SVSSVLYPGLPSHPGHEIA

SEQ ID NO: 223225 - protein, 24 aa, Mycobacterium bovis
SVTGFGVHPVLLDAALHAVVLSAE

SEQ ID NO: 223226 - protein, 25 aa, Mycobacterium bovis
SVTSGLVVGWWQGSASAAMVDAAAS

SEQ ID NO: 223227 - protein, 27 aa, Mycobacterium bovis
SVTVFTQAPRRVVTGVPLWTTRAKRWL

SEQ ID NO: 223228 - protein, 26 aa, Mycobacterium bovis
SVYARVNPFGFIETPYRKVVDGVVSD

SEQ ID NO: 223229 - protein, 21 aa, Mycobacterium bovis
SVYLTRPSLFHFTRTGEEFSW

SEQ ID NO: 223230 - protein, 20 aa, Mycobacterium bovis
SWAETLWRMSVSIAGAVCTA

SEQ ID NO: 223231 - protein, 17 aa, Mycobacterium bovis
SWALLGRQDLRAAEDAL

SEQ ID NO: 223232 - protein, 19 aa, Mycobacterium bovis
SWLPNWPERCCRCTTRRWD

SEQ ID NO: 223233 - protein, 18 aa, Mycobacterium bovis
SWPRYFAALEQLVRPGGP

SEQ ID NO: 223234 - protein, 26 aa, Mycobacterium bovis
SWQRCRVHFMRNLYTAVAAKHAPAVT

SEQ ID NO: 223235 - protein, 18 aa, Mycobacterium bovis
SWRAARATLRLPADTAAR

SEQ ID NO: 223236 - protein, 18 aa, Mycobacterium bovis
SWTFRGIPVRRPGRFFAT

SEQ ID NO: 223237 - protein, 19 aa, Mycobacterium bovis
SWTTDVRSGLLFVWHDHEG

SEQ ID NO: 223238 - protein, 22 aa, Mycobacterium bovis
SWVRTHVLPKLPPPASQLWRSR

SEQ ID NO: 223239 - protein, 29 aa, Mycobacterium bovis
SYAGRMIDSYLPGCWLDSGPFGCLGSGPG

SEQ ID NO: 223240 - protein, 18 aa, Mycobacterium bovis
SYALYPHMTVRQNIAFPL

SEQ ID NO: 223241 - protein, 20 aa, Mycobacterium bovis
SYAYAVLRKAAQRAGDALPR

SEQ ID NO: 223242 - protein, 27 aa, Mycobacterium bovis
SYDPSRIDALLKGRRLTKPLIAAVEGP

SEQ ID NO: 223243 - protein, 34 aa, Mycobacterium bovis
SYGHTWIAPRDTNLALLPIGYADGVFRSLGGRLE

SEQ ID NO: 223244 - protein, 24 aa, Mycobacterium bovis
SYGTYFLCADPRPLGYDDSTEFCA

SEQ ID NO: 223245 - protein, 19 aa, Mycobacterium bovis
SYHVRLSALPYPGTGRDLG

SEQ ID NO: 223246 - protein, 21 aa, Mycobacterium bovis
SYLLVPLDQPGVQIRPIVQIT

SEQ ID NO: 223247 - protein, 26 aa, Mycobacterium bovis
SYPPEAIDWLLPAAARRVLDLGAGTG

SEQ ID NO: 223248 - protein, 26 aa, Mycobacterium bovis
SYPQKPPVGAALWKLMERARQVGLHV

SEQ ID NO: 223249 - protein, 20 aa, Mycobacterium bovis
SYSLQMRAVGQPLQDHLAAV

SEQ ID NO: 223250 - protein, 43 aa, Mycobacterium bovis
SYSNGFLVSGDYQGLIGLPLLGIPVTPGYFNLTGGPSSGFFNS

SEQ ID NO: 223251 - protein, 23 aa, Mycobacterium bovis
SYTFDRLVRVYPHIVRLRPAPHS

SEQ ID NO: 223252 - protein, 46 aa, Mycobacterium bovis
TAAATPGWLEWFINWYLPISQLFYNTVGLPYFAIGIGNSLITSWRA

SEQ ID NO: 223253 - protein, 26 aa, Mycobacterium bovis
TAALRRRLLQRFAIEPLAPVRDAEDA

SEQ ID NO: 223254 - protein, 17 aa, Mycobacterium bovis
TAAPLDRRLLLGMLAEL

SEQ ID NO: 223255 - protein, 21 aa, Mycobacterium bovis
TADDYLRFVRMLLGDGTVDGV

SEQ ID NO: 223256 - protein, 29 aa, Mycobacterium bovis
TAEALRGPLWRWYPGLRAGGKLMHNPHWP

SEQ ID NO: 223257 - protein, 19 aa, Mycobacterium bovis
TAELLRLALTGKRKPYIYT

SEQ ID NO: 223258 - protein, 28 aa, Mycobacterium bovis
TAESRAYKMWLPPLTNPVPLNELIARDR

SEQ ID NO: 223259 - protein, 19 aa, Mycobacterium bovis
TAEVTPHHLLLDDARLASY

SEQ ID NO: 223260 - protein, 18 aa, Mycobacterium bovis
TAFAAIVPPPLIAANRAR

SEQ ID NO: 223261 - protein, 25 aa, Mycobacterium bovis
TAFAESVPMWGPRGAALIQAIPEAT

SEQ ID NO: 223262 - protein, 32 aa, Mycobacterium bovis
TAFESSHRALYTFLLDRPLIAEAISVEATGLT

SEQ ID NO: 223263 - protein, 17 aa, Mycobacterium bovis
TAFRRRITRLSPARLHE

SEQ ID NO: 223264 - protein, 21 aa, Mycobacterium bovis
TAGDLLKRLAVSGAALLSTTL

SEQ ID NO: 223265 - protein, 26 aa, Mycobacterium bovis
TAGLDADYWYRNVRQTVLFDQAVRNA

SEQ ID NO: 223266 - protein, 19 aa, Mycobacterium bovis
TAGLLFGAGGAGGAGGFGF

SEQ ID NO: 223267 - protein, 26 aa, Mycobacterium bovis
TAGQATAAALWLVAPCTELYHDSRAD

SEQ ID NO: 223268 - protein, 27 aa, Mycobacterium bovis
TAGYLALLEAAFLIHRVPAWSTNLSRK

SEQ ID NO: 223269 - protein, 24 aa, Mycobacterium bovis
TAKEARIAFLMLPGVGTKDDIKEA

SEQ ID NO: 223270 - protein, 20 aa, Mycobacterium bovis
TAKILSPHKTVLIPDQRAGC

SEQ ID NO: 223271 - protein, 21 aa, Mycobacterium bovis
TALFRLLELVDEGAPPPAAVL

SEQ ID NO: 223272 - protein, 24 aa, Mycobacterium bovis
TALGEGWFINQHIVWQVGDEDVAE

SEQ ID NO: 223273 - protein, 25 aa, Mycobacterium bovis
TALGTDPWPWVLSGGEDHALVACFV

SEQ ID NO: 223274 - protein, 17 aa, Mycobacterium bovis
TALLAPDWVPWEQRVRP

SEQ ID NO: 223275 - protein, 17 aa, Mycobacterium bovis
TALLPAGADDVSAAIAA

SEQ ID NO: 223276 - protein, 21 aa, Mycobacterium bovis
TALPAWVYIDHRVMPGRPRPG

SEQ ID NO: 223277 - protein, 17 aa, Mycobacterium bovis
TALRMQISTGYTVVEAL

SEQ ID NO: 223278 - protein, 19 aa, Mycobacterium bovis
TALYLGAQAIRGGLADCVL

SEQ ID NO: 223279 - protein, 27 aa, Mycobacterium bovis
TAMTGAAAPYLGWLSAAAAQAQQAATQ

SEQ ID NO: 223280 - protein, 25 aa, Mycobacterium bovis
TAMVAKVGVFRPITRLSAERDYILE

SEQ ID NO: 223281 - protein, 18 aa, Mycobacterium bovis
TAMWFALVNPEMLAAAAT

SEQ ID NO: 223282 - protein, 29 aa, Mycobacterium bovis
TANAIAGILFLHSGLIALPPDLASGVVQP

SEQ ID NO: 223283 - protein, 22 aa, Mycobacterium bovis
TANEALYDWNYQRQLLSIRLAE

SEQ ID NO: 223284 - protein, 22 aa, Mycobacterium bovis
TANTHFGGHRYHWGASAAMIRG

SEQ ID NO: 223285 - protein, 27 aa, Mycobacterium bovis
TAPASLRDFYIAYRAVVRAKVECVRFS

SEQ ID NO: 223286 - protein, 20 aa, Mycobacterium bovis
TAPGHMLGGLPLGHSVNAGS

SEQ ID NO: 223287 - protein, 28 aa, Mycobacterium bovis
TAPGRAIPFGAFRHLISLPASGADIGRP

SEQ ID NO: 223288 - protein, 19 aa, Mycobacterium bovis
TAPVPIVRLLAVIGDRAAQ

SEQ ID NO: 223289 - protein, 21 aa, Mycobacterium bovis
TAQIRLMGMLGRPLPAQVAQL

SEQ ID NO: 223290 - protein, 21 aa, Mycobacterium bovis
TARAAWAWFRHLHRLADRTLA

SEQ ID NO: 223291 - protein, 25 aa, Mycobacterium bovis
TARATPFTMRTWARLLSEVGAPDQR

SEQ ID NO: 223292 - protein, 23 aa, Mycobacterium bovis
TAREALYQYTVRLLTAIASNPER

SEQ ID NO: 223293 - protein, 17 aa, Mycobacterium bovis
TARFMTRWQGEPDPRHI

SEQ ID NO: 223294 - protein, 24 aa, Mycobacterium bovis
TARPARAWLFTVARNMIIDERRSA

SEQ ID NO: 223295 - protein, 25 aa, Mycobacterium bovis
TASAREWWGLVWADRILQSDLAHQL

SEQ ID NO: 223296 - protein, 21 aa, Mycobacterium bovis
TASPYLGFGSLRPLLEVAAAH

SEQ ID NO: 223297 - protein, 21 aa, Mycobacterium bovis
TASRRRVEAALAGHLPMTDLT

SEQ ID NO: 223298 - protein, 22 aa, Mycobacterium bovis
TATGIDIFRIFDALNNIESMRP

SEQ ID NO: 223299 - protein, 19 aa, Mycobacterium bovis
TATIRMLLAAIQTEEVSGK

SEQ ID NO: 223300 - protein, 29 aa, Mycobacterium bovis
TATMEPITDSWYLTSIRAGLEPWSDGVGL

SEQ ID NO: 223301 - protein, 20 aa, Mycobacterium bovis
TATRAPFVLLTSNATRELSE

SEQ ID NO: 223302 - protein, 27 aa, Mycobacterium bovis
TATRSGDVWLLNGFKWFASNCAGEAFV

SEQ ID NO: 223303 - protein, 26 aa, Mycobacterium bovis
TATTPDGLLLWTQKRSIYARGEGGFG

SEQ ID NO: 223304 - protein, 23 aa, Mycobacterium bovis
TAVELMPVHQFLHDSRLLDLGLR

SEQ ID NO: 223305 - protein, 18 aa, Mycobacterium bovis
TAVIRRLQPDFLVTVTAA

SEQ ID NO: 223306 - protein, 19 aa, Mycobacterium bovis
TAVLPAMVARRRGDLIFVG

SEQ ID NO: 223307 - protein, 28 aa, Mycobacterium bovis
TAVQFHFIARLVLVLLDETFLPGGPRAQ

SEQ ID NO: 223308 - protein, 19 aa, Mycobacterium bovis
TAVRFIGRLPRKGPWQQKV

SEQ ID NO: 223309 - protein, 25 aa, Mycobacterium bovis
TAWRNGDWYVARLTPSPLGHEERRT

SEQ ID NO: 223310 - protein, 20 aa, Mycobacterium bovis
TAWTSTWRRWCIPANAATSS

SEQ ID NO: 223311 - protein, 19 aa, Mycobacterium bovis
TCDPIAGLVQIPCIERNAI

SEQ ID NO: 223312 - protein, 17 aa, Mycobacterium bovis
TCRDGRVVGFYALASGS

SEQ ID NO: 223313 - protein, 17 aa, Mycobacterium bovis
TCVPTSWRAARATLRLP

SEQ ID NO: 223314 - protein, 17 aa, Mycobacterium bovis
TCVRVGTALLGPRRLRS

SEQ ID NO: 223315 - protein, 19 aa, Mycobacterium bovis
TDAHRAILASLGTGGAYFF

SEQ ID NO: 223316 - protein, 20 aa, Mycobacterium bovis
TDAYVRLIAMKLVASRASDY

SEQ ID NO: 223317 - protein, 21 aa, Mycobacterium bovis
TDDGRLLARIYSESDLLVAEC

SEQ ID NO: 223318 - protein, 23 aa, Mycobacterium bovis
TDDLLIHGNRFRGALAVDAHMRR

SEQ ID NO: 223319 - protein, 23 aa, Mycobacterium bovis
TDEALLDIYRKLRPGEPPTKESA

SEQ ID NO: 223320 - protein, 20 aa, Mycobacterium bovis
TDELLARDWAPKVHGAWELH

SEQ ID NO: 223321 - protein, 23 aa, Mycobacterium bovis
TDEPEPHWGPFGGAAPVSAGVGH

SEQ ID NO: 223322 - protein, 26 aa, Mycobacterium bovis
TDEQKRFFLPRIAAGDLHFSIGYSEP

SEQ ID NO: 223323 - protein, 25 aa, Mycobacterium bovis
TDEVIDVVLLWWRDGDGDLVDTLMD

SEQ ID NO: 223324 - protein, 22 aa, Mycobacterium bovis
TDFGAFVSLLPGRDGLVHISKL

SEQ ID NO: 223325 - protein, 27 aa, Mycobacterium bovis
TDGRWSCVQWGLRKPPFCPDPAEAAAS

SEQ ID NO: 223326 - protein, 23 aa, Mycobacterium bovis
TDKDGIIMALLAAEILAVTGATP

SEQ ID NO: 223327 - protein, 18 aa, Mycobacterium bovis
TDKTIDLLIACHLAGCGY

SEQ ID NO: 223328 - protein, 21 aa, Mycobacterium bovis
TDLLRSPRPRWPPNAAGMQVE

SEQ ID NO: 223329 - protein, 17 aa, Mycobacterium bovis
TDLRWRIVTALATAGAI

SEQ ID NO: 223330 - protein, 19 aa, Mycobacterium bovis
TDLTFRLLRESFADAVSWV

SEQ ID NO: 223331 - protein, 22 aa, Mycobacterium bovis
TDNMFGFWDWVGGRYSVDSAIG

SEQ ID NO: 223332 - protein, 32 aa, Mycobacterium bovis
TDPAVNGALVHPLMIALISYAVGGPIRMIDAR

SEQ ID NO: 223333 - protein, 25 aa, Mycobacterium bovis
TDPGEQLYTLDYYLKLAEQIVDAGA

SEQ ID NO: 223334 - protein, 23 aa, Mycobacterium bovis
TDPGRFDVIVTDNLFGDIITDLA

SEQ ID NO: 223335 - protein, 24 aa, Mycobacterium bovis
TDPRLYRAYLLKESLRHVFSVKGE

SEQ ID NO: 223336 - protein, 21 aa, Mycobacterium bovis
TDPTLAVDWPLVDGAAPSLSD

SEQ ID NO: 223337 - protein, 17 aa, Mycobacterium bovis
TDRKALVARLYARRYLA

SEQ ID NO: 223338 - protein, 25 aa, Mycobacterium bovis
TDTERLLRDRLAQLRPGDPILGEEG

SEQ ID NO: 223339 - protein, 60 aa, Mycobacterium bovis
TDVGCSWLPLYHDMGLAFVLSAALAGAPLWLAPTTAFTASPFRWLSWLSDSGATMTAAPN

SEQ ID NO: 223340 - protein, 24 aa, Mycobacterium bovis
TDVIVHRGIALTSFYQCGDLYRID

SEQ ID NO: 223341 - protein, 31 aa, Mycobacterium bovis
TDVLSEEFLLQRPLLTAIRRTEPTVLLIDET

SEQ ID NO: 223342 - protein, 26 aa, Mycobacterium bovis
TDVPTGVVVPYFWSDQYDVKIQCLGE

SEQ ID NO: 223343 - protein, 19 aa, Mycobacterium bovis
TDWTATSAEFRKLLADWKA

SEQ ID NO: 223344 - protein, 19 aa, Mycobacterium bovis
TDYDTADRLYFEPLTFEDV

SEQ ID NO: 223345 - protein, 25 aa, Mycobacterium bovis
TDYRTLLEFFFQIHDPTTKDRQGND

SEQ ID NO: 223346 - protein, 17 aa, Mycobacterium bovis
TEAIAEMVELIEKMLAC

SEQ ID NO: 223347 - protein, 35 aa, Mycobacterium bovis
TEAMLHSDYPLQALLYVVVLHRFLRWRQRDYAPAR

SEQ ID NO: 223348 - protein, 36 aa, Mycobacterium bovis
TEASTVFPQTFYLSGLFFFGPVNLSASTLTVPTITL

SEQ ID NO: 223349 - protein, 17 aa, Mycobacterium bovis
TEAWLMQAPKQLVQAFL

SEQ ID NO: 223350 - protein, 27 aa, Mycobacterium bovis
TEDDPNWFRFHQMFADFLHRRLERGGS

SEQ ID NO: 223351 - protein, 24 aa, Mycobacterium bovis
TEFELLRFLMRNPRRALSRTEILD

SEQ ID NO: 223352 - protein, 34 aa, Mycobacterium bovis
TEGAYLGYHPSLPTPVNPWDPTAWAGVSSSGCGV

SEQ ID NO: 223353 - protein, 33 aa, Mycobacterium bovis
TEGRTALRFLPMEELIAAFLPVLFPGMEIVEHH

SEQ ID NO: 223354 - protein, 24 aa, Mycobacterium bovis
TEIIPLDGFLDGLALYDELDFAEL

SEQ ID NO: 223355 - protein, 24 aa, Mycobacterium bovis
TEKFLKDLLAAFADAPVVIGPTAP

SEQ ID NO: 223356 - protein, 19 aa, Mycobacterium bovis
TEKMYANILLRRVPRMLKQ

SEQ ID NO: 223357 - protein, 18 aa, Mycobacterium bovis
TELGTLQAYVAALGGHLR

SEQ ID NO: 223358 - protein, 26 aa, Mycobacterium bovis
TELPADSHLLLLWGAANRDPAQFEAP

SEQ ID NO: 223359 - protein, 23 aa, Mycobacterium bovis
TELTNRLFMLEWEPAPLEKTAEA

SEQ ID NO: 223360 - protein, 23 aa, Mycobacterium bovis
TEPKARALRPYAEKLITHAKKGA

SEQ ID NO: 223361 - protein, 20 aa, Mycobacterium bovis
TEPMLFEWTDRDTLLYAIGV

SEQ ID NO: 223362 - protein, 27 aa, Mycobacterium bovis
TEQQRAQWLRPLLDGKIRSAFSMTEPA

SEQ ID NO: 223363 - protein, 22 aa, Mycobacterium bovis
TERILFRRLAVFVGGFDLTAAS

SEQ ID NO: 223364 - protein, 17 aa, Mycobacterium bovis
TERRQAMLPGHAVVLHP

SEQ ID NO: 223365 - protein, 25 aa, Mycobacterium bovis
TERTDALIIGPLRVQFWVCGVFEVD

SEQ ID NO: 223366 - protein, 23 aa, Mycobacterium bovis
TETLEPVQMLPAPAQGALAVECR

SEQ ID NO: 223367 - protein, 23 aa, Mycobacterium bovis
TETLRAPMWLEHIRRRGWQAVAA

SEQ ID NO: 223368 - protein, 25 aa, Mycobacterium bovis
TEVKVPGVLTARIVPGATALDFQAK

SEQ ID NO: 223369 - protein, 29 aa, Mycobacterium bovis
TFADAFTADFFATWGKLAAVRTPTIAAVA

SEQ ID NO: 223370 - protein, 17 aa, Mycobacterium bovis
TFAKPYAEWRGMFAGNG

SEQ ID NO: 223371 - protein, 18 aa, Mycobacterium bovis
TFASYPHFFELKRTRTEP

SEQ ID NO: 223372 - protein, 18 aa, Mycobacterium bovis
TFAVYRRVSLPDGRYVFT

SEQ ID NO: 223373 - protein, 19 aa, Mycobacterium bovis
TFFMLVIKVAEYFCGGLTE

SEQ ID NO: 223374 - protein, 24 aa, Mycobacterium bovis
TFGPIGELWYRKSGTYRGKVQNLT

SEQ ID NO: 223375 - protein, 19 aa, Mycobacterium bovis
TFGRIGVKVWIYKGDIVGG

SEQ ID NO: 223376 - protein, 19 aa, Mycobacterium bovis
TFHAEFVSLLNGGAAAYTG

SEQ ID NO: 223377 - protein, 20 aa, Mycobacterium bovis
TFNDLLATMLWHGTLDSRLR

SEQ ID NO: 223378 - protein, 19 aa, Mycobacterium bovis
TFNLTLQGDVKRFRGFDNW

SEQ ID NO: 223379 - protein, 17 aa, Mycobacterium bovis
TFSWPPRMELPGYKPNT

SEQ ID NO: 223380 - protein, 22 aa, Mycobacterium bovis
TFTICSFWLVSALVEIGEVGRA

SEQ ID NO: 223381 - protein, 19 aa, Mycobacterium bovis
TGAAYLPIDPANPPPRVAF

SEQ ID NO: 223382 - protein, 23 aa, Mycobacterium bovis
TGAGVSGLWLLSGMRDDGVLTTI

SEQ ID NO: 223383 - protein, 21 aa, Mycobacterium bovis
TGAKEILCIRVLGGSSRRYAG

SEQ ID NO: 223384 - protein, 30 aa, Mycobacterium bovis
TGAPQFEIVDPRPLTLLPEPNPGDLFFDFE

SEQ ID NO: 223385 - protein, 24 aa, Mycobacterium bovis
TGAYAALPYLKKAPGSLMFSTSSS

SEQ ID NO: 223386 - protein, 25 aa, Mycobacterium bovis
TGCTPYMVLLAAFGALVHRYTHSDD

SEQ ID NO: 223387 - protein, 23 aa, Mycobacterium bovis
TGDGIGIVFRKGLPLEDMEFHQF

SEQ ID NO: 223388 - protein, 25 aa, Mycobacterium bovis
TGDLLRMPPYPLILTLRTLVGSAEV

SEQ ID NO: 223389 - protein, 21 aa, Mycobacterium bovis
TGDSFFHLAPLGQSGALAGLN

SEQ ID NO: 223390 - protein, 17 aa, Mycobacterium bovis
TGDYHGLVGFSFSIDIA

SEQ ID NO: 223391 - protein, 19 aa, Mycobacterium bovis
TGDYSNGLLWRGGYEGLVG

SEQ ID NO: 223392 - protein, 26 aa, Mycobacterium bovis
TGFDALYDVAGPQFLLSLIVSSAVCG

SEQ ID NO: 223393 - protein, 25 aa, Mycobacterium bovis
TGFLGRYLVLELLRRLDVDGRLICL

SEQ ID NO: 223394 - protein, 27 aa, Mycobacterium bovis
TGGMGAYAPLPWLPDNIYREVVSRIVE

SEQ ID NO: 223395 - protein, 26 aa, Mycobacterium bovis
TGGNGGAGGLFMNGGDGGAGGQGGDG

SEQ ID NO: 223396 - protein, 17 aa, Mycobacterium bovis
TGGNWLDALLRGLDHNR

SEQ ID NO: 223397 - protein, 21 aa, Mycobacterium bovis
TGGPPLPGQAGMGAAGGAGGL

SEQ ID NO: 223398 - protein, 24 aa, Mycobacterium bovis
TGGSEWICYFAHPQRVVCGGISIP

SEQ ID NO: 223399 - protein, 27 aa, Mycobacterium bovis
TGGSGGAGGLIGWAGAAGGTGAGGTGG

SEQ ID NO: 223400 - protein, 33 aa, Mycobacterium bovis
TGGTGGTAHLGPLAIIGQSGQPGQFGSPGADGR

SEQ ID NO: 223401 - protein, 29 aa, Mycobacterium bovis
TGGTKWEKLFRFLALDRLQSRLHRWRLNM

SEQ ID NO: 223402 - protein, 25 aa, Mycobacterium bovis
TGHYLGCVHLQRLLRDPPAELVGGV

SEQ ID NO: 223403 - protein, 26 aa, Mycobacterium bovis
TGIDDALAVIYLLASPDADLVGIAST

SEQ ID NO: 223404 - protein, 18 aa, Mycobacterium bovis
TGIDVALALLTPIVGQEF

SEQ ID NO: 223405 - protein, 18 aa, Mycobacterium bovis
TGILDPYLLDMIGSPKLW

SEQ ID NO: 223406 - protein, 24 aa, Mycobacterium bovis
TGKFRQQTLDRWLAGASATRPHHV

SEQ ID NO: 223407 - protein, 25 aa, Mycobacterium bovis
TGKSVFLKSLIGLLRPERGSIIIDG

SEQ ID NO: 223408 - protein, 18 aa, Mycobacterium bovis
TGLIYRALGFPTRMFTVL

SEQ ID NO: 223409 - protein, 23 aa, Mycobacterium bovis
TGLLDERALFLGQWGLRGQRGGE

SEQ ID NO: 223410 - protein, 20 aa, Mycobacterium bovis
TGLLGLVLPREIGGMGSGPV

SEQ ID NO: 223411 - protein, 24 aa, Mycobacterium bovis
TGLQTSRMLLWRAASALDDDDADK

SEQ ID NO: 223412 - protein, 18 aa, Mycobacterium bovis
TGLRMNSAYIRPGGVAQD

SEQ ID NO: 223413 - protein, 27 aa, Mycobacterium bovis
TGLSLSPTLIFDYPTPNRLASYIRTEL

SEQ ID NO: 223414 - protein, 18 aa, Mycobacterium bovis
TGLTCPYTTPLDVTADII

SEQ ID NO: 223415 - protein, 26 aa, Mycobacterium bovis
TGLTLPPTLIFDYPTAAELAEHLDIQ

SEQ ID NO: 223416 - protein, 25 aa, Mycobacterium bovis
TGLVPRRIPSLPDLDGIRVLRSFDE

SEQ ID NO: 223417 - protein, 17 aa, Mycobacterium bovis
TGMDLDWRAVVGEAQFV

SEQ ID NO: 223418 - protein, 26 aa, Mycobacterium bovis
TGMGKTFAFGVPLLQRITSGDGTRPL

SEQ ID NO: 223419 - protein, 18 aa, Mycobacterium bovis
TGMPAAPMVPPTGSPGGG

SEQ ID NO: 223420 - protein, 26 aa, Mycobacterium bovis
TGMQRVFFGWAQIWRTKSRAAEAIRR

SEQ ID NO: 223421 - protein, 23 aa, Mycobacterium bovis
TGNEKVWPFLELAVPAPRGHKVP

SEQ ID NO: 223422 - protein, 23 aa, Mycobacterium bovis
TGNPVTMPWRDSVNAIMQAWYPG

SEQ ID NO: 223423 - protein, 29 aa, Mycobacterium bovis
TGPEQVLFRRLAVFPSGFDLDGAQAAAAG

SEQ ID NO: 223424 - protein, 19 aa, Mycobacterium bovis
TGPIHIGGTRWAAVGDALG

SEQ ID NO: 223425 - protein, 17 aa, Mycobacterium bovis
TGPILRSTGLPHDLRKS

SEQ ID NO: 223426 - protein, 24 aa, Mycobacterium bovis
TGPTGVLPTLTPTSTRGASALSLS

SEQ ID NO: 223427 - protein, 37 aa, Mycobacterium bovis
TGPYSIIGLGAIPGGWWLTFGQILGLAQNAPGVAALL

SEQ ID NO: 223428 - protein, 26 aa, Mycobacterium bovis
TGQAGGPGGILYGNGGNGGSGAPGQR

SEQ ID NO: 223429 - protein, 24 aa, Mycobacterium bovis
TGQPFAASAPRIGAPRWDTVIVGL

SEQ ID NO: 223430 - protein, 17 aa, Mycobacterium bovis
TGQVRIPMLAGRRSLNL

SEQ ID NO: 223431 - protein, 44 aa, Mycobacterium bovis
TGRFDDEQLFYLRSRGIPEAQARRLVVRGFFGEIIAKIAVPEVR

SEQ ID NO: 223432 - protein, 19 aa, Mycobacterium bovis
TGSAIAQHWMYEGKHVLII

SEQ ID NO: 223433 - protein, 24 aa, Mycobacterium bovis
TGSPTYVADLAEALLALADAGVRG

SEQ ID NO: 223434 - protein, 25 aa, Mycobacterium bovis
TGSREFMLHPVMMDIALQTLGATRT

SEQ ID NO: 223435 - protein, 24 aa, Mycobacterium bovis
TGSVPQRLWAKPAITVIGIDTTSV

SEQ ID NO: 223436 - protein, 21 aa, Mycobacterium bovis
TGSWRLHVATAARDVDWWLTF

SEQ ID NO: 223437 - protein, 20 aa, Mycobacterium bovis
TGTMVLNLGLANHGTLNVGI

SEQ ID NO: 223438 - protein, 22 aa, Mycobacterium bovis
TGTNLWGAFGLLAEMVKQGRSG

SEQ ID NO: 223439 - protein, 30 aa, Mycobacterium bovis
TGTPHCAAVGRIAYLLGLRGPAVAVDTACS

SEQ ID NO: 223440 - protein, 26 aa, Mycobacterium bovis
TGVEIAEMFQLPPALQRAWHTHGYYG

SEQ ID NO: 223441 - protein, 32 aa, Mycobacterium bovis
TGVETPVWTFLGPRPAGWWVRRRLHEVAVHRA

SEQ ID NO: 223442 - protein, 23 aa, Mycobacterium bovis
TGVFWIQDRLTIGQLREILSAAT

SEQ ID NO: 223443 - protein, 23 aa, Mycobacterium bovis
TGVGLALVAQRRGYKCVFVCPDK

SEQ ID NO: 223444 - protein, 20 aa, Mycobacterium bovis
TGWFTGLVPITVPVASGLFD

SEQ ID NO: 223445 - protein, 24 aa, Mycobacterium bovis
TGYAHGELADRVNLAITALRDEVE

SEQ ID NO: 223446 - protein, 18 aa, Mycobacterium bovis
TGYALGAGLTLALAADWR

SEQ ID NO: 223447 - protein, 17 aa, Mycobacterium bovis
TGYLGPPPVPTSSPPTT

SEQ ID NO: 223448 - protein, 26 aa, Mycobacterium bovis
TGYLVLDQPWPSMLRGIWGDPARYWH

SEQ ID NO: 223449 - protein, 35 aa, Mycobacterium bovis
THAPPYNRRSKFPYRWWWVALTDEAFPRLSVIRAP

SEQ ID NO: 223450 - protein, 19 aa, Mycobacterium bovis
THEDLLATIRYVRDRTGDP

SEQ ID NO: 223451 - protein, 32 aa, Mycobacterium bovis
THFAGVLTVVLKLLQIVRPDRVFFGEKDYQQL

SEQ ID NO: 223452 - protein, 27 aa, Mycobacterium bovis
THGALRSAWIGYWVPSAATGGGVATGA

SEQ ID NO: 223453 - protein, 29 aa, Mycobacterium bovis
THGFVCAIRAWAYQIADLAGDYRVIAFDH

SEQ ID NO: 223454 - protein, 23 aa, Mycobacterium bovis
THGGQLCLPLYGALVTNCGLDRS

SEQ ID NO: 223455 - protein, 31 aa, Mycobacterium bovis
THITGSLKHRLARSLFLYALCNGWINENTTV

SEQ ID NO: 223456 - protein, 21 aa, Mycobacterium bovis
THLDPLRAAVLAHRADLGLAH

SEQ ID NO: 223457 - protein, 24 aa, Mycobacterium bovis
THNAWVEFPIFDAKSRSLKKAVLG

SEQ ID NO: 223458 - protein, 21 aa, Mycobacterium bovis
THPEAGHYGLATWFTRMDAMT

SEQ ID NO: 223459 - protein, 23 aa, Mycobacterium bovis
THPMLCALPIERAIDAAETLDAE

SEQ ID NO: 223460 - protein, 18 aa, Mycobacterium bovis
THQVIVVTHLPQVAAYAD

SEQ ID NO: 223461 - protein, 22 aa, Mycobacterium bovis
THSHRIPDFVKLAEALGCVGLR

SEQ ID NO: 223462 - protein, 24 aa, Mycobacterium bovis
THTEFPYVFCDATFCKVRVGAHVV

SEQ ID NO: 223463 - protein, 18 aa, Mycobacterium bovis
THVLGVKASVNDAALTIT

SEQ ID NO: 223464 - protein, 24 aa, Mycobacterium bovis
THYLRVYLAQLRRKLEDDPSHPKH

SEQ ID NO: 223465 - protein, 26 aa, Mycobacterium bovis
TIAHGFMTLALLPRLQHQMYTVKGVK

SEQ ID NO: 223466 - protein, 22 aa, Mycobacterium bovis
TIALGLLHRLTAMVAKVGVFRP

SEQ ID NO: 223467 - protein, 22 aa, Mycobacterium bovis
TIASGPSLARWARANGWSAPPG

SEQ ID NO: 223468 - protein, 24 aa, Mycobacterium bovis
TIDAARDWLLGTPADDWVSMAVVS

SEQ ID NO: 223469 - protein, 34 aa, Mycobacterium bovis
TIDEFEIPIKLRVSVCVIYIPFKGCVKHVSVTIP

SEQ ID NO: 223470 - protein, 25 aa, Mycobacterium bovis
TIDEPLVRRLWVLKVWGDVVDDRRG

SEQ ID NO: 223471 - protein, 19 aa, Mycobacterium bovis
TIDLVAKSVIWRLAEDLDA

SEQ ID NO: 223472 - protein, 26 aa, Mycobacterium bovis
TIDVAYRYFATPKRKFIIADTPGHIQ

SEQ ID NO: 223473 - protein, 24 aa, Mycobacterium bovis
TIEDHQNSRWIAEPLRLLDCCQET

SEQ ID NO: 223474 - protein, 24 aa, Mycobacterium bovis
TIEILPVIGLPEFRPGDDLSAAVA

SEQ ID NO: 223475 - protein, 21 aa, Mycobacterium bovis
TIGSFNALREDFTALREEMTE

SEQ ID NO: 223476 - protein, 19 aa, Mycobacterium bovis
TIKVLLALVALDELDLNST

SEQ ID NO: 223477 - protein, 25 aa, Mycobacterium bovis
TILLARGDLALRMGLPVLAVVAFAQ

SEQ ID NO: 223478 - protein, 20 aa, Mycobacterium bovis
TILPIVHAIVPFAEAPEAHR

SEQ ID NO: 223479 - protein, 25 aa, Mycobacterium bovis
TIMQPGMTFTIEPMINLGALDYEIW

SEQ ID NO: 223480 - protein, 19 aa, Mycobacterium bovis
TIPMRGGLDSGTLLERMRA

SEQ ID NO: 223481 - protein, 24 aa, Mycobacterium bovis
TIRDDLLVLLRRLHRRDNVGRIVV

SEQ ID NO: 223482 - protein, 19 aa, Mycobacterium bovis
TIRIPVHMVEVINKLGRIQ

SEQ ID NO: 223483 - protein, 29 aa, Mycobacterium bovis
TIRPAPDTMTWVTALLPVARGVSVYAALK

SEQ ID NO: 223484 - protein, 18 aa, Mycobacterium bovis
TIRPAPDTMTYLTALLPV

SEQ ID NO: 223485 - protein, 37 aa, Mycobacterium bovis
TISPIRALDPLAGSIGLFLEPFRLSDPFITIDAFQVV

SEQ ID NO: 223486 - protein, 27 aa, Mycobacterium bovis
TITEVYDYLRLLYARAGTPHCPTCGER

SEQ ID NO: 223487 - protein, 29 aa, Mycobacterium bovis
TITIPEIPYRYDLSVPIDIPITGTVVATT

SEQ ID NO: 223488 - protein, 29 aa, Mycobacterium bovis
TITISSAAKMFNCTGWKIGWACGPAELIA

SEQ ID NO: 223489 - protein, 17 aa, Mycobacterium bovis
TITLDEALKIYAEPKRR

SEQ ID NO: 223490 - protein, 25 aa, Mycobacterium bovis
TIVDLTVIGLGRYIPRIARVAAATE

SEQ ID NO: 223491 - protein, 18 aa, Mycobacterium bovis
TIVFCGVHFMAETAKILS

SEQ ID NO: 223492 - protein, 19 aa, Mycobacterium bovis
TIVHWPNGIAAKGEMRWQF

SEQ ID NO: 223493 - protein, 19 aa, Mycobacterium bovis
TIVSFLRYIDANRASWIVM

SEQ ID NO: 223494 - protein, 19 aa, Mycobacterium bovis
TIYDKFPTLTPDQAAGVIT

SEQ ID NO: 223495 - protein, 22 aa, Mycobacterium bovis
TKAKELGLTPLARIVSTGVSGL

SEQ ID NO: 223496 - protein, 17 aa, Mycobacterium bovis
TKALPPAIMAKDIPLSG

SEQ ID NO: 223497 - protein, 25 aa, Mycobacterium bovis
TKDIPVYRFVLRAYAAQLVQNHVNL

SEQ ID NO: 223498 - protein, 23 aa, Mycobacterium bovis
TKEYTAHWYGRTLHFGVREHAMG

SEQ ID NO: 223499 - protein, 22 aa, Mycobacterium bovis
TKGLPLPFGATLTFCSRADADK

SEQ ID NO: 223500 - protein, 20 aa, Mycobacterium bovis
TKILGLLTAAPKSYAATIRL

SEQ ID NO: 223501 - protein, 25 aa, Mycobacterium bovis
TKNLPSKLWTLLTKGTYPLTAARIS

SEQ ID NO: 223502 - protein, 28 aa, Mycobacterium bovis
TKRSLRLRRLAHKLEWPSNVWMGVSVEN

SEQ ID NO: 223503 - protein, 23 aa, Mycobacterium bovis
TKTLRFYENSGLLPPPARTASGY

SEQ ID NO: 223504 - protein, 22 aa, Mycobacterium bovis
TKYVYITYMPETLTGRLNFRLS

SEQ ID NO: 223505 - protein, 17 aa, Mycobacterium bovis
TLAAHPGTSLILLDTAS

SEQ ID NO: 223506 - protein, 23 aa, Mycobacterium bovis
TLAAYLTMQLLEAAGLPPGVINL

SEQ ID NO: 223507 - protein, 18 aa, Mycobacterium bovis
TLACLPGEYGPNLAVMAA

SEQ ID NO: 223508 - protein, 17 aa, Mycobacterium bovis
TLAFAFSHRSYLDGMLL

SEQ ID NO: 223509 - protein, 17 aa, Mycobacterium bovis
TLAMGHAMIRAGLRLKK

SEQ ID NO: 223510 - protein, 21 aa, Mycobacterium bovis
TLAMLQRLVADGALWPVNGTA

SEQ ID NO: 223511 - protein, 18 aa, Mycobacterium bovis
TLARMMSRRQFGQTLFEH

SEQ ID NO: 223512 - protein, 20 aa, Mycobacterium bovis
TLARRRGVRLVTFDAGVFTL

SEQ ID NO: 223513 - protein, 28 aa, Mycobacterium bovis
TLATITLQNYFRLYDKLAGMTGTAQTEA

SEQ ID NO: 223514 - protein, 20 aa, Mycobacterium bovis
TLATTRWLVAILENHQRPDG

SEQ ID NO: 223515 - protein, 28 aa, Mycobacterium bovis
TLDAIKAVSALDLGLPLAAGNVVSAEGT

SEQ ID NO: 223516 - protein, 20 aa, Mycobacterium bovis
TLDALAAELPLPVGLLKIDV

SEQ ID NO: 223517 - protein, 27 aa, Mycobacterium bovis
TLDDIGWPVIDVKLPALAPMVAAFGKM

SEQ ID NO: 223518 - protein, 25 aa, Mycobacterium bovis
TLDKLLDMALGACDTLFAAQRDALA

SEQ ID NO: 223519 - protein, 26 aa, Mycobacterium bovis
TLDKSDVLAGLFAVWHSLDALLDGLL

SEQ ID NO: 223520 - protein, 24 aa, Mycobacterium bovis
TLDRGYVKAVRRRWLREEHYRRMY

SEQ ID NO: 223521 - protein, 33 aa, Mycobacterium bovis; identical to SEQ ID NO: 117916

SEQ ID NO: 223522 - protein, 22 aa, Mycobacterium bovis
TLEGRWWRRDIGGVMVRFVVCR

SEQ ID NO: 223523 - protein, 30 aa, Mycobacterium bovis
TLERTGYSWGPLSLMLLATAIAQQGHIAES

SEQ ID NO: 223524 - protein, 20 aa, Mycobacterium bovis
TLFAAQRDALALPYPGVLPQ

SEQ ID NO: 223525 - protein, 18 aa, Mycobacterium bovis
TLFNPAAVPIRRYRYRGN

SEQ ID NO: 223526 - protein, 25 aa, Mycobacterium bovis
TLGDRPEARWRQAREWLGERGYDST

SEQ ID NO: 223527 - protein, 26 aa, Mycobacterium bovis
TLGTALARLGMFAPALSYLEEPDGPV

SEQ ID NO: 223528 - protein, 18 aa, Mycobacterium bovis
TLIGRAYLYGLMAGGEAG

SEQ ID NO: 223529 - protein, 33 aa, Mycobacterium bovis
TLKSVPHYGIGYGLLRYVYAPTGRVLGAQRTPD

SEQ ID NO: 223530 - protein, 19 aa, Mycobacterium bovis
TLLLLDEPSSGLDPLMENV

SEQ ID NO: 223531 - protein, 18 aa, Mycobacterium bovis
TLLLLEHPAVYTAGRRTE

SEQ ID NO: 223532 - protein, 22 aa, Mycobacterium bovis
TLLPELVQWLHVAALGAPLGNA

SEQ ID NO: 223533 - protein, 20 aa, Mycobacterium bovis
TLLSCLGGILRPKSGAIKFD

SEQ ID NO: 223534 - protein, 20 aa, Mycobacterium bovis
TLLSCLGGILRPKSGSIKFD

SEQ ID NO: 223535 - protein, 31 aa, Mycobacterium bovis
TLMSPTAFVRRPLRWIQALSEGSRTGRVVTA

SEQ ID NO: 223536 - protein, 20 aa, Mycobacterium bovis
TLNALQFVGGMLWSTALAEA

SEQ ID NO: 223537 - protein, 41 aa, Mycobacterium bovis
TLNELYMAAAHRPELQRLARLWPDGLLALLEPRIGRRAANA

SEQ ID NO: 223538 - protein, 18 aa, Mycobacterium bovis
TLPPGTALTPLGRDQARA

SEQ ID NO: 223539 - protein, 28 aa, Mycobacterium bovis
TLQVTIQVRIPFIGGKLERLIGTQLSQL

SEQ ID NO: 223540 - protein, 23 aa, Mycobacterium bovis
TLRELLTIAMRYFALTTMHVDIT

SEQ ID NO: 223541 - protein, 25 aa, Mycobacterium bovis
TLRNRAVLELLYSTGARISEAVGLD

SEQ ID NO: 223542 - protein, 30 aa, Mycobacterium bovis
TLSEKIDPYLRPLYDALYDMMDPELIPKLM

SEQ ID NO: 223543 - protein, 19 aa, Mycobacterium bovis
TLSFFRLALRLRRERNEFD

SEQ ID NO: 223544 - protein, 23 aa, Mycobacterium bovis
TLSGFGIHPLVLDAALHAMGMVG

SEQ ID NO: 223545 - protein, 22 aa, Mycobacterium bovis
TLSPTTWLPFGGGNRRCLGATF

SEQ ID NO: 223546 - protein, 24 aa, Mycobacterium bovis
TLSRTHPNLVRKLFSLEVPEIADG

SEQ ID NO: 223547 - protein, 25 aa, Mycobacterium bovis
TLTCQYHLWRYGLDGRLRGAPHMAA

SEQ ID NO: 223548 - protein, 22 aa, Mycobacterium bovis
TLTEFKLMNFLVQHAGRAFTRT

SEQ ID NO: 223549 - protein, 20 aa, Mycobacterium bovis
TLTERRLEFTRSLRRVFHDV

SEQ ID NO: 223550 - protein, 25 aa, Mycobacterium bovis
TLTPETPLAAVTRYFAAYNLVCGPV

SEQ ID NO: 223551 - protein, 23 aa, Mycobacterium bovis
TLTYQMMFELRDLGFSTAIGIGG

SEQ ID NO: 223552 - protein, 25 aa, Mycobacterium bovis
TLVENFLRLTFGFPAEPYQADPEVV

SEQ ID NO: 223553 - protein, 33 aa, Mycobacterium bovis
TLVERFLARPGLVYLLWPVALGYLRVVTHPTLL

SEQ ID NO: 223554 - protein, 24 aa, Mycobacterium bovis
TLVLGCTHYPLLSGLIQLAMGENV

SEQ ID NO: 223555 - protein, 24 aa, Mycobacterium bovis
TLVWRDAAQLPLALLTADMRDRQV

SEQ ID NO: 223556 - protein, 17 aa, Mycobacterium bovis
TLYQHFPSKSALVEEYL

SEQ ID NO: 223557 - protein, 27 aa, Mycobacterium bovis
TLYRDDLMIKPPRPLASTSIPAGGIDD

SEQ ID NO: 223558 - protein, 17 aa, Mycobacterium bovis
TMAAAVAPYVAWISVTA

SEQ ID NO: 223559 - protein, 28 aa, Mycobacterium bovis
TMDGALLRLGRPILPNTVFLAFGEVVIV

SEQ ID NO: 223560 - protein, 20 aa, Mycobacterium bovis
TMFDPSAVFYMNKIAVGPDA

SEQ ID NO: 223561 - protein, 17 aa, Mycobacterium bovis
TMPPQVLRLQGHEIHLA

SEQ ID NO: 223562 - protein, 23 aa, Mycobacterium bovis
TMVLNYYAPLRLIRGLAPGMLER

SEQ ID NO: 223563 - protein, 23 aa, Mycobacterium bovis
TMYDRVHWSLTHMSQAGLLDRPT

SEQ ID NO: 223564 - protein, 24 aa, Mycobacterium bovis
TNARMLIQFGFIERLAVAGDRRTY

SEQ ID NO: 223565 - protein, 23 aa, Mycobacterium bovis
TNATFLRDALHKAGIEAQFVARG

SEQ ID NO: 223566 - protein, 27 aa, Mycobacterium bovis
TNAVYGFTAMLINLLRDEAPTHIAAAF

SEQ ID NO: 223567 - protein, 18 aa, Mycobacterium bovis
TNEWLEGFEKQRAEWEAR

SEQ ID NO: 223568 - protein, 32 aa, Mycobacterium bovis
TNLLAWYQRSHRDLPWREPGVSPWQILVSEFM

SEQ ID NO: 223569 - protein, 24 aa, Mycobacterium bovis
TNNFAILAGDYRFATASQLASRLD

SEQ ID NO: 223570 - protein, 17 aa, Mycobacterium bovis
TNPTGAFQFLLYVVVVD

SEQ ID NO: 223571 - protein, 18 aa, Mycobacterium bovis
TNRALVLAALAAAQGRGA

SEQ ID NO: 223572 - protein, 25 aa, Mycobacterium bovis
TNRELLVNVLRHPAFLDGATDTGFF

SEQ ID NO: 223573 - protein, 20 aa, Mycobacterium bovis
TNVKLYGYKWPTLDGMFAPH

SEQ ID NO: 223574 - protein, 27 aa, Mycobacterium bovis
TPADAADALALAICHCWRAPTIARMAE

SEQ ID NO: 223575 - protein, 25 aa, Mycobacterium bovis
TPAERLTCSPWLNAEWRLVSDHIRA

SEQ ID NO: 223576 - protein, 26 aa, Mycobacterium bovis
TPAGSLWRLEFLLQSTQDPSLLVPAE

SEQ ID NO: 223577 - protein, 22 aa, Mycobacterium bovis
TPALATLGLGVVPLLELASAEQ

SEQ ID NO: 223578 - protein, 20 aa, Mycobacterium bovis
TPALFFAVGQGYRNFTQTSD

SEQ ID NO: 223579 - protein, 23 aa, Mycobacterium bovis
TPAMVHVDVYRLLDHNSADLLSE

SEQ ID NO: 223580 - protein, 25 aa, Mycobacterium bovis
TPATPGIDGALLFALSASSQDALRQ

SEQ ID NO: 223581 - protein, 26 aa, Mycobacterium bovis
TPAVGALLCLLAKLSGGKAVAEVGTG

SEQ ID NO: 223582 - protein, 24 aa, Mycobacterium bovis
TPDHLLLGVLTDPAALATALLQQQ

SEQ ID NO: 223583 - protein, 30 aa, Mycobacterium bovis
TPEGFYGKLLSTIRPYRPTLPAGAPHEVWW

SEQ ID NO: 223584 - protein, 20 aa, Mycobacterium bovis
TPEHPFPVWTERGGPATIVP

SEQ ID NO: 223585 - protein, 24 aa, Mycobacterium bovis
TPERLRSLERLECLVRRLPAVGHT

SEQ ID NO: 223586 - protein, 26 aa, Mycobacterium bovis
TPGKVPSWISDIANIFNIGAGNWASA

SEQ ID NO: 223587 - protein, 17 aa, Mycobacterium bovis
TPHHLLLDDARLASYDG

SEQ ID NO: 223588 - protein, 17 aa, Mycobacterium bovis
TPIILADGAHHTNATYY

SEQ ID NO: 223589 - protein, 18 aa, Mycobacterium bovis
TPITLFAQQTFVNQLPFP

SEQ ID NO: 223590 - protein, 25 aa, Mycobacterium bovis
TPKGCVFEYVYLARPDSTIAGRSVH

SEQ ID NO: 223591 - protein, 21 aa, Mycobacterium bovis
TPKGVLVHRLIRTGRSLFTAH

SEQ ID NO: 223592 - protein, 18 aa, Mycobacterium bovis
TPKVPYYSATLFDPREQP

SEQ ID NO: 223593 - protein, 17 aa, Mycobacterium bovis
TPLALFGTDRRLAELKD

SEQ ID NO: 223594 - protein, 17 aa, Mycobacterium bovis
TPLGLAHRLADAGVPIV

SEQ ID NO: 223595 - protein, 23 aa, Mycobacterium bovis
TPLHTQVFGPPHGYPIVLTHGFV

SEQ ID NO: 223596 - protein, 21 aa, Mycobacterium bovis
TPMTDWVPEDIFQTALGRAAE

SEQ ID NO: 223597 - protein, 23 aa, Mycobacterium bovis
TPNADPRFARLARGLIDELRYGR

SEQ ID NO: 223598 - protein, 19 aa, Mycobacterium bovis
TPPTVVMLAGLQGSGKTTL

SEQ ID NO: 223599 - protein, 24 aa, Mycobacterium bovis
TPQGFTTDLLLRSYQRGSLDLPAA

SEQ ID NO: 223600 - protein, 19 aa, Mycobacterium bovis
TPQTLINIRPVVAAIKEFF

SEQ ID NO: 223601 - protein, 35 aa, Mycobacterium bovis
TPRRYGVRWHYRLPVWSDFVEVHWSRWGEAYVTPV

SEQ ID NO: 223602 - protein, 26 aa, Mycobacterium bovis
TPTFGPLRIRFWACGIFEVQRARYGI

SEQ ID NO: 223603 - protein, 29 aa, Mycobacterium bovis
TPTFTGRSWPLADVRLLAPILASKVVCVG

SEQ ID NO: 223604 - protein, 25 aa, Mycobacterium bovis
TPTGYLGPPPVPTSSPPTTPAGAPA

SEQ ID NO: 223605 - protein, 29 aa, Mycobacterium bovis
TPTKWDNSFLEILYGYEWELTKSPAGAWQ

SEQ ID NO: 223606 - protein, 23 aa, Mycobacterium bovis
TPTLKGPLELLPNAVRPAVSATL

SEQ ID NO: 223607 - protein, 18 aa, Mycobacterium bovis
TPTPIPLTLNLDTTPWTL

SEQ ID NO: 223608 - protein, 22 aa, Mycobacterium bovis
TPVEMELIMGWLGQQRARHPDS

SEQ ID NO: 223609 - protein, 24 aa, Mycobacterium bovis
TPVPRPERQYYWFGEPIDTTEFMG

SEQ ID NO: 223610 - protein, 30 aa, Mycobacterium bovis
TPVVWRGPMLHRALQQFLADVYWGDLDVLL

SEQ ID NO: 223611 - protein, 20 aa, Mycobacterium bovis
TQAHLASVHPGLEYDRDAIL

SEQ ID NO: 223612 - protein, 19 aa, Mycobacterium bovis
TQALISGFGNHGARLSGIL

SEQ ID NO: 223613 - protein, 20 aa, Mycobacterium bovis
TQGWFTGQIPVTVPVAGLSF

SEQ ID NO: 223614 - protein, 17 aa, Mycobacterium bovis
TQHLLFKMRDRGRLPGL

SEQ ID NO: 223615 - protein, 22 aa, Mycobacterium bovis
TQIAISAWGLLSPQGRCAAFDA

SEQ ID NO: 223616 - protein, 20 aa, Mycobacterium bovis
TQKFMAIWRASKPVIAQVHG

SEQ ID NO: 223617 - protein, 20 aa, Mycobacterium bovis
TQLALPGGMQPLWGPDQRRV

SEQ ID NO: 223618 - protein, 25 aa, Mycobacterium bovis
TQLASWLQRLQSIPGAASLDARLPS

SEQ ID NO: 223619 - protein, 19 aa, Mycobacterium bovis
TQLLERLGFRRDQLSARVD

SEQ ID NO: 223620 - protein, 18 aa, Mycobacterium bovis
TQLRLQHALVLLAERHDV

SEQ ID NO: 223621 - protein, 27 aa, Mycobacterium bovis
TQPNGPSIRTILRALAIHRRPSANSKL

SEQ ID NO: 223622 - protein, 19 aa, Mycobacterium bovis
TQPWLADHQIHGAAALPGA

SEQ ID NO: 223623 - protein, 17 aa, Mycobacterium bovis
TQQLVESGWRPGDSVIL

SEQ ID NO: 223624 - protein, 24 aa, Mycobacterium bovis
TQRPAPQFEVMYLLAVCDAAAADQ

SEQ ID NO: 223625 - protein, 22 aa, Mycobacterium bovis
TQSATWMALFSGQTTVLAPEFN

SEQ ID NO: 223626 - protein, 25 aa, Mycobacterium bovis
TQSPYPGGGPIPEKYYRTLDPFVAL

SEQ ID NO: 223627 - protein, 25 aa, Mycobacterium bovis
TQVSLAGRFLVYVPGASSTGISRKL

SEQ ID NO: 223628 - protein, 26 aa, Mycobacterium bovis
TQVTLNLAMLTLLQKNIQGTIFGGGN

SEQ ID NO: 223629 - protein, 23 aa, Mycobacterium bovis
TRAEGVACYQLFISGLLDVTDNV

SEQ ID NO: 223630 - protein, 26 aa, Mycobacterium bovis
TRALRDWLLMRAWEAGVTPIGAQPVP

SEQ ID NO: 223631 - protein, 30 aa, Mycobacterium bovis
TRARISGMPVLFWLDPYRPHENELIKKVKT

SEQ ID NO: 223632 - protein, 23 aa, Mycobacterium bovis
TRATGWLGGVFPGDDAALTALAA

SEQ ID NO: 223633 - protein, 18 aa, Mycobacterium bovis
TRATIADLAWLRARDLDR

SEQ ID NO: 223634 - protein, 17 aa, Mycobacterium bovis
TRAVMFHLGKYIPQGVP

SEQ ID NO: 223635 - protein, 22 aa, Mycobacterium bovis
TRAWLRDPSPLFRTNVAGLRNV

SEQ ID NO: 223636 - protein, 24 aa, Mycobacterium bovis
TREDQALIYRLSGDRNPLHSDPWF

SEQ ID NO: 223637 - protein, 19 aa, Mycobacterium bovis
TREIILLHHTDCGMLTFTD

SEQ ID NO: 223638 - protein, 17 aa, Mycobacterium bovis
TREPDVELPFAAQPRVC

SEQ ID NO: 223639 - protein, 23 aa, Mycobacterium bovis
TRIEGTLAPRYVDLRPFAVNDGN

SEQ ID NO: 223640 - protein, 21 aa, Mycobacterium bovis
TRIKARVPEALAATLREFAPR

SEQ ID NO: 223641 - protein, 19 aa, Mycobacterium bovis
TRIYLGPGSGPILAAAQGW

SEQ ID NO: 223642 - protein, 19 aa, Mycobacterium bovis
TRLAALDLCPRVRVNAIAP

SEQ ID NO: 223643 - protein, 33 aa, Mycobacterium bovis
TRLFGVRLVKLLYRLERPLLFALQCMPLNWVRR

SEQ ID NO: 223644 - protein, 19 aa, Mycobacterium bovis
TRLRIQLEPVRPFVALRHI

SEQ ID NO: 223645 - protein, 24 aa, Mycobacterium bovis
TRLSAMFRTRRFRVYTTDDVVGVE

SEQ ID NO: 223646 - protein, 27 aa, Mycobacterium bovis
TRMLLDALRHRGSLRRFVPFDVDASVL

SEQ ID NO: 223647 - protein, 20 aa, Mycobacterium bovis
TRMRVALSALTMAEWFRDEQ

SEQ ID NO: 223648 - protein, 19 aa, Mycobacterium bovis
TRQRAAISTLLETLDDFRS

SEQ ID NO: 223649 - protein, 30 aa, Mycobacterium bovis
TRQVAERLLPALGFRVRFGVLVIRCALCTD

SEQ ID NO: 223650 - protein, 17 aa, Mycobacterium bovis
TRQVAVVQYPTLSTSTV

SEQ ID NO: 223651 - protein, 19 aa, Mycobacterium bovis
TRRAHAEAWLAQRLEHAIA

SEQ ID NO: 223652 - protein, 22 aa, Mycobacterium bovis
TRRLFAGGGFGGRRFDSGFGGG

SEQ ID NO: 223653 - protein, 24 aa, Mycobacterium bovis
TRRVTRLVLVVPFEGHKDIFNLRP

SEQ ID NO: 223654 - protein, 27 aa, Mycobacterium bovis
TRTAAPPRILWLDTAAPAKLILEVRAM

SEQ ID NO: 223655 - protein, 27 aa, Mycobacterium bovis
TRTAARNFYYGIRLLPREKRAALSAVY

SEQ ID NO: 223656 - protein, 20 aa, Mycobacterium bovis
TRTWVGHGVFAHNLVTISAL

SEQ ID NO: 223657 - protein, 39 aa, Mycobacterium bovis
TSAAPLQDLLGVVNAPAQALLGRPLIGNGANGADGTGAP

SEQ ID NO: 223658 - protein, 20 aa, Mycobacterium bovis
TSALLVAYLPARSREEMFGG

SEQ ID NO: 223659 - protein, 25 aa, Mycobacterium bovis
TSAPMCDIFLVLAQAPDGLSCFLLP

SEQ ID NO: 223660 - protein, 20 aa, Mycobacterium bovis
TSAPNVWALGDVASWRDPMG

SEQ ID NO: 223661 - protein, 27 aa, Mycobacterium bovis
TSDEALARVFDYTLAIGKTPIVVNDSR

SEQ ID NO: 223662 - protein, 29 aa, Mycobacterium bovis
TSDLVADLLPKDAWLNDLGTYRLDDLPRP

SEQ ID NO: 223663 - protein, 24 aa, Mycobacterium bovis
TSDQEVRWCPGCGDYVILNTIRNF

SEQ ID NO: 223664 - protein, 23 aa, Mycobacterium bovis
TSEIEPFIVWTSSGAIGPTWYSV

SEQ ID NO: 223665 - protein, 17 aa, Mycobacterium bovis
TSFLRGPSVLVARGDLA

SEQ ID NO: 223666 - protein, 27 aa, Mycobacterium bovis
TSGAGPVVIPLLDIPPAPGFGNSTTGP

SEQ ID NO: 223667 - protein, 24 aa, Mycobacterium bovis
TSGLANNLLAAAGAYLKADDGLAG

SEQ ID NO: 223668 - protein, 24 aa, Mycobacterium bovis
TSGQRALYELGMTGIPIVNVNNNC

SEQ ID NO: 223669 - protein, 21 aa, Mycobacterium bovis
TSLAHGPFPKADAAYLVDETV

SEQ ID NO: 223670 - protein, 21 aa, Mycobacterium bovis
TSLRALLKQYGPLTPARAVAI

SEQ ID NO: 223671 - protein, 22 aa, Mycobacterium bovis
TSMLHAMLIAGGRRAVLCGNIG

SEQ ID NO: 223672 - protein, 18 aa, Mycobacterium bovis
TSMLIVALQHCGLDPSFA

SEQ ID NO: 223673 - protein, 19 aa, Mycobacterium bovis
TSNPWTLRKILRANQIAFE

SEQ ID NO: 223674 - protein, 24 aa, Mycobacterium bovis
TSPPKGPNWAAMPTVRTPAGGGDA

SEQ ID NO: 223675 - protein, 24 aa, Mycobacterium bovis
TSPVQIRTLLARELPVYIISIGRT

SEQ ID NO: 223676 - protein, 30 aa, Mycobacterium bovis
TSRAKLNWWESRALYGWTVLVPRTKDQAGE

SEQ ID NO: 223677 - protein, 24 aa, Mycobacterium bovis
TSRAPRWAIAYKYPPEEAQTKLLD

SEQ ID NO: 223678 - protein, 24 aa, Mycobacterium bovis
TSSPPPGPVLYRTKHTRVEIADEM

SEQ ID NO: 223679 - protein, 24 aa, Mycobacterium bovis
TSTTWPKLTGVPMLGISVLGEAHD

SEQ ID NO: 223680 - protein, 22 aa, Mycobacterium bovis
TSVLTPTFRYNPAVIAQAFATM

SEQ ID NO: 223681 - protein, 23 aa, Mycobacterium bovis
TSYLDFTFAGLPAYQQGLGRKVR

SEQ ID NO: 223682 - protein, 18 aa, Mycobacterium bovis
TTAVMRPSKTFNAALEAV

SEQ ID NO: 223683 - protein, 38 aa, Mycobacterium bovis
TTDAGALFTVARRLLPDPLQIGPIRLLGVGFSGLSDIR

SEQ ID NO: 223684 - protein, 18 aa, Mycobacterium bovis
TTDFMKLTPDRFIHELLV

SEQ ID NO: 223685 - protein, 19 aa, Mycobacterium bovis
TTELRRQLKPLGRQAEAAQ

SEQ ID NO: 223686 - protein, 17 aa, Mycobacterium bovis
TTGGWITRKRKDGTTEW

SEQ ID NO: 223687 - protein, 23 aa, Mycobacterium bovis
TTGPWEPWLRALPVEFDSAEQVF

SEQ ID NO: 223688 - protein, 27 aa, Mycobacterium bovis
TTGQDLLLITVLKGAVLFVTDLARAIP

SEQ ID NO: 223689 - protein, 24 aa, Mycobacterium bovis
TTGRLIMQYASHNLIPVTLELGGK

SEQ ID NO: 223690 - protein, 27 aa, Mycobacterium bovis
TTGRRRRCGWFDAVIARYAARVNGITD

SEQ ID NO: 223691 - protein, 30 aa, Mycobacterium bovis
TTLGRVMFNELLPLGYPFVNKQMHKKVQAA

SEQ ID NO: 223692 - protein, 20 aa, Mycobacterium bovis
TTLLAIVQKLPTSMVVSRAR

SEQ ID NO: 223693 - protein, 19 aa, Mycobacterium bovis
TTLLSILRDDLNIDLTRVT

SEQ ID NO: 223694 - protein, 35 aa, Mycobacterium bovis
TTLLVTDLASGWIPPHIRLPAHITLLEPAPRRRHA

SEQ ID NO: 223695 - protein, 18 aa, Mycobacterium bovis
TTPLPPIRALVCNAGLQV

SEQ ID NO: 223696 - protein, 31 aa, Mycobacterium bovis
TTPNSFTIPGFQIRVLLGPAAVLVNEMIGPI

SEQ ID NO: 223697 - protein, 27 aa, Mycobacterium bovis
TTRLAAPLLPLITEIIWRGLTRERSVH

SEQ ID NO: 223698 - protein, 22 aa, Mycobacterium bovis
TTRYLINDAAVLAGKPYVWGSI

SEQ ID NO: 223699 - protein, 30 aa, Mycobacterium bovis
TTSEQLAHQIHWLLLRFGVGSTVRDYDPTQ

SEQ ID NO: 223700 - protein, 23 aa, Mycobacterium bovis
TTSKLCNVLFTYELDRRLDHGEQ

SEQ ID NO: 223701 - protein, 27 aa, Mycobacterium bovis
TTTATILAQALIKGGLRLVAAGVNPIA

SEQ ID NO: 223702 - protein, 23 aa, Mycobacterium bovis
TTTGVLRLYQFAAAGDLAFPAIN

SEQ ID NO: 223703 - protein, 24 aa, Mycobacterium bovis
TTTRRTIPTWVAMGPSDPLTGYVN

SEQ ID NO: 223704 - protein, 18 aa, Mycobacterium bovis
TTTYLVEAGLRAAGRVAG

SEQ ID NO: 223705 - protein, 24 aa, Mycobacterium bovis
TTVASARWPAARFAVRNVAVQGPN

SEQ ID NO: 223706 - protein, 24 aa, Mycobacterium bovis
TTVLLAQMFAAGVRRLVLASSMVV

SEQ ID NO: 223707 - protein, 22 aa, Mycobacterium bovis
TTWAPKSAGALAYRALARELID

SEQ ID NO: 223708 - protein, 24 aa, Mycobacterium bovis
TTYPLLLHEAYVRLYPAQVIKQAD

SEQ ID NO: 223709 - protein, 24 aa, Mycobacterium bovis
TVAAIRAMRDGRVSVFMGMGGNFA

SEQ ID NO: 223710 - protein, 24 aa, Mycobacterium bovis
TVADLLEPIPGQAGIIVPADDYLP

SEQ ID NO: 223711 - protein, 25 aa, Mycobacterium bovis
TVALPTFVGLIPMPGRSVALRWAQR

SEQ ID NO: 223712 - protein, 20 aa, Mycobacterium bovis
TVAQRRLPLLIASGADVHVI

SEQ ID NO: 223713 - protein, 23 aa, Mycobacterium bovis
TVARAFLRQALGVEVLSHVISIG

SEQ ID NO: 223714 - protein, 34 aa, Mycobacterium bovis
TVCDRYFCSVLGPTLPNRLYWLSATIDPDGQNGG

SEQ ID NO: 223715 - protein, 23 aa, Mycobacterium bovis
TVCKWGGFLDNPADFDCEFFGIG

SEQ ID NO: 223716 - protein, 26 aa, Mycobacterium bovis
TVDFYSNILGMPLIKALDLPGGQGQH

SEQ ID NO: 223717 - protein, 26 aa, Mycobacterium bovis
TVDYPPVNAIPSKAWFDLADAVTAAG

SEQ ID NO: 223718 - protein, 23 aa, Mycobacterium bovis
TVEALWGVGPKTTKRLAKLGINT

SEQ ID NO: 223719 - protein, 29 aa, Mycobacterium bovis
TVESLQRLRLPWWHLWRAAEAAGAATPKR

SEQ ID NO: 223720 - protein, 33 aa, Mycobacterium bovis
TVEVPVGGILAPLQPFQATAVIPVIGPVTVTLE

SEQ ID NO: 223721 - protein, 17 aa, Mycobacterium bovis
TVFLLCAPSVDPEDIAV

SEQ ID NO: 223722 - protein, 24 aa, Mycobacterium bovis
TVGFKFMSRIVPYPGTPLYQAYSD

SEQ ID NO: 223723 - protein, 18 aa, Mycobacterium bovis
TVGLGKPRREWPADTIRC

SEQ ID NO: 223724 - protein, 23 aa, Mycobacterium bovis
TVGTRLMALRRLAHPDDAQLGPP

SEQ ID NO: 223725 - protein, 19 aa, Mycobacterium bovis
TVHPALVAANRALVAWLAG

SEQ ID NO: 223726 - protein, 26 aa, Mycobacterium bovis
TVHPSGHILVRSCRGGYMHSVSLSEA

SEQ ID NO: 223727 - protein, 25 aa, Mycobacterium bovis
TVHPTTMRLLDELGLWERFAALPYS

SEQ ID NO: 223728 - protein, 18 aa, Mycobacterium bovis
TVHSYAYAVLRKAAQRAG

SEQ ID NO: 223729 - protein, 26 aa, Mycobacterium bovis
TVIVAPMFHAWGFSQLVLASSLACTI

SEQ ID NO: 223730 - protein, 28 aa, Mycobacterium bovis
TVKDLLPLLEKVIGAGKPLLIIAEDVEG

SEQ ID NO: 223731 - protein, 22 aa, Mycobacterium bovis
TVKRLGTLPNLTWSRLKVNVAV

SEQ ID NO: 223732 - protein, 18 aa, Mycobacterium bovis
TVLAPRREQLTGDEAHER

SEQ ID NO: 223733 - protein, 21 aa, Mycobacterium bovis
TVLGPLLFQSPEMGALPTLRA

SEQ ID NO: 223734 - protein, 27 aa, Mycobacterium bovis
TVLSRNTFHWVLAFADSGLLTSAVYNE

SEQ ID NO: 223735 - protein, 34 aa, Mycobacterium bovis
TVLTSPVGFLQRPARWIQLLARNGRTISAGPNFA

SEQ ID NO: 223736 - protein, 17 aa, Mycobacterium bovis
TVLYPRKGVSELTRFTP

SEQ ID NO: 223737 - protein, 18 aa, Mycobacterium bovis
TVMSNLGLHLAMRSAGVT

SEQ ID NO: 223738 - protein, 18 aa, Mycobacterium bovis
TVPGWRSRAERFDMAVLE

SEQ ID NO: 223739 - protein, 18 aa, Mycobacterium bovis
TVPTITLTIGGPTVTVPI

SEQ ID NO: 223740 - protein, 22 aa, Mycobacterium bovis
TVPVIGPLRAKENTRRVQRHLV

SEQ ID NO: 223741 - protein, 20 aa, Mycobacterium bovis
TVRPDFWELVDYATAHHVGV

SEQ ID NO: 223742 - protein, 19 aa, Mycobacterium bovis
TVRRDEFSRWLSAKPDYLV

SEQ ID NO: 223743 - protein, 26 aa, Mycobacterium bovis
TVSDEAVLAAARRLRIIPGIASRTRT

SEQ ID NO: 223744 - protein, 24 aa, Mycobacterium bovis
TVSGLFNMSLVAITTPALISGFFN

SEQ ID NO: 223745 - protein, 23 aa, Mycobacterium bovis
TVSLGDWQILLPRAVVGTAAEVI

SEQ ID NO: 223746 - protein, 28 aa, Mycobacterium bovis
TVTAGQPLIWLEAMKMEHTIAAPADGVL

SEQ ID NO: 223747 - protein, 27 aa, Mycobacterium bovis
TVTLEDALRLLSLPRVVGVDPASGEEI

SEQ ID NO: 223748 - protein, 20 aa, Mycobacterium bovis
TVTYPTDSPFRGVKKVHYWA

SEQ ID NO: 223749 - protein, 17 aa, Mycobacterium bovis
TVVAKLLTLFGTEEQRR

SEQ ID NO: 223750 - protein, 19 aa, Mycobacterium bovis
TVVFDRGGYTYGGRIAALA

SEQ ID NO: 223751 - protein, 23 aa, Mycobacterium bovis
TVVLQIPSLHDPSLAPAGKQAAS

SEQ ID NO: 223752 - protein, 24 aa, Mycobacterium bovis
TVVVAADWPLLAAAYRTRGALRIV

SEQ ID NO: 223753 - protein, 20 aa, Mycobacterium bovis
TVVWPDDAPLPPVGTRLRVI

SEQ ID NO: 223754 - protein, 20 aa, Mycobacterium bovis
TVWQTANLVRKEGFGAAVRS

SEQ ID NO: 223755 - protein, 17 aa, Mycobacterium bovis
TVYAPGDWSVFDALAKM

SEQ ID NO: 223756 - protein, 22 aa, Mycobacterium bovis
TVYHYYASKSLILFDIYRQAAE

SEQ ID NO: 223757 - protein, 18 aa, Mycobacterium bovis
TVYYRVFGGWLRQRRNIR

SEQ ID NO: 223758 - protein, 31 aa, Mycobacterium bovis
TWEDIGWLRELWGGPFMLKGVMRVDDAKRAV

SEQ ID NO: 223759 - protein, 22 aa, Mycobacterium bovis
TWILRRILRRLGYAAYGWGLGR

SEQ ID NO: 223760 - protein, 27 aa, Mycobacterium bovis
TWISTDYLFWRDDDGDYWLAGGRGSVV

SEQ ID NO: 223761 - protein, 17 aa, Mycobacterium bovis
TWLLVATGLSGVAQARG

SEQ ID NO: 223762 - protein, 18 aa, Mycobacterium bovis
TWMLQRAVGPQVARAALL

SEQ ID NO: 223763 - protein, 17 aa, Mycobacterium bovis
TWRVPPLSLTNDAIELF

SEQ ID NO: 223764 - protein, 17 aa, Mycobacterium bovis
TWSFLYRDIIVALRDRF

SEQ ID NO: 223765 - protein, 21 aa, Mycobacterium bovis
TYDFFGIIFDGHPALTRIEMP

SEQ ID NO: 223766 - protein, 31 aa, Mycobacterium bovis
TYDHPTFAVHDTLFYCVANMPASVPKTSTYA

SEQ ID NO: 223767 - protein, 28 aa, Mycobacterium bovis
TYEVTALNFMPGWLDMLLEVGGGRLSSL

SEQ ID NO: 223768 - protein, 17 aa, Mycobacterium bovis
TYFRLRPNAFAAGERER

SEQ ID NO: 223769 - protein, 18 aa, Mycobacterium bovis
TYHAFLHVAADEALAAAA

SEQ ID NO: 223770 - protein, 24 aa, Mycobacterium bovis
TYHEIADRLGYVVGLILAGANEPS

SEQ ID NO: 223771 - protein, 21 aa, Mycobacterium bovis
TYTRWGAFLDDATGFDAGFFG

SEQ ID NO: 223772 - protein, 17 aa, Mycobacterium bovis
TYVALTRAQSQVVAWWA

SEQ ID NO: 223773 - protein, 24 aa, Mycobacterium bovis
TYVPTMIEYYLHEKPLLANVETLR

SEQ ID NO: 223774 - protein, 26 aa, Mycobacterium bovis
VAAAAIGLVDLLLASGGDLVTVLIGA

SEQ ID NO: 223775 - protein, 33 aa, Mycobacterium bovis
VAADRFATMSPAERWHLLASAWLDLPGRPALIG

SEQ ID NO: 223776 - protein, 26 aa, Mycobacterium bovis
VAAEIARLALFLTTPAARHITGQTLH

SEQ ID NO: 223777 - protein, 20 aa, Mycobacterium bovis
VAAHTPYLAWLVQASANSAA

SEQ ID NO: 223778 - protein, 24 aa, Mycobacterium bovis
VAAKMALQYWRGRGLPGKRRLMTW

SEQ ID NO: 223779 - protein, 33 aa, Mycobacterium bovis
VAALAAHAPPERLLRCIEAVLACREALAVNVKP

SEQ ID NO: 223780 - protein, 17 aa, Mycobacterium bovis
VAALIRSGLLDVGVIQA

SEQ ID NO: 223781 - protein, 24 aa, Mycobacterium bovis
VAALRSIGITPDALILRCDRDVPE

SEQ ID NO: 223782 - protein, 27 aa, Mycobacterium bovis
VAAMHYPVWRQSWTGILDPYLLDMIGS

SEQ ID NO: 223783 - protein, 36 aa, Mycobacterium bovis
VAANREAFLALIRSNWLGLNAPWIAAVESLYEEYWA

SEQ ID NO: 223784 - protein, 36 aa, Mycobacterium bovis
VAAQRPAAIPLSFAQRRLWFLDQLQRPAPVYNMAVA

SEQ ID NO: 223785 - protein, 20 aa, Mycobacterium bovis
VAARLWPTTALIVDHGLQPG

SEQ ID NO: 223786 - protein, 17 aa, Mycobacterium bovis
VAARMWQVAAFIDLRVV

SEQ ID NO: 223787 - protein, 29 aa, Mycobacterium bovis
VAARPPAAVVLFSPLIDLTFRLGASRELQ

SEQ ID NO: 223788 - protein, 24 aa, Mycobacterium bovis
VAARYPDRFLPFAGADILAGDSAV

SEQ ID NO: 223789 - protein, 26 aa, Mycobacterium bovis
VAASIGAYLWVPDILECLASVMADAG

SEQ ID NO: 223790 - protein, 23 aa, Mycobacterium bovis
VACALGLQRAPLAPIRLRIGMHT

SEQ ID NO: 223791 - protein, 21 aa, Mycobacterium bovis
VADAREEAIRIATAAKREYEA

SEQ ID NO: 223792 - protein, 17 aa, Mycobacterium bovis
VADLPFGSYEAGPTAAL

SEQ ID NO: 223793 - protein, 24 aa, Mycobacterium bovis
VADMTYLQWLRRYVELAIGEGNST

SEQ ID NO: 223794 - protein, 25 aa, Mycobacterium bovis
VADNLPPQLITRMVDFGLAAGSRIT

SEQ ID NO: 223795 - protein, 23 aa, Mycobacterium bovis
VADRAAVAGLFAQLSREYPPVRG

SEQ ID NO: 223796 - protein, 23 aa, Mycobacterium bovis
VADVSRALRLTGRRVMLVPTMGA

SEQ ID NO: 223797 - protein, 24 aa, Mycobacterium bovis
VADWIKVVCFPDRWLDLRYVGPAS

SEQ ID NO: 223798 - protein, 25 aa, Mycobacterium bovis
VAEFEAVRLAMVQPALVAANRSGLI

SEQ ID NO: 223799 - protein, 40 aa, Mycobacterium bovis
VAEGDFLIYPKPKPIPHRTVLPLEFARLAGYYLAEGHACL

SEQ ID NO: 223800 - protein, 25 aa, Mycobacterium bovis
VAELLLLGMPYRDIGARLFISAKTV

SEQ ID NO: 223801 - protein, 23 aa, Mycobacterium bovis
VAEMNWRILKFKPAGSPSSVPDD

SEQ ID NO: 223802 - protein, 18 aa, Mycobacterium bovis
VAENLSIASLRREKDDVT

SEQ ID NO: 223803 - protein, 26 aa, Mycobacterium bovis
VAEQLAMFSLSQWQEAIYARIVDKVG

SEQ ID NO: 223804 - protein, 25 aa, Mycobacterium bovis
VAETLIEVALRFVKIRETAWRVTEL

SEQ ID NO: 223805 - protein, 20 aa, Mycobacterium bovis
VAFGTDLLFAASDLPGFVLH

SEQ ID NO: 223806 - protein, 27 aa, Mycobacterium bovis
VAFVGRIQPLKAPDIVLRAAAKLPGVR

SEQ ID NO: 223807 - protein, 27 aa, Mycobacterium bovis
VAGAAHFLEHLLFKSTPTRSAVDIAQA

SEQ ID NO: 223808 - protein, 25 aa, Mycobacterium bovis
VAGDDVFRAWWDLAGNRAGPPSMAR

SEQ ID NO: 223809 - protein, 19 aa, Mycobacterium bovis
VAGIRLALSLGFRVRVAAT

SEQ ID NO: 223810 - protein, 19 aa, Mycobacterium bovis
VAGPGFINMRLETAAQAKV

SEQ ID NO: 223811 - protein, 24 aa, Mycobacterium bovis
VAGRYRTVRIGAHQARILLAKNPA

SEQ ID NO: 223812 - protein, 27 aa, Mycobacterium bovis
VAHGWIPPGIALPEGVRLLAPARRAGR

SEQ ID NO: 223813 - protein, 20 aa, Mycobacterium bovis
VAHLARLARLALTETELDSF

SEQ ID NO: 223814 - protein, 18 aa, Mycobacterium bovis
VAHRVVVDYLSSITPLGE

SEQ ID NO: 223815 - protein, 20 aa, Mycobacterium bovis
VAHTGIGFRGWLAAAEGWGL

SEQ ID NO: 223816 - protein, 24 aa, Mycobacterium bovis
VAIARAFVNRPLVLLADEPTGNLD

SEQ ID NO: 223817 - protein, 18 aa, Mycobacterium bovis
VAIMLGLAYVLATESLAD

SEQ ID NO: 223818 - protein, 26 aa, Mycobacterium bovis
VAKMGEMGLFGLPFPEEYGGMGGDYF

SEQ ID NO: 223819 - protein, 21 aa, Mycobacterium bovis
VAKPDLLQLITTDSAPIITRA

SEQ ID NO: 223820 - protein, 26 aa, Mycobacterium bovis
VALATLLQHWGISPDFLIGHSVGEIA

SEQ ID NO: 223821 - protein, 27 aa, Mycobacterium bovis
VALDRGEFFLVYQPIIRLADNRIIGAE

SEQ ID NO: 223822 - protein, 17 aa, Mycobacterium bovis
VALFGCLRRVHISRLVM

SEQ ID NO: 223823 - protein, 25 aa, Mycobacterium bovis
VALGHQLAAVPYLESVVLAAGALAR

SEQ ID NO: 223824 - protein, 27 aa, Mycobacterium bovis
VALSRYSYLVSLLPSRIVADLGAPVRL

SEQ ID NO: 223825 - protein, 24 aa, Mycobacterium bovis
VALVNSWSAAFARYGRTVGQVLLT

SEQ ID NO: 223826 - protein, 24 aa, Mycobacterium bovis
VAMCGLFHGPRLRDMDARHGGSII

SEQ ID NO: 223827 - protein, 24 aa, Mycobacterium bovis
VAMDPQHRILLEVAWEALEHAGIP

SEQ ID NO: 223828 - protein, 26 aa, Mycobacterium bovis
VAMESRARRFPKGLAAFIGLRDQRCR

SEQ ID NO: 223829 - protein, 18 aa, Mycobacterium bovis
VAMFNQFCYLQLSGKRSR

SEQ ID NO: 223830 - protein, 19 aa, Mycobacterium bovis
VAMPLRLTSPAPCTNCHGS

SEQ ID NO: 223831 - protein, 26 aa, Mycobacterium bovis
VANTPQSYWLDQAFPPATVGGTVARY

SEQ ID NO: 223832 - protein, 26 aa, Mycobacterium bovis
VAPAIISLTLLPKLSPRAAARYYLTG

SEQ ID NO: 223833 - protein, 22 aa, Mycobacterium bovis
VAPVALAVLACPLAGPAGPAET

SEQ ID NO: 223834 - protein, 29 aa, Mycobacterium bovis
VAQLLLRVGIFSWITHAPKLGGHDSWRLH

SEQ ID NO: 223835 - protein, 22 aa, Mycobacterium bovis
VAQPLIVAATLLAHQELARRCV

SEQ ID NO: 223836 - protein, 24 aa, Mycobacterium bovis
VAQVRGLLDVKRWVTLTGVGGVGK

SEQ ID NO: 223837 - protein, 27 aa, Mycobacterium bovis
VARAGKLPVTLFTAGGIATPADAAMMM

SEQ ID NO: 223838 - protein, 19 aa, Mycobacterium bovis
VARAVRPPTPSRRLPKSLT

SEQ ID NO: 223839 - protein, 24 aa, Mycobacterium bovis
VARERDRMAFRSAAYWDILAKLDA

SEQ ID NO: 223840 - protein, 17 aa, Mycobacterium bovis
VARFDAHGALTNADEAI

SEQ ID NO: 223841 - protein, 21 aa, Mycobacterium bovis
VARGSFFPVIPVCSSTGVGTL

SEQ ID NO: 223842 - protein, 28 aa, Mycobacterium bovis
VARHVRSTILLAASAFGRLALDAVHLDI

SEQ ID NO: 223843 - protein, 20 aa, Mycobacterium bovis
VARIKFPTPAACGRTPLVAN

SEQ ID NO: 223844 - protein, 24 aa, Mycobacterium bovis
VARLVSRLPAPLRRGQIRPLGLDR

SEQ ID NO: 223845 - protein, 27 aa, Mycobacterium bovis
VARRRARVVVPFQPRLLMVGDAFSPRY

SEQ ID NO: 223846 - protein, 20 aa, Mycobacterium bovis
VASAATRWVWVSDAATLDTD

SEQ ID NO: 223847 - protein, 19 aa, Mycobacterium bovis
VASAFGGGNAFGGRGGDGG

SEQ ID NO: 223848 - protein, 25 aa, Mycobacterium bovis
VASCQQRCPPRQFERARVVVFAGDH

SEQ ID NO: 223849 - protein, 26 aa, Mycobacterium bovis
VASDLMLAKLRHGLPGAVFVSARTGD

SEQ ID NO: 223850 - protein, 42 aa, Mycobacterium bovis
VASHKLLIRAGYIRPVAPGLYSWLPLGLRVLRNIERVIRDEM

SEQ ID NO: 223851 - protein, 29 aa, Mycobacterium bovis
VASQLTPWQQLLSVLPPVVTAAPAGAVGV

SEQ ID NO: 223852 - protein, 20 aa, Mycobacterium bovis
VASRALTVLWQREARYLNED

SEQ ID NO: 223853 - protein, 24 aa, Mycobacterium bovis
VATADAMILHRNTIQYRVIQAMEL

SEQ ID NO: 223854 - protein, 20 aa, Mycobacterium bovis
VATALAWTHLGMTPPVGASQ

SEQ ID NO: 223855 - protein, 19 aa, Mycobacterium bovis
VATLRRFTERFAPFNLSET

SEQ ID NO: 223856 - protein, 25 aa, Mycobacterium bovis
VATVAATWRRLELSVPLVVDPVCAS

SEQ ID NO: 223857 - protein, 26 aa, Mycobacterium bovis
VATVRRFIERFAPYNLSPTAIRPSYG

SEQ ID NO: 223858 - protein, 17 aa, Mycobacterium bovis
VAVAVLRRLAPRARITG

SEQ ID NO: 223859 - protein, 23 aa, Mycobacterium bovis
VAVHAGFPLLVSPVAGVAGQGSS

SEQ ID NO: 223860 - protein, 18 aa, Mycobacterium bovis
VAVHDLTLAVLPGMIERK

SEQ ID NO: 223861 - protein, 23 aa, Mycobacterium bovis
VAVLARLDLGSVLIPMPAAGQVQ

SEQ ID NO: 223862 - protein, 23 aa, Mycobacterium bovis
VAVLDYVIPGLADAIRRSGLPKV

SEQ ID NO: 223863 - protein, 24 aa, Mycobacterium bovis
VAVLLRITEVFGVDATFFASQDDT

SEQ ID NO: 223864 - protein, 31 aa, Mycobacterium bovis
VAVLSQRPRMLYDYFHQLFAQVTNPPLDAIR

SEQ ID NO: 223865 - protein, 26 aa, Mycobacterium bovis
VAVMPLYHGHGLIASLLATLASGGAV

SEQ ID NO: 223866 - protein, 19 aa, Mycobacterium bovis
VAWWAPTFDEVNGGLSRLL

SEQ ID NO: 223867 - protein, 30 aa, Mycobacterium bovis
VCAEWTRRGWLAVRYNLPYRRRRPTGPPSG

SEQ ID NO: 223868 - protein, 20 aa, Mycobacterium bovis
VCARALSLPSLPCEVAVNEP

SEQ ID NO: 223869 - protein, 21 aa, Mycobacterium bovis
VCDLGRQIGYLLASQEPALAE

SEQ ID NO: 223870 - protein, 23 aa, Mycobacterium bovis
VCTRLIRSALPDATLRLVVDPRK

SEQ ID NO: 223871 - protein, 17 aa, Mycobacterium bovis
VCVLLDAPQLVDAPLRA

SEQ ID NO: 223872 - protein, 29 aa, Mycobacterium bovis
VDAADWAEMLMRMYIRWAEQHKYPVEVFD

SEQ ID NO: 223873 - protein, 26 aa, Mycobacterium bovis
VDAIRRGAQAILPTPAPLGGALVEEI

SEQ ID NO: 223874 - protein, 19 aa, Mycobacterium bovis
VDALLPAAHGPNPVLPPGC

SEQ ID NO: 223875 - protein, 21 aa, Mycobacterium bovis
VDALRKTGLLGLVLPREIGGM

SEQ ID NO: 223876 - protein, 31 aa, Mycobacterium bovis; identical to SEQ ID NO: 122924

SEQ ID NO: 223877 - protein, 19 aa, Mycobacterium bovis
VDAPLPAWSHRFLFYDREG

SEQ ID NO: 223878 - protein, 24 aa, Mycobacterium bovis
VDAQFYWMSAKVPNDQFLLYAFDG

SEQ ID NO: 223879 - protein, 37 aa, Mycobacterium bovis
VDASDLSNILLLGPVGDLFPILSIPGAMSQNFTNVVM

SEQ ID NO: 223880 - protein, 24 aa, Mycobacterium bovis
VDASLRLLVRGGRFLEMGKTDIRD

SEQ ID NO: 223881 - protein, 20 aa, Mycobacterium bovis
VDAVVFLLRTLNAADVALLK

SEQ ID NO: 223882 - protein, 22 aa, Mycobacterium bovis
VDCRFCHVTVTVKRLGPGHTAV

SEQ ID NO: 223883 - protein, 27 aa, Mycobacterium bovis
VDDALYQMELVGHDFFLFYDKDTERPS

SEQ ID NO: 223884 - protein, 26 aa, Mycobacterium bovis
VDDPDGTWGLQRLADLLAARTRYFDA

SEQ ID NO: 223885 - protein, 18 aa, Mycobacterium bovis
VDELNVIAVRYLPDERTS

SEQ ID NO: 223886 - protein, 22 aa, Mycobacterium bovis
VDEVHGFRFFDNRDLLGFVDGT

SEQ ID NO: 223887 - protein, 24 aa, Mycobacterium bovis
VDFDPIYCWPKPVTKPYPPLYVGG

SEQ ID NO: 223888 - protein, 28 aa, Mycobacterium bovis
VDGKPIAVTDFWTFPRSCNPTGGLMSTA

SEQ ID NO: 223889 - protein, 25 aa, Mycobacterium bovis
VDGMEAVLPVLWSDGHALLTDQLPD

SEQ ID NO: 223890 - protein, 23 aa, Mycobacterium bovis
VDGRFQWIVFTSTNAVRAVWEKF

SEQ ID NO: 223891 - protein, 27 aa, Mycobacterium bovis
VDIAFTWDHFFPLYGDPDGPHFECWTV

SEQ ID NO: 223892 - protein, 17 aa, Mycobacterium bovis
VDIPLQAYFRINTENMG

SEQ ID NO: 223893 - protein, 18 aa, Mycobacterium bovis
VDKVIGWAFERDRIPLGA

SEQ ID NO: 223894 - protein, 24 aa, Mycobacterium bovis
VDLDLPRDALIVFTGLSGSGKSSL

SEQ ID NO: 223895 - protein, 21 aa, Mycobacterium bovis
VDLYSCFPSAVQVAAIELGLD

SEQ ID NO: 223896 - protein, 29 aa, Mycobacterium bovis
VDNKLAEFEEFLNGTLRSVGRGRHQLRTA

SEQ ID NO: 223897 - protein, 33 aa, Mycobacterium bovis
VDPADMPPPFRSLTPIPVHWVAAAVLDGVARRR

SEQ ID NO: 223898 - protein, 22 aa, Mycobacterium bovis
VDPALLLNCMLLAATERSVTGD

SEQ ID NO: 223899 - protein, 20 aa, Mycobacterium bovis
VDPDALVHTIWMASNRSDRV

SEQ ID NO: 223900 - protein, 17 aa, Mycobacterium bovis
VDQGLIRKSGAWFTYEG

SEQ ID NO: 223901 - protein, 26 aa, Mycobacterium bovis
VDQPAFFEKQLALSAPPWLSRATVAH

SEQ ID NO: 223902 - protein, 18 aa, Mycobacterium bovis
VDQRFVFHKPVLAGDKLW

SEQ ID NO: 223903 - protein, 24 aa, Mycobacterium bovis
VDRGGQLRWYGLDGVEHTGGPLVD

SEQ ID NO: 223904 - protein, 29 aa, Mycobacterium bovis
VDRLLDPGSPFLELAPLAAGGMYSDESPG

SEQ ID NO: 223905 - protein, 23 aa, Mycobacterium bovis
VDRTVVVPLLPAQDFKRVGEDDT

SEQ ID NO: 223906 - protein, 17 aa, Mycobacterium bovis
VDRVDHDWVRIDNLLLH

SEQ ID NO: 223907 - protein, 27 aa, Mycobacterium bovis
VDTRRWAGVPFYLRTGKRLGRRVTEIA

SEQ ID NO: 223908 - protein, 28 aa, Mycobacterium bovis
VDVDNLPQLPWWLRPFARFHADDHFADP

SEQ ID NO: 223909 - protein, 24 aa, Mycobacterium bovis
VDVPALDAVLFLNPRNSIVDVVQS

SEQ ID NO: 223910 - protein, 20 aa, Mycobacterium bovis
VDVRCEAEWRFVGVPDLSSL

SEQ ID NO: 223911 - protein, 26 aa, Mycobacterium bovis
VDVTLRPAQYLPWHPGRCAQVFVGES

SEQ ID NO: 223912 - protein, 24 aa, Mycobacterium bovis
VEALIGVFDKIGVKTGIDFFDIAD

SEQ ID NO: 223913 - protein, 17 aa, Mycobacterium bovis
VEASLRSLARVAPTQRH

SEQ ID NO: 223914 - protein, 19 aa, Mycobacterium bovis
VEASRFATPLFTPATKAAL

SEQ ID NO: 223915 - protein, 25 aa, Mycobacterium bovis
VEDFDRVIAINLRGAWLCTKHAAPR

SEQ ID NO: 223916 - protein, 17 aa, Mycobacterium bovis
VEDTEGGIIWRVSAAWQ

SEQ ID NO: 223917 - protein, 35 aa, Mycobacterium bovis
VEDWKCWARWRLIRARAPWLTRALVAEDFEFYGRT

SEQ ID NO: 223918 - protein, 17 aa, Mycobacterium bovis
VEEAPAPFLTDFQRKEI

SEQ ID NO: 223919 - protein, 26 aa, Mycobacterium bovis
VEEFERRFFPIYPASTKVQSWDIFKC

SEQ ID NO: 223920 - protein, 26 aa, Mycobacterium bovis
VEEPPEHLIFIFATTEPEKVLPTIRS

SEQ ID NO: 223921 - protein, 18 aa, Mycobacterium bovis
VEFGIKRGRKTVSIVGST

SEQ ID NO: 223922 - protein, 24 aa, Mycobacterium bovis
VEFMMLDRLFPRSVFHSLKLAEHN

SEQ ID NO: 223923 - protein, 22 aa, Mycobacterium bovis
VEGALVTLDWLGAHGFGRLLQH

SEQ ID NO: 223924 - protein, 26 aa, Mycobacterium bovis
VEGAVVWNAPLRFKREGAGHFNRGTQ

SEQ ID NO: 223925 - protein, 22 aa, Mycobacterium bovis
VEGDLWVRGPAIAKGYWNRPDS

SEQ ID NO: 223926 - protein, 23 aa, Mycobacterium bovis
VEGDTVIAAVDPGWRRGATQGHS

SEQ ID NO: 223927 - protein, 25 aa, Mycobacterium bovis
VEGEILKKALTLSPTGFEDLVIRLL

SEQ ID NO: 223928 - protein, 33 aa, Mycobacterium bovis
VEGFRPATLHQAYLALRAWGLPVSEHTTLATDL

SEQ ID NO: 223929 - protein, 19 aa, Mycobacterium bovis
VEHEGAHVTWLPTAADGSV

SEQ ID NO: 223930 - protein, 25 aa, Mycobacterium bovis
VEHGFRGLSLRPFMIGRPASDPAYF

SEQ ID NO: 223931 - protein, 28 aa, Mycobacterium bovis
VEHVLATQTLPLRPFKTMAVNVDGRLPD

SEQ ID NO: 223932 - protein, 26 aa, Mycobacterium bovis
VEIATPGSWRREPLSGIPAATNTVIV

SEQ ID NO: 223933 - protein, 24 aa, Mycobacterium bovis
VEICPWALREGLILRKLDSEADGT

SEQ ID NO: 223934 - protein, 24 aa, Mycobacterium bovis
VEIEFLVTMIVVCSQGPNGPLIEF

SEQ ID NO: 223935 - protein, 18 aa, Mycobacterium bovis
VEKIKVFDAFPLTHYVEC

SEQ ID NO: 223936 - protein, 24 aa, Mycobacterium bovis
VELGDLHWFYVYSGVMWACVFMRT

SEQ ID NO: 223937 - protein, 28 aa, Mycobacterium bovis
VELGPVALALLKRGLPGDTALVTGPEAE

SEQ ID NO: 223938 - protein, 38 aa, Mycobacterium bovis
VELPFLHKELYREYSLRPPKGVLLYGPPGCGKTLIAKA

SEQ ID NO: 223939 - protein, 18 aa, Mycobacterium bovis
VELPGTDTLYWVGDTGPM

SEQ ID NO: 223940 - protein, 26 aa, Mycobacterium bovis
VELSKELRPWVPVVSLVKGLEQGTNM

SEQ ID NO: 223941 - protein, 26 aa, Mycobacterium bovis
VELSKLYLLPGYHGTGAAAALMHKVL

SEQ ID NO: 223942 - protein, 20 aa, Mycobacterium bovis
VELTGMGVTWMLRPSAENVT

SEQ ID NO: 223943 - protein, 18 aa, Mycobacterium bovis
VEMFRKLLDQGQAGDNVG

SEQ ID NO: 223944 - protein, 17 aa, Mycobacterium bovis
VEPLRPGPPPTVWSRRW

SEQ ID NO: 223945 - protein, 18 aa, Mycobacterium bovis
VERATAERLPLLASPSSG

SEQ ID NO: 223946 - protein, 17 aa, Mycobacterium bovis
VERLIAAHLMDPAPQPS

SEQ ID NO: 223947 - protein, 24 aa, Mycobacterium bovis
VERRHVPANQWLFHAGEPADSIYI

SEQ ID NO: 223948 - protein, 23 aa, Mycobacterium bovis
VERRQLLELYGAQIIFSAAEGGS

SEQ ID NO: 223949 - protein, 25 aa, Mycobacterium bovis
VERRYRAWIRWNAAIMVHRAQRPGV

SEQ ID NO: 223950 - protein, 18 aa, Mycobacterium bovis
VERTGATLVPPFDDLRTI

SEQ ID NO: 223951 - protein, 22 aa, Mycobacterium bovis
VETDSFRLRLLDGLVASIGERG

SEQ ID NO: 223952 - protein, 24 aa, Mycobacterium bovis
VETFIRHFELGAADRWLALATLEC

SEQ ID NO: 223953 - protein, 17 aa, Mycobacterium bovis
VETGFLEHLWNAPTKDI

SEQ ID NO: 223954 - protein, 23 aa, Mycobacterium bovis
VETMIGLFINTVPLRVRLDARAT

SEQ ID NO: 223955 - protein, 24 aa, Mycobacterium bovis
VETYSVLTRLPPPHRIAPVAVHAY

SEQ ID NO: 223956 - protein, 27 aa, Mycobacterium bovis
VEVALPSRPVQVIGFTSVPGAGDNFLV

SEQ ID NO: 223957 - protein, 36 aa, Mycobacterium bovis
VEVGKLADLVLWEPAFFGVRPHVVLKGGAIAWAAMG

SEQ ID NO: 223958 - protein, 18 aa, Mycobacterium bovis
VEVGWRDPFRLAVGPFPC

SEQ ID NO: 223959 - protein, 26 aa, Mycobacterium bovis
VEVIRAFVHRLPSWVDLKTLEKAERD

SEQ ID NO: 223960 - protein, 19 aa, Mycobacterium bovis
VEVRGPWIAGSYYGGRDES

SEQ ID NO: 223961 - protein, 22 aa, Mycobacterium bovis
VEYLVDAVFNYPTFSEAYKNAA

SEQ ID NO: 223962 - protein, 17 aa, Mycobacterium bovis
VFAIEAILRMGDDEQRK

SEQ ID NO: 223963 - protein, 21 aa, Mycobacterium bovis
VFANFKPGTLTSLGFSYDVLH

SEQ ID NO: 223964 - protein, 17 aa, Mycobacterium bovis
VFANYSAGLKTSRDAWC

SEQ ID NO: 223965 - protein, 36 aa, Mycobacterium bovis
VFDGPIVDRPLYRFPVFGFFALSIGAAALGNARAAI

SEQ ID NO: 223966 - protein, 17 aa, Mycobacterium bovis
VFDHPFLHVVATPAQHL

SEQ ID NO: 223967 - protein, 25 aa, Mycobacterium bovis
VFEAAKAAIVPPAAVAANREAFLAL

SEQ ID NO: 223968 - protein, 17 aa, Mycobacterium bovis
VFEHRAVVVGASREQLI

SEQ ID NO: 223969 - protein, 20 aa, Mycobacterium bovis
VFERLRPHLADHGRLYLVGL

SEQ ID NO: 223970 - protein, 18 aa, Mycobacterium bovis
VFIEFRLIARLGSEVVEW

SEQ ID NO: 223971 - protein, 26 aa, Mycobacterium bovis
VFIMGDCDQLMPEYLRFVKGVVDAQD

SEQ ID NO: 223972 - protein, 18 aa, Mycobacterium bovis
VFMVLRDPAADMSLTVTC

SEQ ID NO: 223973 - protein, 17 aa, Mycobacterium bovis
VFPLSNWTEFDIWSYIG

SEQ ID NO: 223974 - protein, 24 aa, Mycobacterium bovis
VFQDPFTFNILRNPNPHVGFGGTG

SEQ ID NO: 223975 - protein, 25 aa, Mycobacterium bovis
VFVACRLRPLTLDDVDFTLAVLGGN

SEQ ID NO: 223976 - protein, 18 aa, Mycobacterium bovis
VFVALSWTKHPPPQTYDE

SEQ ID NO: 223977 - protein, 27 aa, Mycobacterium bovis
VGAITPWNFPHQINLAKLGPALAAGNT

SEQ ID NO: 223978 - protein, 26 aa, Mycobacterium bovis
VGARQRLMCRLPKRPDPHAWLGDAFH

SEQ ID NO: 223979 - protein, 25 aa, Mycobacterium bovis
VGCALIEELVLAAPLVMHPGVGVQV

SEQ ID NO: 223980 - protein, 26 aa, Mycobacterium bovis
VGCGFITWSLARQPQLLDLALQYEPV

SEQ ID NO: 223981 - protein, 25 aa, Mycobacterium bovis
VGDALALQYFHAAPWVAWSDAGQRG

SEQ ID NO: 223982 - protein, 19 aa, Mycobacterium bovis
VGEIWLRGTTVVRGYLGDP

SEQ ID NO: 223983 - protein, 19 aa, Mycobacterium bovis
VGETAEFLRWTAGQAPDAS

SEQ ID NO: 223984 - protein, 23 aa, Mycobacterium bovis
VGFELIAPTLMAEAARLGLAICH

SEQ ID NO: 223985 - protein, 17 aa, Mycobacterium bovis
VGFGANGDPGFAGGKGG

SEQ ID NO: 223986 - protein, 20 aa, Mycobacterium bovis
VGFVGVPLFHIAGIGNMLTG

SEQ ID NO: 223987 - protein, 25 aa, Mycobacterium bovis
VGGAGGAGWLVGNGGAGGFGGVGTT

SEQ ID NO: 223988 - protein, 24 aa, Mycobacterium bovis
VGGDGVAFLGTAPGGPGGAGGAGG

SEQ ID NO: 223989 - protein, 24 aa, Mycobacterium bovis
VGGERILFTHIAVPVMTRLKQPER

SEQ ID NO: 223990 - protein, 17 aa, Mycobacterium bovis
VGGIWQGPSSVAMAAAA

SEQ ID NO: 223991 - protein, 30 aa, Mycobacterium bovis
VGGLLARFPGFYIPFLDVPFNGATPANSPY

SEQ ID NO: 223992 - protein, 26 aa, Mycobacterium bovis
VGGMGGLGFVVARWLAEQGAGLIVLN

SEQ ID NO: 223993 - protein, 27 aa, Mycobacterium bovis
VGGPGGGHGLLGLGGSHGAGGAGGSGG

SEQ ID NO: 223994 - protein, 17 aa, Mycobacterium bovis
VGGWAAVQIGRRLARLA

SEQ ID NO: 223995 - protein, 28 aa, Mycobacterium bovis
VGHHCALPLHRRFGLAATARASFAVYNT

SEQ ID NO: 223996 - protein, 21 aa, Mycobacterium bovis
VGIDFFTRWAAGNIKATDVDD

SEQ ID NO: 223997 - protein, 17 aa, Mycobacterium bovis
VGIHSLAWARLAPVVAL

SEQ ID NO: 223998 - protein, 17 aa, Mycobacterium bovis
VGIYHLIRQAAAQARKR

SEQ ID NO: 223999 - protein, 26 aa, Mycobacterium bovis
VGKGTLFRRFGSRAGLMMVLLDEDER

SEQ ID NO: 224000 - protein, 26 aa, Mycobacterium bovis
VGKLSVPPVWSGPLPGSVTPGAAPLP

SEQ ID NO: 224001 - protein, 20 aa, Mycobacterium bovis
VGKVVLTMPDAWAAGTVLIT

SEQ ID NO: 224002 - protein, 25 aa, Mycobacterium bovis
VGLDAFTLLPDGFTLDTVPATFDGT

SEQ ID NO: 224003 - protein, 20 aa, Mycobacterium bovis
VGLDARYLRAAVRPEWPVLV

SEQ ID NO: 224004 - protein, 17 aa, Mycobacterium bovis
VGLERLYAENPSARDQI

SEQ ID NO: 224005 - protein, 21 aa, Mycobacterium bovis
VGLGCDLAHAHKLVYSTGVVL

SEQ ID NO: 224006 - protein, 19 aa, Mycobacterium bovis
VGLGMPGVGLPVSAAKPGG

SEQ ID NO: 224007 - protein, 26 aa, Mycobacterium bovis
VGLGPFTVPPISIPSLPIASITGSVD

SEQ ID NO: 224008 - protein, 18 aa, Mycobacterium bovis
VGLGSVRYLLAVGDLLIG

SEQ ID NO: 224009 - protein, 18 aa, Mycobacterium bovis
VGLGYWRNPQQTEATFRA

SEQ ID NO: 224010 - protein, 17 aa, Mycobacterium bovis
VGLLFPSADGCAGHSDG

SEQ ID NO: 224011 - protein, 19 aa, Mycobacterium bovis
VGLLNVQYALKDDVLYVLE

SEQ ID NO: 224012 - protein, 21 aa, Mycobacterium bovis
VGLMGIPPLDWDPDEAFDRLQ

SEQ ID NO: 224013 - protein, 24 aa, Mycobacterium bovis
VGLTERRLLNYLISQLRLSEPERV

SEQ ID NO: 224014 - protein, 27 aa, Mycobacterium bovis
VGMGAQLYAELPLFALAFDAVAEELDR

SEQ ID NO: 224015 - protein, 25 aa, Mycobacterium bovis
VGMGRALIGPLRIGLQRAGVPVELN

SEQ ID NO: 224016 - protein, 18 aa, Mycobacterium bovis
VGQMLGGWRGASGSAYGS

SEQ ID NO: 224017 - protein, 18 aa, Mycobacterium bovis
VGQPVLIPGTMGTASYVL

SEQ ID NO: 224018 - protein, 25 aa, Mycobacterium bovis
VGRIVVHLAPWLEPQPICWAIDHVR

SEQ ID NO: 224019 - protein, 17 aa, Mycobacterium bovis
VGRLMSYKLDRSRPLWE

SEQ ID NO: 224020 - protein, 28 aa, Mycobacterium bovis
VGSGPVFLQYPWQVIPDEIIKPLQDAAR

SEQ ID NO: 224021 - protein, 18 aa, Mycobacterium bovis
VGSGRLIAGLDDAVVGLS

SEQ ID NO: 224022 - protein, 33 aa, Mycobacterium bovis
VGTLLVRGPYGRRFPFSLVFARIYAARGYHVVL

SEQ ID NO: 224023 - protein, 26 aa, Mycobacterium bovis
VGTRLGMCGVEYFGHPWEFGPRKTKE

SEQ ID NO: 224024 - protein, 30 aa, Mycobacterium bovis
VGTVFAARPARLSARRFWVRYAAEATGALT

SEQ ID NO: 224025 - protein, 26 aa, Mycobacterium bovis
VGTWHGRSPRLWLVTGGGLSVADDEP

SEQ ID NO: 224026 - protein, 17 aa, Mycobacterium bovis
VGYPIKWRDYSKLAIDR

SEQ ID NO: 224027 - protein, 28 aa, Mycobacterium bovis
VGYYKGAMQLTHPAFLILDSPDGKNHGT

SEQ ID NO: 224028 - protein, 18 aa, Mycobacterium bovis
VHAALRQVLGPNAVQAGS

SEQ ID NO: 224029 - protein, 17 aa, Mycobacterium bovis
VHAPGEHPMFKAMAAGL

SEQ ID NO: 224030 - protein, 19 aa, Mycobacterium bovis
VHDHMAIADVARVVAPFGE

SEQ ID NO: 224031 - protein, 17 aa, Mycobacterium bovis
VHEILCQIPTLTAPYRA

SEQ ID NO: 224032 - protein, 23 aa, Mycobacterium bovis
VHGFPQNWWEWRDLIGPLAADGN

SEQ ID NO: 224033 - protein, 18 aa, Mycobacterium bovis
VHLITCLAEPDPSWWDRL

SEQ ID NO: 224034 - protein, 17 aa, Mycobacterium bovis
VHLPYDRPPLSKEVLRS

SEQ ID NO: 224035 - protein, 20 aa, Mycobacterium bovis
VHNSQPWRWVAESGSEHTTV

SEQ ID NO: 224036 - protein, 18 aa, Mycobacterium bovis
VHRCRLPFCDVTVGLVRG

SEQ ID NO: 224037 - protein, 27 aa, Mycobacterium bovis
VHRDLAWTYHYPLPAVAPIAGLVAFYN

SEQ ID NO: 224038 - protein, 19 aa, Mycobacterium bovis
VHRMGPQQAHRLLEQSFAQ

SEQ ID NO: 224039 - protein, 25 aa, Mycobacterium bovis
VHRRSWRVPVTAFWQAHRDAAAVYS

SEQ ID NO: 224040 - protein, 25 aa, Mycobacterium bovis
VHRVPSRMFPKVTTLPLGVPTFRML

SEQ ID NO: 224041 - protein, 25 aa, Mycobacterium bovis
VHSTTLYYPLVATPMIAPTKAYDGL

SEQ ID NO: 224042 - protein, 21 aa, Mycobacterium bovis
VHTLPMLYALRESGPDCARLR

SEQ ID NO: 224043 - protein, 20 aa, Mycobacterium bovis
VHVPQWRFVAEPGSGELNPG

SEQ ID NO: 224044 - protein, 22 aa, Mycobacterium bovis
VHVTELVAYLRRLCAVDVHCMG

SEQ ID NO: 224045 - protein, 18 aa, Mycobacterium bovis
VIAALRAGNLVLMVQPPR

SEQ ID NO: 224046 - protein, 18 aa, Mycobacterium bovis
VICVDLRRTFVPSKGFGL

SEQ ID NO: 224047 - protein, 24 aa, Mycobacterium bovis
VIDDVCIAVQRWGKLSPARDNVVV

SEQ ID NO: 224048 - protein, 26 aa, Mycobacterium bovis
VIDELREKFAPLRILTGIEVDILEDG

SEQ ID NO: 224049 - protein, 19 aa, Mycobacterium bovis
VIDPIVPQLGKGGGRLPIT

SEQ ID NO: 224050 - protein, 28 aa, Mycobacterium bovis
VIDPVNNVEFFFLRPKDIAIYVGSGELD

SEQ ID NO: 224051 - protein, 26 aa, Mycobacterium bovis
VIDQLPANTWLTDVGKYPLRGLHRQE

SEQ ID NO: 224052 - protein, 22 aa, Mycobacterium bovis
VIDRTALILDIFAQHATSREGK

SEQ ID NO: 224053 - protein, 19 aa, Mycobacterium bovis
VIEFCLGIPHLLKGEYTEG

SEQ ID NO: 224054 - protein, 42 aa, Mycobacterium bovis
VIELRPDVDWDKGKTLLWVLDHLPHSGSAPLVPIYLGDDITD

SEQ ID NO: 224055 - protein, 21 aa, Mycobacterium bovis
VIEPLPNLVFTRDSSIWIGPR

SEQ ID NO: 224056 - protein, 30 aa, Mycobacterium bovis
VIGTKELIAWLPTLLGLGGADLVVVPELAY

SEQ ID NO: 224057 - protein, 17 aa, Mycobacterium bovis
VIGVNLTGTWRTLRATV

SEQ ID NO: 224058 - protein, 20 aa, Mycobacterium bovis
VIHSHPVWATMFAVAHEPIP

SEQ ID NO: 224059 - protein, 19 aa, Mycobacterium bovis
VIIDQLRVIRGKRLALQDV

SEQ ID NO: 224060 - protein, 18 aa, Mycobacterium bovis
VIKVVREIVSGLGLKEAK

SEQ ID NO: 224061 - protein, 18 aa, Mycobacterium bovis
VIMLGRPTLHRPVSVLLA

SEQ ID NO: 224062 - protein, 25 aa, Mycobacterium bovis
VINPFDFFIEDWAEIWPCAGMAYPK

SEQ ID NO: 224063 - protein, 18 aa, Mycobacterium bovis
VIPGQTGMRELPFGVHVT

SEQ ID NO: 224064 - protein, 19 aa, Mycobacterium bovis
VIPPELRPMVQLDGGRFAT

SEQ ID NO: 224065 - protein, 19 aa, Mycobacterium bovis
VISARRVLRDLWFDGHRIR

SEQ ID NO: 224066 - protein, 17 aa, Mycobacterium bovis
VISLVRDPEAAARYAAN

SEQ ID NO: 224067 - protein, 40 aa, Mycobacterium bovis
VISTIFGMVQFQKFFNPVTPFNPDLIPKSALGAGLGLRSA

SEQ ID NO: 224068 - protein, 28 aa, Mycobacterium bovis
VITGAVIIDYWGIIKADIGIRDGRIVGI

SEQ ID NO: 224069 - protein, 18 aa, Mycobacterium bovis
VITRWVQLPLAEGSRFAM

SEQ ID NO: 224070 - protein, 25 aa, Mycobacterium bovis
VIVAEFNFMLIGAAFYHDQYRRTTD

SEQ ID NO: 224071 - protein, 24 aa, Mycobacterium bovis
VIWAFKQLWDKGLAYEGYRVLPYC

SEQ ID NO: 224072 - protein, 28 aa, Mycobacterium bovis
VIYEHPSMAPALRKTLGVPLFQEQLMQL

SEQ ID NO: 224073 - protein, 26 aa, Mycobacterium bovis
VKALDDVGFFTLLQPQQWGGLQCDPA

SEQ ID NO: 224074 - protein, 18 aa, Mycobacterium bovis
VKDCARRLLRHYTMLSLT

SEQ ID NO: 224075 - protein, 20 aa, Mycobacterium bovis
VKDIFFLVCDGLKGLPDSVS

SEQ ID NO: 224076 - protein, 24 aa, Mycobacterium bovis
VKDQRRLRKLAELGWIVIRVIAED

SEQ ID NO: 224077 - protein, 22 aa, Mycobacterium bovis
VKDVFVPRHRFLSYKAMNDHTA

SEQ ID NO: 224078 - protein, 25 aa, Mycobacterium bovis
VKEVQTYVPGYRLLNEPQFDEPSIN

SEQ ID NO: 224079 - protein, 30 aa, Mycobacterium bovis
VKGNPDYGLRLSWNFLARSTAGLWEWAERL

SEQ ID NO: 224080 - protein, 22 aa, Mycobacterium bovis
VKGRVLPMCPVALQIEADVSGL

SEQ ID NO: 224081 - protein, 18 aa, Mycobacterium bovis
VKHDVTIAAPLNLPATMP

SEQ ID NO: 224082 - protein, 19 aa, Mycobacterium bovis
VKIPVQGGPIGGIAISRDG

SEQ ID NO: 224083 - protein, 18 aa, Mycobacterium bovis
VKIYNRKALDPAQVVDAL

SEQ ID NO: 224084 - protein, 24 aa, Mycobacterium bovis
VKLKLEETFMFYLPRICEHCLNPS

SEQ ID NO: 224085 - protein, 19 aa, Mycobacterium bovis
VKLPNRWPLTDAAGVPVVF

SEQ ID NO: 224086 - protein, 22 aa, Mycobacterium bovis
VKNYVSRLLAKLGMERRTQAAV

SEQ ID NO: 224087 - protein, 30 aa, Mycobacterium bovis
VKRRAFADQPYWGRPVPGWGSKRPRLLILG

SEQ ID NO: 224088 - protein, 22 aa, Mycobacterium bovis
VKSLARPVADTVWPTPFLAHQA

SEQ ID NO: 224089 - protein, 26 aa, Mycobacterium bovis
VKTPAQVLLRWNLQLGNAVVVRSARP

SEQ ID NO: 224090 - protein, 34 aa, Mycobacterium bovis
VKVKPTSVPAFRPGAQFKAVVSGAQRLPAEGPAV

SEQ ID NO: 224091 - protein, 18 aa, Mycobacterium bovis
VKVPYMPTDLPAWYDVAM

SEQ ID NO: 224092 - protein, 19 aa, Mycobacterium bovis
VLAALLLNRISLAPGEAIF

SEQ ID NO: 224093 - protein, 25 aa, Mycobacterium bovis
VLAARPVGVPAIVVPPVAAPNVLAG

SEQ ID NO: 224094 - protein, 24 aa, Mycobacterium bovis
VLAGYPLVNLKVTLLDGAYHEVDS

SEQ ID NO: 224095 - protein, 17 aa, Mycobacterium bovis
VLAIYNPASVTRTWQVG

SEQ ID NO: 224096 - protein, 20 aa, Mycobacterium bovis
VLAMCAGALRYYLIERNALP

SEQ ID NO: 224097 - protein, 17 aa, Mycobacterium bovis
VLAMDPASWRIVLGELD

SEQ ID NO: 224098 - protein, 17 aa, Mycobacterium bovis
VLAQARVGSYLRYGAYP

SEQ ID NO: 224099 - protein, 23 aa, Mycobacterium bovis
VLAQRCFELLTPALTRYYPDGSQ

SEQ ID NO: 224100 - protein, 23 aa, Mycobacterium bovis
VLARELLPERALMGDASAIVALH

SEQ ID NO: 224101 - protein, 18 aa, Mycobacterium bovis
VLARKDRTLITENRLGLV

SEQ ID NO: 224102 - protein, 31 aa, Mycobacterium bovis
VLARWSASSRFLLNLPLFSRQALHPDVDLLV

SEQ ID NO: 224103 - protein, 27 aa, Mycobacterium bovis
VLASAAPPWVGPLDVLIVAGDDPGDPA

SEQ ID NO: 224104 - protein, 23 aa, Mycobacterium bovis
VLASSIPLINIPPTPGIGNSTIT

SEQ ID NO: 224105 - protein, 20 aa, Mycobacterium bovis
VLAVNTLYRGPATPGSAAAL

SEQ ID NO: 224106 - protein, 23 aa, Mycobacterium bovis
VLCGATLIVWTTISAARQVPGLW

SEQ ID NO: 224107 - protein, 26 aa, Mycobacterium bovis
VLDELTLAAPLLLPATGSVAVQVVVD

SEQ ID NO: 224108 - protein, 25 aa, Mycobacterium bovis
VLDMLAPWEVLDAVSRLLVAGGVLM

SEQ ID NO: 224109 - protein, 28 aa, Mycobacterium bovis
VLDTAAVTIAKLWELFVAEDATLVEVNP

SEQ ID NO: 224110 - protein, 26 aa, Mycobacterium bovis
VLDTDSFYRPKRPGSYPIVLATYEIV

SEQ ID NO: 224111 - protein, 17 aa, Mycobacterium bovis
VLEEAFRVLRPGGELIF

SEQ ID NO: 224112 - protein, 18 aa, Mycobacterium bovis
VLESLTGIRRAGADIVLT

SEQ ID NO: 224113 - protein, 24 aa, Mycobacterium bovis
VLFHARAKLRRKGCDLLVVNAVGE

SEQ ID NO: 224114 - protein, 17 aa, Mycobacterium bovis
VLGETWTLLNRRCGHRA

SEQ ID NO: 224115 - protein, 17 aa, Mycobacterium bovis
VLGICRGTQVLNVALGG

SEQ ID NO: 224116 - protein, 17 aa, Mycobacterium bovis
VLGIKVARRLLANVAHV

SEQ ID NO: 224117 - protein, 18 aa, Mycobacterium bovis
VLGLLRDAYCRHIGVEYA

SEQ ID NO: 224118 - protein, 17 aa, Mycobacterium bovis
VLGLYTQAQVLAYCGAS

SEQ ID NO: 224119 - protein, 30 aa, Mycobacterium bovis
VLGPDRLPGVRLWLYTNFHCNLCCDYCCVS

SEQ ID NO: 224120 - protein, 19 aa, Mycobacterium bovis
VLHRIRQTLAIQPVSIGSA

SEQ ID NO: 224121 - protein, 22 aa, Mycobacterium bovis
VLHTPPPHWRPDVLLVAVGAMS

SEQ ID NO: 224122 - protein, 17 aa, Mycobacterium bovis
VLIEVRIPLRHNTSSAY

SEQ ID NO: 224123 - protein, 19 aa, Mycobacterium bovis
VLIPSPDYPLWTASTSLAG

SEQ ID NO: 224124 - protein, 17 aa, Mycobacterium bovis
VLIRARGLAKPAIDRKR

SEQ ID NO: 224125 - protein, 26 aa, Mycobacterium bovis
VLLLVAHHIAWDDGSWRVFFTDLTQA

SEQ ID NO: 224126 - protein, 27 aa, Mycobacterium bovis
VLLSDGPVVLFFYPAAMTPGCTKEACH

SEQ ID NO: 224127 - protein, 19 aa, Mycobacterium bovis
VLMKPSTLDMICHGTAAKG

SEQ ID NO: 224128 - protein, 19 aa, Mycobacterium bovis
VLMTIPWAVISGFLFNVLL

SEQ ID NO: 224129 - protein, 30 aa, Mycobacterium bovis
VLNNALYMDRYPLVSAISRPLIVKHLVAAA

SEQ ID NO: 224130 - protein, 19 aa, Mycobacterium bovis
VLPNLRALNFVIEAILGQG

SEQ ID NO: 224131 - protein, 20 aa, Mycobacterium bovis
VLQASLFTAYGTLYQQVSAE

SEQ ID NO: 224132 - protein, 19 aa, Mycobacterium bovis
VLQPLGLHKVANPDLCGFA

SEQ ID NO: 224133 - protein, 25 aa, Mycobacterium bovis
VLQSSWVHLLPSRKEGWGLAVIEAA

SEQ ID NO: 224134 - protein, 18 aa, Mycobacterium bovis
VLRARFRPSPESGPPVHA

SEQ ID NO: 224135 - protein, 18 aa, Mycobacterium bovis
VLRDRLFDTLAAAGGPEV

SEQ ID NO: 224136 - protein, 20 aa, Mycobacterium bovis
VLREVFVNGIPRRVDRVDLE

SEQ ID NO: 224137 - protein, 28 aa, Mycobacterium bovis
VLRGARPLFASRRLGIAGRRVLLATLTA

SEQ ID NO: 224138 - protein, 17 aa, Mycobacterium bovis
VLRLPGHDVDWVPVHVT

SEQ ID NO: 224139 - protein, 18 aa, Mycobacterium bovis
VLRRLPDLRLVADDSVLP

SEQ ID NO: 224140 - protein, 19 aa, Mycobacterium bovis
VLRSAGVKVLMALPVGMGC

SEQ ID NO: 224141 - protein, 17 aa, Mycobacterium bovis
VLRSDLLRPWANWVTPE

SEQ ID NO: 224142 - protein, 17 aa, Mycobacterium bovis
VLSQPGLRKLLAQEWLR

SEQ ID NO: 224143 - protein, 17 aa, Mycobacterium bovis
VLTLYGIPHRDCGSYAS

SEQ ID NO: 224144 - protein, 18 aa, Mycobacterium bovis
VLVAMNSLWELNVPRRDL

SEQ ID NO: 224145 - protein, 21 aa, Mycobacterium bovis
VLVGIAFLRAPCRVVYVIDEP

SEQ ID NO: 224146 - protein, 28 aa, Mycobacterium bovis
VLVTGYDILFFWVARMMMFGTFVGDDAA

SEQ ID NO: 224147 - protein, 27 aa, Mycobacterium bovis
VLVVQRMLASRFTPLALFGTDRRLAEL

SEQ ID NO: 224148 - protein, 18 aa, Mycobacterium bovis
VLVWQDMAGFSGAKTARF

SEQ ID NO: 224149 - protein, 24 aa, Mycobacterium bovis
VMAEPLTYFFSDPAARDFVAGVAQ

SEQ ID NO: 224150 - protein, 25 aa, Mycobacterium bovis
VMAVWVILRAMEALDLLPLTDRRHL

SEQ ID NO: 224151 - protein, 27 aa, Mycobacterium bovis
VMEFPVLPPEINSVLMYSGAGSSPLLA

SEQ ID NO: 224152 - protein, 25 aa, Mycobacterium bovis
VMGLPSIFVGFSRQRGLAADGRCKA

SEQ ID NO: 224153 - protein, 17 aa, Mycobacterium bovis
VMPARFLILGSASPDLV

SEQ ID NO: 224154 - protein, 28 aa, Mycobacterium bovis
VMPETVTWILRDLGVYAIRLSDDVPGFG

SEQ ID NO: 224155 - protein, 21 aa, Mycobacterium bovis
VMPVLKKWRIFEREDFTGEGA

SEQ ID NO: 224156 - protein, 17 aa, Mycobacterium bovis
VMRLSRQLRFRNPSSPV

SEQ ID NO: 224157 - protein, 30 aa, Mycobacterium bovis
VMRQLPITLLHIVAPVVVGWPVGQLYANMT

SEQ ID NO: 224158 - protein, 17 aa, Mycobacterium bovis
VMRQRLAAAGVAVPRYA

SEQ ID NO: 224159 - protein, 17 aa, Mycobacterium bovis
VMRVPLEGGGRLVVELT

SEQ ID NO: 224160 - protein, 31 aa, Mycobacterium bovis
VMTPDLSTLRLIPWLPGTALVIADLVWADGS

SEQ ID NO: 224161 - protein, 25 aa, Mycobacterium bovis
VMTQELLEFPGGILGVALNLDEHSV

SEQ ID NO: 224162 - protein, 24 aa, Mycobacterium bovis
VMTTSQPWWPADYGHYGPLFIRMA

SEQ ID NO: 224163 - protein, 21 aa, Mycobacterium bovis
VMVPLRSAGMSRRASRRRAEE

SEQ ID NO: 224164 - protein, 18 aa, Mycobacterium bovis
VMVWLHGGAYILGSGSQP

SEQ ID NO: 224165 - protein, 22 aa, Mycobacterium bovis
VMYRSVLALLMLTGSMGRNGGG

SEQ ID NO: 224166 - protein, 26 aa, Mycobacterium bovis
VNAAAPDVIRLAPPLIIAEAQLDGFV

SEQ ID NO: 224167 - protein, 23 aa, Mycobacterium bovis
VNAAVLYVFRTLVADDIPLNDGC

SEQ ID NO: 224168 - protein, 23 aa, Mycobacterium bovis
VNADIARYNARCGRTFVLPNEQA

SEQ ID NO: 224169 - protein, 24 aa, Mycobacterium bovis
VNDLRLALGVMLEIGPRGPERLPG

SEQ ID NO: 224170 - protein, 19 aa, Mycobacterium bovis
VNFGAFVDLGGVDGLVHVS

SEQ ID NO: 224171 - protein, 26 aa, Mycobacterium bovis
VNFRDVLVALGIYPGAAELGAEGAGV

SEQ ID NO: 224172 - protein, 19 aa, Mycobacterium bovis
VNGIVFNRAFTGAVQTIYD

SEQ ID NO: 224173 - protein, 26 aa, Mycobacterium bovis
VNGKSWLVFGPYAGWSPKFLKHGQIS

SEQ ID NO: 224174 - protein, 17 aa, Mycobacterium bovis
VNGLWVTHLGVGQNVTV

SEQ ID NO: 224175 - protein, 25 aa, Mycobacterium bovis
VNISGGLPAFTLFAGGLTIPTNAIP

SEQ ID NO: 224176 - protein, 23 aa, Mycobacterium bovis
VNKLRGRHVPKLRQVIGCVFQDF

SEQ ID NO: 224177 - protein, 23 aa, Mycobacterium bovis
VNLLHDHLVDILLDAAAMGRVHV

SEQ ID NO: 224178 - protein, 26 aa, Mycobacterium bovis
VNLPNWLSLTFRIDGGAWFNVDTVEL

SEQ ID NO: 224179 - protein, 26 aa, Mycobacterium bovis
VNPDAAWYYRRPSPLARRIKNHVAFW

SEQ ID NO: 224180 - protein, 24 aa, Mycobacterium bovis
VNQYLAVAALIAGGLYGIERGLQL

SEQ ID NO: 224181 - protein, 27 aa, Mycobacterium bovis
VNRDIPLRLVYVIDPSQLSAAGEGGGQ

SEQ ID NO: 224182 - protein, 34 aa, Mycobacterium bovis
VNSFSKYYAMTGWRLGWLLVPTVLRRAVDCLTGN

SEQ ID NO: 224183 - protein, 24 aa, Mycobacterium bovis
VNSRHLVLPLEKYPKLTDFGEANK

SEQ ID NO: 224184 - protein, 30 aa, Mycobacterium bovis
VNTADADVIRYLRWFTFLSADELAELEQAT

SEQ ID NO: 224185 - protein, 17 aa, Mycobacterium bovis
VNTLPVPGLTIADLGEL

SEQ ID NO: 224186 - protein, 17 aa, Mycobacterium bovis
VNTLVASSGSYAATEAA

SEQ ID NO: 224187 - protein, 17 aa, Mycobacterium bovis
VNTLVLRVNLAGDPSFA

SEQ ID NO: 224188 - protein, 21 aa, Mycobacterium bovis
VNVLALQRILGHKSAKVTLDT

SEQ ID NO: 224189 - protein, 24 aa, Mycobacterium bovis
VPARPRRVRKPGEPLRIGVGGPVG

SEQ ID NO: 224190 - protein, 17 aa, Mycobacterium bovis
VPATVPVGILCLEFLVH

SEQ ID NO: 224191 - protein, 40 aa, Mycobacterium bovis
VPDHSFFGLLWADVKFEWHALPYLLGFKKACAGFRSLGRG

SEQ ID NO: 224192 - protein, 18 aa, Mycobacterium bovis
VPEDIFQTALGRAAEPVE

SEQ ID NO: 224193 - protein, 24 aa, Mycobacterium bovis
VPESKRFCWNCGRPVGRSDSETKG

SEQ ID NO: 224194 - protein, 22 aa, Mycobacterium bovis
VPGPDRVALLSLLRSTPLTEEQ

SEQ ID NO: 224195 - protein, 17 aa, Mycobacterium bovis
VPGPFVPSAIASALIAA

SEQ ID NO: 224196 - protein, 20 aa, Mycobacterium bovis
VPGRLLGKSAYHALTFGWLM

SEQ ID NO: 224197 - protein, 36 aa, Mycobacterium bovis
VPGSAALFAWGLNQLVFLGLRPPPPQRYPLSEAQAA

SEQ ID NO: 224198 - protein, 26 aa, Mycobacterium bovis
VPHGRDEIWRFTPLRRLRGLHDGSAR

SEQ ID NO: 224199 - protein, 24 aa, Mycobacterium bovis
VPHLHIHVFPTRSLSDFGFANVDR

SEQ ID NO: 224200 - protein, 20 aa, Mycobacterium bovis
VPHSWNLPPAVRQVAAMFPG

SEQ ID NO: 224201 - protein, 25 aa, Mycobacterium bovis
VPIERTCEFLEWFGENVPISPIWLC

SEQ ID NO: 224202 - protein, 19 aa, Mycobacterium bovis
VPISGILFGGRRKTTVPLV

SEQ ID NO: 224203 - protein, 17 aa, Mycobacterium bovis
VPLFINTGDKLKVDSRD

SEQ ID NO: 224204 - protein, 21 aa, Mycobacterium bovis
VPLVAGPLPVAFFIGVLAGEE

SEQ ID NO: 224205 - protein, 18 aa, Mycobacterium bovis
VPNLLQLASALEVQRNHV

SEQ ID NO: 224206 - protein, 22 aa, Mycobacterium bovis
VPPGCVGPLQIALTKVAAEEHV

SEQ ID NO: 224207 - protein, 18 aa, Mycobacterium bovis
VPPITIPAGNHCRRIYAT

SEQ ID NO: 224208 - protein, 21 aa, Mycobacterium bovis
VPPMPVVDAIRRGAQAILPTP

SEQ ID NO: 224209 - protein, 25 aa, Mycobacterium bovis
VPPNGLPVILGPDHPITGSYPVVGV

SEQ ID NO: 224210 - protein, 24 aa, Mycobacterium bovis
VPSSMVLLSPWLDVGTWQISQAWA

SEQ ID NO: 224211 - protein, 25 aa, Mycobacterium bovis
VPTAAAYRWRGAARALRRLANTGEA

SEQ ID NO: 224212 - protein, 20 aa, Mycobacterium bovis
VPVAAPWDARRARELDDVSL

SEQ ID NO: 224213 - protein, 23 aa, Mycobacterium bovis
VPVAGLTWMPFTDQRYTAVAGGP

SEQ ID NO: 224214 - protein, 18 aa, Mycobacterium bovis
VPVPKSVWRWIDSAQHRL

SEQ ID NO: 224215 - protein, 18 aa, Mycobacterium bovis
VPVRAFINPANRLMVYRR

SEQ ID NO: 224216 - protein, 24 aa, Mycobacterium bovis
VQAAWAVLVAYFNRLRCGTGDYID

SEQ ID NO: 224217 - protein, 17 aa, Mycobacterium bovis
VQALLVALAVRGLGSCW

SEQ ID NO: 224218 - protein, 19 aa, Mycobacterium bovis
VQARPGCRPSLAELDSFVR

SEQ ID NO: 224219 - protein, 34 aa, Mycobacterium bovis
VQEIVPVQLVRIGRLYLIGIPGEPTIVAGLRLRR

SEQ ID NO: 224220 - protein, 24 aa, Mycobacterium bovis
VQFHPTGMVWPPSVKGILVTEGVR

SEQ ID NO: 224221 - protein, 18 aa, Mycobacterium bovis
VQIGRRLARLARTHQVIV

SEQ ID NO: 224222 - protein, 20 aa, Mycobacterium bovis
VQIICQLARALFGPGHPVPW

SEQ ID NO: 224223 - protein, 32 aa, Mycobacterium bovis
VQRCGPLDWRWRRRGFFGDHGGRWCRHRSLQR

SEQ ID NO: 224224 - protein, 18 aa, Mycobacterium bovis
VQRYPNVRLLPTGANLGY

SEQ ID NO: 224225 - protein, 19 aa, Mycobacterium bovis
VQSTFRRIYRSREAEVTLV

SEQ ID NO: 224226 - protein, 32 aa, Mycobacterium bovis
VQTAVLYDHFTPFTLIQLEELGFCGKGEAKDF

SEQ ID NO: 224227 - protein, 20 aa, Mycobacterium bovis
VQVPIPRAGGLGAPRIRDVE

SEQ ID NO: 224228 - protein, 19 aa, Mycobacterium bovis
VQYAILRRNFFVERLIPAG

SEQ ID NO: 224229 - protein, 29 aa, Mycobacterium bovis
VRAEVAVLKILALQFIMSDPRHLETQARQ

SEQ ID NO: 224230 - protein, 23 aa, Mycobacterium bovis
VRAGARILLAPDGPDLRVQPGDR

SEQ ID NO: 224231 - protein, 28 aa, Mycobacterium bovis
VRAHLIDAARPFIFDTGLAPAAVGAARA

SEQ ID NO: 224232 - protein, 21 aa, Mycobacterium bovis
VRAILAGHLHYSTNATFVGIP

SEQ ID NO: 224233 - protein, 21 aa, Mycobacterium bovis
VRAKYGWTDVSRFAALGIPAV

SEQ ID NO: 224234 - protein, 22 aa, Mycobacterium bovis
VRARLRREVLIDDGTDEARVSR

SEQ ID NO: 224235 - protein, 29 aa, Mycobacterium bovis
VRARPDLPPTPWLIPESAGLELLYRMADF

SEQ ID NO: 224236 - protein, 18 aa, Mycobacterium bovis
VRAYANASAAMNLVRALT

SEQ ID NO: 224237 - protein, 20 aa, Mycobacterium bovis
VRAYAPVRTARYCYTRVTKV

SEQ ID NO: 224238 - protein, 18 aa, Mycobacterium bovis
VRCGIDIQDALRNSAKRK

SEQ ID NO: 224239 - protein, 17 aa, Mycobacterium bovis
VRCRATVGEVGNAEQAN

SEQ ID NO: 224240 - protein, 21 aa, Mycobacterium bovis
VRDVRLATVLSRCSYLRDGIV

SEQ ID NO: 224241 - protein, 27 aa, Mycobacterium bovis
VRDVRYLGSQPWPFPRSLMVGFHALGD

SEQ ID NO: 224242 - protein, 20 aa, Mycobacterium bovis
VRDWPKPLGFVWGLDDPVAT

SEQ ID NO: 224243 - protein, 24 aa, Mycobacterium bovis
VREFACQRWQWHDLEVSRTAIVPD

SEQ ID NO: 224244 - protein, 17 aa, Mycobacterium bovis
VREINIGEIPLGLRLGS

SEQ ID NO: 224245 - protein, 19 aa, Mycobacterium bovis
VRFMKFIGEEIFPGGQLPA

SEQ ID NO: 224246 - protein, 36 aa, Mycobacterium bovis
VRGGTVHAPRLSPAPALLALPAAESAWRLAAGGGGT

SEQ ID NO: 224247 - protein, 25 aa, Mycobacterium bovis
VRGLPQLSSAPVWCSDIRAGAGLVL

SEQ ID NO: 224248 - protein, 19 aa, Mycobacterium bovis
VRGLRITPQQLRDIAEREG

SEQ ID NO: 224249 - protein, 19 aa, Mycobacterium bovis
VRGVPVWASLIALLEDGVP

SEQ ID NO: 224250 - protein, 23 aa, Mycobacterium bovis
VRKNGVLPYLRPDGKTQVTIAYE

SEQ ID NO: 224251 - protein, 19 aa, Mycobacterium bovis
VRLCPTPGHLHFFAVDGRR

SEQ ID NO: 224252 - protein, 18 aa, Mycobacterium bovis
VRLGLAAQLARQLGAPVV

SEQ ID NO: 224253 - protein, 22 aa, Mycobacterium bovis
VRLLNMVPYFQANPRITRAEAA

SEQ ID NO: 224254 - protein, 22 aa, Mycobacterium bovis
VRLPHGNGETIRLARGASLSDF

SEQ ID NO: 224255 - protein, 29 aa, Mycobacterium bovis
VRLTNFEGPFDLLLQLIFAHQLDVTEVAL

SEQ ID NO: 224256 - protein, 17 aa, Mycobacterium bovis
VRLVTFDAGVFTLAQQR

SEQ ID NO: 224257 - protein, 21 aa, Mycobacterium bovis
VRMIEAYHRLSKLNEYSAIDF

SEQ ID NO: 224258 - protein, 18 aa, Mycobacterium bovis
VRNNFSWLNSYYDDMAWL

SEQ ID NO: 224259 - protein, 26 aa, Mycobacterium bovis
VRPATQYRYLLIASPAGAYFKGGIAP

SEQ ID NO: 224260 - protein, 18 aa, Mycobacterium bovis
VRPEIELGPIRPPQRLAP

SEQ ID NO: 224261 - protein, 21 aa, Mycobacterium bovis
VRPEPFGALLYHFGTRKLSFL

SEQ ID NO: 224262 - protein, 21 aa, Mycobacterium bovis
VRPIDGLSLDVAPGSLVILLG

SEQ ID NO: 224263 - protein, 24 aa, Mycobacterium bovis
VRPTELCFVPRIWDMVFAEFHSEV

SEQ ID NO: 224264 - protein, 32 aa, Mycobacterium bovis
VRPVSILYRLYRPLIFALYCLPLNWLRRKHGL

SEQ ID NO: 224265 - protein, 25 aa, Mycobacterium bovis
VRQHGGRLLVRLAGVADRDAADALR

SEQ ID NO: 224266 - protein, 20 aa, Mycobacterium bovis
VRQMLRRVTIIDSGSTEFLP

SEQ ID NO: 224267 - protein, 20 aa, Mycobacterium bovis
VRRANFVYGSTKAGLDGFYL

SEQ ID NO: 224268 - protein, 17 aa, Mycobacterium bovis
VRRRPSRGLGQRLLYPI

SEQ ID NO: 224269 - protein, 19 aa, Mycobacterium bovis
VRSETIPEFLAALEKPRRV

SEQ ID NO: 224270 - protein, 29 aa, Mycobacterium bovis
VRSGVAFDILRRWLLARGYDVAFIRNVTD

SEQ ID NO: 224271 - protein, 21 aa, Mycobacterium bovis
VRSMRYTCERLVRGLDTIAAT

SEQ ID NO: 224272 - protein, 20 aa, Mycobacterium bovis
VRSTPGLRYRIYRPAVVVGD

SEQ ID NO: 224273 - protein, 23 aa, Mycobacterium bovis
VRTALFNWAYARHTGGTFVFRIE

SEQ ID NO: 224274 - protein, 28 aa, Mycobacterium bovis
VRTDEQWRWLAHTLTVELLKELLPETAG

SEQ ID NO: 224275 - protein, 20 aa, Mycobacterium bovis
VRTSGTPFPLALRPNPDAEP

SEQ ID NO: 224276 - protein, 23 aa, Mycobacterium bovis
VRVLRPGGYFPYADLRPNNEIAA

SEQ ID NO: 224277 - protein, 17 aa, Mycobacterium bovis
VRVLYGRDPHHITEAQY

SEQ ID NO: 224278 - protein, 22 aa, Mycobacterium bovis
VRVRDLLATHLETAGVLAASVH

SEQ ID NO: 224279 - protein, 21 aa, Mycobacterium bovis
VRWFDIEPCYVYHPLNAYSEC

SEQ ID NO: 224280 - protein, 23 aa, Mycobacterium bovis
VSADELMAAARRLSRLPVVAAVG

SEQ ID NO: 224281 - protein, 40 aa, Mycobacterium bovis
VSAGFMRILGPQFLSRFYGRTLNTHPALLPAFPGTHGVAD

SEQ ID NO: 224282 - protein, 24 aa, Mycobacterium bovis
VSAKDIILALIAKIGTGGGQGHVI

SEQ ID NO: 224283 - protein, 30 aa, Mycobacterium bovis
VSAQAAAFHDRFVQLLNAGGGSYASAEIAN

SEQ ID NO: 224284 - protein, 29 aa, Mycobacterium bovis
VSAQMSAFHAQFVQTFTAGAGAYASAEAA

SEQ ID NO: 224285 - protein, 26 aa, Mycobacterium bovis
VSASAALGLLRRNKIEKLPVVDGRGR

SEQ ID NO: 224286 - protein, 29 aa, Mycobacterium bovis
VSDDGRWRIVGNIPRGMFVGGRRGSSVTV

SEQ ID NO: 224287 - protein, 25 aa, Mycobacterium bovis
VSENLRYVAAWNAAFLPSKDLTEGI

SEQ ID NO: 224288 - protein, 23 aa, Mycobacterium bovis
VSEPFLVAIPILEQKGMQVLTVA

SEQ ID NO: 224289 - protein, 26 aa, Mycobacterium bovis
VSFGENLPPPLRWLERRTRGDQLHPL

SEQ ID NO: 224290 - protein, 25 aa, Mycobacterium bovis
VSGGELFIIGRIKDLLIVYGRNHAP

SEQ ID NO: 224291 - protein, 27 aa, Mycobacterium bovis
VSGGGCAPDLIYIDLHLVHEVTSPQAF

SEQ ID NO: 224292 - protein, 35 aa, Mycobacterium bovis
VSGPLLRRKFRPSSAAMLPLRTALDRGLLSIRGVD

SEQ ID NO: 224293 - protein, 25 aa, Mycobacterium bovis
VSGQRFAGMLVAGVFLREFVAESVD

SEQ ID NO: 224294 - protein, 27 aa, Mycobacterium bovis
VSGRAQILNMTLSQRWGRLFVAVCYAL

SEQ ID NO: 224295 - protein, 26 aa, Mycobacterium bovis
VSGSGPAYFFLLVEALVDAGVGVGLS

SEQ ID NO: 224296 - protein, 18 aa, Mycobacterium bovis
VSHFQRLFRVAQHNPMPV

SEQ ID NO: 224297 - protein, 27 aa, Mycobacterium bovis
VSKLHTKLFYQPLLESIGPTGLEIAHG

SEQ ID NO: 224298 - protein, 19 aa, Mycobacterium bovis
VSKRTLYQHFPSKSALVEE

SEQ ID NO: 224299 - protein, 22 aa, Mycobacterium bovis
VSLALACDFILASDSAFFMLAN

SEQ ID NO: 224300 - protein, 25 aa, Mycobacterium bovis
VSLDSPPFYDPWFAHARTSGAIEAR

SEQ ID NO: 224301 - protein, 25 aa, Mycobacterium bovis
VSLDVEYFGVMWPNNAAVGATYGGV

SEQ ID NO: 224302 - protein, 34 aa, Mycobacterium bovis
VSLGIYASPRQTVISGPPLLIDELIDKVRQQNGF

SEQ ID NO: 224303 - protein, 23 aa, Mycobacterium bovis
VSLGLYSRIFRNNILASGVIPQI

SEQ ID NO: 224304 - protein, 22 aa, Mycobacterium bovis
VSLHDSAIAILRRFGKSDYLRD

SEQ ID NO: 224305 - protein, 23 aa, Mycobacterium bovis
VSLPVVRAFIHRIKERARGAEVS

SEQ ID NO: 224306 - protein, 23 aa, Mycobacterium bovis
VSLTQILAWDLPLTKRLTEQVAK

SEQ ID NO: 224307 - protein, 27 aa, Mycobacterium bovis
VSMESRARLFPRGLAAFIELRDQRCRT

SEQ ID NO: 224308 - protein, 21 aa, Mycobacterium bovis
VSMQALLERAYRMGLVSAEAR

SEQ ID NO: 224309 - protein, 28 aa, Mycobacterium bovis
VSMTMNGAVLPILALYVVAAEEQGVAPE

SEQ ID NO: 224310 - protein, 25 aa, Mycobacterium bovis
VSNRRGKPAIPAWEDVLLGVRSGGR

SEQ ID NO: 224311 - protein, 28 aa, Mycobacterium bovis
VSPEVATWLEVPLPPGVLRWQQDHGRHL

SEQ ID NO: 224312 - protein, 18 aa, Mycobacterium bovis
VSPQLYIALGISGAIQHR

SEQ ID NO: 224313 - protein, 31 aa, Mycobacterium bovis
VSQAADRPWRLWLTGRPEVSAYRRSSRAPAR

SEQ ID NO: 224314 - protein, 25 aa, Mycobacterium bovis
VSRHFGAVLMAFTLCFVTDPAAIFR

SEQ ID NO: 224315 - protein, 17 aa, Mycobacterium bovis
VSRKCSVPYLYRFELMG

SEQ ID NO: 224316 - protein, 24 aa, Mycobacterium bovis
VSRQTLHTWLARYEAEGLDGLRIG

SEQ ID NO: 224317 - protein, 25 aa, Mycobacterium bovis
VSRQYHRWLYPHPIADLEAWTTANW

SEQ ID NO: 224318 - protein, 18 aa, Mycobacterium bovis
VSRRALLALARAEYRILG

SEQ ID NO: 224319 - protein, 24 aa, Mycobacterium bovis
VSRRRLLRALRDYSTPHASIPYVP

SEQ ID NO: 224320 - protein, 23 aa, Mycobacterium bovis
VSSIFLMCLPDRVLAYGDCAIIP

SEQ ID NO: 224321 - protein, 24 aa, Mycobacterium bovis
VSSLYTAIPFAQDASVLVIGERTN

SEQ ID NO: 224322 - protein, 31 aa, Mycobacterium bovis
VSTLLLVVQRVPYFQVWNLTGQPAAVVPWDF

SEQ ID NO: 224323 - protein, 26 aa, Mycobacterium bovis
VSVHPVFNLYNKRWPIRGESENLAPA

SEQ ID NO: 224324 - protein, 23 aa, Mycobacterium bovis
VSWNWTELPSALGVTNHLAFRAQ

SEQ ID NO: 224325 - protein, 22 aa, Mycobacterium bovis
VTADVTLTRAWCLRELGDDDAA

SEQ ID NO: 224326 - protein, 19 aa, Mycobacterium bovis
VTAMVTKILALQAKPTPAD

SEQ ID NO: 224327 - protein, 24 aa, Mycobacterium bovis
VTDGKMFIIGRIKDLLIVYGRNHS

SEQ ID NO: 224328 - protein, 28 aa, Mycobacterium bovis
VTDMAHFFYIHFGLPTYFKNVFEGHIAS

SEQ ID NO: 224329 - protein, 25 aa, Mycobacterium bovis
VTDMPDRVVWLPLNSAGSTVHRQLR

SEQ ID NO: 224330 - protein, 17 aa, Mycobacterium bovis
VTEFMLLQAAVAVVLHK

SEQ ID NO: 224331 - protein, 22 aa, Mycobacterium bovis
VTFIGQPLWGSIGYTLPAAVGA

SEQ ID NO: 224332 - protein, 24 aa, Mycobacterium bovis
VTGDLANWMIPGKMVKGMGGAMDL

SEQ ID NO: 224333 - protein, 18 aa, Mycobacterium bovis
VTGPYDYLLHIRVCDTAD

SEQ ID NO: 224334 - protein, 30 aa, Mycobacterium bovis
VTGPYTFPGVLPPSGVPYLLGIQSVLVTQN

SEQ ID NO: 224335 - protein, 29 aa, Mycobacterium bovis
VTGRRVYGTLPWHPDLWLDSEDALDLQGR

SEQ ID NO: 224336 - protein, 17 aa, Mycobacterium bovis
VTGWARLHGYPLGILAN

SEQ ID NO: 224337 - protein, 19 aa, Mycobacterium bovis
VTINYRFAPDRSVAAALQH

SEQ ID NO: 224338 - protein, 24 aa, Mycobacterium bovis
VTISTLVQMAWATTLSAFTGRGDV

SEQ ID NO: 224339 - protein, 21 aa, Mycobacterium bovis
VTIVGLPDIPGYAAKVFRAVA

SEQ ID NO: 224340 - protein, 26 aa, Mycobacterium bovis
VTIYYTAPTLIRMFMKWGREIPDSHD

SEQ ID NO: 224341 - protein, 25 aa, Mycobacterium bovis
VTLADLLDFFKDPVKGFFRALDYTL

SEQ ID NO: 224342 - protein, 18 aa, Mycobacterium bovis
VTLAHHGGYRTMISHRSG

SEQ ID NO: 224343 - protein, 17 aa, Mycobacterium bovis
VTLVAQLSRRFAPPTLV

SEQ ID NO: 224344 - protein, 22 aa, Mycobacterium bovis
VTPVEHGLVLPSGPLIHGGTGG

SEQ ID NO: 224345 - protein, 26 aa, Mycobacterium bovis
VTQRHLRRLWALPGTQLAVVAWPSTR

SEQ ID NO: 224346 - protein, 19 aa, Mycobacterium bovis
VTRIILTRPAVEAGERLGF

SEQ ID NO: 224347 - protein, 17 aa, Mycobacterium bovis
VTRLFDRIAGHRRFRFY

SEQ ID NO: 224348 - protein, 19 aa, Mycobacterium bovis
VTRMDYLSPFFNETAYCLG

SEQ ID NO: 224349 - protein, 24 aa, Mycobacterium bovis
VTRPLVAELQRKFSVSAAETGSHD

SEQ ID NO: 224350 - protein, 32 aa, Mycobacterium bovis
VTRRLLPRVPRCIPLAARLAPGTIGCPSFWNP

SEQ ID NO: 224351 - protein, 23 aa, Mycobacterium bovis
VTRRPIHLMGLDKTFRLFSTLHD

SEQ ID NO: 224352 - protein, 17 aa, Mycobacterium bovis
VTSALLEPTWWEGDRPP

SEQ ID NO: 224353 - protein, 30 aa, Mycobacterium bovis
VTSATPARALGLTGVGRLAAGYAANLVVLD

SEQ ID NO: 224354 - protein, 25 aa, Mycobacterium bovis
VTTLPAVISRWLSSVLPGGAAPEVT

SEQ ID NO: 224355 - protein, 22 aa, Mycobacterium bovis
VTTLPGAAFFSSSTSFGIIRGG

SEQ ID NO: 224356 - protein, 23 aa, Mycobacterium bovis
VTTNTHFLQTPPAAPMVAASLGA

SEQ ID NO: 224357 - protein, 25 aa, Mycobacterium bovis
VTVDDLLDHLLPHDWRVDMPELDPS

SEQ ID NO: 224358 - protein, 20 aa, Mycobacterium bovis
VTVDWHMPPRARKPQRRVRL

SEQ ID NO: 224359 - protein, 22 aa, Mycobacterium bovis
VTVFFDGATLHALITGTPLSTD

SEQ ID NO: 224360 - protein, 22 aa, Mycobacterium bovis
VTVPVSFTELALGSTLSVPTLD

SEQ ID NO: 224361 - protein, 18 aa, Mycobacterium bovis
VTVVSYTWAMLRDVVDDP

SEQ ID NO: 224362 - protein, 27 aa, Mycobacterium bovis
VTWTEEQTYFFRLSAYTDKLLAHYHAN

SEQ ID NO: 224363 - protein, 17 aa, Mycobacterium bovis
VVAAARWARSELDYIPG

SEQ ID NO: 224364 - protein, 20 aa, Mycobacterium bovis
VVAALGMYPGQAPPLGAEGA

SEQ ID NO: 224365 - protein, 18 aa, Mycobacterium bovis
VVADIHFQPRYIFAAIDA

SEQ ID NO: 224366 - protein, 24 aa, Mycobacterium bovis
VVADLSFISLATVLPALVGCASRD

SEQ ID NO: 224367 - protein, 27 aa, Mycobacterium bovis
VVAGGHSLLPMMKLRIANPEYLVDIND

SEQ ID NO: 224368 - protein, 31 aa, Mycobacterium bovis; identical to SEQ ID NO: 118502

SEQ ID NO: 224369 - protein, 17 aa, Mycobacterium bovis
VVAMLRLVADPTAGAAA

SEQ ID NO: 224370 - protein, 20 aa, Mycobacterium bovis
VVARGRLMQALPAGGAMVAV

SEQ ID NO: 224371 - protein, 20 aa, Mycobacterium bovis
VVARLRVILRRAGKGNKEPR

SEQ ID NO: 224372 - protein, 22 aa, Mycobacterium bovis
VVASPGFSPATPLLAAAAAAGV

SEQ ID NO: 224373 - protein, 36 aa, Mycobacterium bovis
VVAVYSTFLHRAFDQLLFDIGLHRLPVTLVLDRAGV

SEQ ID NO: 224374 - protein, 27 aa, Mycobacterium bovis
VVCPLGWPATPARLPFTLGAGAHLQAD

SEQ ID NO: 224375 - protein, 28 aa, Mycobacterium bovis
VVDPQVHTLLDFHFRPHLTAASGKHGMG

SEQ ID NO: 224376 - protein, 27 aa, Mycobacterium bovis
VVDVPVQAWGWLSLAAGLAVLDSVAPL

SEQ ID NO: 224377 - protein, 17 aa, Mycobacterium bovis
VVELLRRGITARDILTK

SEQ ID NO: 224378 - protein, 23 aa, Mycobacterium bovis
VVGHPYVDIWQAVKPQRVGLAAW

SEQ ID NO: 224379 - protein, 17 aa, Mycobacterium bovis
VVGIATFDQKRPAVGVD

SEQ ID NO: 224380 - protein, 19 aa, Mycobacterium bovis
VVGVISPWNYPMTLTVSDS

SEQ ID NO: 224381 - protein, 21 aa, Mycobacterium bovis
VVHPPFRWQRRYAEGFSDQVA

SEQ ID NO: 224382 - protein, 32 aa, Mycobacterium bovis
VVHRYGMAFHRPGPRLRYLLAVKACFAVFQTG

SEQ ID NO: 224383 - protein, 18 aa, Mycobacterium bovis
VVIRGQTPHFDYVCDAVT

SEQ ID NO: 224384 - protein, 18 aa, Mycobacterium bovis
VVKGGRRFSFTALVIVGD

SEQ ID NO: 224385 - protein, 17 aa, Mycobacterium bovis
VVLAAGHNFPLACPGLL

SEQ ID NO: 224386 - protein, 25 aa, Mycobacterium bovis
VVLDDSLVYLALNKPRGMHSTMSDD

SEQ ID NO: 224387 - protein, 26 aa, Mycobacterium bovis
VVLDNVFATPLLQQGFPLGVDVVVYS

SEQ ID NO: 224388 - protein, 18 aa, Mycobacterium bovis
VVLKGGAIAWAAMGDANA

SEQ ID NO: 224389 - protein, 17 aa, Mycobacterium bovis
VVLPPIPVPAVNAHLTG

SEQ ID NO: 224390 - protein, 29 aa, Mycobacterium bovis
VVNADVATWPPMPYPETWGVWQEDEGRQI

SEQ ID NO: 224391 - protein, 24 aa, Mycobacterium bovis
VVNDARFLVYPAMKALTLDIASMV

SEQ ID NO: 224392 - protein, 25 aa, Mycobacterium bovis
VVNLNGLDFMGCCAVAVLAHKAERC

SEQ ID NO: 224393 - protein, 30 aa, Mycobacterium bovis
VVPDITIPGIPLSLNALGGVGPIVVPDITI

SEQ ID NO: 224394 - protein, 17 aa, Mycobacterium bovis
VVPLLELASAEQQDRFL

SEQ ID NO: 224395 - protein, 19 aa, Mycobacterium bovis
VVPSMRPAPYSVAPGVDCV

SEQ ID NO: 224396 - protein, 25 aa, Mycobacterium bovis
VVPSTPGDAYWLLRHAIACPDPVMY

SEQ ID NO: 224397 - protein, 18 aa, Mycobacterium bovis
VVPVLPLSDTIKAVDANG

SEQ ID NO: 224398 - protein, 17 aa, Mycobacterium bovis
VVPVMFDRIMDLPAEIR

SEQ ID NO: 224399 - protein, 17 aa, Mycobacterium bovis
VVRDRVRTEPPLPGTRY

SEQ ID NO: 224400 - protein, 20 aa, Mycobacterium bovis
VVRFIVPRYVQDDPSLAGVL

SEQ ID NO: 224401 - protein, 25 aa, Mycobacterium bovis
VVRGELFTAFVPFAARWPVEVHIYP

SEQ ID NO: 224402 - protein, 26 aa, Mycobacterium bovis
VVRRARFAAAFTFQYSKRPGTPAAQL

SEQ ID NO: 224403 - protein, 24 aa, Mycobacterium bovis
VVRTRGRLWLANRPDQVMWLESAG

SEQ ID NO: 224404 - protein, 18 aa, Mycobacterium bovis
VVRVSALKALEGDAKWVA

SEQ ID NO: 224405 - protein, 33 aa, Mycobacterium bovis
VVSRARLQLAIAWANILLQRPAPATGALNRFET

SEQ ID NO: 224406 - protein, 24 aa, Mycobacterium bovis
VVSTLIVEPWMGPAAAAMAAAATP

SEQ ID NO: 224407 - protein, 27 aa, Mycobacterium bovis
VVSVDLPLAQLALQRLAAGLGVPHPDT

SEQ ID NO: 224408 - protein, 24 aa, Mycobacterium bovis
VVTSVLERDISWEALVCGGVTALP

SEQ ID NO: 224409 - protein, 17 aa, Mycobacterium bovis
VVVGENFTFGKKAAGNV

SEQ ID NO: 224410 - protein, 19 aa, Mycobacterium bovis
VVVQTMVAPGLLSWRDIAR

SEQ ID NO: 224411 - protein, 19 aa, Mycobacterium bovis
VVVVEWGEGLAERLSQRHL

SEQ ID NO: 224412 - protein, 30 aa, Mycobacterium bovis
VVVVNFLSLPVRRWPLKPFTQRAYQLRSTH

SEQ ID NO: 224413 - protein, 32 aa, Mycobacterium bovis
VVWQRLHQVDPAHLWWIRSQLRSMLVEDVRAR

SEQ ID NO: 224414 - protein, 18 aa, Mycobacterium bovis
VVYRRDEVSRWISKRESA

SEQ ID NO: 224415 - protein, 18 aa, Mycobacterium bovis
VWCPLCALAALVTGEQHP

SEQ ID NO: 224416 - protein, 19 aa, Mycobacterium bovis
VWCRRRPNWVSRPRDSRRP

SEQ ID NO: 224417 - protein, 18 aa, Mycobacterium bovis
VWDIRRLLSWIRSQEEES

SEQ ID NO: 224418 - protein, 19 aa, Mycobacterium bovis
VWGAVPRVWEKLKAGIEFT

SEQ ID NO: 224419 - protein, 24 aa, Mycobacterium bovis
VWISGPQYQAWKHTQLIIDVVPGR

SEQ ID NO: 224420 - protein, 24 aa, Mycobacterium bovis
VWLCDHFLTISPGEYAKVAGIAAD

SEQ ID NO: 224421 - protein, 23 aa, Mycobacterium bovis
VWMDAYLAAFALTGGFELVTTDT

SEQ ID NO: 224422 - protein, 18 aa, Mycobacterium bovis
VYALINTYRVALPLHPEY

SEQ ID NO: 224423 - protein, 18 aa, Mycobacterium bovis
VYASLFTCGIAVPHMVAS

SEQ ID NO: 224424 - protein, 20 aa, Mycobacterium bovis
VYATPVDQRGWSSRAPRIVF

SEQ ID NO: 224425 - protein, 20 aa, Mycobacterium bovis
VYDLTGRLALPPLTLEILSR

SEQ ID NO: 224426 - protein, 25 aa, Mycobacterium bovis
VYERYMKYLTGCAKLFRVGYIDVNQ

SEQ ID NO: 224427 - protein, 17 aa, Mycobacterium bovis
VYGYFPAVSEGNDIVVL

SEQ ID NO: 224428 - protein, 19 aa, Mycobacterium bovis
VYKMPWGTMHPTTISAPIV

SEQ ID NO: 224429 - protein, 26 aa, Mycobacterium bovis
VYKRSLAVFFLSEPPEGFDTLRDFRR

SEQ ID NO: 224430 - protein, 25 aa, Mycobacterium bovis
VYPDGPAPYYGIYAGGRWGSLDAQW

SEQ ID NO: 224431 - protein, 18 aa, Mycobacterium bovis
VYQINYLRCIGCGLCIEA

SEQ ID NO: 224432 - protein, 20 aa, Mycobacterium bovis
VYRCDLGYGAKPWLIVSNNA

SEQ ID NO: 224433 - protein, 22 aa, Mycobacterium bovis
VYRGAEYSVDFVPKVRIEVVVD

SEQ ID NO: 224434 - protein, 20 aa, Mycobacterium bovis
VYRLTVEGVLPMPQSTHYPL

SEQ ID NO: 224435 - protein, 18 aa, Mycobacterium bovis
VYRVGQNVAWQRWTEIAF

SEQ ID NO: 224436 - protein, 23 aa, Mycobacterium bovis
VYTYWDYTQLRFPKKQGMRIDFI

SEQ ID NO: 224437 - protein, 22 aa, Mycobacterium bovis
VYYRAMFSGRVTSWNLRDQHMA

SEQ ID NO: 224438 - protein, 18 aa, Mycobacterium bovis
WAAAIPWSDIQKYWMMFL

SEQ ID NO: 224439 - protein, 18 aa, Mycobacterium bovis
WAARRSGLYYVPINTHLT

SEQ ID NO: 224440 - protein, 22 aa, Mycobacterium bovis
WACGVTVVLPPPGTVGAVDCRG

SEQ ID NO: 224441 - protein, 33 aa, Mycobacterium bovis
WADSPRAWPIRAPSRLQVWRTRATTARECSIRV

SEQ ID NO: 224442 - protein, 24 aa, Mycobacterium bovis
WAEGAAMFLLQRRSRATADRRRVL

SEQ ID NO: 224443 - protein, 21 aa, Mycobacterium bovis
WAERRRMFELPRSSWGDYDRS

SEQ ID NO: 224444 - protein, 20 aa, Mycobacterium bovis
WAGPIANWVAACDAMIALDA

SEQ ID NO: 224445 - protein, 22 aa, Mycobacterium bovis
WAHLQRQGFRWPSATVKTIMRA

SEQ ID NO: 224446 - protein, 27 aa, Mycobacterium bovis
WAKSLTQRTILRLLDPSISAAGILRAE

SEQ ID NO: 224447 - protein, 17 aa, Mycobacterium bovis
WAKTWEFQALLKARPVV

SEQ ID NO: 224448 - protein, 17 aa, Mycobacterium bovis
WALVRVGCAGQLVYSPA

SEQ ID NO: 224449 - protein, 17 aa, Mycobacterium bovis
WAMLRDVVDDPAFVLHG

SEQ ID NO: 224450 - protein, 17 aa, Mycobacterium bovis
WAPFRPPKVLSPLFPRP

SEQ ID NO: 224451 - protein, 20 aa, Mycobacterium bovis
WARHIRAVVRFGDSVRSAHC

SEQ ID NO: 224452 - protein, 18 aa, Mycobacterium bovis
WASVWTPQQPGRFEWLGL

SEQ ID NO: 224453 - protein, 24 aa, Mycobacterium bovis
WAVSSPRVLSDLFWMGRYGERAEN

SEQ ID NO: 224454 - protein, 17 aa, Mycobacterium bovis
WCVRLVQGGGFAGPLFD

SEQ ID NO: 224455 - protein, 24 aa, Mycobacterium bovis
WDAEAFYHPDPLTPGRMTTKWGGF

SEQ ID NO: 224456 - protein, 26 aa, Mycobacterium bovis
WDEVFRELSIPYLPVRWSTDNPDSIV

SEQ ID NO: 224457 - protein, 27 aa, Mycobacterium bovis
WDLELIGRIGWTCRDVWWAATQDPRAW

SEQ ID NO: 224458 - protein, 18 aa, Mycobacterium bovis
WDLTDWQGTPIRIGFVAR

SEQ ID NO: 224459 - protein, 19 aa, Mycobacterium bovis
WDVIGDTGIGFCLDTCHTW

SEQ ID NO: 224460 - protein, 25 aa, Mycobacterium bovis
WEDKRLGIIIAGFDRRRIPLVAEIS

SEQ ID NO: 224461 - protein, 22 aa, Mycobacterium bovis
WEDVFLQMRNQAHAIAWNGAGG

SEQ ID NO: 224462 - protein, 21 aa, Mycobacterium bovis
WEEFIPFLDYDVEIRRVPCST

SEQ ID NO: 224463 - protein, 17 aa, Mycobacterium bovis
WEGLAVDLWASASSFES

SEQ ID NO: 224464 - protein, 17 aa, Mycobacterium bovis
WEGRAVGLAQRWGSRNP

SEQ ID NO: 224465 - protein, 31 aa, Mycobacterium bovis
WEQDPDVLDTWFSSALWPFSTLGWPDKTAEL

SEQ ID NO: 224466 - protein, 29 aa, Mycobacterium bovis
WEWTTSPLRPWPGFVPMVYERYSQPFFGG

SEQ ID NO: 224467 - protein, 17 aa, Mycobacterium bovis
WFPNFCTGELTTAIAMT

SEQ ID NO: 224468 - protein, 32 aa, Mycobacterium bovis
WGADPIDMGMGGSIPFIAEFAAAFPQATILVT

SEQ ID NO: 224469 - protein, 24 aa, Mycobacterium bovis
WGQARHNYFLRPSDLARAIAFVAE

SEQ ID NO: 224470 - protein, 27 aa, Mycobacterium bovis
WGRLFVAVCYALRTPTTRSPLTQPTVR

SEQ ID NO: 224471 - protein, 23 aa, Mycobacterium bovis
WGSDAYTPLAWWGSSTQRVRLGT

SEQ ID NO: 224472 - protein, 29 aa, Mycobacterium bovis
WGVGFFDGAIPRRWRSPAPLWGDTSFHSV

SEQ ID NO: 224473 - protein, 20 aa, Mycobacterium bovis
WGVVNGTKAFLPHLIASGDG

SEQ ID NO: 224474 - protein, 21 aa, Mycobacterium bovis
WGVVTEKGRWYLVGHDRDRDA

SEQ ID NO: 224475 - protein, 17 aa, Mycobacterium bovis
WHLRMQAAVQRHVEAAV

SEQ ID NO: 224476 - protein, 20 aa, Mycobacterium bovis
WIDRTAQFASGAIVFSIGVL

SEQ ID NO: 224477 - protein, 26 aa, Mycobacterium bovis
WIRDSTFALWGLYTLGLDREADDFFA

SEQ ID NO: 224478 - protein, 25 aa, Mycobacterium bovis
WKASLQGVLATRPDFVFGAEPYNAD

SEQ ID NO: 224479 - protein, 17 aa, Mycobacterium bovis
WKGYLKPGSRDDASEIH

SEQ ID NO: 224480 - protein, 22 aa, Mycobacterium bovis
WKYLMALFSSKIDEHADPKVQI

SEQ ID NO: 224481 - protein, 17 aa, Mycobacterium bovis
WLALALSGHVHHRASRA

SEQ ID NO: 224482 - protein, 17 aa, Mycobacterium bovis
WLAVLRAQAELGVAVAD

SEQ ID NO: 224483 - protein, 19 aa, Mycobacterium bovis
WLDHLMVDYDEQQRWVVMR

SEQ ID NO: 224484 - protein, 20 aa, Mycobacterium bovis
WLEEVLRPALGERLRVLDGW

SEQ ID NO: 224485 - protein, 18 aa, Mycobacterium bovis
WLLAQPDKPDLVFEATSA

SEQ ID NO: 224486 - protein, 24 aa, Mycobacterium bovis
WLLNGQKIWSSRAPFADMGFGLFR

SEQ ID NO: 224487 - protein, 19 aa, Mycobacterium bovis
WLPGEQLLRPDELARLIHI

SEQ ID NO: 224488 - protein, 19 aa, Mycobacterium bovis
WLRGRLPTLNDWLRGIPVL

SEQ ID NO: 224489 - protein, 17 aa, Mycobacterium bovis
WLRGTTVVRGYLGDPTI

SEQ ID NO: 224490 - protein, 19 aa, Mycobacterium bovis
WLVAADGLHSAVRRAVGIK

SEQ ID NO: 224491 - protein, 26 aa, Mycobacterium bovis
WMYEGKHVLIIFDDLTKQAEAYRAIS

SEQ ID NO: 224492 - protein, 20 aa, Mycobacterium bovis
WNEITPCNLSLDRLANAVKE

SEQ ID NO: 224493 - protein, 23 aa, Mycobacterium bovis
WNGRAGDYVAIPPTRHALHAVED

SEQ ID NO: 224494 - protein, 18 aa, Mycobacterium bovis
WNMVATVDAFLSSGFSPA

SEQ ID NO: 224495 - protein, 23 aa, Mycobacterium bovis
WNPQRRARVLMRFIELVNDTIDE

SEQ ID NO: 224496 - protein, 17 aa, Mycobacterium bovis
WPALAHGPLTLKGFDAP

SEQ ID NO: 224497 - protein, 25 aa, Mycobacterium bovis
WPGAYGTWWQADPSADLILLYLIQH

SEQ ID NO: 224498 - protein, 21 aa, Mycobacterium bovis
WPGRRFEGAGPAGWIRRCATS

SEQ ID NO: 224499 - protein, 17 aa, Mycobacterium bovis
WPKVFRPPVIAATVTTP

SEQ ID NO: 224500 - protein, 25 aa, Mycobacterium bovis
WPLPTAITPHHLWLRAVAAGGQGRY

SEQ ID NO: 224501 - protein, 24 aa, Mycobacterium bovis
WPLRTFECTVPPGRLGWGWARFAF

SEQ ID NO: 224502 - protein, 17 aa, Mycobacterium bovis
WPQPQVLCTMRLARRVL

SEQ ID NO: 224503 - protein, 17 aa, Mycobacterium bovis
WPTALQAAGFDSAAPTA

SEQ ID NO: 224504 - protein, 19 aa, Mycobacterium bovis
WPTIFNPMTYAGMARLAVI

SEQ ID NO: 224505 - protein, 25 aa, Mycobacterium bovis
WPVAGRMMGRLGWYVESMLSPRLHR

SEQ ID NO: 224506 - protein, 18 aa, Mycobacterium bovis
WQGLGASVTLLARGSGLL

SEQ ID NO: 224507 - protein, 19 aa, Mycobacterium bovis
WQPGAAQGYHMTTFGFILG

SEQ ID NO: 224508 - protein, 19 aa, Mycobacterium bovis
WQRLCTELELPALHVPPEH

SEQ ID NO: 224509 - protein, 27 aa, Mycobacterium bovis
WRAGNRAPLPVLLPSMRRGGVAAVSET

SEQ ID NO: 224510 - protein, 20 aa, Mycobacterium bovis
WRAPSKLAYIDAGLIDLIRV

SEQ ID NO: 224511 - protein, 22 aa, Mycobacterium bovis
WRARGRLQEGLAWFAAALADHD

SEQ ID NO: 224512 - protein, 24 aa, Mycobacterium bovis
WRDPRVWWQLRNPFTPSWGEPYVD

SEQ ID NO: 224513 - protein, 25 aa, Mycobacterium bovis
WRDYFDVYDMFKGLLRGLVALVVPS

SEQ ID NO: 224514 - protein, 17 aa, Mycobacterium bovis
WRERFMQRRDGLAHLGF

SEQ ID NO: 224515 - protein, 20 aa, Mycobacterium bovis
WRSDRALVESLQTVLRDATL

SEQ ID NO: 224516 - protein, 17 aa, Mycobacterium bovis
WRVLRLLRTVGMHHALG

SEQ ID NO: 224517 - protein, 21 aa, Mycobacterium bovis
WRVRAYGDFLSYCLVAEGAVD

SEQ ID NO: 224518 - protein, 33 aa, Mycobacterium bovis
WRYDTGEELELLNRLWPLVSLRCNFFTPTKKPV

SEQ ID NO: 224519 - protein, 21 aa, Mycobacterium bovis
WSATESMRIELAPRGVQVVGV

SEQ ID NO: 224520 - protein, 23 aa, Mycobacterium bovis
WSIGRDILLAPPQRAGRSLFFAG

SEQ ID NO: 224521 - protein, 25 aa, Mycobacterium bovis
WSPEALAWPLLAVIDASLDEPWCRT

SEQ ID NO: 224522 - protein, 25 aa, Mycobacterium bovis
WSQLYRRMLNVAEPLRHVGATGDRA

SEQ ID NO: 224523 - protein, 18 aa, Mycobacterium bovis
WSRPLEKVYAAVFIDAIM

SEQ ID NO: 224524 - protein, 24 aa, Mycobacterium bovis
WTDELAQLPSLLAEKVRAPSVMPG

SEQ ID NO: 224525 - protein, 17 aa, Mycobacterium bovis
WTDLGMFPVLGMDWRER

SEQ ID NO: 224526 - protein, 18 aa, Mycobacterium bovis
WTGTVRIAGFYASICNAV

SEQ ID NO: 224527 - protein, 19 aa, Mycobacterium bovis
WTSLAHLSQWCFVLARTEK

SEQ ID NO: 224528 - protein, 18 aa, Mycobacterium bovis
WVAALRNSLRARRDRLAA

SEQ ID NO: 224529 - protein, 35 aa, Mycobacterium bovis
WVDDMHDWCISRQLWWGHRIPIWYGPDGEQVCVGP

SEQ ID NO: 224530 - protein, 17 aa, Mycobacterium bovis
WVDIRFTLPANTVDGGT

SEQ ID NO: 224531 - protein, 17 aa, Mycobacterium bovis
WVDWFNHRRLYQYCGDV

SEQ ID NO: 224532 - protein, 17 aa, Mycobacterium bovis
WVGFPTVDQIERAVFDM

SEQ ID NO: 224533 - protein, 25 aa, Mycobacterium bovis
WVGYLERDVFPGGCFFAAAAADVDS

SEQ ID NO: 224534 - protein, 24 aa, Mycobacterium bovis
WVNTIFLSTRFRAWRVGGYNEYLY

SEQ ID NO: 224535 - protein, 17 aa, Mycobacterium bovis
WVPSINPGLNFYFGQPQ

SEQ ID NO: 224536 - protein, 19 aa, Mycobacterium bovis
WVRAQLLHYIAAHRISIST

SEQ ID NO: 224537 - protein, 25 aa, Mycobacterium bovis
WVSISVGCNNSCTFCIVPSLRGREV

SEQ ID NO: 224538 - protein, 18 aa, Mycobacterium bovis
WVSPVDTIVRVRTGERGH

SEQ ID NO: 224539 - protein, 20 aa, Mycobacterium bovis
WVTGLFSRGWSNLESFFAGV

SEQ ID NO: 224540 - protein, 18 aa, Mycobacterium bovis
WVVPHFEKMLYDNALLLR

SEQ ID NO: 224541 - protein, 19 aa, Mycobacterium bovis
WVWVLDPIDGTINHAAGSP

SEQ ID NO: 224542 - protein, 17 aa, Mycobacterium bovis
WWAQRFGIEPDLAEALV

SEQ ID NO: 224543 - protein, 18 aa, Mycobacterium bovis
WWCRMVVMSAERIARRGG

SEQ ID NO: 224544 - protein, 25 aa, Mycobacterium bovis
WWDASYLVMWGSNVPITRTPDAHWM

SEQ ID NO: 224545 - protein, 17 aa, Mycobacterium bovis
WWHSLTPGQQDRVKQWF

SEQ ID NO: 224546 - protein, 17 aa, Mycobacterium bovis
WWNQAPSALLGAGSGVG

SEQ ID NO: 224547 - protein, 19 aa, Mycobacterium bovis
WWVRRRLHEVAVHRADVAI

SEQ ID NO: 224548 - protein, 18 aa, Mycobacterium bovis
WYAELGRRHELLSGLVPQ

SEQ ID NO: 224549 - protein, 17 aa, Mycobacterium bovis
WYGLQDLARIKAGDKVL

SEQ ID NO: 224550 - protein, 17 aa, Mycobacterium bovis
WYGSSLVVADRWFPSSK

SEQ ID NO: 224551 - protein, 17 aa, Mycobacterium bovis
YAAQHIPLVVFGGKEYG

SEQ ID NO: 224552 - protein, 24 aa, Mycobacterium bovis
YAAYYEQWAQPWEIQALLRAHAVA

SEQ ID NO: 224553 - protein, 19 aa, Mycobacterium bovis
YACVESYAPALRSEALRER

SEQ ID NO: 224554 - protein, 25 aa, Mycobacterium bovis
YADGKRSGLWPGLRETFKSGSSQPP

SEQ ID NO: 224555 - protein, 22 aa, Mycobacterium bovis
YADVLGYFRRIENVTAAWHFVS

SEQ ID NO: 224556 - protein, 20 aa, Mycobacterium bovis
YAFSAGGPVLWPDLEAILVV

SEQ ID NO: 224557 - protein, 23 aa, Mycobacterium bovis
YANDPAWIMRDKGDRLAYNRVWV

SEQ ID NO: 224558 - protein, 19 aa, Mycobacterium bovis
YAPFYAFVSHDGRRVIPAP

SEQ ID NO: 224559 - protein, 17 aa, Mycobacterium bovis
YARGVLVEMYREAKTRL

SEQ ID NO: 224560 - protein, 23 aa, Mycobacterium bovis
YARVCVDLLKPRKAQPLLPGIGK

SEQ ID NO: 224561 - protein, 31 aa, Mycobacterium bovis
YATHNEPMIPIYIFYSMFGFQRTGDSFWAAA

SEQ ID NO: 224562 - protein, 19 aa, Mycobacterium bovis
YATQLMTELSERGEKLPAA

SEQ ID NO: 224563 - protein, 18 aa, Mycobacterium bovis
YAVPRLLARNGLSLQDFD

SEQ ID NO: 224564 - protein, 20 aa, Mycobacterium bovis
YCHCMFTALDTLPAERYQPW

SEQ ID NO: 224565 - protein, 26 aa, Mycobacterium bovis
YDAFFSLAHRLLPADGVMLLHTITGL

SEQ ID NO: 224566 - protein, 24 aa, Mycobacterium bovis
YDAGTGIALIIRPPTRRAMAPRVY

SEQ ID NO: 224567 - protein, 18 aa, Mycobacterium bovis
YDAVWRWIDWPERRGRTD

SEQ ID NO: 224568 - protein, 26 aa, Mycobacterium bovis
YDCARLRFILTAQRDHYLPLKVIRAQ

SEQ ID NO: 224569 - protein, 19 aa, Mycobacterium bovis
YDDFFKRCFNIMPADGRMT

SEQ ID NO: 224570 - protein, 20 aa, Mycobacterium bovis
YDDPFMSWLLSNDNARTARL

SEQ ID NO: 224571 - protein, 25 aa, Mycobacterium bovis
YDESLWRLLCEQVGAAALVIPEELG

SEQ ID NO: 224572 - protein, 20 aa, Mycobacterium bovis
YDGRALIKDLSFSLPRNGIV

SEQ ID NO: 224573 - protein, 29 aa, Mycobacterium bovis
YDISDDFFALFLDPTWVYTCAYFERDDMT

SEQ ID NO: 224574 - protein, 19 aa, Mycobacterium bovis
YDPIWPRHGIRIIPGPSSL

SEQ ID NO: 224575 - protein, 17 aa, Mycobacterium bovis
YDQLAATGDFRRGSISE

SEQ ID NO: 224576 - protein, 21 aa, Mycobacterium bovis
YDQLRRYPWPQGHTMSVLSNA

SEQ ID NO: 224577 - protein, 23 aa, Mycobacterium bovis
YDRYMKYLTGCAKLFRQGYTDVD

SEQ ID NO: 224578 - protein, 18 aa, Mycobacterium bovis
YDVIIRDGLWFDGTGNAP

SEQ ID NO: 224579 - protein, 17 aa, Mycobacterium bovis
YDVLVGINLLREGLDLP

SEQ ID NO: 224580 - protein, 29 aa, Mycobacterium bovis
YEAIALVQKIAFSLPDKYYDRVDVAVIPP

SEQ ID NO: 224581 - protein, 25 aa, Mycobacterium bovis
YEEPAFDIFALVPPPVGSGLGRIGR

SEQ ID NO: 224582 - protein, 27 aa, Mycobacterium bovis
YEGGPTPVLQWLLYPRTDFTAQTRSMG

SEQ ID NO: 224583 - protein, 30 aa, Mycobacterium bovis
YEKTHLPPGAWPPTSWYADWIRGLDVFTTN

SEQ ID NO: 224584 - protein, 19 aa, Mycobacterium bovis
YELEIAFAEILRLSPSSGG

SEQ ID NO: 224585 - protein, 24 aa, Mycobacterium bovis
YERYMKYLTGCAKAFRMGYIDCNQ

SEQ ID NO: 224586 - protein, 22 aa, Mycobacterium bovis
YEVHLGSWRPGLSYRQLARELT

SEQ ID NO: 224587 - protein, 18 aa, Mycobacterium bovis
YEWVLGPSMTYTCAVFPN

SEQ ID NO: 224588 - protein, 23 aa, Mycobacterium bovis
YFMIVFSGPIPDDKWLQAVQIVK

SEQ ID NO: 224589 - protein, 17 aa, Mycobacterium bovis
YFNDHGAQIDRFANSLI

SEQ ID NO: 224590 - protein, 25 aa, Mycobacterium bovis
YFPGDNYRYPHWDYNPHDSPTARWQ

SEQ ID NO: 224591 - protein, 17 aa, Mycobacterium bovis
YFPRFRALCMAENATHN

SEQ ID NO: 224592 - protein, 17 aa, Mycobacterium bovis
YGATLRITRLRPSGRGT

SEQ ID NO: 224593 - protein, 17 aa, Mycobacterium bovis
YGDERIFAALAKRLPKL

SEQ ID NO: 224594 - protein, 23 aa, Mycobacterium bovis
YGDLSVLRRLVPAGPLASLAHST

SEQ ID NO: 224595 - protein, 26 aa, Mycobacterium bovis
YGDRDWLARQFDLAAGAPVGCGFITW

SEQ ID NO: 224596 - protein, 19 aa, Mycobacterium bovis
YGFSRMPFGRDLAPGMLHR

SEQ ID NO: 224597 - protein, 23 aa, Mycobacterium bovis
YGITIPQFPIRITTTGGIGPIVI

SEQ ID NO: 224598 - protein, 19 aa, Mycobacterium bovis
YGKKLSWADLIVFAGNCAL

SEQ ID NO: 224599 - protein, 17 aa, Mycobacterium bovis
YGLTWKWPDVDCAHPLD

SEQ ID NO: 224600 - protein, 25 aa, Mycobacterium bovis
YGNAIINTLLLYMENHRDELVVFGA

SEQ ID NO: 224601 - protein, 35 aa, Mycobacterium bovis
YGNTRLGLFPFRRGLTFYYLDLALMSVTQPDRVRE

SEQ ID NO: 224602 - protein, 27 aa, Mycobacterium bovis
YGPDGLALPMRLALPGSVNRGNAAQAV

SEQ ID NO: 224603 - protein, 26 aa, Mycobacterium bovis
YGQAKLANLLFTYELQRRLAPGGTTI

SEQ ID NO: 224604 - protein, 25 aa, Mycobacterium bovis
YGQAKLANLLFTYELQRRLGEAGKS

SEQ ID NO: 224605 - protein, 21 aa, Mycobacterium bovis
YGQRLAAFVVLKPGVSATPET

SEQ ID NO: 224606 - protein, 25 aa, Mycobacterium bovis
YGRRRTFLTLLGDPTVRRIVMKRRD

SEQ ID NO: 224607 - protein, 21 aa, Mycobacterium bovis
YGRYWREVFRLPTMNHRKLAR

SEQ ID NO: 224608 - protein, 27 aa, Mycobacterium bovis
YGSASILPITWAYIRMMGAEGLRAASL

SEQ ID NO: 224609 - protein, 17 aa, Mycobacterium bovis
YGVLYHLSRPAEALAWM

SEQ ID NO: 224610 - protein, 17 aa, Mycobacterium bovis
YGWGLDLDLALRARKSG

SEQ ID NO: 224611 - protein, 17 aa, Mycobacterium bovis
YHGGEFIDLIVGGSTYD

SEQ ID NO: 224612 - protein, 28 aa, Mycobacterium bovis
YHIGRRQLHSHLRVRSLAIQRLAGRCHH

SEQ ID NO: 224613 - protein, 28 aa, Mycobacterium bovis
YHLSRPAEALAWMCDRAVDLLLLETCVS

SEQ ID NO: 224614 - protein, 20 aa, Mycobacterium bovis
YHRDLPEETLRWLYEMMVVT

SEQ ID NO: 224615 - protein, 19 aa, Mycobacterium bovis
YHTFGGWKRSGFGDLNQHG

SEQ ID NO: 224616 - protein, 19 aa, Mycobacterium bovis
YHWGASAAMIRGLRRTHGW

SEQ ID NO: 224617 - protein, 18 aa, Mycobacterium bovis
YIDAGLIDLIRVIRELNI

SEQ ID NO: 224618 - protein, 18 aa, Mycobacterium bovis
YIDYSKHRVTRETLALLI

SEQ ID NO: 224619 - protein, 20 aa, Mycobacterium bovis
YIITGGLGGLGLFLAEKMAN

SEQ ID NO: 224620 - protein, 19 aa, Mycobacterium bovis
YIPVVGHALSAAFQAPFCA

SEQ ID NO: 224621 - protein, 18 aa, Mycobacterium bovis
YIRHCREQWVTGGPLRSF

SEQ ID NO: 224622 - protein, 25 aa, Mycobacterium bovis
YISNIIYEGPGADSLFFASGQLREL

SEQ ID NO: 224623 - protein, 19 aa, Mycobacterium bovis
YKEFELLKYLAQHAGRVFT

SEQ ID NO: 224624 - protein, 18 aa, Mycobacterium bovis
YKLFKRYASHEGGIADPA

SEQ ID NO: 224625 - protein, 18 aa, Mycobacterium bovis
YKRIRILGGHRLGMMMRI

SEQ ID NO: 224626 - protein, 19 aa, Mycobacterium bovis
YLAIFDRGKALALYHTKRL

SEQ ID NO: 224627 - protein, 18 aa, Mycobacterium bovis
YLANMGLRPWPPPGRLRA

SEQ ID NO: 224628 - protein, 19 aa, Mycobacterium bovis
YLDGMLLPEAILANRLSPA

SEQ ID NO: 224629 - protein, 17 aa, Mycobacterium bovis
YLDRRNNVLKLSQGEFI

SEQ ID NO: 224630 - protein, 17 aa, Mycobacterium bovis
YLGPPPVPTSSPPTTPA

SEQ ID NO: 224631 - protein, 29 aa, Mycobacterium bovis
YLGVAVHGFPNYFFITGPDTAAQARCVVE

SEQ ID NO: 224632 - protein, 19 aa, Mycobacterium bovis
YLIDQPLMRNVLADLAVEA

SEQ ID NO: 224633 - protein, 28 aa, Mycobacterium bovis
YLIGKSYRFRRLELARFLAALHATVLDN

SEQ ID NO: 224634 - protein, 17 aa, Mycobacterium bovis
YLLEYWTETVRTVGVRR

SEQ ID NO: 224635 - protein, 21 aa, Mycobacterium bovis
YLNRELSWLDFNARVLALAAD

SEQ ID NO: 224636 - protein, 36 aa, Mycobacterium bovis
YLNRVFDYLMVSLRSLPLVMLIGRPEAQIPVVSFAV

SEQ ID NO: 224637 - protein, 17 aa, Mycobacterium bovis
YLNWESRSWRLTATGDY

SEQ ID NO: 224638 - protein, 17 aa, Mycobacterium bovis
YLPMERGRYVITPEQVL

SEQ ID NO: 224639 - protein, 19 aa, Mycobacterium bovis
YLPSELVAAFLWAQFEEAE

SEQ ID NO: 224640 - protein, 18 aa, Mycobacterium bovis
YLRCLRVLTAGRGYPMVA

SEQ ID NO: 224641 - protein, 18 aa, Mycobacterium bovis
YLRTLVDVGLGYVRLGQP

SEQ ID NO: 224642 - protein, 18 aa, Mycobacterium bovis
YLSPAPMYHTAPSVWTMS

SEQ ID NO: 224643 - protein, 18 aa, Mycobacterium bovis
YLTEVSVPALLRGLARSG

SEQ ID NO: 224644 - protein, 17 aa, Mycobacterium bovis
YLVGGSVRDALLGRLSP

SEQ ID NO: 224645 - protein, 20 aa, Mycobacterium bovis
YNKLFEERIIFLGVQVDDAS

SEQ ID NO: 224646 - protein, 28 aa, Mycobacterium bovis
YNLGFALPIALPRRTVVTFTPEHTGAIT

SEQ ID NO: 224647 - protein, 29 aa, Mycobacterium bovis
YNNVIQPFINWLTNLPFLQAMFSGFDPWL

SEQ ID NO: 224648 - protein, 33 aa, Mycobacterium bovis
YPAELAYFEVLHELKLIVDLMYEGGLARMYYSV

SEQ ID NO: 224649 - protein, 27 aa, Mycobacterium bovis
YPDGVWYVNLAPITDPALVPIAAARVL

SEQ ID NO: 224650 - protein, 19 aa, Mycobacterium bovis
YPEAVLARELELCYAAIAL

SEQ ID NO: 224651 - protein, 18 aa, Mycobacterium bovis
YPGDAGVLAALLLNRISL

SEQ ID NO: 224652 - protein, 27 aa, Mycobacterium bovis
YPKFLDRNLIGHVPLIGGGLSLLLSDG

SEQ ID NO: 224653 - protein, 27 aa, Mycobacterium bovis
YPLGEALLALYRWRGPLINAGVGGHGY

SEQ ID NO: 224654 - protein, 26 aa, Mycobacterium bovis
YPNHDIATVVDWMLLAAINALIAGDQ

SEQ ID NO: 224655 - protein, 17 aa, Mycobacterium bovis
YPRVEVMQANLAELPLP

SEQ ID NO: 224656 - protein, 20 aa, Mycobacterium bovis
YQAVRTNFFDTYFASAVAAG

SEQ ID NO: 224657 - protein, 23 aa, Mycobacterium bovis
YQGYGVFVVPVSARWKFLAENTK

SEQ ID NO: 224658 - protein, 18 aa, Mycobacterium bovis
YQQLVLIRQLVADFNLDV

SEQ ID NO: 224659 - protein, 18 aa, Mycobacterium bovis
YQRFRGAEIAGLTAGLVG

SEQ ID NO: 224660 - protein, 23 aa, Mycobacterium bovis
YRAERYLGIIERVRAAIPHAAIT

SEQ ID NO: 224661 - protein, 21 aa, Mycobacterium bovis
YRARSTGQRPSWAPLPVQYAD

SEQ ID NO: 224662 - protein, 28 aa, Mycobacterium bovis
YRDDLRHEKLLFKKGIHLLDCGTSGGVW

SEQ ID NO: 224663 - protein, 24 aa, Mycobacterium bovis
YRESLGFEVLPLSGGERPPFEVLC

SEQ ID NO: 224664 - protein, 19 aa, Mycobacterium bovis
YRFRARPFDLVSSPSVCEH

SEQ ID NO: 224665 - protein, 34 aa, Mycobacterium bovis
YRGPRRKGVRYFGPYSHAWAIRETLDLLTRVFPA

SEQ ID NO: 224666 - protein, 28 aa, Mycobacterium bovis
YRIWLEQNKQRWLAFFQAEGGAAAARWI

SEQ ID NO: 224667 - protein, 22 aa, Mycobacterium bovis
YRKLRDAWLTARRDLVDRRNRA

SEQ ID NO: 224668 - protein, 18 aa, Mycobacterium bovis
YRLQTFGTVTRLAAGGEL

SEQ ID NO: 224669 - protein, 24 aa, Mycobacterium bovis
YRLRDPLNRSLRYGVKTMFATAGA

SEQ ID NO: 224670 - protein, 24 aa, Mycobacterium bovis
YRPALQQVAAWYWTLKHPEQSGSV

SEQ ID NO: 224671 - protein, 23 aa, Mycobacterium bovis
YRQETIRIFGLPESSLADTLRDA

SEQ ID NO: 224672 - protein, 19 aa, Mycobacterium bovis
YRQIFYAELPECLNALSAD

SEQ ID NO: 224673 - protein, 24 aa, Mycobacterium bovis
YRRIDDAFLDPLQFRADSVLGVAG

SEQ ID NO: 224674 - protein, 22 aa, Mycobacterium bovis
YRTRWEIPIGLRETDLTPAHCH

SEQ ID NO: 224675 - protein, 23 aa, Mycobacterium bovis
YSEWTPEGRLRQSSWRGLRPDKK

SEQ ID NO: 224676 - protein, 17 aa, Mycobacterium bovis
YSFPMKKKPNRKCLRIT

SEQ ID NO: 224677 - protein, 46 aa, Mycobacterium bovis
YSGLDLPPNTAVTVIFFGPVDIDPFTVPVIRITGPTPVVMVGGPTT

SEQ ID NO: 224678 - protein, 25 aa, Mycobacterium bovis
YSGVMWACVFMRTGARRVHFGEIEK

SEQ ID NO: 224679 - protein, 26 aa, Mycobacterium bovis
YSKNITALLDLLIKDGRLAPDFDDEV

SEQ ID NO: 224680 - protein, 20 aa, Mycobacterium bovis
YSLDVPRITILDAHFTGAFG

SEQ ID NO: 224681 - protein, 33 aa, Mycobacterium bovis
YSNTRLELLPFRRNLAFYGLDLGLMSVSHPAAV

SEQ ID NO: 224682 - protein, 31 aa, Mycobacterium bovis
YSPLPATHIGGLWWILTCLMHGGLCVTGGEN

SEQ ID NO: 224683 - protein, 17 aa, Mycobacterium bovis
YSQPFFGGDYRVLRGGS

SEQ ID NO: 224684 - protein, 19 aa, Mycobacterium bovis
YSRMCLTTFFTSLTQRFPQ

SEQ ID NO: 224685 - protein, 24 aa, Mycobacterium bovis
YSTPHASIPYVPPPYRSDGIHASR

SEQ ID NO: 224686 - protein, 17 aa, Mycobacterium bovis
YSTRLRIQLEPVRPFVA

SEQ ID NO: 224687 - protein, 29 aa, Mycobacterium bovis
YSYIENYAPRPLLDLPWDIQESPAGMAVA

SEQ ID NO: 224688 - protein, 17 aa, Mycobacterium bovis
YTDEIFGPVLCMVRARD

SEQ ID NO: 224689 - protein, 26 aa, Mycobacterium bovis
YTGIDPYFDDLFLMAAERRFLSVERI

SEQ ID NO: 224690 - protein, 34 aa, Mycobacterium bovis
YTGNTHYYMFLTQDLPLLQPIRAIPFVGTPIAEL

SEQ ID NO: 224691 - protein, 35 aa, Mycobacterium bovis
YTGNTQYYMFLTQDLPLLQPIRDIPYAGPPIADLF

SEQ ID NO: 224692 - protein, 22 aa, Mycobacterium bovis
YTHKIMTPMFTPEPQPYPVPRV

SEQ ID NO: 224693 - protein, 21 aa, Mycobacterium bovis
YTNTPFFLSTILPSSNTVSTA

SEQ ID NO: 224694 - protein, 18 aa, Mycobacterium bovis
YTQLARLLRDRHGHQVYS

SEQ ID NO: 224695 - protein, 17 aa, Mycobacterium bovis
YTRRLLGAVPQPDPARR

SEQ ID NO: 224696 - protein, 35 aa, Mycobacterium bovis
YTSADIRALYAFKRYAWWPYTLVMRRVNVFFTRAL

SEQ ID NO: 224697 - protein, 43 aa, Mycobacterium bovis
YVAAEAVNVEQSLLAAVNAPTQALFGRPLIGNGADGSPGTGQA

SEQ ID NO: 224698 - protein, 30 aa, Mycobacterium bovis
YVALRTEIDNWRWAGVPIFVRAGKELPAKV

SEQ ID NO: 224699 - protein, 27 aa, Mycobacterium bovis
YVAVFDSFVERIVPGGALVVCTDDPGG

SEQ ID NO: 224700 - protein, 21 aa, Mycobacterium bovis
YVDASYWRDMGTPEDFVRGSA

SEQ ID NO: 224701 - protein, 29 aa, Mycobacterium bovis
YVDDVALPGMLHLAILRSPYAHARIVRID

SEQ ID NO: 224702 - protein, 30 aa, Mycobacterium bovis
YVDLERRLFADLMWVYPFGDRHTAMTVLVC

SEQ ID NO: 224703 - protein, 24 aa, Mycobacterium bovis
YVDWLPAALAMHRRRRRMRFMIKA

SEQ ID NO: 224704 - protein, 17 aa, Mycobacterium bovis
YVEAMALSYIGDSAART

SEQ ID NO: 224705 - protein, 22 aa, Mycobacterium bovis
YVELFYGRPRTQSSWELVTDAL

SEQ ID NO: 224706 - protein, 20 aa, Mycobacterium bovis
YVFATPYIEAGDWRETLRNH

SEQ ID NO: 224707 - protein, 20 aa, Mycobacterium bovis
YVHNLIHGFILAAAHLVPDG

SEQ ID NO: 224708 - protein, 29 aa, Mycobacterium bovis
YVHNRLLTLLLFDIGSFAGLAALLNSAVV

SEQ ID NO: 224709 - protein, 20 aa, Mycobacterium bovis
YVKEDVAIRRLLSSGLERAG

SEQ ID NO: 224710 - protein, 17 aa, Mycobacterium bovis
YVLMLAALDLAATVEDE

SEQ ID NO: 224711 - protein, 21 aa, Mycobacterium bovis
YVLRIPDVLPLDVAAPLLCAG

SEQ ID NO: 224712 - protein, 17 aa, Mycobacterium bovis
YVNQRWLGGMLTNFSTV

SEQ ID NO: 224713 - protein, 18 aa, Mycobacterium bovis
YVRKPPYFEGMTAKPEPV

SEQ ID NO: 224714 - protein, 28 aa, Mycobacterium bovis
YVRPSWLRRWVRDGYAWVQPRLSPVARA

SEQ ID NO: 224715 - protein, 24 aa, Mycobacterium bovis
YVRRAFSAPLRRAGAVLVTPVPHP

SEQ ID NO: 224716 - protein, 25 aa, Mycobacterium bovis
YVRRQRSWFRRDHRVHWLDAGVASS

SEQ ID NO: 224717 - protein, 18 aa, Mycobacterium bovis
YVRSFYFQDPDGITLEFA

SEQ ID NO: 224718 - protein, 23 aa, Mycobacterium bovis
YVSMPLFHSNAVLVGWAVAAACQ

SEQ ID NO: 224719 - protein, 18 aa, Mycobacterium bovis
YVSMPLFHSNAVVAGWAP

SEQ ID NO: 224720 - protein, 28 aa, Mycobacterium bovis
YVTTPGSALLFPALCTPTGDPPAPEPAR

SEQ ID NO: 224721 - protein, 17 aa, Mycobacterium bovis
YWRAIMADPPEPLELPG

SEQ ID NO: 224722 - protein, 31 aa, Mycobacterium bovis; identical to SEQ ID NO: 134219

SEQ ID NO: 224723 - protein, 18 aa, Mycobacterium bovis
YYNAIVWQDTRTDRIASA

SEQ ID NO: 224724 - protein, 17 aa, Mycobacterium bovis
YYPKRPAGVKLAPTSKL

SEQ ID NO: 224725 - protein, 17 aa, Mycobacterium bovis
YYSTIKDLTRLLGGPSH

SEQ ID NO: 224726 - protein, 25 aa, Mycobacterium bovis
YYTICELLHRHGFAGATVLLGVDGT

SEQ ID NO: 224727 - protein, 26 aa, Mycobacterium bovis
YYTRQDIPIHYLLADAFTVCDRYFCS

SEQ ID NO: 224728 - protein, 19 aa, Mycobacterium bovis
YYVQYAHARLSALARNAAE

SEQ ID NO: 224729 - protein, 21 aa, Mycobacterium bovis
AAAARKFGCGFAPSGWDSLTK

SEQ ID NO: 224730 - protein, 36 aa, Mycobacterium bovis
AAAEAAAVSPLLDPINEFFLANTGRPLIGNGANGAP

SEQ ID NO: 224731 - protein, 24 aa, Mycobacterium bovis
AAAILLTEWQLRNTPHVPIPYVYP

SEQ ID NO: 224732 - protein, 21 aa, Mycobacterium bovis
AAAPPRFDGLRALFINATLKR

SEQ ID NO: 224733 - protein, 25 aa, Mycobacterium bovis
AAFAIMQIKAIFSVLLREYEFEMAQ

SEQ ID NO: 224734 - protein, 20 aa, Mycobacterium bovis
AAGGLQLLIIISAGRTIAND

SEQ ID NO: 224735 - protein, 20 aa, Mycobacterium bovis
AAGYGAPGYDQGYRQSGGCG

SEQ ID NO: 224736 - protein, 17 aa, Mycobacterium bovis
AAIPRRRTDRRAYSCWP

SEQ ID NO: 224737 - protein, 25 aa, Mycobacterium bovis
AAKYPGTQWRFEYSPESYTGTELEY

SEQ ID NO: 224738 - protein, 26 aa, Mycobacterium bovis
AAMAAAVAPYLGWLAAAAAQAQRSAT

SEQ ID NO: 224739 - protein, 35 aa, Mycobacterium bovis
AANASPLQTLEQGLLGAINAPAAALSGRPFIGNGT

SEQ ID NO: 224740 - protein, 20 aa, Mycobacterium bovis
AAQGWGGRWLVVGADVDPGR

SEQ ID NO: 224741 - protein, 18 aa, Mycobacterium bovis
AASAWTGLAGDLGSAAAS

SEQ ID NO: 224742 - protein, 20 aa, Mycobacterium bovis
AASPFGIDIGIGGAGGHGGA

SEQ ID NO: 224743 - protein, 19 aa, Mycobacterium bovis
AATVLPYRQFHDVAENFRY

SEQ ID NO: 224744 - protein, 17 aa, Mycobacterium bovis
AAYGEWMATPPPTWEDI

SEQ ID NO: 224745 - protein, 22 aa, Mycobacterium bovis
ADAHCALWRALIGLDSMERISI

SEQ ID NO: 224746 - protein, 24 aa, Mycobacterium bovis
ADGASNWYTEFARLAPLMEKDVHY

SEQ ID NO: 224747 - protein, 23 aa, Mycobacterium bovis
ADTETIFGVVRFALPDVSRQAVY

SEQ ID NO: 224748 - protein, 20 aa, Mycobacterium bovis
ADVFVHYTEIQGTGFRTLEE

SEQ ID NO: 224749 - protein, 20 aa, Mycobacterium bovis
AEAFVLAEKLGLSAQSLFDV

SEQ ID NO: 224750 - protein, 19 aa, Mycobacterium bovis
AEDLLAEPLQFSIVLGVRG

SEQ ID NO: 224751 - protein, 21 aa, Mycobacterium bovis
AEFERPVLLFSGGKDSIVMLH

SEQ ID NO: 224752 - protein, 17 aa, Mycobacterium bovis
AEKVTGIFLVPAQWQAV

SEQ ID NO: 224753 - protein, 26 aa, Mycobacterium bovis
AELTIDALINRVVPIPGLRSTEAQWA

SEQ ID NO: 224754 - protein, 24 aa, Mycobacterium bovis
AERGYGYGLAFRGLTAMWRRGDEV

SEQ ID NO: 224755 - protein, 19 aa, Mycobacterium bovis
AFFLYMETPSQPLNVCCVL

SEQ ID NO: 224756 - protein, 26 aa, Mycobacterium bovis
AFGASFLARIFPPGSHIPIPFIEYTM

SEQ ID NO: 224757 - protein, 17 aa, Mycobacterium bovis
AFLPPPHVDSAVLVVRR

SEQ ID NO: 224758 - protein, 20 aa, Mycobacterium bovis
AFLTSQKVRWAARASLDAAG

SEQ ID NO: 224759 - protein, 18 aa, Mycobacterium bovis
AFVQLVMTNLFGQNAPLI

SEQ ID NO: 224760 - protein, 23 aa, Mycobacterium bovis
AFVRFRIDGKDWPASPLPSLRMR

SEQ ID NO: 224761 - protein, 17 aa, Mycobacterium bovis
AFVSERIGLAAQAYSSA

SEQ ID NO: 224762 - protein, 24 aa, Mycobacterium bovis
AGAELMLGMRRFAPSSSTSLYVYA

SEQ ID NO: 224763 - protein, 25 aa, Mycobacterium bovis
AGAGAYAFAEAANASPLQSAMGAVS

SEQ ID NO: 224764 - protein, 17 aa, Mycobacterium bovis
AGGILFGTGGAGGAGGV

SEQ ID NO: 224765 - protein, 23 aa, Mycobacterium bovis
AGGNAGLFSLGASGGAGGSGGSS

SEQ ID NO: 224766 - protein, 24 aa, Mycobacterium bovis
AGGNAGMLALGAAGGAGGIGGDGG

SEQ ID NO: 224767 - protein, 22 aa, Mycobacterium bovis
AGGQGLPFEAGANGGAGGAGGW

SEQ ID NO: 224768 - protein, 24 aa, Mycobacterium bovis
AGGQVWLMPHNPAFDPIPGNDATV

SEQ ID NO: 224769 - protein, 25 aa, Mycobacterium bovis
AGGSARGLIFALGGAGAAGGDASTG

SEQ ID NO: 224770 - protein, 34 aa, Mycobacterium bovis
AGIERPDYSITGWVILTLIQHGTPWQIERFVEKA

SEQ ID NO: 224771 - protein, 31 aa, Mycobacterium bovis
AGIFTGYIGPIPLSTFVLGVTLAGGTLESGI

SEQ ID NO: 224772 - protein, 32 aa, Mycobacterium bovis
AGKAGVGGVSGLLLGLDGFNAPASTSPLHTLQ

SEQ ID NO: 224773 - protein, 19 aa, Mycobacterium bovis
AGLLALLAGALEGAGAGIV

SEQ ID NO: 224774 - protein, 18 aa, Mycobacterium bovis
AGPSTLVRAGAQAFLVDC

SEQ ID NO: 224775 - protein, 25 aa, Mycobacterium bovis
AGRTERFWVGLSVYRPGGTAEPAPT

SEQ ID NO: 224776 - protein, 19 aa, Mycobacterium bovis
AGRVAILDLWPLSVAERSG

SEQ ID NO: 224777 - protein, 23 aa, Mycobacterium bovis
AGSLRLDLSQYRELEAFAAFASD

SEQ ID NO: 224778 - protein, 24 aa, Mycobacterium bovis
AGSLVAPPKVRVPLLVGGNGTEVL

SEQ ID NO: 224779 - protein, 17 aa, Mycobacterium bovis
AGSWPYGLPELPGARDQ

SEQ ID NO: 224780 - protein, 20 aa, Mycobacterium bovis
AGVLVLGSFPSGRRARVLIG

SEQ ID NO: 224781 - protein, 27 aa, Mycobacterium bovis
AHALALQFGWRLFAPMLRSATGIDELT

SEQ ID NO: 224782 - protein, 29 aa, Mycobacterium bovis
AIAAAEAMYEQMWAADVAAMVGYHGGASA

SEQ ID NO: 224783 - protein, 18 aa, Mycobacterium bovis
AIPMMVFSGVMNAGQGCV

SEQ ID NO: 224784 - protein, 18 aa, Mycobacterium bovis
AKDTLLGDRIISLSSRGP

SEQ ID NO: 224785 - protein, 17 aa, Mycobacterium bovis
AKGLEWDAVFLVGLADG

SEQ ID NO: 224786 - protein, 26 aa, Mycobacterium bovis
AKRDSEWMGRVHRFLGLQVGVILATM

SEQ ID NO: 224787 - protein, 29 aa, Mycobacterium bovis
AKRYTGRGMAFLDLIQEGNLGLIRAVEKF

SEQ ID NO: 224788 - protein, 26 aa, Mycobacterium bovis
ALARALPLSMSLLGVQFVMGTAAAHA

SEQ ID NO: 224789 - protein, 27 aa, Mycobacterium bovis
ALELGCGTGFFLLNLIQAGVARRGSVT

SEQ ID NO: 224790 - protein, 25 aa, Mycobacterium bovis
ALFHDRFVQILQEGAAAYAMAEAAN

SEQ ID NO: 224791 - protein, 18 aa, Mycobacterium bovis
ALGIGYEIVPGVPAFAAA

SEQ ID NO: 224792 - protein, 26 aa, Mycobacterium bovis
ALGLSTYKMVFGHRGINIPVVDHATG

SEQ ID NO: 224793 - protein, 24 aa, Mycobacterium bovis
ALGVALGVIRLLLGADYAPLAVHL

SEQ ID NO: 224794 - protein, 30 aa, Mycobacterium bovis
ALPVLTMVCGYSRWASALLIPTRTAEDLYA

SEQ ID NO: 224795 - protein, 17 aa, Mycobacterium bovis
ALRDTHVELERLVHALP

SEQ ID NO: 224796 - protein, 17 aa, Mycobacterium bovis
ALSAMDYLRAHGIYVPG

SEQ ID NO: 224797 - protein, 17 aa, Mycobacterium bovis
ALVKTYVADALAADLYL

SEQ ID NO: 224798 - protein, 23 aa, Mycobacterium bovis
AMLTLPPVGPSIGWRTSTRLPRD

SEQ ID NO: 224799 - protein, 18 aa, Mycobacterium bovis
AMVDPVVVAANRSAFVQL

SEQ ID NO: 224800 - protein, 23 aa, Mycobacterium bovis
ANNRAALIGYLPTGYPDVPASVA

SEQ ID NO: 224801 - protein, 25 aa, Mycobacterium bovis
ANSWLDAFAHWRQAQGLPATAIAWG

SEQ ID NO: 224802 - protein, 26 aa, Mycobacterium bovis
APAGSGAMGSTGFAGGAGGDGGNGGG

SEQ ID NO: 224803 - protein, 21 aa, Mycobacterium bovis
APDFRLFWDNAYAVHTLTLDF

SEQ ID NO: 224804 - protein, 20 aa, Mycobacterium bovis
APDKLQFTTFGDPTGRHAFG

SEQ ID NO: 224805 - protein, 24 aa, Mycobacterium bovis
APGARLVFNAFLANGDYAPDQAAR

SEQ ID NO: 224806 - protein, 20 aa, Mycobacterium bovis
APLDAFVVRKLGAPGHDEFA

SEQ ID NO: 224807 - protein, 18 aa, Mycobacterium bovis
APPAPAPALAHLRGTTQK

SEQ ID NO: 224808 - protein, 18 aa, Mycobacterium bovis
APPTPFNGPLGRLRNIAY

SEQ ID NO: 224809 - protein, 17 aa, Mycobacterium bovis
APPVGGLHLQFGRNAST

SEQ ID NO: 224810 - protein, 19 aa, Mycobacterium bovis
APRLSRRILHQLYLGYPDS

SEQ ID NO: 224811 - protein, 23 aa, Mycobacterium bovis
APTALLRVYRDKLPHRYAKALRR

SEQ ID NO: 224812 - protein, 19 aa, Mycobacterium bovis
AQLFHTSGHLDWYADGMFP

SEQ ID NO: 224813 - protein, 27 aa, Mycobacterium bovis
AQRPGDPTLRRLLPDFYRPDDLDDDDP

SEQ ID NO: 224814 - protein, 22 aa, Mycobacterium bovis
AQYDVRLVSRVSDAPPVPARLV

SEQ ID NO: 224815 - protein, 17 aa, Mycobacterium bovis
ARAFVSERIGLAAQAYS

SEQ ID NO: 224816 - protein, 18 aa, Mycobacterium bovis
AREVLGVAHALLVSVDGL

SEQ ID NO: 224817 - protein, 20 aa, Mycobacterium bovis
ARFDGWFVVAVLTTGVYCRP

SEQ ID NO: 224818 - protein, 21 aa, Mycobacterium bovis
ARKRRMFDLLVRMGYKEIEVG

SEQ ID NO: 224819 - protein, 24 aa, Mycobacterium bovis
ARLAGIPYIAIANAYWSPYAQRRF

SEQ ID NO: 224820 - protein, 17 aa, Mycobacterium bovis
ARLAIQHGYPIVPFASV

SEQ ID NO: 224821 - protein, 19 aa, Mycobacterium bovis
ARRLATMVLLIAQSTIQSA

SEQ ID NO: 224822 - protein, 27 aa, Mycobacterium bovis
ARTDLLAFTAFPKQIWRQIWSNNPQER

SEQ ID NO: 224823 - protein, 26 aa, Mycobacterium bovis
ARVFHRAFPCLGSLAYKAYSLSFETF

SEQ ID NO: 224824 - protein, 24 aa, Mycobacterium bovis
ARYAQRVMDWLHPDGDLTDTERAR

SEQ ID NO: 224825 - protein, 31 aa, Mycobacterium bovis
ASERFDGLLTFTLTETLWLAGQGFSNLLLAY

SEQ ID NO: 224826 - protein, 28 aa, Mycobacterium bovis
ASFDMYTGRLFAVSLLPGSPDRLVLTAS

SEQ ID NO: 224827 - protein, 18 aa, Mycobacterium bovis
ASHCYPHFRRFLAEVVRV

SEQ ID NO: 224828 - protein, 17 aa, Mycobacterium bovis
ASIRFQQGAYRIHPALL

SEQ ID NO: 224829 - protein, 17 aa, Mycobacterium bovis
ASLFAAHGQAYQAVSAQ

SEQ ID NO: 224830 - protein, 19 aa, Mycobacterium bovis
ASRLIPFAAPPKTTNSAGV

SEQ ID NO: 224831 - protein, 19 aa, Mycobacterium bovis
ASSQFVSGLLLSAASFTDG

SEQ ID NO: 224832 - protein, 26 aa, Mycobacterium bovis
ASVLAYPRVVWIAGGLLKGASLHAEV

SEQ ID NO: 224833 - protein, 23 aa, Mycobacterium bovis
ATEALLPFEDAPLITNPGGLLEQ

SEQ ID NO: 224834 - protein, 21 aa, Mycobacterium bovis
ATLPAAAWQRCRTHYAANLMA

SEQ ID NO: 224835 - protein, 25 aa, Mycobacterium bovis
ATMRAIENALTLILGLPTGPERGEA

SEQ ID NO: 224836 - protein, 27 aa, Mycobacterium bovis
ATSPMDPALYLVWAQANAAAGYRYSVE

SEQ ID NO: 224837 - protein, 22 aa, Mycobacterium bovis
ATTARAVAVARSGMDCVAGDAS

SEQ ID NO: 224838 - protein, 22 aa, Mycobacterium bovis
AVDAALGWQRDGAEWIHLVDLD

SEQ ID NO: 224839 - protein, 18 aa, Mycobacterium bovis
AVDIPALNLRRQLRAIWV

SEQ ID NO: 224840 - protein, 24 aa, Mycobacterium bovis
AVDYLTSMGLRILNRNWRCRYGEL

SEQ ID NO: 224841 - protein, 28 aa, Mycobacterium bovis
AVIRTSVPPFTWWRGLRARELLENYFTA

SEQ ID NO: 224842 - protein, 19 aa, Mycobacterium bovis
AVLAALLHRERNGVADVVQ

SEQ ID NO: 224843 - protein, 26 aa, Mycobacterium bovis
AVLGRLPMRAWLIGLRPMEGSPEGHN

SEQ ID NO: 224844 - protein, 17 aa, Mycobacterium bovis
AVLLLENEGPVASATDP

SEQ ID NO: 224845 - protein, 19 aa, Mycobacterium bovis
AVLNRLRRAQGQLAGVISM

SEQ ID NO: 224846 - protein, 19 aa, Mycobacterium bovis
AVLVFPHAGGAAAAYRWLA

SEQ ID NO: 224847 - protein, 22 aa, Mycobacterium bovis
AVRQWGFMQGLKQKLGPGVDVR

SEQ ID NO: 224848 - protein, 24 aa, Mycobacterium bovis
AVTGQFLWQNVFGVWPVSGEVSAA

SEQ ID NO: 224849 - protein, 23 aa, Mycobacterium bovis
AYQERFVLALSQASSTYAVAEAA

SEQ ID NO: 224850 - protein, 24 aa, Mycobacterium bovis
CAPLTWPEGWRRWPQRVYGDTRLE

SEQ ID NO: 224851 - protein, 29 aa, Mycobacterium bovis
CGKYLVVMHDLWLPLLTAAGDLDKPLVTE

SEQ ID NO: 224852 - protein, 17 aa, Mycobacterium bovis
CGLAPSSIYWHFGSKEG

SEQ ID NO: 224853 - protein, 19 aa, Mycobacterium bovis
CNLACKFCQNWDISKSREI

SEQ ID NO: 224854 - protein, 21 aa, Mycobacterium bovis
CPELGLRPLLPRLDTAERALR

SEQ ID NO: 224855 - protein, 17 aa, Mycobacterium bovis
CTSGCALTIRLLGRTEI

SEQ ID NO: 224856 - protein, 18 aa, Mycobacterium bovis
CVGFPKVLAAFRPHAGDL

SEQ ID NO: 224857 - protein, 22 aa, Mycobacterium bovis
DADELFRRSLGNPLYLRHLIDG

SEQ ID NO: 224858 - protein, 18 aa, Mycobacterium bovis
DAGPYTFLAADALVLKVR

SEQ ID NO: 224859 - protein, 29 aa, Mycobacterium bovis
DAMLISDLINVRYLSGFSGSNGALLVFAD

SEQ ID NO: 224860 - protein, 23 aa, Mycobacterium bovis
DDALTVLWHSITWQYLPADERAA

SEQ ID NO: 224861 - protein, 18 aa, Mycobacterium bovis
DDESAFTAVIPLFSLRLP

SEQ ID NO: 224862 - protein, 17 aa, Mycobacterium bovis
DDFFRLFLDPTQTYSCA

SEQ ID NO: 224863 - protein, 17 aa, Mycobacterium bovis
DDMVAACLKWEGGYVWA

SEQ ID NO: 224864 - protein, 25 aa, Mycobacterium bovis
DDPVPVRVLYLGRGLAKATLFGPAE

SEQ ID NO: 224865 - protein, 23 aa, Mycobacterium bovis
DDPYLQVVLQRRLPVVVVDQPKD

SEQ ID NO: 224866 - protein, 22 aa, Mycobacterium bovis
DDVLPYMRYNANKALANLGYQP

SEQ ID NO: 224867 - protein, 17 aa, Mycobacterium bovis
DDVVRGLRITPQQLRDI

SEQ ID NO: 224868 - protein, 23 aa, Mycobacterium bovis
DDWPGMFLLAAASFTDFIGPESA

SEQ ID NO: 224869 - protein, 17 aa, Mycobacterium bovis
DEGLRFAIREGGRTVGA

SEQ ID NO: 224870 - protein, 22 aa, Mycobacterium bovis
DELGTALLLITHDLALAAQRAE

SEQ ID NO: 224871 - protein, 28 aa, Mycobacterium bovis
DELRSLLRFVLDLLADYGLTDFYLELST

SEQ ID NO: 224872 - protein, 20 aa, Mycobacterium bovis
DERGWLIVVTSRLCLDHIKS

SEQ ID NO: 224873 - protein, 18 aa, Mycobacterium bovis
DEVSAAVAALFGSYAQSY

SEQ ID NO: 224874 - protein, 25 aa, Mycobacterium bovis
DEVSQAIARLFSDYATHYQSLNAQA

SEQ ID NO: 224875 - protein, 22 aa, Mycobacterium bovis
DFPASAVRFFASARSQGRKLAF

SEQ ID NO: 224876 - protein, 25 aa, Mycobacterium bovis
DGAHGALGGLTVAGGNGGAGGAGGA

SEQ ID NO: 224877 - protein, 18 aa, Mycobacterium bovis
DGDLLRLGDLALPVAPGS

SEQ ID NO: 224878 - protein, 22 aa, Mycobacterium bovis
DGGAGGIFFGTGGTGGAGGVGT

SEQ ID NO: 224879 - protein, 26 aa, Mycobacterium bovis
DGGDGGWGRPGGQGGFGSTSGAHGKA

SEQ ID NO: 224880 - protein, 23 aa, Mycobacterium bovis
DGGNAGMFFGSGGAGGAGGFGRT

SEQ ID NO: 224881 - protein, 27 aa, Mycobacterium bovis
DGGTGGRGGLLMGAGAGGHGGTGGAGG

SEQ ID NO: 224882 - protein, 30 aa, Mycobacterium bovis
DGGTGGSGGFGAPPPRSIGGGDGGDGGRGG

SEQ ID NO: 224883 - protein, 19 aa, Mycobacterium bovis
DGGWLIGNGGAGGSGAAGV

SEQ ID NO: 224884 - protein, 17 aa, Mycobacterium bovis
DGLADELAVAASWFGSV

SEQ ID NO: 224885 - protein, 17 aa, Mycobacterium bovis
DGMLEWRLAGLPVDEGA

SEQ ID NO: 224886 - protein, 26 aa, Mycobacterium bovis
DGNDHFEFFVFPYADKALTRTMHRSD

SEQ ID NO: 224887 - protein, 23 aa, Mycobacterium bovis
DGSPKILERCTLPLTGVGCVDRI

SEQ ID NO: 224888 - protein, 25 aa, Mycobacterium bovis
DGTGPALPTVWPGNAYPLGATYDGA

SEQ ID NO: 224889 - protein, 22 aa, Mycobacterium bovis
DGTLRVGYLPVTITRWPPGERV

SEQ ID NO: 224890 - protein, 19 aa, Mycobacterium bovis
DGVGNYTFGLAEQAVFHEV

SEQ ID NO: 224891 - protein, 37 aa, Mycobacterium bovis
DHFTFYASIAHLCVDPMIVGVLFIEIHMMYSALVGGD

SEQ ID NO: 224892 - protein, 29 aa, Mycobacterium bovis
DHGRVVFTRAALPAIRPVNHLVVDGRVIV

SEQ ID NO: 224893 - protein, 18 aa, Mycobacterium bovis
DHLIALLEICAVRADPET

SEQ ID NO: 224894 - protein, 19 aa, Mycobacterium bovis
DIAAIKQLKYRYLRALDTK

SEQ ID NO: 224895 - protein, 18 aa, Mycobacterium bovis
DIDRLVELFTAEAIWEMP

SEQ ID NO: 224896 - protein, 23 aa, Mycobacterium bovis
DIKAPLLAALGAADLALATVNEL

SEQ ID NO: 224897 - protein, 21 aa, Mycobacterium bovis
DILVAVTRWTVRLQQTGWDHT

SEQ ID NO: 224898 - protein, 25 aa, Mycobacterium bovis
DIPTQWRNQPLGWYTQGLAPYLPGL

SEQ ID NO: 224899 - protein, 17 aa, Mycobacterium bovis
DIRLEPDSILRVLAMHR

SEQ ID NO: 224900 - protein, 17 aa, Mycobacterium bovis
DIRLPFHKPVDDMTGLS

SEQ ID NO: 224901 - protein, 17 aa, Mycobacterium bovis
DKLFIGGKWTKPSTSDV

SEQ ID NO: 224902 - protein, 30 aa, Mycobacterium bovis
DKRSVRVTAWTRKLGYLTDIDFDLAASVEA

SEQ ID NO: 224903 - protein, 24 aa, Mycobacterium bovis
DKSRPLWEMYLVEGLEKNRIALYT

SEQ ID NO: 224904 - protein, 20 aa, Mycobacterium bovis
DKVNAYVAAFNQGRNTGPTE

SEQ ID NO: 224905 - protein, 19 aa, Mycobacterium bovis
DLDALLRRVAGHDQAAFAE

SEQ ID NO: 224906 - protein, 17 aa, Mycobacterium bovis
DLKPGMTLLDIGCGWGT

SEQ ID NO: 224907 - protein, 19 aa, Mycobacterium bovis
DLLPEAFAVAREAAWRVLD

SEQ ID NO: 224908 - protein, 26 aa, Mycobacterium bovis
DLLVARRRPPAGDGWRKAVTKMTFGR

SEQ ID NO: 224909 - protein, 17 aa, Mycobacterium bovis
DLRAIATLTHRGVEGAI

SEQ ID NO: 224910 - protein, 19 aa, Mycobacterium bovis
DLVSLMKVGLRRGKIIVVR

SEQ ID NO: 224911 - protein, 22 aa, Mycobacterium bovis
DNTLVFYIWGDNGASMEGTNTG

SEQ ID NO: 224912 - protein, 26 aa, Mycobacterium bovis
DPAEWKVFLNLLRTRFETDKDKWTKI

SEQ ID NO: 224913 - protein, 17 aa, Mycobacterium bovis
DPFITIDAFQVVAGVLF

SEQ ID NO: 224914 - protein, 17 aa, Mycobacterium bovis
DPNPMFVERALALLEQV

SEQ ID NO: 224915 - protein, 23 aa, Mycobacterium bovis
DPQVPVFALGRYAGVRRQAILAM

SEQ ID NO: 224916 - protein, 20 aa, Mycobacterium bovis
DPYPYYRRLRDEAPLYRNEE

SEQ ID NO: 224917 - protein, 30 aa, Mycobacterium bovis; identical to SEQ ID NO: 164669

SEQ ID NO: 224918 - protein, 22 aa, Mycobacterium bovis
DRDRPLWEMWVIEGGARSDTVA

SEQ ID NO: 224919 - protein, 27 aa, Mycobacterium bovis
DREAQLLDILRTEIWPLLADRSPITKL

SEQ ID NO: 224920 - protein, 20 aa, Mycobacterium bovis
DRGFARFRRLRWRHPLDGQT

SEQ ID NO: 224921 - protein, 20 aa, Mycobacterium bovis
DRLLAEPTAWLFGPEAHGLS

SEQ ID NO: 224922 - protein, 20 aa, Mycobacterium bovis
DRLRRWMAVAARIELRTGGA

SEQ ID NO: 224923 - protein, 19 aa, Mycobacterium bovis
DRLYIIISGKVKIGRRAPD

SEQ ID NO: 224924 - protein, 19 aa, Mycobacterium bovis
DRPVVLVAHGGLIAALSAA

SEQ ID NO: 224925 - protein, 20 aa, Mycobacterium bovis
DRQHYRLVGWRHGLCGYRRF

SEQ ID NO: 224926 - protein, 25 aa, Mycobacterium bovis
DRQRHASLLPLLHNYREPAKPICGS

SEQ ID NO: 224927 - protein, 20 aa, Mycobacterium bovis
DSIEWMSRNLANRESVILSL

SEQ ID NO: 224928 - protein, 24 aa, Mycobacterium bovis
DSILRVLAMHRFAKAPMLVGGQML

SEQ ID NO: 224929 - protein, 19 aa, Mycobacterium bovis
DSMFPLGPSLATRASTSPS

SEQ ID NO: 224930 - protein, 20 aa, Mycobacterium bovis
DSMTLYGFPDGETRDLFLTL

SEQ ID NO: 224931 - protein, 21 aa, Mycobacterium bovis
DSQLWLLQTRGAERSAQAAVR

SEQ ID NO: 224932 - protein, 21 aa, Mycobacterium bovis
DSRFTGVIRAFAGLYPGRKFG

SEQ ID NO: 224933 - protein, 19 aa, Mycobacterium bovis
DSRLPRWRAMAAHALCKRD

SEQ ID NO: 224934 - protein, 17 aa, Mycobacterium bovis
DTEWIDRPTAFAARRAE

SEQ ID NO: 224935 - protein, 33 aa, Mycobacterium bovis; identical to SEQ ID NO: 113990

SEQ ID NO: 224936 - protein, 24 aa, Mycobacterium bovis
DTNTGFGNAGFFNMGIGNAGNEDM

SEQ ID NO: 224937 - protein, 20 aa, Mycobacterium bovis
DTPKYFHYVKKDKIAESAVM

SEQ ID NO: 224938 - protein, 22 aa, Mycobacterium bovis
DVAIKRPIFVTGLVRTGTTALH

SEQ ID NO: 224939 - protein, 23 aa, Mycobacterium bovis
DVDDALWRRFKAAQDSFFTARNA

SEQ ID NO: 224940 - protein, 23 aa, Mycobacterium bovis
DVDGFVFPTCRWVHPIGPGNRSL

SEQ ID NO: 224941 - protein, 17 aa, Mycobacterium bovis
DVFYWAHATFFVGTLHV

SEQ ID NO: 224942 - protein, 23 aa, Mycobacterium bovis
DVGDYVAYLLEPVSVWAPECSED

SEQ ID NO: 224943 - protein, 24 aa, Mycobacterium bovis
DVLAFPDHLVPSVSPFAGATAAAM

SEQ ID NO: 224944 - protein, 21 aa, Mycobacterium bovis
DVLDALSLWAPTQSVAAYDAV

SEQ ID NO: 224945 - protein, 24 aa, Mycobacterium bovis
DVLDELCLTIAPYVVGGLARRIVT

SEQ ID NO: 224946 - protein, 32 aa, Mycobacterium bovis
DVRARIGVLSQVPWLWAKFIGHAQAIAPAPDA

SEQ ID NO: 224947 - protein, 19 aa, Mycobacterium bovis
DVVPPGDLRMALAALASDS

SEQ ID NO: 224948 - protein, 17 aa, Mycobacterium bovis
DWGLWKSLADVQKDATQ

SEQ ID NO: 224949 - protein, 19 aa, Mycobacterium bovis
DWGVLPDLVMGHSVGEIAA

SEQ ID NO: 224950 - protein, 20 aa, Mycobacterium bovis
DYARVFLPGGDRIISAGLES

SEQ ID NO: 224951 - protein, 25 aa, Mycobacterium bovis
DYSEALALARLGWAALAVGTSHAVL

SEQ ID NO: 224952 - protein, 18 aa, Mycobacterium bovis
EADPRMFRLIRGQVAIAT

SEQ ID NO: 224953 - protein, 22 aa, Mycobacterium bovis
EAFRLLGHVDVVFSNAGIVVGG

SEQ ID NO: 224954 - protein, 35 aa, Mycobacterium bovis
EALQRVIDLVRRRSLPIMFPIEVRFSAPDDSFLST

SEQ ID NO: 224955 - protein, 32 aa, Mycobacterium bovis
EALRLGHNYIGTEHLLLALLELEDGDGPLHRS

SEQ ID NO: 224956 - protein, 17 aa, Mycobacterium bovis
EAMLLAGFVIPVRKKGV

SEQ ID NO: 224957 - protein, 26 aa, Mycobacterium bovis
EANNHFRVLFFRWGQHPVALTAFYKN

SEQ ID NO: 224958 - protein, 19 aa, Mycobacterium bovis
EAPEYFRVPKRGQVEILDP

SEQ ID NO: 224959 - protein, 21 aa, Mycobacterium bovis
EASIVVIRILGGYRAWQSGID

SEQ ID NO: 224960 - protein, 23 aa, Mycobacterium bovis
EAVSAMQERLPFFADLEASQRAS

SEQ ID NO: 224961 - protein, 23 aa, Mycobacterium bovis
EAVYEQMWAADVAAMLGYHGEAS

SEQ ID NO: 224962 - protein, 19 aa, Mycobacterium bovis
EAWRWYRDVIGGGRTPLVD

SEQ ID NO: 224963 - protein, 18 aa, Mycobacterium bovis
EDFPLHVAVYRRVIAEFN

SEQ ID NO: 224964 - protein, 25 aa, Mycobacterium bovis
EDGAGWLAFFRDLVARGLSGVALVT

SEQ ID NO: 224965 - protein, 23 aa, Mycobacterium bovis
EDHALRLLNLRRAARSVEGAGPG

SEQ ID NO: 224966 - protein, 25 aa, Mycobacterium bovis
EDVFPLPRELVGEGTLFLLKVIGDS

SEQ ID NO: 224967 - protein, 18 aa, Mycobacterium bovis
EEPILAGLIDRIARDEVR

SEQ ID NO: 224968 - protein, 29 aa, Mycobacterium bovis
EETQWPLAGTRWRPMYLAGPGLLATEPPP

SEQ ID NO: 224969 - protein, 17 aa, Mycobacterium bovis
EGGGNQDWWPNRLNLKV

SEQ ID NO: 224970 - protein, 22 aa, Mycobacterium bovis
EGNLHLNVLRCPPDREPALYAK

SEQ ID NO: 224971 - protein, 25 aa, Mycobacterium bovis
EIAVRVIRTLRRLGIRSVAVYSDPD

SEQ ID NO: 224972 - protein, 22 aa, Mycobacterium bovis
EICRRLDGIPLAIEFAAARVRS

SEQ ID NO: 224973 - protein, 21 aa, Mycobacterium bovis
EILRLLLGHPAYADGRLRIGA

SEQ ID NO: 224974 - protein, 24 aa, Mycobacterium bovis
EINSLRMFTGAGSAPMLAASVAWD

SEQ ID NO: 224975 - protein, 18 aa, Mycobacterium bovis
EIPGISVPAFSLPAITLP

SEQ ID NO: 224976 - protein, 19 aa, Mycobacterium bovis
EIRPAHLLMALLTQNDGIA

SEQ ID NO: 224977 - protein, 38 aa, Mycobacterium bovis
EIVRQLRLRDIGGIVVIDFIDMVLESNRDLVLRRLTES

SEQ ID NO: 224978 - protein, 19 aa, Mycobacterium bovis
ELAKLDAELTRIAHRATHL

SEQ ID NO: 224979 - protein, 25 aa, Mycobacterium bovis
ELGQPLPLFIKWDDADYGLRAAEHG

SEQ ID NO: 224980 - protein, 18 aa, Mycobacterium bovis
ELIARIRAVLRRGGDDDS

SEQ ID NO: 224981 - protein, 19 aa, Mycobacterium bovis
ELILSCGVALHHCVVALAS

SEQ ID NO: 224982 - protein, 26 aa, Mycobacterium bovis
ELKAALWELIWAGRVTGDTFAPVRAV

SEQ ID NO: 224983 - protein, 20 aa, Mycobacterium bovis
ELMRRFNGAALETLLTRLNL

SEQ ID NO: 224984 - protein, 21 aa, Mycobacterium bovis
ELPTYAFDKRRFWLSAEGSGA

SEQ ID NO: 224985 - protein, 24 aa, Mycobacterium bovis
ELRHHIATPQPLQWDCFLFGIIQS

SEQ ID NO: 224986 - protein, 18 aa, Mycobacterium bovis
ELSELGEWLVIHEGWRSE

SEQ ID NO: 224987 - protein, 22 aa, Mycobacterium bovis
ELTLAAPLVLPASGSVAVQVVV

SEQ ID NO: 224988 - protein, 28 aa, Mycobacterium bovis
ELVHFTKFILAEIFPGGWLPSIPTVHEY

SEQ ID NO: 224989 - protein, 22 aa, Mycobacterium bovis
ELYPDPVLPALSLLPHTVRTAP

SEQ ID NO: 224990 - protein, 34 aa, Mycobacterium bovis
ENHLTLPHPLAHLRAFVLIPWIAVDPTAQLTVAG

SEQ ID NO: 224991 - protein, 25 aa, Mycobacterium bovis
EPDVACEITLQPIRRYDVDAAILFS

SEQ ID NO: 224992 - protein, 18 aa, Mycobacterium bovis
EPIIARMLTAYGAGVDMV

SEQ ID NO: 224993 - protein, 29 aa, Mycobacterium bovis
EPLTPELCALSWMVYSLPGAPVLEHYELG

SEQ ID NO: 224994 - protein, 25 aa, Mycobacterium bovis
ERGIPLTMEMAKFIRFIVTDIFPGG

SEQ ID NO: 224995 - protein, 23 aa, Mycobacterium bovis
ERGKAARRFLPGATILKASVGPM

SEQ ID NO: 224996 - protein, 17 aa, Mycobacterium bovis
ERIAPLFNLINGDLCYA

SEQ ID NO: 224997 - protein, 26 aa, Mycobacterium bovis
ERLDRFAGQLLPRRAAQKFADFANAR

SEQ ID NO: 224998 - protein, 21 aa, Mycobacterium bovis
ERLNLPAGWSYHTRVLTSELR

SEQ ID NO: 224999 - protein, 21 aa, Mycobacterium bovis
ERSSHTWFVLRELLGHQNVKN

SEQ ID NO: 225000 - protein, 26 aa, Mycobacterium bovis
ESLADPLTFLLRKEGFEATVVTDGPA

SEQ ID NO: 225001 - protein, 17 aa, Mycobacterium bovis
ESRAQMATLPRLKPRVF

SEQ ID NO: 225002 - protein, 18 aa, Mycobacterium bovis
ESRFRGMCEARGLPAVRI

SEQ ID NO: 225003 - protein, 19 aa, Mycobacterium bovis
ETRLVPQRGYHLELITAVP

SEQ ID NO: 225004 - protein, 17 aa, Mycobacterium bovis
EVGLRRVFGCFPCGVIA

SEQ ID NO: 225005 - protein, 28 aa, Mycobacterium bovis
EVIAPTPERPIIFNLPATVEMTTPNVYA

SEQ ID NO: 225006 - protein, 24 aa, Mycobacterium bovis
EVLDFEPRTVWWGSANWTVRAGSH

SEQ ID NO: 225007 - protein, 23 aa, Mycobacterium bovis
EVNSLRMYLGAGSGPMLAAAAAW

SEQ ID NO: 225008 - protein, 23 aa, Mycobacterium bovis
EVTTIVVLRHAPPAPWIPVDQRG

SEQ ID NO: 225009 - protein, 18 aa, Mycobacterium bovis
EVVTDMWGRPRVRLTGAI

SEQ ID NO: 225010 - protein, 23 aa, Mycobacterium bovis
EYLRELTIWSGRYGSVAGVPARN

SEQ ID NO: 225011 - protein, 17 aa, Mycobacterium bovis
FARASFSYGLNAKWPVY

SEQ ID NO: 225012 - protein, 25 aa, Mycobacterium bovis
FAVHFFRRELVARLATGWVLEEVHD

SEQ ID NO: 225013 - protein, 17 aa, Mycobacterium bovis
FDAAAARKFGCGFAPSG

SEQ ID NO: 225014 - protein, 19 aa, Mycobacterium bovis
FDCSDPAKLAGWWAEQFDG

SEQ ID NO: 225015 - protein, 23 aa, Mycobacterium bovis
FDSEHPLFLLYTSGTTGKPKGIM

SEQ ID NO: 225016 - protein, 29 aa, Mycobacterium bovis
FGSGAHFCLGLTWPGWKPGWPWARCCVGS

SEQ ID NO: 225017 - protein, 18 aa, Mycobacterium bovis
FGTAPMPPGPPPPGTVSP

SEQ ID NO: 225018 - protein, 25 aa, Mycobacterium bovis
FGTPDTWVLWNLTGGPRGGGVHVTD

SEQ ID NO: 225019 - protein, 33 aa, Mycobacterium bovis
FGYAINATPELMPLPIALAHRLSRRLTEVRKNG

SEQ ID NO: 225020 - protein, 19 aa, Mycobacterium bovis
FIDACHTRRLGVLIDAVFN

SEQ ID NO: 225021 - protein, 21 aa, Mycobacterium bovis
FIEHDSQGYRLIFENDFVTEP

SEQ ID NO: 225022 - protein, 21 aa, Mycobacterium bovis
FLRWLAGVRFTGDVWAAPEGT

SEQ ID NO: 225023 - protein, 35 aa, Mycobacterium bovis
FMGSSYLLNGLFFSLPWYYRSGYDVLLYTLPFHGQ

SEQ ID NO: 225024 - protein, 22 aa, Mycobacterium bovis
FMTFNLMHIAQMLRVAGGIPAY

SEQ ID NO: 225025 - protein, 19 aa, Mycobacterium bovis
FQGLAFVVSRRRLLGRFVR

SEQ ID NO: 225026 - protein, 17 aa, Mycobacterium bovis
FSSKLELYLAVLHRHVE

SEQ ID NO: 225027 - protein, 17 aa, Mycobacterium bovis
FTASFAGLVPNAGLGAY

SEQ ID NO: 225028 - protein, 20 aa, Mycobacterium bovis
FTKKLLAADGLPVGAYAVLR

SEQ ID NO: 225029 - protein, 17 aa, Mycobacterium bovis
FTRPVSVDPVRGLDPLT

SEQ ID NO: 225030 - protein, 25 aa, Mycobacterium bovis
FVEATFPIAAHYFAVFPLAKHMESA

SEQ ID NO: 225031 - protein, 31 aa, Mycobacterium bovis
FVNPVEAFQFYFELLLFDYPTHIVQIVEALS

SEQ ID NO: 225032 - protein, 24 aa, Mycobacterium bovis
GAAGFGYPYAIAPPGIGFGSGMSA

SEQ ID NO: 225033 - protein, 19 aa, Mycobacterium bovis
GAAIWHMAWSDKDDAIDWQ

SEQ ID NO: 225034 - protein, 23 aa, Mycobacterium bovis
GADGGAGGWLFGNGGNGGSGATG

SEQ ID NO: 225035 - protein, 25 aa, Mycobacterium bovis
GAGGAGGLFGAGGMGGAGGFGDHGT

SEQ ID NO: 225036 - protein, 24 aa, Mycobacterium bovis
GAGGAGGWLFGNGGAGGVGGAGGA

SEQ ID NO: 225037 - protein, 27 aa, Mycobacterium bovis
GAGGDAPLIGWGGNGGPGGFAAFGNGG

SEQ ID NO: 225038 - protein, 25 aa, Mycobacterium bovis
GAGGNAGLLFGAAGVGGAGGFTNGS

SEQ ID NO: 225039 - protein, 29 aa, Mycobacterium bovis
GAGGTGGNAAWLLGGGGTGGAGGIGGGNG

SEQ ID NO: 225040 - protein, 23 aa, Mycobacterium bovis
GAGQLLSHSGVAGASGKGGAGGT

SEQ ID NO: 225041 - protein, 17 aa, Mycobacterium bovis
GALPLVMNPDAAVATVV

SEQ ID NO: 225042 - protein, 20 aa, Mycobacterium bovis
GAPVPIPGFPTTVTVFGTPF

SEQ ID NO: 225043 - protein, 19 aa, Mycobacterium bovis
GAQRFFAAIPTWDEAHGPV

SEQ ID NO: 225044 - protein, 34 aa, Mycobacterium bovis
GATTTTYLVPVNHLPLTLPLRYLGMSDAEVDQID

SEQ ID NO: 225045 - protein, 24 aa, Mycobacterium bovis
GAVAQPLIAAFAAALRQLGAHVEA

SEQ ID NO: 225046 - protein, 19 aa, Mycobacterium bovis
GCRMDSMFPLGPSLATRAS

SEQ ID NO: 225047 - protein, 20 aa, Mycobacterium bovis
GDAMPWLMASAKTLSYAVNM

SEQ ID NO: 225048 - protein, 32 aa, Mycobacterium bovis
GDARPPFWQNLAELGWLGLHIDERHGGSGYGL

SEQ ID NO: 225049 - protein, 22 aa, Mycobacterium bovis
GDGGNAGLFGDGGAGGDGADGT

SEQ ID NO: 225050 - protein, 21 aa, Mycobacterium bovis
GDGIALGLWAGVAVSDLEFIQ

SEQ ID NO: 225051 - protein, 18 aa, Mycobacterium bovis
GDLAVAIDALRRPERRRG

SEQ ID NO: 225052 - protein, 22 aa, Mycobacterium bovis
GDPEAAFAHFGRRFDDLSTEIM

SEQ ID NO: 225053 - protein, 18 aa, Mycobacterium bovis
GDRDIRLPFHKPVDDMTG

SEQ ID NO: 225054 - protein, 28 aa, Mycobacterium bovis
GDRVAIYLPLIPEAVIAMLACARLGIMH

SEQ ID NO: 225055 - protein, 24 aa, Mycobacterium bovis
GDVPLIGFAGAPFTLASYLVEGGP

SEQ ID NO: 225056 - protein, 25 aa, Mycobacterium bovis
GDVVVLLESMKMEIPVLAEAAGTVS

SEQ ID NO: 225057 - protein, 19 aa, Mycobacterium bovis
GEFVFVLGYLGHVRAIVGN

SEQ ID NO: 225058 - protein, 21 aa, Mycobacterium bovis
GELALLRLACEAADAALTDLV

SEQ ID NO: 225059 - protein, 32 aa, Mycobacterium bovis
GEPTPLDYLVAEILRIISGGRLIWDPAEGTMN

SEQ ID NO: 225060 - protein, 27 aa, Mycobacterium bovis
GEQELDLVLAILRACQLFGGAHAIPGL

SEQ ID NO: 225061 - protein, 18 aa, Mycobacterium bovis
GEWLVIHEGWRSELPDQL

SEQ ID NO: 225062 - protein, 20 aa, Mycobacterium bovis
GFLTPRNSLRQRCVAHRLTI

SEQ ID NO: 225063 - protein, 20 aa, Mycobacterium bovis
GFMRNAAGGTLFNFGFANDG

SEQ ID NO: 225064 - protein, 19 aa, Mycobacterium bovis
GFSFFDGNGGDGGTGGTLI

SEQ ID NO: 225065 - protein, 25 aa, Mycobacterium bovis
GFSSLAYLPRLPVDVVKLGGKFIEC

SEQ ID NO: 225066 - protein, 25 aa, Mycobacterium bovis
GFSYDVLHAFNPRIVLAGSSAFGNR

SEQ ID NO: 225067 - protein, 29 aa, Mycobacterium bovis
GFTVPEPLSLRPHYIKTLRIWGDTLQSNK

SEQ ID NO: 225068 - protein, 20 aa, Mycobacterium bovis
GGAAGLFGIGGAGGAGGAGA

SEQ ID NO: 225069 - protein, 29 aa, Mycobacterium bovis
GGAGAGIANFLGFSVLHGGAGGAGGTATG

SEQ ID NO: 225070 - protein, 25 aa, Mycobacterium bovis
GGAGGAGGAFLGDGGNGGAGGQGGA

SEQ ID NO: 225071 - protein, 24 aa, Mycobacterium bovis
GGAGGAGGWLFGNGGAGGNGGIGG

SEQ ID NO: 225072 - protein, 19 aa, Mycobacterium bovis
GGAGGIPGLIGNGGNGGDG

SEQ ID NO: 225073 - protein, 22 aa, Mycobacterium bovis
GGAGQITGLRSGFGSAGGAGGA

SEQ ID NO: 225074 - protein, 25 aa, Mycobacterium bovis
GGAGSLFNGAPGFGGPGGSGGASLL

SEQ ID NO: 225075 - protein, 23 aa, Mycobacterium bovis
GGAKLRALGPQLAQRRLGLENQG

SEQ ID NO: 225076 - protein, 24 aa, Mycobacterium bovis
GGGATPLLVFYHGGGWTLGDLDTH

SEQ ID NO: 225077 - protein, 24 aa, Mycobacterium bovis
GGGNPHYDIPKLLSMYKAGKLNLD

SEQ ID NO: 225078 - protein, 21 aa, Mycobacterium bovis
GGIRDLWLDLGALTELLRDPR

SEQ ID NO: 225079 - protein, 24 aa, Mycobacterium bovis
GGLLRPQVLWDELLAECKAAPGGD

SEQ ID NO: 225080 - protein, 21 aa, Mycobacterium bovis
GGMPMMLMPMSISGAGAGMPG

SEQ ID NO: 225081 - protein, 18 aa, Mycobacterium bovis
GGNGGIGITVGGAGGAGG

SEQ ID NO: 225082 - protein, 26 aa, Mycobacterium bovis
GGPGGNGGWLLGNGGHGGAGGIGGGS

SEQ ID NO: 225083 - protein, 21 aa, Mycobacterium bovis
GGPLWWPKCPKVIRCRSPAST

SEQ ID NO: 225084 - protein, 25 aa, Mycobacterium bovis
GGPYAHGWVTWFPPDAPPGTERFGP

SEQ ID NO: 225085 - protein, 19 aa, Mycobacterium bovis
GGQGLPFEAGANGGAGGAG

SEQ ID NO: 225086 - protein, 20 aa, Mycobacterium bovis
GGQGLPFEAGANGGAGGAGG

SEQ ID NO: 225087 - protein, 18 aa, Mycobacterium bovis
GGRRPLITEAIRGEGAIL

SEQ ID NO: 225088 - protein, 19 aa, Mycobacterium bovis
GGSAFLIGSGGTGGVGGAA

SEQ ID NO: 225089 - protein, 20 aa, Mycobacterium bovis
GGSAGLFYGSGGAGGNGGYS

SEQ ID NO: 225090 - protein, 21 aa, Mycobacterium bovis
GGSAGLLGNGGSGGAGGTGAP

SEQ ID NO: 225091 - protein, 17 aa, Mycobacterium bovis
GGSAGLWGSGGNGGQGG

SEQ ID NO: 225092 - protein, 21 aa, Mycobacterium bovis
GGTGDLLFGNGGAGGQGGLGL

SEQ ID NO: 225093 - protein, 29 aa, Mycobacterium bovis
GGTGGFAVAPDFIGFGAAYGGAGGLGGAA

SEQ ID NO: 225094 - protein, 22 aa, Mycobacterium bovis
GGTGGIGGTGAPGAMGGTGGNG

SEQ ID NO: 225095 - protein, 18 aa, Mycobacterium bovis
GGTPFPLQLATQVDAPPG

SEQ ID NO: 225096 - protein, 25 aa, Mycobacterium bovis
GGVGGAGGLLFGYGGAGGAGGYSNI

SEQ ID NO: 225097 - protein, 22 aa, Mycobacterium bovis
GGYPPETGGYPPQPGYPRPRHP

SEQ ID NO: 225098 - protein, 29 aa, Mycobacterium bovis
GGYRDTEIMRWLFTPDPSLTITRDGSRDA

SEQ ID NO: 225099 - protein, 23 aa, Mycobacterium bovis
GHATAIMWAREQFGLELIWGIED

SEQ ID NO: 225100 - protein, 19 aa, Mycobacterium bovis
GHFNAVELILCFNQLAYSA

SEQ ID NO: 225101 - protein, 17 aa, Mycobacterium bovis
GHPAYADGRLRIGALTA

SEQ ID NO: 225102 - protein, 27 aa, Mycobacterium bovis
GIDFTNIYFYTVLYHALRASNRIAIER

SEQ ID NO: 225103 - protein, 17 aa, Mycobacterium bovis
GIDPWEISFGFHGLDSL

SEQ ID NO: 225104 - protein, 22 aa, Mycobacterium bovis
GIGPPITDGFYYDFDVPEPFTP

SEQ ID NO: 225105 - protein, 18 aa, Mycobacterium bovis
GKITYRIKLEVSFKMRPA

SEQ ID NO: 225106 - protein, 17 aa, Mycobacterium bovis
GKPELWVEFPHGASLCS

SEQ ID NO: 225107 - protein, 27 aa, Mycobacterium bovis
GKPEQNAWWWDVLKFGRSSAYAEFFDI

SEQ ID NO: 225108 - protein, 18 aa, Mycobacterium bovis
GLCLDVCTGGELAVALHA

SEQ ID NO: 225109 - protein, 26 aa, Mycobacterium bovis
GLLDNRPIGVLFKRIFDRPARRPVRR

SEQ ID NO: 225110 - protein, 19 aa, Mycobacterium bovis
GLLRQYFPKGTSLSTYTPD

SEQ ID NO: 225111 - protein, 22 aa, Mycobacterium bovis
GLMLPRRAFLPPPHVDSAVLVV

SEQ ID NO: 225112 - protein, 22 aa, Mycobacterium bovis
GLMRRHIKPYQKPHPPIGVTGF

SEQ ID NO: 225113 - protein, 25 aa, Mycobacterium bovis
GLPRRLRWVSPLVPLVAGPLPVAFF

SEQ ID NO: 225114 - protein, 26 aa, Mycobacterium bovis
GLSFSGLLGAVYFPGILSLLQDDMPF

SEQ ID NO: 225115 - protein, 22 aa, Mycobacterium bovis
GLSSPVILGIGIGGAGGDGGGA

SEQ ID NO: 225116 - protein, 19 aa, Mycobacterium bovis
GLVLGWRCSWCPSGTRGNG

SEQ ID NO: 225117 - protein, 19 aa, Mycobacterium bovis
GLVPLPSKWRIAFGEPICT

SEQ ID NO: 225118 - protein, 17 aa, Mycobacterium bovis
GLVRFIDACHTRRLGVL

SEQ ID NO: 225119 - protein, 19 aa, Mycobacterium bovis
GMLENPLTMVPAPTRRWAA

SEQ ID NO: 225120 - protein, 31 aa, Mycobacterium bovis
GNGGLGGDGFTYLADFDGEPGGDGGDGGDGG

SEQ ID NO: 225121 - protein, 34 aa, Mycobacterium bovis
GNGGPGTPGSPMVAPPPPTPITQVQQGGDGGAGG

SEQ ID NO: 225122 - protein, 24 aa, Mycobacterium bovis
GNGGRGGWLLGNGGAGGVGGVGGA

SEQ ID NO: 225123 - protein, 23 aa, Mycobacterium bovis
GNLGLIRAMEKFDYTKGFKFSTY

SEQ ID NO: 225124 - protein, 22 aa, Mycobacterium bovis
GNQILGRALGLSTYKMVFGHRG

SEQ ID NO: 225125 - protein, 27 aa, Mycobacterium bovis
GNVDALFLFDVLLHQVSPDWDTILDMY

SEQ ID NO: 225126 - protein, 25 aa, Mycobacterium bovis
GPGDYFGEIGVLFHLPRSATVRARS

SEQ ID NO: 225127 - protein, 23 aa, Mycobacterium bovis
GPLGRLRNIAYTQLDMRDVKRVK

SEQ ID NO: 225128 - protein, 22 aa, Mycobacterium bovis
GPQDMFFLYSESSTTMMHVGAL

SEQ ID NO: 225129 - protein, 24 aa, Mycobacterium bovis
GPTMTQYYIVRTENLPLLEPLRSV

SEQ ID NO: 225130 - protein, 27 aa, Mycobacterium bovis
GPTVMEDYFYRPFRDLVIRAAERADAP

SEQ ID NO: 225131 - protein, 18 aa, Mycobacterium bovis
GPVLALLCDPRVTVEIIA

SEQ ID NO: 225132 - protein, 24 aa, Mycobacterium bovis
GQAGGNGGWLWGNGGNGGSGAPGQ

SEQ ID NO: 225133 - protein, 24 aa, Mycobacterium bovis
GQAGGNGGWLWGNGGNSGSGAPGQ

SEQ ID NO: 225134 - protein, 24 aa, Mycobacterium bovis
GQVPYLLTLPGHGFYWFQLTTHEV

SEQ ID NO: 225135 - protein, 23 aa, Mycobacterium bovis
GRLWATILQHRFGGSGALAGHPI

SEQ ID NO: 225136 - protein, 25 aa, Mycobacterium bovis
GRSAACWARRLVFVNGHGGNVGALT

SEQ ID NO: 225137 - protein, 19 aa, Mycobacterium bovis
GRSIIVLSEGRLLNLGNAT

SEQ ID NO: 225138 - protein, 29 aa, Mycobacterium bovis
GRSVSDALDILRWAPQAASGPVAKVIASA

SEQ ID NO: 225139 - protein, 24 aa, Mycobacterium bovis
GRTRYRLLETVRQYALEKLRESGD

SEQ ID NO: 225140 - protein, 26 aa, Mycobacterium bovis
GSIERFFGILTEHYAGAFPAWLAPVQ

SEQ ID NO: 225141 - protein, 20 aa, Mycobacterium bovis
GSLAAKWLVTRVPVAGLAEK

SEQ ID NO: 225142 - protein, 25 aa, Mycobacterium bovis
GSQGLTPQLYPQLAAIAPTVFTAAP

SEQ ID NO: 225143 - protein, 24 aa, Mycobacterium bovis
GSRWYRTFQTREMLRWLRGEYNDA

SEQ ID NO: 225144 - protein, 23 aa, Mycobacterium bovis
GTASSPFGIAIAIGGAGAQGGAG

SEQ ID NO: 225145 - protein, 24 aa, Mycobacterium bovis
GVAGLLSRRLRIPAALAGVGAGLA

SEQ ID NO: 225146 - protein, 29 aa, Mycobacterium bovis
GVARVTAYRWFHAGLLPVPARKAGRLILV

SEQ ID NO: 225147 - protein, 18 aa, Mycobacterium bovis
GVDASKHGPLTGGDGGVG

SEQ ID NO: 225148 - protein, 22 aa, Mycobacterium bovis
GVGGTWHWNTYPGIAVDIPSFS

SEQ ID NO: 225149 - protein, 24 aa, Mycobacterium bovis
GVIKMVLAMRHELLPATLHVDVPS

SEQ ID NO: 225150 - protein, 23 aa, Mycobacterium bovis
GVITEQEWLAHWPTAVNDSRGGS

SEQ ID NO: 225151 - protein, 24 aa, Mycobacterium bovis
GVLRLRALMESFWSDELDRLVADA

SEQ ID NO: 225152 - protein, 17 aa, Mycobacterium bovis
GVLRVPPRPYVMPHSPA

SEQ ID NO: 225153 - protein, 29 aa, Mycobacterium bovis
GVRRAIGMVFQRPNPFPAMSIRNNVVAGL

SEQ ID NO: 225154 - protein, 20 aa, Mycobacterium bovis
GVRVGVETALLGRFFERFAD

SEQ ID NO: 225155 - protein, 17 aa, Mycobacterium bovis
HADALLALRQLGQRPRV

SEQ ID NO: 225156 - protein, 20 aa, Mycobacterium bovis
HARLHRFYRDLIALRHNEAD

SEQ ID NO: 225157 - protein, 26 aa, Mycobacterium bovis
HAVTLWKQWDRCALHWFPGSHLLHVS

SEQ ID NO: 225158 - protein, 30 aa, Mycobacterium bovis
HAYAGELLFLYNGVRPRNVMPVHGTWRMLR

SEQ ID NO: 225159 - protein, 24 aa, Mycobacterium bovis
HDTTHPLFFNIPTPGRSPADTQDS

SEQ ID NO: 225160 - protein, 24 aa, Mycobacterium bovis
HDVGLAILGPLRELDEVAYLRFAS

SEQ ID NO: 225161 - protein, 20 aa, Mycobacterium bovis
HERHPYGGDLVYTAFSGSHQ

SEQ ID NO: 225162 - protein, 17 aa, Mycobacterium bovis
HFAGLVAAGLHPSPVPH

SEQ ID NO: 225163 - protein, 20 aa, Mycobacterium bovis
HFYRDVLGFRLRDSMRLPPQ

SEQ ID NO: 225164 - protein, 18 aa, Mycobacterium bovis
HGLADMYGFIPVDREPGL

SEQ ID NO: 225165 - protein, 25 aa, Mycobacterium bovis
HGLCGYRRFFSITSLAGLRQEDRAV

SEQ ID NO: 225166 - protein, 20 aa, Mycobacterium bovis
HGNLVRLYPAGTASDEAGAG

SEQ ID NO: 225167 - protein, 22 aa, Mycobacterium bovis
HGRFALGERLLGFGSVTGAHIA

SEQ ID NO: 225168 - protein, 22 aa, Mycobacterium bovis
HGRSYILRAGISSLFRYIEGVH

SEQ ID NO: 225169 - protein, 19 aa, Mycobacterium bovis
HHTNHKVPFMVLAGDRDVA

SEQ ID NO: 225170 - protein, 19 aa, Mycobacterium bovis
HLHASPYVLVSILITPDLH

SEQ ID NO: 225171 - protein, 20 aa, Mycobacterium bovis
HLSFARDRLGDEFITGVLFY

SEQ ID NO: 225172 - protein, 17 aa, Mycobacterium bovis
HLWQWVGTNIGRYHSYP

SEQ ID NO: 225173 - protein, 20 aa, Mycobacterium bovis
HRDEALHLIRKRAKRLRYTA

SEQ ID NO: 225174 - protein, 21 aa, Mycobacterium bovis
HRQFPLDWRANGPIASTGLAR

SEQ ID NO: 225175 - protein, 26 aa, Mycobacterium bovis
HSEVDTLRRVELLRQLRLGDYDVLVG

SEQ ID NO: 225176 - protein, 17 aa, Mycobacterium bovis
HSVKVIPSRGAWLEFDV

SEQ ID NO: 225177 - protein, 25 aa, Mycobacterium bovis
HTLNLTDVHIGWVFTRTVRNNARTH

SEQ ID NO: 225178 - protein, 24 aa, Mycobacterium bovis
HTRRLRFGLAAPLPRAGTQMRAFA

SEQ ID NO: 225179 - protein, 20 aa, Mycobacterium bovis
HTVPLLGRRIAVIGTGSTGV

SEQ ID NO: 225180 - protein, 17 aa, Mycobacterium bovis
HVVALCGEVFPVTRAPK

SEQ ID NO: 225181 - protein, 18 aa, Mycobacterium bovis
HVVPLVRDVRRIGSAALD

SEQ ID NO: 225182 - protein, 25 aa, Mycobacterium bovis
HYAGAFPAWLAPVQVVGIPVADEHV

SEQ ID NO: 225183 - protein, 19 aa, Mycobacterium bovis
HYDLSDAFFALFQDPTRTY

SEQ ID NO: 225184 - protein, 19 aa, Mycobacterium bovis
HYRPISWDAAYQLIAEQLN

SEQ ID NO: 225185 - protein, 17 aa, Mycobacterium bovis
HYVDVPLPGPRLPHDMA

SEQ ID NO: 225186 - protein, 18 aa, Mycobacterium bovis
IAAVFPDGPQRYFDTIYN

SEQ ID NO: 225187 - protein, 23 aa, Mycobacterium bovis
IAERIGWWYSIRTLSGRVRELRP

SEQ ID NO: 225188 - protein, 17 aa, Mycobacterium bovis
IANGSSLAVGGFGLCGI

SEQ ID NO: 225189 - protein, 22 aa, Mycobacterium bovis
IARAHLLLRFDRGNWIAIDNDS

SEQ ID NO: 225190 - protein, 28 aa, Mycobacterium bovis
IARVISDVWLSNLLAWLTRRASATDVSK

SEQ ID NO: 225191 - protein, 17 aa, Mycobacterium bovis
IAVNPLPEAGLIRFKDP

SEQ ID NO: 225192 - protein, 18 aa, Mycobacterium bovis
ICDRLGLLPMYAVNQDKH

SEQ ID NO: 225193 - protein, 24 aa, Mycobacterium bovis
IDERTVICVLTHDPKFDVPVLEVA

SEQ ID NO: 225194 - protein, 25 aa, Mycobacterium bovis
IDSPELLWKALLRGDDLITEVPPDR

SEQ ID NO: 225195 - protein, 21 aa, Mycobacterium bovis
IDWVIKRKLFQRYQDRYDMEL

SEQ ID NO: 225196 - protein, 18 aa, Mycobacterium bovis
IEALGPIALPVKTSADSG

SEQ ID NO: 225197 - protein, 17 aa, Mycobacterium bovis
IFAALAKRLPKLATGPF

SEQ ID NO: 225198 - protein, 18 aa, Mycobacterium bovis
IFDQGLGDMFVVRTAGHV

SEQ ID NO: 225199 - protein, 18 aa, Mycobacterium bovis
IFGQFNDPLRFQPRWKEL

SEQ ID NO: 225200 - protein, 18 aa, Mycobacterium bovis
IFSVLLREYEFEMAQPPE

SEQ ID NO: 225201 - protein, 31 aa, Mycobacterium bovis
IGVELARGLAGRGFPLMLVARRRERLDELAD

SEQ ID NO: 225202 - protein, 24 aa, Mycobacterium bovis
IGVRSVCYVPLTYDHRLIDGADAG

SEQ ID NO: 225203 - protein, 21 aa, Mycobacterium bovis
IHNTQPWRWRVCPTSLELFSR

SEQ ID NO: 225204 - protein, 19 aa, Mycobacterium bovis
IIGAEALLRWEHPTLGTLL

SEQ ID NO: 225205 - protein, 17 aa, Mycobacterium bovis
ILIALRRCPAETAFDEL

SEQ ID NO: 225206 - protein, 19 aa, Mycobacterium bovis
IMGEVVDRSIFMWTAAPHA

SEQ ID NO: 225207 - protein, 19 aa, Mycobacterium bovis
IPAFKLTRSSAAYWRGDQK

SEQ ID NO: 225208 - protein, 18 aa, Mycobacterium bovis
IPGFPTTVTVFGTPFMGM

SEQ ID NO: 225209 - protein, 17 aa, Mycobacterium bovis
IPGLIGNGGNGGDGGAS

SEQ ID NO: 225210 - protein, 19 aa, Mycobacterium bovis
IPRLRRALVAPCTTTIRGL

SEQ ID NO: 225211 - protein, 20 aa, Mycobacterium bovis
IPVRVYWPPVVRDNLPVVVY

SEQ ID NO: 225212 - protein, 18 aa, Mycobacterium bovis
IQAAYWPRYGLGMGETYE

SEQ ID NO: 225213 - protein, 21 aa, Mycobacterium bovis
IRACRPITVPLTQAQGLVLGG

SEQ ID NO: 225214 - protein, 23 aa, Mycobacterium bovis
IRDAKVIAPDKPWFSYVCPGAGH

SEQ ID NO: 225215 - protein, 17 aa, Mycobacterium bovis
IREFGLLQPIVVRSLAG

SEQ ID NO: 225216 - protein, 22 aa, Mycobacterium bovis
IREVLRVWLGVAGLPAPGCRTI

SEQ ID NO: 225217 - protein, 28 aa, Mycobacterium bovis
IRIDLRKTYLFAFLDDHSRLVPGYRWGH

SEQ ID NO: 225218 - protein, 27 aa, Mycobacterium bovis
IRVLAAALRLRRTHPESFLGGAYHPVF

SEQ ID NO: 225219 - protein, 17 aa, Mycobacterium bovis
ISAVVGLAGRWLRPGGL

SEQ ID NO: 225220 - protein, 44 aa, Mycobacterium bovis; identical to SEQ ID NO: 164754

SEQ ID NO: 225221 - protein, 25 aa, Mycobacterium bovis
ISHGPAVLGAPAWKPPHPLSDSITA

SEQ ID NO: 225222 - protein, 21 aa, Mycobacterium bovis
ISLGWGLWDQASAMTSGLATV

SEQ ID NO: 225223 - protein, 17 aa, Mycobacterium bovis
ISNDRHLRTRPVEAELA

SEQ ID NO: 225224 - protein, 24 aa, Mycobacterium bovis
ISVPAFSLPAITLPSLTIPAVTTP

SEQ ID NO: 225225 - protein, 27 aa, Mycobacterium bovis
ITAKMTARYSQWVRSRPLLLAGKSVTG

SEQ ID NO: 225226 - protein, 19 aa, Mycobacterium bovis
ITDITPYWRPASWAAGVAV

SEQ ID NO: 225227 - protein, 25 aa, Mycobacterium bovis
ITEAWMRLQHRPRWQVTVSVVFDDW

SEQ ID NO: 225228 - protein, 19 aa, Mycobacterium bovis
ITIAIERIAPLFNLINGDL

SEQ ID NO: 225229 - protein, 21 aa, Mycobacterium bovis
ITRVRLRVHRIPESTRYEAWS

SEQ ID NO: 225230 - protein, 18 aa, Mycobacterium bovis
IVPSPFPPDDAPNVLIVL

SEQ ID NO: 225231 - protein, 17 aa, Mycobacterium bovis
IVSLWLDRLRQRGEITR

SEQ ID NO: 225232 - protein, 30 aa, Mycobacterium bovis
IVVPDITIPGIPLSLNALGGVGPITVPGVP

SEQ ID NO: 225233 - protein, 19 aa, Mycobacterium bovis
KAGRTWWVPNEHKPWPLRA

SEQ ID NO: 225234 - protein, 17 aa, Mycobacterium bovis
KAMMLAEPASWHALMAK

SEQ ID NO: 225235 - protein, 24 aa, Mycobacterium bovis
KAYHAEPFIYLMPEGQLPRTGAVI

SEQ ID NO: 225236 - protein, 23 aa, Mycobacterium bovis
KDGIPEVWPFAPAKHRAMLANLH

SEQ ID NO: 225237 - protein, 24 aa, Mycobacterium bovis
KENNVVYIQWAIRLARRGAVIVVD

SEQ ID NO: 225238 - protein, 22 aa, Mycobacterium bovis
KEYRDWFATLPAELTDVVTAYW

SEQ ID NO: 225239 - protein, 26 aa, Mycobacterium bovis
KGDVVVLLESMKMEIPVLAEAAGTVS

SEQ ID NO: 225240 - protein, 23 aa, Mycobacterium bovis
KIKAHAIALAETLPTACVLGDVD

SEQ ID NO: 225241 - protein, 21 aa, Mycobacterium bovis
KLAPQRLIVVLGHDHQRIAPL

SEQ ID NO: 225242 - protein, 18 aa, Mycobacterium bovis
KLGPVRPYGFLLICPVRS

SEQ ID NO: 225243 - protein, 26 aa, Mycobacterium bovis
KPAIDPILLKVLDAVPFRLSIDDGIE

SEQ ID NO: 225244 - protein, 18 aa, Mycobacterium bovis
KPFALEELLARMRALLRR

SEQ ID NO: 225245 - protein, 21 aa, Mycobacterium bovis
KPVLYQHFSSKLELYLAVLHR

SEQ ID NO: 225246 - protein, 17 aa, Mycobacterium bovis
KRQFRRAILDHQAGTVI

SEQ ID NO: 225247 - protein, 28 aa, Mycobacterium bovis
KSRGVRPRVWFGERWITSALDLFQENIR

SEQ ID NO: 225248 - protein, 22 aa, Mycobacterium bovis
KTTLIEALLVAAKVLSRPGSVT

SEQ ID NO: 225249 - protein, 21 aa, Mycobacterium bovis
KVTGIFLVPAQWQAVCTEQQA

SEQ ID NO: 225250 - protein, 17 aa, Mycobacterium bovis
LAALPSGASFGSLVHAV

SEQ ID NO: 225251 - protein, 23 aa, Mycobacterium bovis
LAARGLRRILTEGGPTLLGTFVE

SEQ ID NO: 225252 - protein, 18 aa, Mycobacterium bovis
LAARQRRFGVSYWTVFDE

SEQ ID NO: 225253 - protein, 26 aa, Mycobacterium bovis
LAETLLVVLCGVGFYIGFVGSYQRMA

SEQ ID NO: 225254 - protein, 33 aa, Mycobacterium bovis
LAGERPYREFPLDWMLGRLGLAGFRILEARRFP

SEQ ID NO: 225255 - protein, 26 aa, Mycobacterium bovis
LAGQGFSNLLLAYPPTDRAALRALGE

SEQ ID NO: 225256 - protein, 22 aa, Mycobacterium bovis
LAHTFPATRFLGAGAAMSLLPE

SEQ ID NO: 225257 - protein, 35 aa, Mycobacterium bovis
LAQPTKSIWPFDQLSELWKAISPHLSPLSNIVSML

SEQ ID NO: 225258 - protein, 18 aa, Mycobacterium bovis
LARAVRIGDWPAAYAIGE

SEQ ID NO: 225259 - protein, 35 aa, Mycobacterium bovis; identical to SEQ ID NO: 120958

SEQ ID NO: 225260 - protein, 19 aa, Mycobacterium bovis
LATQIRSLPRHLGIHSGGM

SEQ ID NO: 225261 - protein, 34 aa, Mycobacterium bovis
LAVAANARLALYSGGDYLLRRLTAEPATPAELRD

SEQ ID NO: 225262 - protein, 18 aa, Mycobacterium bovis
LAVGFWAAPSDLRANWRE

SEQ ID NO: 225263 - protein, 22 aa, Mycobacterium bovis
LAWRTKRLIVFDVDSTLVQGEV

SEQ ID NO: 225264 - protein, 25 aa, Mycobacterium bovis
LDAINAPVQSLTGRPLIGDGANGID

SEQ ID NO: 225265 - protein, 20 aa, Mycobacterium bovis
LDCADLGHLVFLPSGDAALT

SEQ ID NO: 225266 - protein, 29 aa, Mycobacterium bovis
LDDVLRRAVRLLAQLTRQVAVVQYPTLST

SEQ ID NO: 225267 - protein, 20 aa, Mycobacterium bovis
LDGSPLRYNQLDPYLPDLLM

SEQ ID NO: 225268 - protein, 21 aa, Mycobacterium bovis
LDHGQPRINRYHHPEKILCEP

SEQ ID NO: 225269 - protein, 18 aa, Mycobacterium bovis
LDIRTGHVALRVLHDGTA

SEQ ID NO: 225270 - protein, 17 aa, Mycobacterium bovis
LDLTYKEFELLKYLAQH

SEQ ID NO: 225271 - protein, 25 aa, Mycobacterium bovis
LDVLAQAQRPLLVLGKGAAYAQADN

SEQ ID NO: 225272 - protein, 25 aa, Mycobacterium bovis
LDWDDELLSLFSIPRAMLPEIASSA

SEQ ID NO: 225273 - protein, 17 aa, Mycobacterium bovis
LEEQVVVLRLLAAQQEA

SEQ ID NO: 225274 - protein, 21 aa, Mycobacterium bovis
LELYLAVLHRHVENLVSGVHQ

SEQ ID NO: 225275 - protein, 17 aa, Mycobacterium bovis
LEQLEFGLVREALYERE

SEQ ID NO: 225276 - protein, 17 aa, Mycobacterium bovis
LFAAHGQAYQAVSAQMS

SEQ ID NO: 225277 - protein, 25 aa, Mycobacterium bovis
LFCPDQFLGAHVRRVTGRKNLHVWA

SEQ ID NO: 225278 - protein, 26 aa, Mycobacterium bovis
LFEAGDWHLPAPLTLFGHCMGAIVAF

SEQ ID NO: 225279 - protein, 20 aa, Mycobacterium bovis
LFFRQHINYVLARPKLRPIT

SEQ ID NO: 225280 - protein, 35 aa, Mycobacterium bovis
LGARGLFACRQSLRPRYLCMLAEILRFHRAAARLL

SEQ ID NO: 225281 - protein, 29 aa, Mycobacterium bovis
LGAVNAPTQTLLGRPLIGDGAHGTAPGQP

SEQ ID NO: 225282 - protein, 25 aa, Mycobacterium bovis
LGEPTLTWLDSLAPNGPLVIIHNSG

SEQ ID NO: 225283 - protein, 19 aa, Mycobacterium bovis
LGGFTLPQLSIPAITTPAF

SEQ ID NO: 225284 - protein, 33 aa, Mycobacterium bovis
LGLGWRQCQTPTPPFALVLFLDIDWDETNKQHQ

SEQ ID NO: 225285 - protein, 18 aa, Mycobacterium bovis
LGPIALPVKTSADSGKLF

SEQ ID NO: 225286 - protein, 18 aa, Mycobacterium bovis
LGRRVVYRRDEVSRWISK

SEQ ID NO: 225287 - protein, 20 aa, Mycobacterium bovis
LGTRGIWHEGWFANTIHAAT

SEQ ID NO: 225288 - protein, 21 aa, Mycobacterium bovis
LHLGQVLRTPESWLLIDFEGE

SEQ ID NO: 225289 - protein, 18 aa, Mycobacterium bovis
LHLIRKRAKRLRYTAAAT

SEQ ID NO: 225290 - protein, 22 aa, Mycobacterium bovis
LHPYRVRHLLDRYGSLISDVLA

SEQ ID NO: 225291 - protein, 17 aa, Mycobacterium bovis
LHQAPLSPIVLRIGIHT

SEQ ID NO: 225292 - protein, 31 aa, Mycobacterium bovis
LIADLMARRLDRGRPLWEVWVIEGLADSKWA

SEQ ID NO: 225293 - protein, 18 aa, Mycobacterium bovis
LIGAPAMNLIDAAVAHGV

SEQ ID NO: 225294 - protein, 17 aa, Mycobacterium bovis
LIIYDEVHLLPAPVFRM

SEQ ID NO: 225295 - protein, 25 aa, Mycobacterium bovis
LKAALWELIWAGRVTGDTFAPVRAV

SEQ ID NO: 225296 - protein, 17 aa, Mycobacterium bovis
LLDKIFYRSGQGVTLQA

SEQ ID NO: 225297 - protein, 17 aa, Mycobacterium bovis
LLELARYKRGDLVVIVA

SEQ ID NO: 225298 - protein, 19 aa, Mycobacterium bovis
LLETYSVPPLLHNQALAIS

SEQ ID NO: 225299 - protein, 19 aa, Mycobacterium bovis
LLMALLTQNDGIAAPLLEA

SEQ ID NO: 225300 - protein, 17 aa, Mycobacterium bovis
LLPQHRALRHQIPQVYQ

SEQ ID NO: 225301 - protein, 19 aa, Mycobacterium bovis
LLSTFIAALMGAEADALCG

SEQ ID NO: 225302 - protein, 24 aa, Mycobacterium bovis
LLTGRRTWVPWTAVLVNVATRDCW

SEQ ID NO: 225303 - protein, 17 aa, Mycobacterium bovis
LLVAAKVLSRPGSVTEG

SEQ ID NO: 225304 - protein, 17 aa, Mycobacterium bovis
LPAIYVPLPIGNGEQRL

SEQ ID NO: 225305 - protein, 20 aa, Mycobacterium bovis
LPAQRRALTVHSARWRPWRS

SEQ ID NO: 225306 - protein, 17 aa, Mycobacterium bovis
LPASIRFQQGAYRIHPA

SEQ ID NO: 225307 - protein, 17 aa, Mycobacterium bovis
LPELAVQMRRRLIETVT

SEQ ID NO: 225308 - protein, 21 aa, Mycobacterium bovis
LPGYWQCTIPLGPDPDDEGDI

SEQ ID NO: 225309 - protein, 17 aa, Mycobacterium bovis
LPRIARATKILDLARAY

SEQ ID NO: 225310 - protein, 18 aa, Mycobacterium bovis
LPTLSIPSVTVPPITIPA

SEQ ID NO: 225311 - protein, 35 aa, Mycobacterium bovis
LQPVSATFNPPLRGWQRRALVQYLGTQPRDFLAVA

SEQ ID NO: 225312 - protein, 17 aa, Mycobacterium bovis
LQVIEKSFPAGYHVGRA

SEQ ID NO: 225313 - protein, 22 aa, Mycobacterium bovis
LRADACFVIGFGILRHIRCAGI

SEQ ID NO: 225314 - protein, 25 aa, Mycobacterium bovis
LRADMRVAHPLIARAHLLLRFDRGN

SEQ ID NO: 225315 - protein, 24 aa, Mycobacterium bovis
LRAIAAAHPDLILGSQGLTPQLYP

SEQ ID NO: 225316 - protein, 20 aa, Mycobacterium bovis
LRALFINATLKRSPELSHTD

SEQ ID NO: 225317 - protein, 35 aa, Mycobacterium bovis
LRELPHQLLRSWYILYFQLPWLPERSASWVVPLLW

SEQ ID NO: 225318 - protein, 19 aa, Mycobacterium bovis
LRGCYRIAVLSLKGGVGKT

SEQ ID NO: 225319 - protein, 33 aa, Mycobacterium bovis; identical to SEQ ID NO: 121199

SEQ ID NO: 225320 - protein, 18 aa, Mycobacterium bovis
LRLVDLCERLGLAKSTTR

SEQ ID NO: 225321 - protein, 31 aa, Mycobacterium bovis
LRRHGARRMVIAPWLLAPGILSDRVRGYARE

SEQ ID NO: 225322 - protein, 20 aa, Mycobacterium bovis
LSAALSAQLGDALNAYVDAA

SEQ ID NO: 225323 - protein, 28 aa, Mycobacterium bovis
LSAQLAAYHNQFVRALNAGAGSYASAEA

SEQ ID NO: 225324 - protein, 29 aa, Mycobacterium bovis
LSDGFRVPGLPMPSLPVIGGDAAAACIAA

SEQ ID NO: 225325 - protein, 20 aa, Mycobacterium bovis
LSSSAWPWQPYLLSHHQGGI

SEQ ID NO: 225326 - protein, 17 aa, Mycobacterium bovis
LSTFIAALMGAEADALC

SEQ ID NO: 225327 - protein, 20 aa, Mycobacterium bovis
LTEIDLLRPHDAPPATRIFE

SEQ ID NO: 225328 - protein, 26 aa, Mycobacterium bovis
LTINIRIPVNITLNELPFNVAGIFTG

SEQ ID NO: 225329 - protein, 23 aa, Mycobacterium bovis
LTQATCLFLDRQAFERLLATHPA

SEQ ID NO: 225330 - protein, 26 aa, Mycobacterium bovis
LTVEPSAPLPAFWVNIARKKILHAAT

SEQ ID NO: 225331 - protein, 20 aa, Mycobacterium bovis
LVASGLRSLPADGLKLAPGE

SEQ ID NO: 225332 - protein, 17 aa, Mycobacterium bovis
LVATNFFGINTIPIALN

SEQ ID NO: 225333 - protein, 28 aa, Mycobacterium bovis
LVERQTRLIRLLHLPTHDAYCLRIAITE

SEQ ID NO: 225334 - protein, 31 aa, Mycobacterium bovis
LVEWSHPLGHRWRWEFESLSPTLTRVTETFD

SEQ ID NO: 225335 - protein, 17 aa, Mycobacterium bovis
LVKVIRDLFNEDFVGLI

SEQ ID NO: 225336 - protein, 23 aa, Mycobacterium bovis
LVLEAPRRLVVRQYRLPRIGDDD

SEQ ID NO: 225337 - protein, 19 aa, Mycobacterium bovis
LVQDPARLPEALVSARREA

SEQ ID NO: 225338 - protein, 17 aa, Mycobacterium bovis
LVSKFAREVLGVAHALL

SEQ ID NO: 225339 - protein, 31 aa, Mycobacterium bovis
LVSLQSQHPDFLRLFYLLSMERSQDPAVAAV

SEQ ID NO: 225340 - protein, 19 aa, Mycobacterium bovis
LVTLGLNLFSRGVDPQIDF

SEQ ID NO: 225341 - protein, 25 aa, Mycobacterium bovis
LYAGWWQHLSTLGAVPRVLVWDGEG

SEQ ID NO: 225342 - protein, 17 aa, Mycobacterium bovis
MCELEAPEYFRVPKRGQ

SEQ ID NO: 225343 - protein, 24 aa, Mycobacterium bovis
MDDLHRHLLSVLIDREWRHGVRVG

SEQ ID NO: 225344 - protein, 28 aa, Mycobacterium bovis
MFQRTAQWVLPWPNPRYSKLARVFHRAF

SEQ ID NO: 225345 - protein, 29 aa, Mycobacterium bovis
MGRGSTWARQLPWLTLLGAVYTYDAPWHR

SEQ ID NO: 225346 - protein, 19 aa, Mycobacterium bovis
MGWSPFYPQFDRSSLDVAD

SEQ ID NO: 225347 - protein, 27 aa, Mycobacterium bovis
MIDDISQLVYLHLRFHGYGDGKWTDSA

SEQ ID NO: 225348 - protein, 39 aa, Mycobacterium bovis
MLTDVKLLARLFGLPYFPITPLFPLAGPVGLVPLPSKWR

SEQ ID NO: 225349 - protein, 22 aa, Mycobacterium bovis
MLVSSWQMPGGIYAPMMHPWST

SEQ ID NO: 225350 - protein, 24 aa, Mycobacterium bovis
MMHVGALMPFTPPSGAPPDLLRQL

SEQ ID NO: 225351 - protein, 17 aa, Mycobacterium bovis
MNLIDAAVAHGVVRAPD

SEQ ID NO: 225352 - protein, 18 aa, Mycobacterium bovis
MNLNHYEAIALVQKIAFS

SEQ ID NO: 225353 - protein, 19 aa, Mycobacterium bovis
MNVLYSLQHLGYTIPPQAD

SEQ ID NO: 225354 - protein, 23 aa, Mycobacterium bovis
MPCIRGLRIPVATVVAMVADQMT

SEQ ID NO: 225355 - protein, 25 aa, Mycobacterium bovis
MQAGGLTVYSGEWWHFDGPGPGPGA

SEQ ID NO: 225356 - protein, 17 aa, Mycobacterium bovis
MQWPWSSAYRLEPAVAT

SEQ ID NO: 225357 - protein, 18 aa, Mycobacterium bovis
MVAATMWDRYRQAVAGRI

SEQ ID NO: 225358 - protein, 25 aa, Mycobacterium bovis
MVGGVSIPLIKIPAAPGFGNSTTSP

SEQ ID NO: 225359 - protein, 25 aa, Mycobacterium bovis
MVREWLTVLLRRDLGLLVTIGVPGG

SEQ ID NO: 225360 - protein, 26 aa, Mycobacterium bovis
NAGTSISGFFNFGSLMSGFANFDDEV

SEQ ID NO: 225361 - protein, 27 aa, Mycobacterium bovis
NCYHQSLPLAAMLYARGSGLRASRNQG

SEQ ID NO: 225362 - protein, 19 aa, Mycobacterium bovis
NDPLRFQPRWKELFPTARQ

SEQ ID NO: 225363 - protein, 20 aa, Mycobacterium bovis
NGETWPLQDTVRPWDSLSDE

SEQ ID NO: 225364 - protein, 24 aa, Mycobacterium bovis
NGIDAARWPFAARRPRTGPAELLY

SEQ ID NO: 225365 - protein, 27 aa, Mycobacterium bovis
NGLAAELLRRLPFELTAGQREVLDVLS

SEQ ID NO: 225366 - protein, 25 aa, Mycobacterium bovis
NGPLAAFVHALADVGFDVAVLDYYE

SEQ ID NO: 225367 - protein, 18 aa, Mycobacterium bovis
NGSSLAVGGFGLCGIPEA

SEQ ID NO: 225368 - protein, 29 aa, Mycobacterium bovis
NGVARVIAYRWLRVGRLPVPARRVGRVIL

SEQ ID NO: 225369 - protein, 17 aa, Mycobacterium bovis
NKIILFGARTGLDGIGG

SEQ ID NO: 225370 - protein, 23 aa, Mycobacterium bovis
NLDKRIVRLPKTHIKAVGTHFVS

SEQ ID NO: 225371 - protein, 18 aa, Mycobacterium bovis
NLLVPLNFHLGYHGMPIG

SEQ ID NO: 225372 - protein, 27 aa, Mycobacterium bovis
NLTGVMTFGLPLAMTLNAVGSPITTAI

SEQ ID NO: 225373 - protein, 25 aa, Mycobacterium bovis
NNMVLAVQQIAIAEAFVLAEKLGLS

SEQ ID NO: 225374 - protein, 26 aa, Mycobacterium bovis
NNRRRARVHGFRLRMRTRAGRSIVSS

SEQ ID NO: 225375 - protein, 19 aa, Mycobacterium bovis
NPFPMSIMDNVLAGVRAHK

SEQ ID NO: 225376 - protein, 20 aa, Mycobacterium bovis
NPLTMVPAPTRRWAARRRGG

SEQ ID NO: 225377 - protein, 28 aa, Mycobacterium bovis
NRRGNYLYNFWRDAANPRGLWRRTTLDS

SEQ ID NO: 225378 - protein, 27 aa, Mycobacterium bovis
NRYAPPPPYPAPDPFEPFAVAVVELAD

SEQ ID NO: 225379 - protein, 26 aa, Mycobacterium bovis
NSAIVRPLLRFFFKSWFRVEVSGVEN

SEQ ID NO: 225380 - protein, 18 aa, Mycobacterium bovis
NSNGLLRQYFPKGTSLST

SEQ ID NO: 225381 - protein, 17 aa, Mycobacterium bovis
NSSMVTNWTVAPAGPGS

SEQ ID NO: 225382 - protein, 26 aa, Mycobacterium bovis
NVQEDFAYHQFLIKKSKMPSQTPPEP

SEQ ID NO: 225383 - protein, 18 aa, Mycobacterium bovis
NYAVLLPTVDIALALVTT

SEQ ID NO: 225384 - protein, 18 aa, Mycobacterium bovis
NYLIVRAGEFSRISDVLL

SEQ ID NO: 225385 - protein, 25 aa, Mycobacterium bovis
PAERYQPWLDRLLAMSWDDSEHRKI

SEQ ID NO: 225386 - protein, 28 aa, Mycobacterium bovis
PAHQPGSWSRLFTGATFPGASKAVADLR

SEQ ID NO: 225387 - protein, 17 aa, Mycobacterium bovis
PALDTLPTLAGGPFDLV

SEQ ID NO: 225388 - protein, 23 aa, Mycobacterium bovis
PALLRVRFPWPPFEPDVRLSPYL

SEQ ID NO: 225389 - protein, 22 aa, Mycobacterium bovis
PAPGLPADLLIHNRWHRDPHGS

SEQ ID NO: 225390 - protein, 17 aa, Mycobacterium bovis
PAPPRRKPIQMPGLQDV

SEQ ID NO: 225391 - protein, 26 aa, Mycobacterium bovis
PAQQRYPPWPASYDASLRVSWRQLQP

SEQ ID NO: 225392 - protein, 26 aa, Mycobacterium bovis
PASAAMTGVAASYARWLTTAAAQAEQ

SEQ ID NO: 225393 - protein, 24 aa, Mycobacterium bovis
PDAANGFILDGYPRSVEQAKALHE

SEQ ID NO: 225394 - protein, 24 aa, Mycobacterium bovis
PDDLLNALIDFLAAVRNGLVPIIE

SEQ ID NO: 225395 - protein, 33 aa, Mycobacterium bovis
PDNGGMYFVPAFSGLFAPYWRSDARGAIVGLSR

SEQ ID NO: 225396 - protein, 27 aa, Mycobacterium bovis
PDVVHAHDWLVAHPAIALAQFYDVPMV

SEQ ID NO: 225397 - protein, 18 aa, Mycobacterium bovis
PEQIGYPDQGGYPEQRGY

SEQ ID NO: 225398 - protein, 18 aa, Mycobacterium bovis
PFAFEGVFGHLAATAVPG

SEQ ID NO: 225399 - protein, 19 aa, Mycobacterium bovis
PFGLFPEVSPVVIADALAA

SEQ ID NO: 225400 - protein, 18 aa, Mycobacterium bovis
PFYTGKQKILDSGGRVAR

SEQ ID NO: 225401 - protein, 17 aa, Mycobacterium bovis
PGAYVAGWIKRGPTGFI

SEQ ID NO: 225402 - protein, 28 aa, Mycobacterium bovis
PGCYPTAALLALFPALAADLIEPAVTVV

SEQ ID NO: 225403 - protein, 28 aa, Mycobacterium bovis
PGETRFALVLSRLFWDAAIFHRACEAVM

SEQ ID NO: 225404 - protein, 21 aa, Mycobacterium bovis
PGGVLAWESLALSGAEAGTAS

SEQ ID NO: 225405 - protein, 19 aa, Mycobacterium bovis
PGLLAELRRRAEARHPPVV

SEQ ID NO: 225406 - protein, 23 aa, Mycobacterium bovis
PGLRAEFGDRLPVVLLDGREHSY

SEQ ID NO: 225407 - protein, 18 aa, Mycobacterium bovis
PGLRAIFAELLGIAVPNL

SEQ ID NO: 225408 - protein, 21 aa, Mycobacterium bovis
PGMFSRITIDYYGAATLITQL

SEQ ID NO: 225409 - protein, 22 aa, Mycobacterium bovis
PGPPPTVWSRRWRQPWAPPTSV

SEQ ID NO: 225410 - protein, 18 aa, Mycobacterium bovis
PGRGAWLHPLRQCAQQAI

SEQ ID NO: 225411 - protein, 20 aa, Mycobacterium bovis
PGSGIPKSNFYPSPDRESAY

SEQ ID NO: 225412 - protein, 17 aa, Mycobacterium bovis
PGTYGAGLLQLIDSRSW

SEQ ID NO: 225413 - protein, 32 aa, Mycobacterium bovis
PIAVTDWFGDQPFAVWPWAAPKLGGARPAVLN

SEQ ID NO: 225414 - protein, 17 aa, Mycobacterium bovis
PIGTTIFELDRPQVLDF

SEQ ID NO: 225415 - protein, 19 aa, Mycobacterium bovis
PIPGRLFAGPGLSQPSDVL

SEQ ID NO: 225416 - protein, 30 aa, Mycobacterium bovis
PKEMWDAFAEEYLAPVRPLERIRQHVDAAD

SEQ ID NO: 225417 - protein, 23 aa, Mycobacterium bovis
PKPSWPWVRTLLHSIYDQPDAES

SEQ ID NO: 225418 - protein, 21 aa, Mycobacterium bovis
PLAGKPFYVDPASAAMVAARN

SEQ ID NO: 225419 - protein, 24 aa, Mycobacterium bovis
PLDPQAIQPVLVAASLLVAELGDV

SEQ ID NO: 225420 - protein, 20 aa, Mycobacterium bovis
PLDRLIAFGRERMRFVHAHH

SEQ ID NO: 225421 - protein, 24 aa, Mycobacterium bovis
PLHSDPWFATQLAGFPKPILHGLC

SEQ ID NO: 225422 - protein, 17 aa, Mycobacterium bovis
PLNWCNPSGRALGAPPT

SEQ ID NO: 225423 - protein, 22 aa, Mycobacterium bovis
PLVVVAGAATRWVWVKDAPGFD

SEQ ID NO: 225424 - protein, 25 aa, Mycobacterium bovis
PNDPLALVLIELRHPRTEPPVPSAI

SEQ ID NO: 225425 - protein, 18 aa, Mycobacterium bovis
PNVWPRNTTRDEVGVVCI

SEQ ID NO: 225426 - protein, 17 aa, Mycobacterium bovis
PPAEPFLVELRGPSGDT

SEQ ID NO: 225427 - protein, 27 aa, Mycobacterium bovis
PPDAELTERPDLFPAWDSMSEAQKRLF

SEQ ID NO: 225428 - protein, 26 aa, Mycobacterium bovis
PPYEQRPPVSPGPAAGYGAPGYDQGY

SEQ ID NO: 225429 - protein, 20 aa, Mycobacterium bovis
PRIAGPCGMVIFGVTGDLAR

SEQ ID NO: 225430 - protein, 28 aa, Mycobacterium bovis
PRRAVLVRPPRGLTATGLAALLRSMRSP

SEQ ID NO: 225431 - protein, 23 aa, Mycobacterium bovis
PRVAQGILILFFATGFPAQRIHQ

SEQ ID NO: 225432 - protein, 31 aa, Mycobacterium bovis
PRYAELIKRTQWWGRQMLIWGVHVHVGIRSA

SEQ ID NO: 225433 - protein, 26 aa, Mycobacterium bovis
PSAFNTIIDKWLPLSWSLNMVNRSMG

SEQ ID NO: 225434 - protein, 31 aa, Mycobacterium bovis; identical to SEQ ID NO: 164862

SEQ ID NO: 225435 - protein, 18 aa, Mycobacterium bovis
PSRGLIGWRTDFLTETRG

SEQ ID NO: 225436 - protein, 17 aa, Mycobacterium bovis
PSTVRLFPVDGAVSPTI

SEQ ID NO: 225437 - protein, 17 aa, Mycobacterium bovis
PTARFLEKEQRIIAALR

SEQ ID NO: 225438 - protein, 22 aa, Mycobacterium bovis
PTHIETLLRPSLQPETRLAAPL

SEQ ID NO: 225439 - protein, 21 aa, Mycobacterium bovis
PTQIPSVAVPVTGAGGTGGNG

SEQ ID NO: 225440 - protein, 22 aa, Mycobacterium bovis
PTTFEVFARRLPTGRRYGVVAG

SEQ ID NO: 225441 - protein, 19 aa, Mycobacterium bovis
PVDQLRYPVFSWQRITLQE

SEQ ID NO: 225442 - protein, 17 aa, Mycobacterium bovis
PVGGLHLQFGRNASTEM

SEQ ID NO: 225443 - protein, 17 aa, Mycobacterium bovis
PVILVVNKTDRPDARIA

SEQ ID NO: 225444 - protein, 18 aa, Mycobacterium bovis
PVSYRPGLLCVRQKRFTH

SEQ ID NO: 225445 - protein, 23 aa, Mycobacterium bovis
PVTGLVFVTNFDSNTVSVIDPNT

SEQ ID NO: 225446 - protein, 23 aa, Mycobacterium bovis
PVTIPGFAINPFGLDVPLSGGTN

SEQ ID NO: 225447 - protein, 26 aa, Mycobacterium bovis
PVTIPGFAINPFGLDVPLSGGTSPVT

SEQ ID NO: 225448 - protein, 25 aa, Mycobacterium bovis
PVTIPGFAINPFGLNVPLSGGTNAV

SEQ ID NO: 225449 - protein, 18 aa, Mycobacterium bovis
PWTMLGNLAFGLPSRLRL

SEQ ID NO: 225450 - protein, 21 aa, Mycobacterium bovis
PYVDAWLLRACAKLGVRLVHS

SEQ ID NO: 225451 - protein, 17 aa, Mycobacterium bovis
QAFFDFIEHDSQGYRLI

SEQ ID NO: 225452 - protein, 30 aa, Mycobacterium bovis
QALGNTPLVGLQRLSPRWDDGRDGPHVRLW

SEQ ID NO: 225453 - protein, 20 aa, Mycobacterium bovis
QANYAGRPSPLYEATRLSQH

SEQ ID NO: 225454 - protein, 17 aa, Mycobacterium bovis
QAYPLMSRMVELGWICV

SEQ ID NO: 225455 - protein, 17 aa, Mycobacterium bovis
QCRLPAPQYPVPAQGRH

SEQ ID NO: 225456 - protein, 21 aa, Mycobacterium bovis
QDARWFLLCTVDGATVTTADG

SEQ ID NO: 225457 - protein, 18 aa, Mycobacterium bovis
QDGLWLRIMNVPAALEAR

SEQ ID NO: 225458 - protein, 25 aa, Mycobacterium bovis
QDSRGTFTIIFTGPAFHPHGNSRCR

SEQ ID NO: 225459 - protein, 29 aa, Mycobacterium bovis
QDWDGVAITLTWSQLYRRTLNVARELSRC

SEQ ID NO: 225460 - protein, 21 aa, Mycobacterium bovis
QEISRLIGRSLRACIDLAALG

SEQ ID NO: 225461 - protein, 26 aa, Mycobacterium bovis
QETFLRAIGAIPRFSARSSARTWLLA

SEQ ID NO: 225462 - protein, 17 aa, Mycobacterium bovis
QFTTFGDPTGRHAFGAS

SEQ ID NO: 225463 - protein, 37 aa, Mycobacterium bovis
QGGNGAAGGAGWSPDSDLKGFDGFDGGSGGAGGDGGA

SEQ ID NO: 225464 - protein, 61 aa, Mycobacterium bovis
QGQWGAHYAITVPQIPLLNFSLNIPVNIPIHLDFGTLAVNGFQIPAITLRALGVTHFSVGP

SEQ ID NO: 225465 - protein, 18 aa, Mycobacterium bovis
QIQQLVVARRLLGLSSSE

SEQ ID NO: 225466 - protein, 36 aa, Mycobacterium bovis
QLAQPTKSIWPFDQLSELWKAISPHLSPLSNIVSML

SEQ ID NO: 225467 - protein, 30 aa, Mycobacterium bovis
QLGTPEIPAIPPFFPGFPPDYVTVSGQIGP

SEQ ID NO: 225468 - protein, 33 aa, Mycobacterium bovis
QLHCKIMWCPSVSLSIWANAWLAGKAAPDDVLD

SEQ ID NO: 225469 - protein, 19 aa, Mycobacterium bovis
QLLSLVLSNLFGQNLPAIA

SEQ ID NO: 225470 - protein, 21 aa, Mycobacterium bovis
QLNAALHRIALTQIRMTDSRG

SEQ ID NO: 225471 - protein, 24 aa, Mycobacterium bovis
QLRAHLRVVFPGVGLFADLDSPIS

SEQ ID NO: 225472 - protein, 17 aa, Mycobacterium bovis
QLTADAILANRLYVLPH

SEQ ID NO: 225473 - protein, 22 aa, Mycobacterium bovis
QMLDTAVLLGALPPRVSPVSDG

SEQ ID NO: 225474 - protein, 18 aa, Mycobacterium bovis
QMRTAAPDFRLFWDNAYA

SEQ ID NO: 225475 - protein, 21 aa, Mycobacterium bovis
QNPRRRWRGGSLPPRRDRSRV

SEQ ID NO: 225476 - protein, 26 aa, Mycobacterium bovis
QPDVIVLGLARGGLPVAWEVAAALHA

SEQ ID NO: 225477 - protein, 21 aa, Mycobacterium bovis
QPIRRYDVDAAILFSDIVVPL

SEQ ID NO: 225478 - protein, 19 aa, Mycobacterium bovis
QPMLSIHQRPFDPADRSEP

SEQ ID NO: 225479 - protein, 24 aa, Mycobacterium bovis
QQLAMTPGFLRVFGFRTAKARAAL

SEQ ID NO: 225480 - protein, 20 aa, Mycobacterium bovis
QQYAILDDRLRHLPGGIDEY

SEQ ID NO: 225481 - protein, 19 aa, Mycobacterium bovis
QRAFLRYGKGRHRAALNFG

SEQ ID NO: 225482 - protein, 25 aa, Mycobacterium bovis
QRDRAKMFALLWQSLRRQRQLLKRF

SEQ ID NO: 225483 - protein, 26 aa, Mycobacterium bovis
QRHRLPVFEIAWALVHLAVEGSTPCR

SEQ ID NO: 225484 - protein, 17 aa, Mycobacterium bovis
QRIMLYAKDSGCSAPGC

SEQ ID NO: 225485 - protein, 19 aa, Mycobacterium bovis
QRLRLRPFDLGAPKWVDDP

SEQ ID NO: 225486 - protein, 24 aa, Mycobacterium bovis
QRRAVRQWLVRWAAHPGRATRGFH

SEQ ID NO: 225487 - protein, 20 aa, Mycobacterium bovis
QRYESGALRQAGFYGLDLYS

SEQ ID NO: 225488 - protein, 21 aa, Mycobacterium bovis
QTFDLRRATLTRSLRFRDAGG

SEQ ID NO: 225489 - protein, 19 aa, Mycobacterium bovis
QTGLLPHLNPGVMSWSEMS

SEQ ID NO: 225490 - protein, 18 aa, Mycobacterium bovis
QTGRRFPSVAPRLNRLMT

SEQ ID NO: 225491 - protein, 18 aa, Mycobacterium bovis
QTIDRWIRGWRAGGFDAL

SEQ ID NO: 225492 - protein, 19 aa, Mycobacterium bovis
QTIYSFTGASPRFLLDFSR

SEQ ID NO: 225493 - protein, 29 aa, Mycobacterium bovis
QTVAIPGFPNFFMMLGPHSPVGNFPLTAV

SEQ ID NO: 225494 - protein, 33 aa, Mycobacterium bovis
QTVSAQVATFHDRFVQTLSAAASSYVAAEAVNV

SEQ ID NO: 225495 - protein, 20 aa, Mycobacterium bovis
QVKIIDRVLASPLVTEAMVL

SEQ ID NO: 225496 - protein, 32 aa, Mycobacterium bovis
QVLAAVRATFKPEFINRLDDVLIFEGLNPEEL

SEQ ID NO: 225497 - protein, 23 aa, Mycobacterium bovis
QVLRALDGRFIPAGPSGSPLRGL

SEQ ID NO: 225498 - protein, 17 aa, Mycobacterium bovis
QVPVSWRRRLRTDRNST

SEQ ID NO: 225499 - protein, 25 aa, Mycobacterium bovis
QWDGGYVANYTINQFGRDFDDRLAV

SEQ ID NO: 225500 - protein, 21 aa, Mycobacterium bovis
QYNTYLKQYLALYTNGMNDVV

SEQ ID NO: 225501 - protein, 19 aa, Mycobacterium bovis
RAEFQRITQDLLDRTRKPF

SEQ ID NO: 225502 - protein, 28 aa, Mycobacterium bovis
RAERARAIGLFRYQLIWEAADAAHSTKQ

SEQ ID NO: 225503 - protein, 17 aa, Mycobacterium bovis
RAIFAELLGIAVPNLIA

SEQ ID NO: 225504 - protein, 19 aa, Mycobacterium bovis
RALGWLREDRKPLLNAKLL

SEQ ID NO: 225505 - protein, 26 aa, Mycobacterium bovis
RAPADLLSGYYHAVHKLTLEYIAGMT

SEQ ID NO: 225506 - protein, 17 aa, Mycobacterium bovis
RATLTRSLRFRDAGGRV

SEQ ID NO: 225507 - protein, 24 aa, Mycobacterium bovis
RAVAPGLFVPTVIASAVVAKEGTD

SEQ ID NO: 225508 - protein, 19 aa, Mycobacterium bovis
RAWHAYFRDARRAHALYTD

SEQ ID NO: 225509 - protein, 26 aa, Mycobacterium bovis
RCRGAAVVTPLLLADAYHARVDIPAQ

SEQ ID NO: 225510 - protein, 25 aa, Mycobacterium bovis
RDGAEWIHLVDLDAAFGRGSNHELL

SEQ ID NO: 225511 - protein, 17 aa, Mycobacterium bovis
RDGWVDRFGLDLPRHDT

SEQ ID NO: 225512 - protein, 20 aa, Mycobacterium bovis
RDIEWRIGPGERIGIVGANG

SEQ ID NO: 225513 - protein, 27 aa, Mycobacterium bovis
RDIQVRGYTLRLPLDVLVVASANPEDY

SEQ ID NO: 225514 - protein, 17 aa, Mycobacterium bovis
RDLWWHHVVGSASPAHT

SEQ ID NO: 225515 - protein, 18 aa, Mycobacterium bovis
RDNPYGFVAFDVDPGQPG

SEQ ID NO: 225516 - protein, 23 aa, Mycobacterium bovis
RDPHRHELRSYRIVDGAVTEEPV

SEQ ID NO: 225517 - protein, 28 aa, Mycobacterium bovis
RDRLGDEFITGVLFYTGARALPFGDRLM

SEQ ID NO: 225518 - protein, 22 aa, Mycobacterium bovis
RDRTYFLNFDTIGSPELIMLEG

SEQ ID NO: 225519 - protein, 27 aa, Mycobacterium bovis
REARLQRPLYVMPTKGIFTSSFGYRWG

SEQ ID NO: 225520 - protein, 22 aa, Mycobacterium bovis
REDRKPLLNAKLLVLGHLALNV

SEQ ID NO: 225521 - protein, 24 aa, Mycobacterium bovis
REFTFPMEFVSFKGGWQLSRQTAE

SEQ ID NO: 225522 - protein, 20 aa, Mycobacterium bovis
REGYFQIAYLGPKGTDAQLR

SEQ ID NO: 225523 - protein, 20 aa, Mycobacterium bovis
REHLGVRPPVEADWLLLVEL

SEQ ID NO: 225524 - protein, 18 aa, Mycobacterium bovis
RFTSMYRRIVGSAGPITD

SEQ ID NO: 225525 - protein, 17 aa, Mycobacterium bovis
RGAEVVDLLAALNTGHE

SEQ ID NO: 225526 - protein, 24 aa, Mycobacterium bovis
RGFERFYGFLGGETDQWYPDLVYD

SEQ ID NO: 225527 - protein, 23 aa, Mycobacterium bovis
RGGQWSGGRQRRAGQRRQRRQRW

SEQ ID NO: 225528 - protein, 17 aa, Mycobacterium bovis
RGILLHADPVDSAAATG

SEQ ID NO: 225529 - protein, 25 aa, Mycobacterium bovis
RGIPVRRPGRFFATVDFSPMGCGIA

SEQ ID NO: 225530 - protein, 30 aa, Mycobacterium bovis
RGVAAVAPVCRLLRRLLGPTDPVLASTVFG

SEQ ID NO: 225531 - protein, 28 aa, Mycobacterium bovis
RHHFSQYFVDYFITPLVAAVWSCGGADA

SEQ ID NO: 225532 - protein, 21 aa, Mycobacterium bovis
RHTGKVVMLMPGSWAAGTVLI

SEQ ID NO: 225533 - protein, 22 aa, Mycobacterium bovis
RIAQLCHPNLRNTFPPLRMRIA

SEQ ID NO: 225534 - protein, 20 aa, Mycobacterium bovis
RIARATKILDLARAYGIEVS

SEQ ID NO: 225535 - protein, 27 aa, Mycobacterium bovis
RIDTQLPNWWGPILAPALAGVGALRGS

SEQ ID NO: 225536 - protein, 26 aa, Mycobacterium bovis
RIGELPRGLHRLAGAAGLLGAGFPEA

SEQ ID NO: 225537 - protein, 17 aa, Mycobacterium bovis
RIISVVPVVLEVRRAEP

SEQ ID NO: 225538 - protein, 17 aa, Mycobacterium bovis
RIQPWMQAIADATGRPV

SEQ ID NO: 225539 - protein, 31 aa, Mycobacterium bovis
RKNERYKLVWKNRLGFARLAIQHGYPIVPFA

SEQ ID NO: 225540 - protein, 23 aa, Mycobacterium bovis
RKVVVFRPLYAVGGQELGYLPGS

SEQ ID NO: 225541 - protein, 23 aa, Mycobacterium bovis
RLAHVHLSRRLAHWTRLYPEVRV

SEQ ID NO: 225542 - protein, 18 aa, Mycobacterium bovis
RLCLDFDAGYWRAGGRIK

SEQ ID NO: 225543 - protein, 20 aa, Mycobacterium bovis
RLDFRPKHRLAVLVVSAIPL

SEQ ID NO: 225544 - protein, 17 aa, Mycobacterium bovis
RLLPALIDGTLTAGVGL

SEQ ID NO: 225545 - protein, 21 aa, Mycobacterium bovis
RLMRGLGSSIYPRNVDYRAFD

SEQ ID NO: 225546 - protein, 24 aa, Mycobacterium bovis
RLRRLAGLWLADQEERWAAVRIDV

SEQ ID NO: 225547 - protein, 29 aa, Mycobacterium bovis
RLVELFTAEAIWEMPPYTGWYQGAQAIVT

SEQ ID NO: 225548 - protein, 21 aa, Mycobacterium bovis
RLWEHWGKPEIVWYPGGHTGF

SEQ ID NO: 225549 - protein, 19 aa, Mycobacterium bovis
RMFDVVPNPAWVARPGKYA

SEQ ID NO: 225550 - protein, 25 aa, Mycobacterium bovis
RMYTRARFAPYVEKLLLDGARTKLT

SEQ ID NO: 225551 - protein, 22 aa, Mycobacterium bovis
RNPRSLRVCTLLRKPDAVHANV

SEQ ID NO: 225552 - protein, 17 aa, Mycobacterium bovis
RPGEFVFVLGYLGHVRA

SEQ ID NO: 225553 - protein, 17 aa, Mycobacterium bovis
RPGGRLGLVWNTRDERL

SEQ ID NO: 225554 - protein, 18 aa, Mycobacterium bovis
RPLDAGPYTFLAADALVL

SEQ ID NO: 225555 - protein, 18 aa, Mycobacterium bovis
RPLDTEWIDRPTAFAARR

SEQ ID NO: 225556 - protein, 20 aa, Mycobacterium bovis
RPLGLLLTRRSENATVTLCH

SEQ ID NO: 225557 - protein, 21 aa, Mycobacterium bovis
RPPFARNVRFLPTAAAAQGEG

SEQ ID NO: 225558 - protein, 20 aa, Mycobacterium bovis
RPPMVTSGLRIGTPALATRG

SEQ ID NO: 225559 - protein, 25 aa, Mycobacterium bovis
RPPVEADWLLLVELAADHDQTDRLA

SEQ ID NO: 225560 - protein, 24 aa, Mycobacterium bovis
RQQVLFCGLWYDDDFVRTPDGWRI

SEQ ID NO: 225561 - protein, 21 aa, Mycobacterium bovis
RQRLHVAVQAFFDFIEHDSQG

SEQ ID NO: 225562 - protein, 22 aa, Mycobacterium bovis
RQRLPRTIQIEAGVFLWCTPGD

SEQ ID NO: 225563 - protein, 18 aa, Mycobacterium bovis
RQRYGWCPRPDWVRVVPD

SEQ ID NO: 225564 - protein, 23 aa, Mycobacterium bovis
RQYRDMRILGIGGGTTEILTALA

SEQ ID NO: 225565 - protein, 27 aa, Mycobacterium bovis
RRFAGMWHDFHLQVGLLPEARDAIADL

SEQ ID NO: 225566 - protein, 23 aa, Mycobacterium bovis
RRFGVSYWTVFDEWAGRASAMRD

SEQ ID NO: 225567 - protein, 28 aa, Mycobacterium bovis
RRGRVQSVLLPRLLDWMSYAPDPDGGLL

SEQ ID NO: 225568 - protein, 18 aa, Mycobacterium bovis
RRHSVLPMLLASNSQRLQ

SEQ ID NO: 225569 - protein, 31 aa, Mycobacterium bovis
RRRKHLTLVHKTNVLTLAGGLWLRTVDEVGE

SEQ ID NO: 225570 - protein, 26 aa, Mycobacterium bovis
RRTGIEMAWSEGRDLWWHHVVGSASP

SEQ ID NO: 225571 - protein, 23 aa, Mycobacterium bovis
RSAAYAMRWVAKNVVAAGLAERV

SEQ ID NO: 225572 - protein, 23 aa, Mycobacterium bovis
RSGKIMRRLLRDVAENRELGDTS

SEQ ID NO: 225573 - protein, 23 aa, Mycobacterium bovis
RSLAWELSWKDTAAPLWTFPRVA

SEQ ID NO: 225574 - protein, 17 aa, Mycobacterium bovis
RSYFWVAKTTAADGLGY

SEQ ID NO: 225575 - protein, 19 aa, Mycobacterium bovis
RTDEARQILGHRAMIVAGG

SEQ ID NO: 225576 - protein, 19 aa, Mycobacterium bovis
RTIRLPVHLVEQVNKLARI

SEQ ID NO: 225577 - protein, 22 aa, Mycobacterium bovis
RTPGFERTLLGRALDFWNEEVY

SEQ ID NO: 225578 - protein, 31 aa, Mycobacterium bovis
RTRRRWPPNIQLKAYYLPSEDRRIKVRVSAQ

SEQ ID NO: 225579 - protein, 22 aa, Mycobacterium bovis
RVDLILPGFRYRAAMADGTVEN

SEQ ID NO: 225580 - protein, 19 aa, Mycobacterium bovis
RVLGGAVALLRDLLNPDEV

SEQ ID NO: 225581 - protein, 23 aa, Mycobacterium bovis
RVTAPAHWKVISNGAPLAAANGV

SEQ ID NO: 225582 - protein, 17 aa, Mycobacterium bovis
RVTRNAPPFLVIHGSRD

SEQ ID NO: 225583 - protein, 18 aa, Mycobacterium bovis
RVWVMNRLREKMPHVYVT

SEQ ID NO: 225584 - protein, 18 aa, Mycobacterium bovis
RWARNTGGLLVVTHDRWF

SEQ ID NO: 225585 - protein, 20 aa, Mycobacterium bovis
RWFLPLAVPLGLGPKNSELW

SEQ ID NO: 225586 - protein, 21 aa, Mycobacterium bovis
RWNWTDVRRWLTDPTGRWHPI

SEQ ID NO: 225587 - protein, 21 aa, Mycobacterium bovis
RWRRRRALWVGVTLGGAVDSA

SEQ ID NO: 225588 - protein, 33 aa, Mycobacterium bovis
RYIVISAYVPKHWQKLCYLIGRPDLVEDQRFAE

SEQ ID NO: 225589 - protein, 27 aa, Mycobacterium bovis
RYPARYLFVFLDHHGMLSVFGSPTWRT

SEQ ID NO: 225590 - protein, 25 aa, Mycobacterium bovis
SAAAYVAAHAPYLAWLMRASETSAE

SEQ ID NO: 225591 - protein, 23 aa, Mycobacterium bovis
SAAMRWGHLPLAEESGTIAPQLV

SEQ ID NO: 225592 - protein, 24 aa, Mycobacterium bovis
SAFQSVVWGLTVGSWIGSSAGLMV

SEQ ID NO: 225593 - protein, 21 aa, Mycobacterium bovis
SAPMLAASVAWDRLAAELAVA

SEQ ID NO: 225594 - protein, 18 aa, Mycobacterium bovis
SAQAALFHDRFVQILQEG

SEQ ID NO: 225595 - protein, 25 aa, Mycobacterium bovis
SAQQGKFLCLLAGAIQARRVLEIGT

SEQ ID NO: 225596 - protein, 20 aa, Mycobacterium bovis
SASFPLAFEPSFLPFTKGTA

SEQ ID NO: 225597 - protein, 17 aa, Mycobacterium bovis
SAVLSRLRRTHTVIVID

SEQ ID NO: 225598 - protein, 18 aa, Mycobacterium bovis
SDALALGQPGGNGGQGDA

SEQ ID NO: 225599 - protein, 23 aa, Mycobacterium bovis
SDEFFSLFLDPTMAYTCAYFERE

SEQ ID NO: 225600 - protein, 28 aa, Mycobacterium bovis
SDMTRTFVLGKAADWQLEIYQLVAEAQQ

SEQ ID NO: 225601 - protein, 24 aa, Mycobacterium bovis
SDQPRPLVPAMFSAVLSRLRRTHT

SEQ ID NO: 225602 - protein, 27 aa, Mycobacterium bovis
SDSDMFTFGYKFRPWRDVKVLADGASS

SEQ ID NO: 225603 - protein, 25 aa, Mycobacterium bovis
SENSRFMFDYIPPVFKGQYAETEEE

SEQ ID NO: 225604 - protein, 25 aa, Mycobacterium bovis
SFATYFNAFPASYWRRWTTCKSVVL

SEQ ID NO: 225605 - protein, 36 aa, Mycobacterium bovis
SGDTVRRLARLHTPLPLLAFTAWPEVRSQLAMTWGT

SEQ ID NO: 225606 - protein, 19 aa, Mycobacterium bovis
SGEEMARLFAWCPEAVTAA

SEQ ID NO: 225607 - protein, 19 aa, Mycobacterium bovis
SGGLGSAFGPGGTGGMGGA

SEQ ID NO: 225608 - protein, 19 aa, Mycobacterium bovis
SGGLMRLGSAVAPLLQVGG

SEQ ID NO: 225609 - protein, 18 aa, Mycobacterium bovis
SGIPYVGRILVNVQVVPH

SEQ ID NO: 225610 - protein, 36 aa, Mycobacterium bovis
SGRYPQAIFDHGTPLALYHTKRLASPAQRIMLFAND

SEQ ID NO: 225611 - protein, 24 aa, Mycobacterium bovis
SIGAPPIVIGPLYAEKTIQLCAPG

SEQ ID NO: 225612 - protein, 26 aa, Mycobacterium bovis
SIQAGIINLLLDLQEQFGLSYLFVSH

SEQ ID NO: 225613 - protein, 20 aa, Mycobacterium bovis
SIREFGLLQPIVVRSLAGSQ

SEQ ID NO: 225614 - protein, 30 aa, Mycobacterium bovis
SISARVITRTLFVVRLLPAIDHFLDLLRKD

SEQ ID NO: 225615 - protein, 24 aa, Mycobacterium bovis
SITVGRISYLLGLRGPAVAVDTAC

SEQ ID NO: 225616 - protein, 19 aa, Mycobacterium bovis
SLAEYVLELARKLIKPEER

SEQ ID NO: 225617 - protein, 19 aa, Mycobacterium bovis
SLAILPRSVTALIGPSGCG

SEQ ID NO: 225618 - protein, 17 aa, Mycobacterium bovis
SLAIWMAGVTREINLLA

SEQ ID NO: 225619 - protein, 22 aa, Mycobacterium bovis
SLARLPLILSDGHLRELALTGK

SEQ ID NO: 225620 - protein, 19 aa, Mycobacterium bovis
SLGDELMRRFNGAALETLL

SEQ ID NO: 225621 - protein, 23 aa, Mycobacterium bovis
SLLARIGDAFLALPNGFTAHPRV

SEQ ID NO: 225622 - protein, 19 aa, Mycobacterium bovis
SLYHAGVKLDWMVATTLLT

SEQ ID NO: 225623 - protein, 21 aa, Mycobacterium bovis
SNGLLWRGDNQGLIDLAIGVD

SEQ ID NO: 225624 - protein, 18 aa, Mycobacterium bovis
SPALDLYGLLSPRADRHL

SEQ ID NO: 225625 - protein, 23 aa, Mycobacterium bovis
SPNILYLVWDDVGIATWDCFGGL

SEQ ID NO: 225626 - protein, 17 aa, Mycobacterium bovis
SPYSHWAFQHVEDFMPT

SEQ ID NO: 225627 - protein, 19 aa, Mycobacterium bovis
SQDEIVWAKEFFAEFARDG

SEQ ID NO: 225628 - protein, 26 aa, Mycobacterium bovis
SRDLQPWLAVPDRLLPLPAGLAGERR

SEQ ID NO: 225629 - protein, 24 aa, Mycobacterium bovis
SRLHSHALDLRRPPWEVHFIEGLE

SEQ ID NO: 225630 - protein, 24 aa, Mycobacterium bovis
SRLHTSLLDRHRPLWELHVVEGLN

SEQ ID NO: 225631 - protein, 21 aa, Mycobacterium bovis
SRRILHQLYLGYPDSAAAQGI

SEQ ID NO: 225632 - protein, 21 aa, Mycobacterium bovis
SRVGFLGWSMGGYGALLLGAR

SEQ ID NO: 225633 - protein, 18 aa, Mycobacterium bovis
SSATWPEPISYTALDRGD

SEQ ID NO: 225634 - protein, 26 aa, Mycobacterium bovis
SSFLLDHALVDIGVGVRWLREVQGVE

SEQ ID NO: 225635 - protein, 20 aa, Mycobacterium bovis
SSYFALIETQAHHIIRCLKR

SEQ ID NO: 225636 - protein, 24 aa, Mycobacterium bovis
STEYDVERYFRDSPLMILGEGTNE

SEQ ID NO: 225637 - protein, 20 aa, Mycobacterium bovis
STSVHTLQQAALNVVNEPFQ

SEQ ID NO: 225638 - protein, 26 aa, Mycobacterium bovis
STVPGPLQGINFGFGNIGSLNLGSGN

SEQ ID NO: 225639 - protein, 32 aa, Mycobacterium bovis
SVMLESFLFYSGFYLPMYWSSRGKLTNTADLI

SEQ ID NO: 225640 - protein, 26 aa, Mycobacterium bovis
SVPGYPNFFTVFGPYGYVGSSYFALI

SEQ ID NO: 225641 - protein, 19 aa, Mycobacterium bovis
SVRAYLKQIGKVALLNAEE

SEQ ID NO: 225642 - protein, 21 aa, Mycobacterium bovis
SWPYGLPELPGARDQLRGTRR

SEQ ID NO: 225643 - protein, 18 aa, Mycobacterium bovis
TACAYDHLIPGRGVGVLL

SEQ ID NO: 225644 - protein, 23 aa, Mycobacterium bovis
TADAILANRLYVLPHAASRASIR

SEQ ID NO: 225645 - protein, 19 aa, Mycobacterium bovis
TAGIPLLRLAAQTALLESE

SEQ ID NO: 225646 - protein, 26 aa, Mycobacterium bovis
TALRDGSYLPMTFAANDIAWSDNKPS

SEQ ID NO: 225647 - protein, 20 aa, Mycobacterium bovis
TAPGHMLGGLPLGQLTNSGG

SEQ ID NO: 225648 - protein, 21 aa, Mycobacterium bovis
TAQCRLPAPQYPVPAQGRHID

SEQ ID NO: 225649 - protein, 26 aa, Mycobacterium bovis
TAQLRSRSWWSGFDVVLLVDDWHIQP

SEQ ID NO: 225650 - protein, 22 aa, Mycobacterium bovis
TASARFDFGAAPLPTGPDAAPA

SEQ ID NO: 225651 - protein, 21 aa, Mycobacterium bovis
TCDYLISCTGYYNYDAGYLPD

SEQ ID NO: 225652 - protein, 17 aa, Mycobacterium bovis
TCGAWQTGFPRRSKSCW

SEQ ID NO: 225653 - protein, 21 aa, Mycobacterium bovis
TDEIYFVLSGRGLVSVGDESG

SEQ ID NO: 225654 - protein, 34 aa, Mycobacterium bovis
TDEWPALYRRVLDAHILVLCGPIWLGDNSSVMKR

SEQ ID NO: 225655 - protein, 18 aa, Mycobacterium bovis
TDRQALLLVTVAHPVAEV

SEQ ID NO: 225656 - protein, 25 aa, Mycobacterium bovis
TELLEYHWGPDWVVWDAAKTAQQHG

SEQ ID NO: 225657 - protein, 17 aa, Mycobacterium bovis
TFIGVMPAGQALAIITF

SEQ ID NO: 225658 - protein, 25 aa, Mycobacterium bovis
TFTLQPAAMFALPVCRRPGAKTVTA

SEQ ID NO: 225659 - protein, 24 aa, Mycobacterium bovis
TGEAGGPGGWLLGNGGNGGSGAPG

SEQ ID NO: 225660 - protein, 20 aa, Mycobacterium bovis
TGELPTWQWESLISKSTRLV

SEQ ID NO: 225661 - protein, 25 aa, Mycobacterium bovis
TGQTPLARWSAGGPIPLPAPETLTE

SEQ ID NO: 225662 - protein, 19 aa, Mycobacterium bovis
TGTPALFTLSASSADALRQ

SEQ ID NO: 225663 - protein, 28 aa, Mycobacterium bovis
TGVSRRHLEIRWDGQVALLADLNSTNGT

SEQ ID NO: 225664 - protein, 28 aa, Mycobacterium bovis
THFSVGPIIVPRIAGTLPVIDINIGDPG

SEQ ID NO: 225665 - protein, 18 aa, Mycobacterium bovis
THHPLIQVMLAWQDNPVG

SEQ ID NO: 225666 - protein, 19 aa, Mycobacterium bovis
THWCGLHPGVSVDHSCLSR

SEQ ID NO: 225667 - protein, 23 aa, Mycobacterium bovis
TIPGFAINPFGLDVPLSGGTSPV

SEQ ID NO: 225668 - protein, 24 aa, Mycobacterium bovis
TIPGFAINPFGLDVPLSGGTSPVT

SEQ ID NO: 225669 - protein, 20 aa, Mycobacterium bovis
TIPQFRTLVILSNHGPINLA

SEQ ID NO: 225670 - protein, 22 aa, Mycobacterium bovis
TLGVITALDLRLHPTPSHRVTA

SEQ ID NO: 225671 - protein, 17 aa, Mycobacterium bovis
TLHSVKVIPSRGAWLEF

SEQ ID NO: 225672 - protein, 17 aa, Mycobacterium bovis
TLILGLPTGPERGEAAT

SEQ ID NO: 225673 - protein, 19 aa, Mycobacterium bovis
TLPTMPPWHVQENKWRAAR

SEQ ID NO: 225674 - protein, 29 aa, Mycobacterium bovis
TLRRAGVRTNTWWLPAMQSLYETDYGPVL

SEQ ID NO: 225675 - protein, 18 aa, Mycobacterium bovis
TLTVGLMLPRRAFLPPPH

SEQ ID NO: 225676 - protein, 17 aa, Mycobacterium bovis
TNWSRRYKANLEKLASG

SEQ ID NO: 225677 - protein, 18 aa, Mycobacterium bovis
TPAPPRRKPIQMPGLQDV

SEQ ID NO: 225678 - protein, 32 aa, Mycobacterium bovis
TPGRAQFHYLESWLLPSLGLRATVFHFNPSHK

SEQ ID NO: 225679 - protein, 24 aa, Mycobacterium bovis
TPGYADFVGELWAGLRAADCALFV

SEQ ID NO: 225680 - protein, 27 aa, Mycobacterium bovis
TPNGRPFFCGTYYPKAAFLQLLSAISE

SEQ ID NO: 225681 - protein, 19 aa, Mycobacterium bovis
TPPFAIDPIGLSGFTLPQV

SEQ ID NO: 225682 - protein, 25 aa, Mycobacterium bovis
TRAAICRFATWWVVLERHGNLVRLY

SEQ ID NO: 225683 - protein, 21 aa, Mycobacterium bovis
TRIGLTYPALFGFLRIATSAR

SEQ ID NO: 225684 - protein, 21 aa, Mycobacterium bovis
TRLADRGMRLTLRVYAYSSCC

SEQ ID NO: 225685 - protein, 20 aa, Mycobacterium bovis
TRMPSCRAHLLKEGLRHLFS

SEQ ID NO: 225686 - protein, 21 aa, Mycobacterium bovis
TSFSARLFNLLITNAPGTQSQ

SEQ ID NO: 225687 - protein, 18 aa, Mycobacterium bovis
TSLISYMLPRSPIVRIVD

SEQ ID NO: 225688 - protein, 26 aa, Mycobacterium bovis
TSPDETWLALQPFLAPAGITRVADVT

SEQ ID NO: 225689 - protein, 24 aa, Mycobacterium bovis
TTLDDPFGYGRILRTQDHEVMAIV

SEQ ID NO: 225690 - protein, 19 aa, Mycobacterium bovis
TTPPLTVPGIHLPSTTIGA

SEQ ID NO: 225691 - protein, 95 aa, Mycobacterium bovis
TTQVLAAGADEVSARIAALFGMYGLEYQAISAQVAAYHQQFVQTLRTGAASYMLAEATNVEQNLLNLINAPTQTLLGRPLIGDGANATTPGGAGG

SEQ ID NO: 225692 - protein, 18 aa, Mycobacterium bovis
TVPSLTIPAAMTPANITV

SEQ ID NO: 225693 - protein, 18 aa, Mycobacterium bovis
TVRLFPVDGAVSPTITPA

SEQ ID NO: 225694 - protein, 23 aa, Mycobacterium bovis
TVVDPQWVWPISPALTELAGRHR

SEQ ID NO: 225695 - protein, 28 aa, Mycobacterium bovis
TVVNVGVKVLPWIPTPAKRILSAGRSVI

SEQ ID NO: 225696 - protein, 24 aa, Mycobacterium bovis
TWPKLRDRPRLGVSVLAEGHDAAC

SEQ ID NO: 225697 - protein, 18 aa, Mycobacterium bovis
TWWVPNEHKPWPLRAAEI

SEQ ID NO: 225698 - protein, 17 aa, Mycobacterium bovis
TYLNDFAQLLAALGRRY

SEQ ID NO: 225699 - protein, 20 aa, Mycobacterium bovis
VAALFSRRGFNIESLAVGAT

SEQ ID NO: 225700 - protein, 18 aa, Mycobacterium bovis
VAALLRHIGRYRCDYPGQ

SEQ ID NO: 225701 - protein, 17 aa, Mycobacterium bovis
VADLLRLLGPLTEDEIA

SEQ ID NO: 225702 - protein, 19 aa, Mycobacterium bovis
VAGVLFLENIIVPGLTVSG

SEQ ID NO: 225703 - protein, 20 aa, Mycobacterium bovis
VALMLEPRKAAAGSALGMLS

SEQ ID NO: 225704 - protein, 33 aa, Mycobacterium bovis
VAMILRTEKSVMFVIPWGSHWIIGTTDTDWNLD

SEQ ID NO: 225705 - protein, 23 aa, Mycobacterium bovis
VAMTLDRSILRQLGMGRRTVVVT

SEQ ID NO: 225706 - protein, 21 aa, Mycobacterium bovis
VAPLIAKYRLAGDHRPAPPET

SEQ ID NO: 225707 - protein, 27 aa, Mycobacterium bovis
VAQRTSAINRLRWLVHELDPERAPAAR

SEQ ID NO: 225708 - protein, 20 aa, Mycobacterium bovis
VARFLPYFTDVIVGDLRVGK

SEQ ID NO: 225709 - protein, 17 aa, Mycobacterium bovis
VATIVRRHWPTPSLARV

SEQ ID NO: 225710 - protein, 24 aa, Mycobacterium bovis
VAVARLVLGPGMRIQAPPNLVSGD

SEQ ID NO: 225711 - protein, 17 aa, Mycobacterium bovis
VAVIPPFTDLRSVQTLV

SEQ ID NO: 225712 - protein, 33 aa, Mycobacterium bovis
VAVSDLEFIQFHPTMLFAGRAGGRRPLITEAIR

SEQ ID NO: 225713 - protein, 26 aa, Mycobacterium bovis
VDAGTHFILATGRPPRWVRPIVDALG

SEQ ID NO: 225714 - protein, 22 aa, Mycobacterium bovis
VDALVHSRLPPTLPARSSMAAA

SEQ ID NO: 225715 - protein, 24 aa, Mycobacterium bovis
VDELERRNARRALITLCIGGGMGV

SEQ ID NO: 225716 - protein, 22 aa, Mycobacterium bovis
VDSGLTLSWLSRNLTSRNPRSL

SEQ ID NO: 225717 - protein, 26 aa, Mycobacterium bovis
VDSYADDWTQLWWVRADGVAAIHRDG

SEQ ID NO: 225718 - protein, 20 aa, Mycobacterium bovis
VELILCFNQLAYSAFAPAVL

SEQ ID NO: 225719 - protein, 23 aa, Mycobacterium bovis
VELPTYAFQRRRFWLSGDGVAAD

SEQ ID NO: 225720 - protein, 32 aa, Mycobacterium bovis
VELSPSLRRPQPLFSLVNFFDAQVGPLSAVTK

SEQ ID NO: 225721 - protein, 50 aa, Mycobacterium bovis
VEVICAELLRLRDWFVSAAPEITPFALTLRLLVIALKHNVILNSTWVDSG

SEQ ID NO: 225722 - protein, 22 aa, Mycobacterium bovis
VFAIAAGLRWSAAVPPLHKGDA

SEQ ID NO: 225723 - protein, 19 aa, Mycobacterium bovis
VFATAHYALVDLAAARSGQ

SEQ ID NO: 225724 - protein, 38 aa, Mycobacterium bovis
VFRDYGYRRLRAKARLKFLIKDWGIAKFREVLETEYLK

SEQ ID NO: 225725 - protein, 17 aa, Mycobacterium bovis
VFTTAYYAFIHLADVQP

SEQ ID NO: 225726 - protein, 20 aa, Mycobacterium bovis
VFVLHEIFGLPYQQIATTIG

SEQ ID NO: 225727 - protein, 34 aa, Mycobacterium bovis
VGAFNLPQLSIPSVTFPPITIPAGTALGAFNLPT

SEQ ID NO: 225728 - protein, 35 aa, Mycobacterium bovis
VGFGGYVALPAYLAARGLPLPPRRRRRIPVVIHEA

SEQ ID NO: 225729 - protein, 21 aa, Mycobacterium bovis
VGKALYARRFTLPQALAAVRD

SEQ ID NO: 225730 - protein, 23 aa, Mycobacterium bovis
VGTGVHWTLLRSRPPGCSPTPAP

SEQ ID NO: 225731 - protein, 32 aa, Mycobacterium bovis
VGTHLFNAMPPLDHRAPGPVLALLCDPRVTVE

SEQ ID NO: 225732 - protein, 17 aa, Mycobacterium bovis
VHAALRAALRASAARSL

SEQ ID NO: 225733 - protein, 20 aa, Mycobacterium bovis
VHGWVQGVGFRWWTRCRALE

SEQ ID NO: 225734 - protein, 18 aa, Mycobacterium bovis
VHIAKITRREYPNQVLPE

SEQ ID NO: 225735 - protein, 29 aa, Mycobacterium bovis
VKDGYGRNFLLPRGLAIVASRGAQKQADE

SEQ ID NO: 225736 - protein, 22 aa, Mycobacterium bovis
VKQELFERLATLAPDAVLATNT

SEQ ID NO: 225737 - protein, 19 aa, Mycobacterium bovis
VLAWHDALNAADIETLVAL

SEQ ID NO: 225738 - protein, 26 aa, Mycobacterium bovis
VLDAINAPVQSLTGRPLIGDGANGID

SEQ ID NO: 225739 - protein, 25 aa, Mycobacterium bovis
VLGVYGPPLKFDVSLPLSAISGFAR

SEQ ID NO: 225740 - protein, 17 aa, Mycobacterium bovis
VLPSMEAAFVDIGRGRN

SEQ ID NO: 225741 - protein, 26 aa, Mycobacterium bovis
VLRLVNWQRIRHRWNWTDVRRWLTDP

SEQ ID NO: 225742 - protein, 17 aa, Mycobacterium bovis
VLVKEIPMYSTCEHHLV

SEQ ID NO: 225743 - protein, 19 aa, Mycobacterium bovis
VNALKFIAFVTNPTNTAYF

SEQ ID NO: 225744 - protein, 32 aa, Mycobacterium bovis
VNTAAWYVNAAIPTAIFLANALNSGAPVAIAE

SEQ ID NO: 225745 - protein, 21 aa, Mycobacterium bovis
VPAVVKLHRWLTESLDHLHAS

SEQ ID NO: 225746 - protein, 20 aa, Mycobacterium bovis
VPLTFLCACGPAYLPERDQR

SEQ ID NO: 225747 - protein, 18 aa, Mycobacterium bovis
VPPLTMKPDVCWQLPIRR

SEQ ID NO: 225748 - protein, 19 aa, Mycobacterium bovis
VPPNSSWPNLDYPGLHALS

SEQ ID NO: 225749 - protein, 17 aa, Mycobacterium bovis
VPPSDRPWRLAMSTAGT

SEQ ID NO: 225750 - protein, 24 aa, Mycobacterium bovis
VQGWLADHSVAGVTIFPGAGFVEL

SEQ ID NO: 225751 - protein, 20 aa, Mycobacterium bovis
VQTDGFLRGHGGDGGNAVGL

SEQ ID NO: 225752 - protein, 19 aa, Mycobacterium bovis
VRDWYSIRHYALTEDGRCQ

SEQ ID NO: 225753 - protein, 17 aa, Mycobacterium bovis
VRFIDACHTRRLGVLID

SEQ ID NO: 225754 - protein, 26 aa, Mycobacterium bovis
VRGGKQPRILFATQATARPPTFVLFT

SEQ ID NO: 225755 - protein, 23 aa, Mycobacterium bovis
VRLHMLRYQQILAPKFALVAEVL

SEQ ID NO: 225756 - protein, 24 aa, Mycobacterium bovis
VRQPPPRLANLLPLIRPHEHMPDS

SEQ ID NO: 225757 - protein, 29 aa, Mycobacterium bovis
VRRCGMVSPTVFWPIPRVYSGLVRIDRYE

SEQ ID NO: 225758 - protein, 18 aa, Mycobacterium bovis
VRTWQGFCYTAFVTDVCT

SEQ ID NO: 225759 - protein, 32 aa, Mycobacterium bovis
VRVCDIHLDVPLYWQCWKLDSPIIARITDTVR

SEQ ID NO: 225760 - protein, 24 aa, Mycobacterium bovis
VSEKLGALPGWQLLDMRLSRAFQC

SEQ ID NO: 225761 - protein, 19 aa, Mycobacterium bovis
VSFTPVLIPASRGILATCT

SEQ ID NO: 225762 - protein, 35 aa, Mycobacterium bovis
VSHLTVFQRTPIWCFPKFDVPLPTAVRWAMRIPGG

SEQ ID NO: 225763 - protein, 18 aa, Mycobacterium bovis
VSHLYLSPILTAVGGSTH

SEQ ID NO: 225764 - protein, 27 aa, Mycobacterium bovis
VSIERFLDTAWWVSDLPSARAFAAVWT

SEQ ID NO: 225765 - protein, 20 aa, Mycobacterium bovis
VSPFHQLAGYYLIRAPRPDR

SEQ ID NO: 225766 - protein, 27 aa, Mycobacterium bovis
VSWPNPNDWWLVRLLGSITPTERTTIV

SEQ ID NO: 225767 - protein, 24 aa, Mycobacterium bovis
VTASRHAHWLNPEPKHLWGSGDSA

SEQ ID NO: 225768 - protein, 20 aa, Mycobacterium bovis
VTHDRWFLDEVATTTWEVHD

SEQ ID NO: 225769 - protein, 22 aa, Mycobacterium bovis
VTIPGFAINPFGLDVPLSGGTN

SEQ ID NO: 225770 - protein, 25 aa, Mycobacterium bovis
VTIPGFAINPFGLNVPLSGGTSPVT

SEQ ID NO: 225771 - protein, 22 aa, Mycobacterium bovis
VTLQTVPLFTLHRHDQRRSLAQ

SEQ ID NO: 225772 - protein, 19 aa, Mycobacterium bovis
VTPILPMIRAAEQRGIDWR

SEQ ID NO: 225773 - protein, 17 aa, Mycobacterium bovis
VVCDFADACVPVVKVLA

SEQ ID NO: 225774 - protein, 26 aa, Mycobacterium bovis
VVDVFIGYLRRKLEAGGGPRLLHTVR

SEQ ID NO: 225775 - protein, 23 aa, Mycobacterium bovis
VVNEPFQTLTGRPLIGNGANGTP

SEQ ID NO: 225776 - protein, 22 aa, Mycobacterium bovis
VVPATVLTLVRTLLRAREGRTM

SEQ ID NO: 225777 - protein, 18 aa, Mycobacterium bovis
VVRVLGAIEIPVVAQELA

SEQ ID NO: 225778 - protein, 17 aa, Mycobacterium bovis
VVSLAKRYTGRGMPLLD

SEQ ID NO: 225779 - protein, 25 aa, Mycobacterium bovis
VVVIGRGVTVGRPLGLLLTRRSENA

SEQ ID NO: 225780 - protein, 17 aa, Mycobacterium bovis
VVYPHHGAALVEAIETR

SEQ ID NO: 225781 - protein, 20 aa, Mycobacterium bovis
VWALMGMPCGKYLVVMHDLW

SEQ ID NO: 225782 - protein, 19 aa, Mycobacterium bovis
VWHRLQATDEIYFVLSGRG

SEQ ID NO: 225783 - protein, 20 aa, Mycobacterium bovis
VWIYRGFLRIAARGYRLCSP

SEQ ID NO: 225784 - protein, 25 aa, Mycobacterium bovis
VYFAGYAMWNYLTTPYLLTREGVAV

SEQ ID NO: 225785 - protein, 22 aa, Mycobacterium bovis
WATQLRIMQAQLLAKIAAAVGN

SEQ ID NO: 225786 - protein, 21 aa, Mycobacterium bovis
WFRSFFGVPSSITAPDGRPVN

SEQ ID NO: 225787 - protein, 21 aa, Mycobacterium bovis
WGNQMRSYVLHPYQMVKDLRT

SEQ ID NO: 225788 - protein, 29 aa, Mycobacterium bovis
WHAVPCFPTISELWLRLLESYRDSFYLLV

SEQ ID NO: 225789 - protein, 17 aa, Mycobacterium bovis
WHEGWFANTIHAATPAG

SEQ ID NO: 225790 - protein, 19 aa, Mycobacterium bovis
WKDTAAPLWTFPRVAWERE

SEQ ID NO: 225791 - protein, 18 aa, Mycobacterium bovis
WNLPGLMCAQVILSNRRD

SEQ ID NO: 225792 - protein, 20 aa, Mycobacterium bovis
WPEPISYTALDRGDLQRAMS

SEQ ID NO: 225793 - protein, 18 aa, Mycobacterium bovis
WPWQPYLLSHHQGGIAVT

SEQ ID NO: 225794 - protein, 20 aa, Mycobacterium bovis
WQGFCYTAFVTDVCTRKIVV

SEQ ID NO: 225795 - protein, 27 aa, Mycobacterium bovis
WQMSTIQLDFNFPERFGLEYTAADGTR

SEQ ID NO: 225796 - protein, 18 aa, Mycobacterium bovis
WSFVWRDVLLRLANDFRC

SEQ ID NO: 225797 - protein, 20 aa, Mycobacterium bovis
WSLRLSHPELLYHPTQSWVV

SEQ ID NO: 225798 - protein, 24 aa, Mycobacterium bovis
WSNFNADRWELFHIAADRSQCHDL

SEQ ID NO: 225799 - protein, 20 aa, Mycobacterium bovis
WVDDYPVMLINANAAPDRKR

SEQ ID NO: 225800 - protein, 17 aa, Mycobacterium bovis
WVMLYQYGNPANTDSHY

SEQ ID NO: 225801 - protein, 23 aa, Mycobacterium bovis
WVPNDYGLKIERAIDAYLETWPI

SEQ ID NO: 225802 - protein, 18 aa, Mycobacterium bovis
YAEMWAQDALAMYGYAAA

SEQ ID NO: 225803 - protein, 17 aa, Mycobacterium bovis
YAEPAGRDYDYGQSGAP

SEQ ID NO: 225804 - protein, 20 aa, Mycobacterium bovis
YASVEAANASPLQVALDVIN

SEQ ID NO: 225805 - protein, 17 aa, Mycobacterium bovis
YCIDLGGGGLIYLENLP

SEQ ID NO: 225806 - protein, 23 aa, Mycobacterium bovis
YCMPEAEYAWLPRADLLSVDEIS

SEQ ID NO: 225807 - protein, 18 aa, Mycobacterium bovis
YDVSDDFFALFQDPTRTY

SEQ ID NO: 225808 - protein, 21 aa, Mycobacterium bovis
YFRLLTGWVGGGFRVPGDDVR

SEQ ID NO: 225809 - protein, 28 aa, Mycobacterium bovis
YFSRQRLRDLGLWGLTNFDRVDFVYTDV

SEQ ID NO: 225810 - protein, 22 aa, Mycobacterium bovis
YGALLLGARLGPARTAGICAIS

SEQ ID NO: 225811 - protein, 25 aa, Mycobacterium bovis
YGEQRDFLFALWDALDLGDHVVLVL

SEQ ID NO: 225812 - protein, 19 aa, Mycobacterium bovis
YGFPDGETRDLFLTLLSVS

SEQ ID NO: 225813 - protein, 18 aa, Mycobacterium bovis
YGFVAFDVDPGQPGGTTS

SEQ ID NO: 225814 - protein, 18 aa, Mycobacterium bovis
YGLTVPPPVIAENRAELM

SEQ ID NO: 225815 - protein, 19 aa, Mycobacterium bovis
YGLTVPPPVIAENRAELMI

SEQ ID NO: 225816 - protein, 18 aa, Mycobacterium bovis
YGPVVYLDLRHLGADLID

SEQ ID NO: 225817 - protein, 23 aa, Mycobacterium bovis
YHGWGFHEDGAASGLRAARRLGA

SEQ ID NO: 225818 - protein, 24 aa, Mycobacterium bovis
YLDGYPRLHLKLSVIGVAAGVAGL

SEQ ID NO: 225819 - protein, 35 aa, Mycobacterium bovis
YLRKRLPRLIRMQRFWISLYFPLTMRSLCNAIVVP

SEQ ID NO: 225820 - protein, 30 aa, Mycobacterium bovis
YNHYPIGWAMAFNTPYKLFKRYASHEGGIA

SEQ ID NO: 225821 - protein, 19 aa, Mycobacterium bovis
YPALFGFLRIATSARVLAA

SEQ ID NO: 225822 - protein, 25 aa, Mycobacterium bovis
YPDDRSMWLCHESIYQAVYQPQSRL

SEQ ID NO: 225823 - protein, 25 aa, Mycobacterium bovis
YPSAVAKARFVRVSPRKARRVIDLV

SEQ ID NO: 225824 - protein, 18 aa, Mycobacterium bovis
YQIVMGERRWRAAQEAGL

SEQ ID NO: 225825 - protein, 26 aa, Mycobacterium bovis
YRAALDLLVSGRYLFASLPRRCVRLE

SEQ ID NO: 225826 - protein, 18 aa, Mycobacterium bovis
YRLVALRETSPRIHELIR

SEQ ID NO: 225827 - protein, 37 aa, Mycobacterium bovis
YSLIREVLRLYHRTGEKLIITFAMPAYAKMVMNFGRF

SEQ ID NO: 225828 - protein, 25 aa, Mycobacterium bovis
YTDAAQPIWWVVRAIEFSKDFETFV

SEQ ID NO: 225829 - protein, 29 aa, Mycobacterium bovis
YTLTGPIVIGSFFLPAFNIPGIDVPAINV

SEQ ID NO: 225830 - protein, 18 aa, Mycobacterium bovis
YVAAFNQGRNTGPTEGPA

SEQ ID NO: 225831 - protein, 19 aa, Mycobacterium bovis
YVSNLRKLLGGAGIDPRVV

SEQ ID NO: 225832 - protein, 17 aa, Mycobacterium bovis
YWPSRVLGSADPTTIAH

SEQ ID NO: 225833 - protein, 33 aa, Mycobacterium bovis
AAAAALPSWQQALRGLPGLGQVASAISGGAASM

SEQ ID NO: 225834 - protein, 23 aa, Mycobacterium bovis
AAAILLTEWQLRNTPHVPIPYVY

SEQ ID NO: 225835 - protein, 20 aa, Mycobacterium bovis
AAARKFGCGFAPSGWDSLTK

SEQ ID NO: 225836 - protein, 20 aa, Mycobacterium bovis
AAATVLPYRQFHDVAENFRY

SEQ ID NO: 225837 - protein, 25 aa, Mycobacterium bovis
AAEAMYEQMWAADVAAMVGYHGGAS

SEQ ID NO: 225838 - protein, 27 aa, Mycobacterium bovis
AAELTIDALINRVVPIPGLRSTEAQWA

SEQ ID NO: 225839 - protein, 18 aa, Mycobacterium bovis
AAEPFHRSPLLIGRPYNW

SEQ ID NO: 225840 - protein, 28 aa, Mycobacterium bovis
AAFAIMQIKAIFSVLLREYEFEMAQPPE

SEQ ID NO: 225841 - protein, 28 aa, Mycobacterium bovis
AAGAGYADMTAIFLGSSGTPGEDGGNGG

SEQ ID NO: 225842 - protein, 29 aa, Mycobacterium bovis
AAGAGYADMTAIFLGSSGTPGEDGGNGGA

SEQ ID NO: 225843 - protein, 19 aa, Mycobacterium bovis
AAGGLQLLIIISAGRTIAN

SEQ ID NO: 225844 - protein, 35 aa, Mycobacterium bovis
AAGIERPDYSITGWVILTLIQHGTPWQIERFVEKA

SEQ ID NO: 225845 - protein, 19 aa, Mycobacterium bovis
AAGYGAPGYDQGYRQSGGC

SEQ ID NO: 225846 - protein, 18 aa, Mycobacterium bovis
AAIMSVALLLSHLGEHDA

SEQ ID NO: 225847 - protein, 20 aa, Mycobacterium bovis
AAIPMMVFSGVMNAGQGCVN

SEQ ID NO: 225848 - protein, 20 aa, Mycobacterium bovis
AALDLLVSGRYPFASLPRRC

SEQ ID NO: 225849 - protein, 26 aa, Mycobacterium bovis
AAMAAAAAPYAGWLAAAAARAAGASA

SEQ ID NO: 225850 - protein, 27 aa, Mycobacterium bovis
AAMAAAAAPYAGWLAAAAARAAGASAQ

SEQ ID NO: 225851 - protein, 27 aa, Mycobacterium bovis
AAMAAAAAPYAGWLAAAAARAAGASVQ

SEQ ID NO: 225852 - protein, 22 aa, Mycobacterium bovis
AAMRWGHLPLAEESGTIAPQLV

SEQ ID NO: 225853 - protein, 23 aa, Mycobacterium bovis
AAPAGPAARAATAAPAGCCSATA

SEQ ID NO: 225854 - protein, 22 aa, Mycobacterium bovis
AAQGLAELTLNLGVGNIGSLNL

SEQ ID NO: 225855 - protein, 19 aa, Mycobacterium bovis
AAQGWGGRWLVVGADVDPG

SEQ ID NO: 225856 - protein, 20 aa, Mycobacterium bovis
AAQPFFDPSASFPPAPASAN

SEQ ID NO: 225857 - protein, 26 aa, Mycobacterium bovis
AATVHPMLVAANRNAFVQLVLSNLFG

SEQ ID NO: 225858 - protein, 23 aa, Mycobacterium bovis
AAWRAHRAYLVDLAFRMVGDIGV

SEQ ID NO: 225859 - protein, 20 aa, Mycobacterium bovis
ACEITLQPIRRYDVDAAILF

SEQ ID NO: 225860 - protein, 29 aa, Mycobacterium bovis
ACRKHHLLKTFWTGWRDVQLPDGTVIWTA

SEQ ID NO: 225861 - protein, 23 aa, Mycobacterium bovis
ADADELFRRSLGNPLYLRHLIDG

SEQ ID NO: 225862 - protein, 21 aa, Mycobacterium bovis
ADAILANRLYVLPHAASRASI

SEQ ID NO: 225863 - protein, 18 aa, Mycobacterium bovis
ADATRVQVLWSLADREMS

SEQ ID NO: 225864 - protein, 19 aa, Mycobacterium bovis
ADATRVQVLWSLADREMSV

SEQ ID NO: 225865 - protein, 27 aa, Mycobacterium bovis
ADFADLFPVPAKLWTIADLGGWGSVDP

SEQ ID NO: 225866 - protein, 25 aa, Mycobacterium bovis
ADQPGATGGTGFAGGAGGAGGAGGS

SEQ ID NO: 225867 - protein, 27 aa, Mycobacterium bovis
ADRDWLAFHASYPGNDPLRDARPIEQD

SEQ ID NO: 225868 - protein, 21 aa, Mycobacterium bovis
ADRLLAEPTAWLFGPEAHGLS

SEQ ID NO: 225869 - protein, 21 aa, Mycobacterium bovis
ADSLAEYVLELARKLIKPEER

SEQ ID NO: 225870 - protein, 20 aa, Mycobacterium bovis
AEAMLLAGFVIPVRKKGVRA

SEQ ID NO: 225871 - protein, 26 aa, Mycobacterium bovis
AEDGAGWLAFFRDLVARGLSGVALVT

SEQ ID NO: 225872 - protein, 24 aa, Mycobacterium bovis
AEDHALRLLNLRRAARSVEGAGPG

SEQ ID NO: 225873 - protein, 22 aa, Mycobacterium bovis
AEFERPVLLFSGGKDSIVMLHL

SEQ ID NO: 225874 - protein, 19 aa, Mycobacterium bovis
AEIIRLGTALGANGATLAG

SEQ ID NO: 225875 - protein, 23 aa, Mycobacterium bovis
AEKVTGIFLVPAQWQAVCTEQQA

SEQ ID NO: 225876 - protein, 26 aa, Mycobacterium bovis
AERARAIGLFRYQLIWEAADAAHSTK

SEQ ID NO: 225877 - protein, 19 aa, Mycobacterium bovis
AERGPGQMLGGLPVGQMGA

SEQ ID NO: 225878 - protein, 24 aa, Mycobacterium bovis
AERGYGYGPAFRGLTAMWRRGDEV

SEQ ID NO: 225879 - protein, 24 aa, Mycobacterium bovis
AERYQPWLDRLLGMSWDDSEHRKI

SEQ ID NO: 225880 - protein, 25 aa, Mycobacterium bovis
AETLLVVLCGVGFYIGFVGSYQRMA

SEQ ID NO: 225881 - protein, 20 aa, Mycobacterium bovis
AEVLVLGSFPSGRRARVLIG

SEQ ID NO: 225882 - protein, 25 aa, Mycobacterium bovis
AFGASFLARIFPPGSHIPIPFIEYT

SEQ ID NO: 225883 - protein, 17 aa, Mycobacterium bovis
AFGYLPGPNGPEPDPRT

SEQ ID NO: 225884 - protein, 19 aa, Mycobacterium bovis
AFRERLGVGGLRDLIEHRA

SEQ ID NO: 225885 - protein, 24 aa, Mycobacterium bovis
AFVQLVLSNLFGQNAPAIAAAEAM

SEQ ID NO: 225886 - protein, 19 aa, Mycobacterium bovis
AFVQLVMTNLFGQNAPLIA

SEQ ID NO: 225887 - protein, 18 aa, Mycobacterium bovis
AFVSERIGLAAQAYSSAQ

SEQ ID NO: 225888 - protein, 25 aa, Mycobacterium bovis
AGAELMLGMRRFAPSSSTSLYVYAR

SEQ ID NO: 225889 - protein, 27 aa, Mycobacterium bovis
AGEACARAIAWYLAMARRSQGNESAAV

SEQ ID NO: 225890 - protein, 23 aa, Mycobacterium bovis
AGELALLRLACEAADAALTDLVA

SEQ ID NO: 225891 - protein, 17 aa, Mycobacterium bovis
AGEVGNRGVGGDGGDGG

SEQ ID NO: 225892 - protein, 18 aa, Mycobacterium bovis
AGEVGNRGVGGDGGDGGS

SEQ ID NO: 225893 - protein, 22 aa, Mycobacterium bovis
AGGAGGAFLGDGGNGGAGGQGG

SEQ ID NO: 225894 - protein, 22 aa, Mycobacterium bovis
AGGAGGWLFGNGGAGGVGGAGG

SEQ ID NO: 225895 - protein, 23 aa, Mycobacterium bovis
AGGDAGLLFGSGGAGGAGGSGRT

SEQ ID NO: 225896 - protein, 26 aa, Mycobacterium bovis
AGGDAPLIGWGGNGGPGGFAAFGNGG

SEQ ID NO: 225897 - protein, 21 aa, Mycobacterium bovis
AGGGALLFGAGGAGGAGGSSG

SEQ ID NO: 225898 - protein, 18 aa, Mycobacterium bovis
AGGILFGTGGAGGAGGVG

SEQ ID NO: 225899 - protein, 23 aa, Mycobacterium bovis
AGGKAGLLFGSGGAGGSGGAAGT

SEQ ID NO: 225900 - protein, 23 aa, Mycobacterium bovis
AGGKAGLLFGSGGAGGSGGAGGF

SEQ ID NO: 225901 - protein, 19 aa, Mycobacterium bovis
AGGLFGAGGAGGLGGQGNH

SEQ ID NO: 225902 - protein, 17 aa, Mycobacterium bovis
AGGLLFGDGGNGGAGGA

SEQ ID NO: 225903 - protein, 26 aa, Mycobacterium bovis
AGGNGVAGTGLALNGGNGGIGGNGGS

SEQ ID NO: 225904 - protein, 25 aa, Mycobacterium bovis
AGGQVWLMPHNPAFDPIPGNDATVL

SEQ ID NO: 225905 - protein, 21 aa, Mycobacterium bovis
AGGSAFLIGSGGTGGVGGAAT

SEQ ID NO: 225906 - protein, 23 aa, Mycobacterium bovis
AGGSAGLLALGDGGAGGAGGAAT

SEQ ID NO: 225907 - protein, 25 aa, Mycobacterium bovis
AGGSGGTAGLLGSGGTGGDGGNGGL

SEQ ID NO: 225908 - protein, 24 aa, Mycobacterium bovis
AGHATAIMWAREQFGLELIWGIED

SEQ ID NO: 225909 - protein, 30 aa, Mycobacterium bovis
AGIFTGYIGPIPLSTFVLGVTLAGGTLESG

SEQ ID NO: 225910 - protein, 20 aa, Mycobacterium bovis
AGKITYRIKLEVSFKMRPAQ

SEQ ID NO: 225911 - protein, 18 aa, Mycobacterium bovis
AGLLFGSGGSGGAGGFGF

SEQ ID NO: 225912 - protein, 20 aa, Mycobacterium bovis
AGLLVGSGGVGGAGGFGLTT

SEQ ID NO: 225913 - protein, 19 aa, Mycobacterium bovis
AGPSTLVRAGAQAFLVDCG

SEQ ID NO: 225914 - protein, 21 aa, Mycobacterium bovis
AGQLLSHSGVAGASGKGGAGG

SEQ ID NO: 225915 - protein, 17 aa, Mycobacterium bovis
AGQSWQGAAAAAMAAAA

SEQ ID NO: 225916 - protein, 23 aa, Mycobacterium bovis
AGRMLAIMHALDGALATVSPGAT

SEQ ID NO: 225917 - protein, 24 aa, Mycobacterium bovis
AGSLRLDLSQYRELEAFAAFASDL

SEQ ID NO: 225918 - protein, 22 aa, Mycobacterium bovis
AGSWPMAGTPAWRQLDDADPRK

SEQ ID NO: 225919 - protein, 24 aa, Mycobacterium bovis
AGTGWLPGWRLTFGGEDIGWEGAL

SEQ ID NO: 225920 - protein, 25 aa, Mycobacterium bovis
AGTSISGFFNFGSLMSGFANFDDEV

SEQ ID NO: 225921 - protein, 18 aa, Mycobacterium bovis
AHLLLRFDRGNWIAIDND

SEQ ID NO: 225922 - protein, 18 aa, Mycobacterium bovis
AHTKHYRVVSKPAALVHG

SEQ ID NO: 225923 - protein, 18 aa, Mycobacterium bovis
AIPDRGLFAVYLATERPS

SEQ ID NO: 225924 - protein, 17 aa, Mycobacterium bovis
AKRIAAIVASAIEYEIK

SEQ ID NO: 225925 - protein, 30 aa, Mycobacterium bovis; identical to SEQ ID NO: 124058

SEQ ID NO: 225926 - protein, 24 aa, Mycobacterium bovis
AKYPGTQWRFEYSPESYTGTELEY

SEQ ID NO: 225927 - protein, 29 aa, Mycobacterium bovis
ALAARQRRFGVSYWTVFDEWAGRASAMRD

SEQ ID NO: 225928 - protein, 28 aa, Mycobacterium bovis
ALAAVNAPIQAVTGRPLIGNGANGAPGS

SEQ ID NO: 225929 - protein, 21 aa, Mycobacterium bovis
ALALQFGWRLFAPMLRSATGI

SEQ ID NO: 225930 - protein, 18 aa, Mycobacterium bovis
ALATSPYLRQHADNPVHW

SEQ ID NO: 225931 - protein, 18 aa, Mycobacterium bovis
ALEEQVVVLRLLAAQQEA

SEQ ID NO: 225932 - protein, 24 aa, Mycobacterium bovis
ALFHDRFVQILQEGAAAYAMAEAA

SEQ ID NO: 225933 - protein, 26 aa, Mycobacterium bovis
ALGSVPLTFLCAWGPAYLPERDQRMG

SEQ ID NO: 225934 - protein, 19 aa, Mycobacterium bovis
ALLAGCTIVLKPAAETPLT

SEQ ID NO: 225935 - protein, 19 aa, Mycobacterium bovis
ALMLEPRKAAAGSALGMLS

SEQ ID NO: 225936 - protein, 18 aa, Mycobacterium bovis
ALRDTHVELERLVHALPA

SEQ ID NO: 225937 - protein, 24 aa, Mycobacterium bovis
ALTQATCLFLDRQAFERLLATHPA

SEQ ID NO: 225938 - protein, 18 aa, Mycobacterium bovis
ALVKTYVADALAADLYLE

SEQ ID NO: 225939 - protein, 25 aa, Mycobacterium bovis
AMAAAVAPYLGWLAAAAAQAQRSAT

SEQ ID NO: 225940 - protein, 20 aa, Mycobacterium bovis
AMGWSPFYPQFDRSSLDVAD

SEQ ID NO: 225941 - protein, 17 aa, Mycobacterium bovis
AMIAAVLEKHARLAIAV

SEQ ID NO: 225942 - protein, 19 aa, Mycobacterium bovis
AMLSHGWIDGPPPGQYFHG

SEQ ID NO: 225943 - protein, 18 aa, Mycobacterium bovis
AMNLIDAAVAHGVVRAPD

SEQ ID NO: 225944 - protein, 18 aa, Mycobacterium bovis
AMRQLLLDLLANNQDLAG

SEQ ID NO: 225945 - protein, 19 aa, Mycobacterium bovis
AMRQLLLDLLANNQDLAGK

SEQ ID NO: 225946 - protein, 24 aa, Mycobacterium bovis
ANNRAALIGYLPTGYPDVPASVAA

SEQ ID NO: 225947 - protein, 24 aa, Mycobacterium bovis
ANSWLDAFAHWRQAQGLPATAIAW

SEQ ID NO: 225948 - protein, 31 aa, Mycobacterium bovis
APADKAVSVPQVARTARPASAPPAVTEATAG

SEQ ID NO: 225949 - protein, 22 aa, Mycobacterium bovis
APDFRLFWDNAYAVHTLTLDFP

SEQ ID NO: 225950 - protein, 20 aa, Mycobacterium bovis
APLIAKYRLAGDHRPAPPET

SEQ ID NO: 225951 - protein, 17 aa, Mycobacterium bovis
APPAPAPALAHLRGTTQ

SEQ ID NO: 225952 - protein, 25 aa, Mycobacterium bovis
APRLSRRILHQLYLGYPDSAAAQGI

SEQ ID NO: 225953 - protein, 17 aa, Mycobacterium bovis
APSWRKGPRHIAGRGPR

SEQ ID NO: 225954 - protein, 18 aa, Mycobacterium bovis
APSWRKGPRHIAGRGPRD

SEQ ID NO: 225955 - protein, 24 aa, Mycobacterium bovis
APTALLRVYRDKLPHRYAKALRRY

SEQ ID NO: 225956 - protein, 39 aa, Mycobacterium bovis
APTHRSPAVMAVTAVPVATAGWSVTVGPAVMAVTEPRVP

SEQ ID NO: 225957 - protein, 18 aa, Mycobacterium bovis
AQLLAALGRRYDGDERLS

SEQ ID NO: 225958 - protein, 23 aa, Mycobacterium bovis
AQTAPGHMLGGLPLGQLTNSGGG

SEQ ID NO: 225959 - protein, 19 aa, Mycobacterium bovis
ARFLPYFTDVIVGDLRVGK

SEQ ID NO: 225960 - protein, 19 aa, Mycobacterium bovis
ARGRHYLLAERLTATTNPR

SEQ ID NO: 225961 - protein, 18 aa, Mycobacterium bovis
ARKAATKAPAKKAATKAP

SEQ ID NO: 225962 - protein, 18 aa, Mycobacterium bovis
ARLHRFYRDLIALRHNEA

SEQ ID NO: 225963 - protein, 19 aa, Mycobacterium bovis
ARLVMIDHGLPLPELQYPI

SEQ ID NO: 225964 - protein, 18 aa, Mycobacterium bovis
ARRLATMVLLIAQSTIQS

SEQ ID NO: 225965 - protein, 26 aa, Mycobacterium bovis
ARVISDVWLSNLLAWLTRRASATDVS

SEQ ID NO: 225966 - protein, 29 aa, Mycobacterium bovis
ASAAAALAPWQQAVPGLSGLLGGAANAPA

SEQ ID NO: 225967 - protein, 25 aa, Mycobacterium bovis
ASAAMTGAAASYARWLTTAAAQAEQ

SEQ ID NO: 225968 - protein, 17 aa, Mycobacterium bovis
ASAWTGLAGDLGSAAAS

SEQ ID NO: 225969 - protein, 18 aa, Mycobacterium bovis
ASDFHAFSAAPNFAFELA

SEQ ID NO: 225970 - protein, 19 aa, Mycobacterium bovis
ASLFAAHGQAYQAVSAQMS

SEQ ID NO: 225971 - protein, 18 aa, Mycobacterium bovis
ASPFGIDIGIGGAGGHGG

SEQ ID NO: 225972 - protein, 28 aa, Mycobacterium bovis
ASQWDGGYVANYTITQFGRDFDDRLAVA

SEQ ID NO: 225973 - protein, 27 aa, Mycobacterium bovis
ASRDLQPWLAVPDRLLPLPAGLAGERR

SEQ ID NO: 225974 - protein, 26 aa, Mycobacterium bovis
ASRFYNLVLADCGAGFFDPLTRGVLS

SEQ ID NO: 225975 - protein, 20 aa, Mycobacterium bovis
ASRLIPFAAPPKTTNSAGVV

SEQ ID NO: 225976 - protein, 25 aa, Mycobacterium bovis
ATAFRNFQYTVQAQKLWAQAGFRPV

SEQ ID NO: 225977 - protein, 22 aa, Mycobacterium bovis
ATDHPDLFWALRGGGGGNFGVT

SEQ ID NO: 225978 - protein, 27 aa, Mycobacterium bovis
ATDTGSFRWASVRGYRLAARLVEIGVD

SEQ ID NO: 225979 - protein, 23 aa, Mycobacterium bovis
ATNPSWVMLYQYGNPANTDSHYC

SEQ ID NO: 225980 - protein, 18 aa, Mycobacterium bovis
ATQIRNLPRHLGIHSGGM

SEQ ID NO: 225981 - protein, 28 aa, Mycobacterium bovis
ATRSVRSPAYCFTLPFAHQALMPINVVA

SEQ ID NO: 225982 - protein, 23 aa, Mycobacterium bovis
ATSFSARLFNLLITNAPGTQSQM

SEQ ID NO: 225983 - protein, 20 aa, Mycobacterium bovis
ATSLISYMLPRSPIVRIVDS

SEQ ID NO: 225984 - protein, 26 aa, Mycobacterium bovis
AVAPVRRLLRRLLGPTDPVLASTVFG

SEQ ID NO: 225985 - protein, 18 aa, Mycobacterium bovis
AVAQPLIAAFAAALRQLG

SEQ ID NO: 225986 - protein, 27 aa, Mycobacterium bovis
AVDAGTHFILATGRPPRWVRPIVDALG

SEQ ID NO: 225987 - protein, 20 aa, Mycobacterium bovis
AVDYLTSMGLRILNRNWRCR

SEQ ID NO: 225988 - protein, 25 aa, Mycobacterium bovis
AVELELYKRLPGDLSILTPSPASDT

SEQ ID NO: 225989 - protein, 17 aa, Mycobacterium bovis
AVEVARQLRRPRALATL

SEQ ID NO: 225990 - protein, 20 aa, Mycobacterium bovis
AVFPTILARATPGDGWASLA

SEQ ID NO: 225991 - protein, 27 aa, Mycobacterium bovis
AVIRTSVPPFTWWRGLRARELLENYFT

SEQ ID NO: 225992 - protein, 23 aa, Mycobacterium bovis
AVKQELFERLATLAPDAVLATNT

SEQ ID NO: 225993 - protein, 26 aa, Mycobacterium bovis
AVLGRLPMRAWLIGLRPMEGSPERHN

SEQ ID NO: 225994 - protein, 33 aa, Mycobacterium bovis
AVLTSPVSFLQRPARWMHLMASDFHAFSAAPNF

SEQ ID NO: 225995 - protein, 20 aa, Mycobacterium bovis
AVLVFPHAGGAAAAYRWLAK

SEQ ID NO: 225996 - protein, 33 aa, Mycobacterium bovis
AVNTAAWYVNAAIPTAIFLANALNSGAPVAIAE

SEQ ID NO: 225997 - protein, 26 aa, Mycobacterium bovis
AVPKSPSGLLLAELKPRRLVENRPSV

SEQ ID NO: 225998 - protein, 20 aa, Mycobacterium bovis
AVPPNSSWPNLDYPGLHALS

SEQ ID NO: 225999 - protein, 21 aa, Mycobacterium bovis
AVRQWGFMQGLKQKLGPGVDV

SEQ ID NO: 226000 - protein, 22 aa, Mycobacterium bovis
AVSAMQERLPFFADLEASQRAS

SEQ ID NO: 226001 - protein, 23 aa, Mycobacterium bovis
AVVPFHERIAPPPFAELGHARSP

SEQ ID NO: 226002 - protein, 23 aa, Mycobacterium bovis
AWATQLRIMQAQLLAKIAAAVGN

SEQ ID NO: 226003 - protein, 20 aa, Mycobacterium bovis
AYGLTVPPPVIAENRAELMI

SEQ ID NO: 226004 - protein, 22 aa, Mycobacterium bovis
AYHAEPFIYLMPEGQLPRTGAV

SEQ ID NO: 226005 - protein, 21 aa, Mycobacterium bovis
AYQERFVLALSQASSTYAVAE

SEQ ID NO: 226006 - protein, 46 aa, Mycobacterium bovis
CAELLRLRDWFVSAAPEITPFALTLRLLVIALKHNVILNSTWVDSG

SEQ ID NO: 226007 - protein, 23 aa, Mycobacterium bovis
CALDLQRTSLAPIRLRIGLHTGE

SEQ ID NO: 226008 - protein, 22 aa, Mycobacterium bovis
CATFLADYLPGPVRVEPMRNFP

SEQ ID NO: 226009 - protein, 24 aa, Mycobacterium bovis
CCLPPNLRRPLRRTARRGPPTRGL

SEQ ID NO: 226010 - protein, 17 aa, Mycobacterium bovis
CDRLGLLPMYAVNQDKH

SEQ ID NO: 226011 - protein, 20 aa, Mycobacterium bovis
CDYLISCTGYYNYDAGYLPD

SEQ ID NO: 226012 - protein, 24 aa, Mycobacterium bovis
CGDAVPYIILPNLQTGEPVMGVAD

SEQ ID NO: 226013 - protein, 30 aa, Mycobacterium bovis
CGKYLVVMHDLWLPLLTAAGDLDKPLVTEA

SEQ ID NO: 226014 - protein, 18 aa, Mycobacterium bovis
CIRGLRIPVATVVAMVAD

SEQ ID NO: 226015 - protein, 17 aa, Mycobacterium bovis
CPTLRAAVTGLPGVVDG

SEQ ID NO: 226016 - protein, 20 aa, Mycobacterium bovis
CREIRHFYHDGSMRVRTIRH

SEQ ID NO: 226017 - protein, 24 aa, Mycobacterium bovis
DADWHFIADPASRFYNLVLADCGA

SEQ ID NO: 226018 - protein, 18 aa, Mycobacterium bovis
DAINAPVQSLTGRPLIGD

SEQ ID NO: 226019 - protein, 24 aa, Mycobacterium bovis
DAINAPVQSLTGRPLIGDGANGID

SEQ ID NO: 226020 - protein, 31 aa, Mycobacterium bovis
DAKDLQVWERLTGNFWLPEKIPLSNDLASWQ

SEQ ID NO: 226021 - protein, 32 aa, Mycobacterium bovis
DAKDLQVWERLTGNFWLPEKIPLSNDLASWQT

SEQ ID NO: 226022 - protein, 20 aa, Mycobacterium bovis
DAKVIAPDKPWFSYVCPGAG

SEQ ID NO: 226023 - protein, 17 aa, Mycobacterium bovis
DALSKLTPWKAPPPIAH

SEQ ID NO: 226024 - protein, 22 aa, Mycobacterium bovis
DCPPSLGVLTLNGLTAADEAIV

SEQ ID NO: 226025 - protein, 27 aa, Mycobacterium bovis
DDPAEWKIFLNLLRTRFETDKDKWTKI

SEQ ID NO: 226026 - protein, 26 aa, Mycobacterium bovis
DDPVPVRVLYLGRGLAKATLFGPAEV

SEQ ID NO: 226027 - protein, 18 aa, Mycobacterium bovis
DDYFMPLTRQVLSEGIQD

SEQ ID NO: 226028 - protein, 17 aa, Mycobacterium bovis
DELDLPVDWEPLGAIAI

SEQ ID NO: 226029 - protein, 23 aa, Mycobacterium bovis
DELGTALLLITHDLALAAQRAEA

SEQ ID NO: 226030 - protein, 25 aa, Mycobacterium bovis
DERDFPASAVRFFASARSQGRKLAF

SEQ ID NO: 226031 - protein, 27 aa, Mycobacterium bovis
DFVEFTPSHTPLLITNHLPRVPGDDTA

SEQ ID NO: 226032 - protein, 25 aa, Mycobacterium bovis
DGASMWFRSFFGVPSSITAPDGRPV

SEQ ID NO: 226033 - protein, 20 aa, Mycobacterium bovis
DGEHVVPIPRLLNVEDYLDY

SEQ ID NO: 226034 - protein, 31 aa, Mycobacterium bovis
DGGAGANGLNSGAMLPGGGTVGNPGTGGNGG

SEQ ID NO: 226035 - protein, 24 aa, Mycobacterium bovis
DGGDGGYGGWGGAGGNGGAGGSAP

SEQ ID NO: 226036 - protein, 28 aa, Mycobacterium bovis
DGLDYAVIKFDPAKVTPVAVFNGFAING

SEQ ID NO: 226037 - protein, 17 aa, Mycobacterium bovis
DGRFIPAGPSGSPLRGL

SEQ ID NO: 226038 - protein, 18 aa, Mycobacterium bovis
DGRIILPLLGSDSDVANL

SEQ ID NO: 226039 - protein, 25 aa, Mycobacterium bovis
DGRTRYRLLETVRQYALEKLRESGD

SEQ ID NO: 226040 - protein, 22 aa, Mycobacterium bovis
DGSPKILERCTLPLTGVGCVDR

SEQ ID NO: 226041 - protein, 19 aa, Mycobacterium bovis
DGVGSYTFGLAEQAVFHEV

SEQ ID NO: 226042 - protein, 24 aa, Mycobacterium bovis
DHGQPWTCEIHYTCACCCLPPNLR

SEQ ID NO: 226043 - protein, 28 aa, Mycobacterium bovis
DHSTFFRGRWPRLLRSLYPIGGVVFDGD

SEQ ID NO: 226044 - protein, 20 aa, Mycobacterium bovis
DHYRPISWDAAYQLIAEQLN

SEQ ID NO: 226045 - protein, 32 aa, Mycobacterium bovis
DIDRLVELFTAEAIWEMPPYTGWYQGAQAIVT

SEQ ID NO: 226046 - protein, 20 aa, Mycobacterium bovis
DIPRVPVTLNYLFGSQPGGP

SEQ ID NO: 226047 - protein, 19 aa, Mycobacterium bovis
DIVALLLGDSFHPGGATLT

SEQ ID NO: 226048 - protein, 30 aa, Mycobacterium bovis
DKADMFIGFGRFSTFDFPLLSSGKTSLYFT

SEQ ID NO: 226049 - protein, 23 aa, Mycobacterium bovis
DKVNAYVAAFNQGRNTGPTEGPA

SEQ ID NO: 226050 - protein, 22 aa, Mycobacterium bovis
DLGVSHLYLSPILTAVGGSTHG

SEQ ID NO: 226051 - protein, 22 aa, Mycobacterium bovis
DLHLGQVLRTPESWLLIDFEGE

SEQ ID NO: 226052 - protein, 20 aa, Mycobacterium bovis
DLLPEAFAVAREAAWRVLDQ

SEQ ID NO: 226053 - protein, 27 aa, Mycobacterium bovis
DLLVARRRPPAGDGWRKAVTKMTFGRV

SEQ ID NO: 226054 - protein, 18 aa, Mycobacterium bovis
DLVSLMKVGLRRGKIIVV

SEQ ID NO: 226055 - protein, 21 aa, Mycobacterium bovis
DNKAPLTDRLFPIGCQAAPRS

SEQ ID NO: 226056 - protein, 18 aa, Mycobacterium bovis
DNVPMRTIMDRYGAVWQR

SEQ ID NO: 226057 - protein, 21 aa, Mycobacterium bovis
DPEAAFAHFGRRFDDLSTEIM

SEQ ID NO: 226058 - protein, 22 aa, Mycobacterium bovis
DPHRHELRSYRIVDGAVTEEPV

SEQ ID NO: 226059 - protein, 17 aa, Mycobacterium bovis
DPLTPEAFYLQYFGCRP

SEQ ID NO: 226060 - protein, 18 aa, Mycobacterium bovis
DPNPMFVERALALLEQVD

SEQ ID NO: 226061 - protein, 18 aa, Mycobacterium bovis
DPQLTFAAQFRTPSTVTV

SEQ ID NO: 226062 - protein, 29 aa, Mycobacterium bovis
DPRRAVLVRPPRGLTATGLAALLRSMRSP

SEQ ID NO: 226063 - protein, 22 aa, Mycobacterium bovis
DPYPYYRRLRDEAPLYRNEERN

SEQ ID NO: 226064 - protein, 24 aa, Mycobacterium bovis
DQGQGVFDCAHRGGFEGAESLHES

SEQ ID NO: 226065 - protein, 43 aa, Mycobacterium bovis
DQGRHVWGWRRLLLKQILECVLRRFPILGFQHPLSGLGDQTDI

SEQ ID NO: 226066 - protein, 24 aa, Mycobacterium bovis
DQMLDTAVLLGALPPRVSPVSDGL

SEQ ID NO: 226067 - protein, 23 aa, Mycobacterium bovis
DRFAGQLLPRRAAQKFADFANAR

SEQ ID NO: 226068 - protein, 24 aa, Mycobacterium bovis
DRLRTRFEWGLITDVQPPELETRI

SEQ ID NO: 226069 - protein, 25 aa, Mycobacterium bovis
DRQQVLFCGLWYDDDFVRTPDGWRI

SEQ ID NO: 226070 - protein, 24 aa, Mycobacterium bovis
DRQRHTSLLPLLHNYREPAKPICG

SEQ ID NO: 226071 - protein, 20 aa, Mycobacterium bovis
DRVVLVLLDRAGSSAVVGAV

SEQ ID NO: 226072 - protein, 21 aa, Mycobacterium bovis
DSGLTLSWLSRNLTSRNPRSL

SEQ ID NO: 226073 - protein, 24 aa, Mycobacterium bovis
DSMTLYGFPDGETRDLFLTLLSVS

SEQ ID NO: 226074 - protein, 18 aa, Mycobacterium bovis
DSRLPRWRAMAAHALCKR

SEQ ID NO: 226075 - protein, 34 aa, Mycobacterium bovis
DTPGPQRSLAYDRAWWFARFVAAAYGTAKLRELY

SEQ ID NO: 226076 - protein, 30 aa, Mycobacterium bovis
DTSLITAKIISVILLVQLIEPVAFCIGFEH

SEQ ID NO: 226077 - protein, 23 aa, Mycobacterium bovis
DVAIKRPIFVTGLVRTGTTALHR

SEQ ID NO: 226078 - protein, 22 aa, Mycobacterium bovis
DVDGFVFPTCRWVHPIGPGNRS

SEQ ID NO: 226079 - protein, 22 aa, Mycobacterium bovis
DVGDYVAYLLEPVSVWAPECSE

SEQ ID NO: 226080 - protein, 24 aa, Mycobacterium bovis
DVLAQAQRPLLVLGKGAAYAQADN

SEQ ID NO: 226081 - protein, 23 aa, Mycobacterium bovis
DVLDELCLTIAPYVVGGLARRIV

SEQ ID NO: 226082 - protein, 22 aa, Mycobacterium bovis
DVPLIGFAGAPFTLASYLVEGG

SEQ ID NO: 226083 - protein, 17 aa, Mycobacterium bovis
DVSDDFFALFQDPTRTY

SEQ ID NO: 226084 - protein, 22 aa, Mycobacterium bovis
DVYALQSALPPRFQASAAFAAN

SEQ ID NO: 226085 - protein, 18 aa, Mycobacterium bovis
DWFATLPAELTDVVTAYW

SEQ ID NO: 226086 - protein, 19 aa, Mycobacterium bovis
DWMVATTLLTGRRTWVPWT

SEQ ID NO: 226087 - protein, 18 aa, Mycobacterium bovis
DYLIRTLAAAPPLTDEQR

SEQ ID NO: 226088 - protein, 29 aa, Mycobacterium bovis
DYPAGAAFSWWPTMLLPPGSHQDNMTVGV

SEQ ID NO: 226089 - protein, 26 aa, Mycobacterium bovis
DYSEALALARLGWAALAVGTSHAVLD

SEQ ID NO: 226090 - protein, 17 aa, Mycobacterium bovis
EAAFVDIGRGRNGVLYA

SEQ ID NO: 226091 - protein, 36 aa, Mycobacterium bovis
EAANASPLQTLEQGLLGAINAPAAALSGRPFIGNGT

SEQ ID NO: 226092 - protein, 19 aa, Mycobacterium bovis
EADPRMFRLIRGQVAIATT

SEQ ID NO: 226093 - protein, 23 aa, Mycobacterium bovis
EAFRLLGHFDVVFSNAGIVVGGP

SEQ ID NO: 226094 - protein, 19 aa, Mycobacterium bovis
EAFVLAEKLGLSAQSLFDV

SEQ ID NO: 226095 - protein, 25 aa, Mycobacterium bovis
EAGSLVAPPKVRVPLLVGGNGTEVL

SEQ ID NO: 226096 - protein, 17 aa, Mycobacterium bovis
EALAPYGLGTAYVNFTA

SEQ ID NO: 226097 - protein, 31 aa, Mycobacterium bovis
EALRLGHNYIGTEHLLLALLELEDGDGPLHR

SEQ ID NO: 226098 - protein, 27 aa, Mycobacterium bovis
EANNHFRVLFFRWGQHPVALTAFYKNQ

SEQ ID NO: 226099 - protein, 24 aa, Mycobacterium bovis
EAPARAYNPLFIWGESGLGKTHLL

SEQ ID NO: 226100 - protein, 28 aa, Mycobacterium bovis
EAPTGWPNILPDDFTILDGILAAYATVG

SEQ ID NO: 226101 - protein, 26 aa, Mycobacterium bovis
EARLQRPLYVMPTKGIFTSSFGYRWG

SEQ ID NO: 226102 - protein, 20 aa, Mycobacterium bovis
EASIVVIRILGGYRAWQSGI

SEQ ID NO: 226103 - protein, 23 aa, Mycobacterium bovis
EATYEQMWAADVAAMVGYHGGAS

SEQ ID NO: 226104 - protein, 22 aa, Mycobacterium bovis
EAVYEQMWAADVAAMLGYHGEA

SEQ ID NO: 226105 - protein, 25 aa, Mycobacterium bovis
EDRKPLLNAKLLVLGHLALNVYDPD

SEQ ID NO: 226106 - protein, 22 aa, Mycobacterium bovis
EDSQLWLLQTRGAERSAQAAVR

SEQ ID NO: 226107 - protein, 17 aa, Mycobacterium bovis
EEPILAGLIDRIARDEV

SEQ ID NO: 226108 - protein, 19 aa, Mycobacterium bovis
EESRFRGMCEARGLPAVRI

SEQ ID NO: 226109 - protein, 18 aa, Mycobacterium bovis
EFCDIDHSAPWPLGPTHP

SEQ ID NO: 226110 - protein, 18 aa, Mycobacterium bovis
EFKAMFLDDLLNGSRKQL

SEQ ID NO: 226111 - protein, 22 aa, Mycobacterium bovis
EFLRWLAGVRFTGDVWAAPEGT

SEQ ID NO: 226112 - protein, 28 aa, Mycobacterium bovis
EGIDFTNIYFYTVLYHALRASNRIAIER

SEQ ID NO: 226113 - protein, 19 aa, Mycobacterium bovis
EGLCLDVCTGGELAVALHA

SEQ ID NO: 226114 - protein, 17 aa, Mycobacterium bovis
EGRMIEFVIERLSLIPE

SEQ ID NO: 226115 - protein, 18 aa, Mycobacterium bovis
EHAHKLVFAVLRGVAAVA

SEQ ID NO: 226116 - protein, 25 aa, Mycobacterium bovis
EHAHKLVFAVLRGVAAVAPVCRLLR

SEQ ID NO: 226117 - protein, 27 aa, Mycobacterium bovis
EHAVTLWKQWDRCALHWFPGSHLLHVS

SEQ ID NO: 226118 - protein, 17 aa, Mycobacterium bovis
EHEVHVLFYGDYKKRLP

SEQ ID NO: 226119 - protein, 26 aa, Mycobacterium bovis
EHSPNILYLVWDDVGIATWDCFGGLV

SEQ ID NO: 226120 - protein, 21 aa, Mycobacterium bovis
EICRRLDGIPLAIEFAAARVR

SEQ ID NO: 226121 - protein, 37 aa, Mycobacterium bovis; identical to SEQ ID NO: 125850

SEQ ID NO: 226122 - protein, 22 aa, Mycobacterium bovis
ELERRNARRALITLCIGGGMGV

SEQ ID NO: 226123 - protein, 18 aa, Mycobacterium bovis
ELGLRPLLPRLDTAERAL

SEQ ID NO: 226124 - protein, 19 aa, Mycobacterium bovis
ELLEYHWGPDWVVWDAAKT

SEQ ID NO: 226125 - protein, 22 aa, Mycobacterium bovis
ELPTYAFDKRRFWLSAEGSGAD

SEQ ID NO: 226126 - protein, 23 aa, Mycobacterium bovis
ELRHHIATPQPLQWDCFLFGIIQ

SEQ ID NO: 226127 - protein, 17 aa, Mycobacterium bovis
ELTAMITYHRKMAAVAQ

SEQ ID NO: 226128 - protein, 23 aa, Mycobacterium bovis
ELTLAAPLVLPASGSVAVQVVVN

SEQ ID NO: 226129 - protein, 17 aa, Mycobacterium bovis
ELVARLATGWVLEEVHD

SEQ ID NO: 226130 - protein, 19 aa, Mycobacterium bovis
ELYLAVLHRHVENLVSGVH

SEQ ID NO: 226131 - protein, 23 aa, Mycobacterium bovis
ELYPDPVLPALSLLPHTVRTAPA

SEQ ID NO: 226132 - protein, 30 aa, Mycobacterium bovis
ENHTFNYLDLVRYLAVGNLNPSPLGYVGGS

SEQ ID NO: 226133 - protein, 23 aa, Mycobacterium bovis
ENRAELMILIATNLLGQNTPAIA

SEQ ID NO: 226134 - protein, 31 aa, Mycobacterium bovis
EPDLKWERFITAVRLLAERLGVRQTIGLGTV

SEQ ID NO: 226135 - protein, 32 aa, Mycobacterium bovis
EPDLKWERFITAVRLLAERLGVRQTIGLGTVP

SEQ ID NO: 226136 - protein, 33 aa, Mycobacterium bovis; identical to SEQ ID NO: 114290

SEQ ID NO: 226137 - protein, 19 aa, Mycobacterium bovis
EPDVACEITLQPIRRYDVD

SEQ ID NO: 226138 - protein, 22 aa, Mycobacterium bovis
EPLDADAWFDTVRRAAPFATLP

SEQ ID NO: 226139 - protein, 24 aa, Mycobacterium bovis
EQELDLVLAILRARQLFGGAHAIP

SEQ ID NO: 226140 - protein, 17 aa, Mycobacterium bovis
EQIGYPDQGGYPEQRGY

SEQ ID NO: 226141 - protein, 17 aa, Mycobacterium bovis
EQRDMFLRWSDDLVTFL

SEQ ID NO: 226142 - protein, 33 aa, Mycobacterium bovis
EQVLAAVRATFKPEFINRLDDVLIFEGLNPEEL

SEQ ID NO: 226143 - protein, 25 aa, Mycobacterium bovis
ERASPYVVGALKLGLTAPFNIDEVP

SEQ ID NO: 226144 - protein, 26 aa, Mycobacterium bovis
ERGIPLTMEMAKFIRFIVTDIFPGGR

SEQ ID NO: 226145 - protein, 24 aa, Mycobacterium bovis
ERGKAARRFLPGATILKASVGPMD

SEQ ID NO: 226146 - protein, 19 aa, Mycobacterium bovis
ERGLSMVDGLLLLVDASEG

SEQ ID NO: 226147 - protein, 18 aa, Mycobacterium bovis
ERGWLIVVTSRLCLDHIK

SEQ ID NO: 226148 - protein, 22 aa, Mycobacterium bovis
ERLNLPAGWSYHTRVLTSELRV

SEQ ID NO: 226149 - protein, 17 aa, Mycobacterium bovis
ERLTALPGWELVDGKLR

SEQ ID NO: 226150 - protein, 22 aa, Mycobacterium bovis
ERSSHTWFVLRELLGHQNVKNY

SEQ ID NO: 226151 - protein, 26 aa, Mycobacterium bovis
ESLADPLAFLLRKEGFEATVVTDGPA

SEQ ID NO: 226152 - protein, 24 aa, Mycobacterium bovis
ESRAQMATLPRLKPRVFYDLVVEV

SEQ ID NO: 226153 - protein, 22 aa, Mycobacterium bovis
ETARMHLLRLASEFGLTPAAEQ

SEQ ID NO: 226154 - protein, 21 aa, Mycobacterium bovis
ETGLLPAELFAEAISQVAIAA

SEQ ID NO: 226155 - protein, 29 aa, Mycobacterium bovis
ETGQTPLARWSAGGPIPLPAPETLTEAFL

SEQ ID NO: 226156 - protein, 18 aa, Mycobacterium bovis
ETIFGAVRFALPDVSRQA

SEQ ID NO: 226157 - protein, 20 aa, Mycobacterium bovis
ETIRAWFPDAPLEVREALVR

SEQ ID NO: 226158 - protein, 30 aa, Mycobacterium bovis; identical to SEQ ID NO: 198850

SEQ ID NO: 226159 - protein, 28 aa, Mycobacterium bovis
ETQWPLAGTRWRPMYLAGPGLLATEPPP

SEQ ID NO: 226160 - protein, 18 aa, Mycobacterium bovis
ETRLVPQRGYHLELITAV

SEQ ID NO: 226161 - protein, 21 aa, Mycobacterium bovis
EVHVLFYGDYKKRLPSTAQGA

SEQ ID NO: 226162 - protein, 25 aa, Mycobacterium bovis
EVLDFEPRTVWWGSANWTVRAGSHL

SEQ ID NO: 226163 - protein, 23 aa, Mycobacterium bovis
EVSQAIARLFSDYATHYQSLNAQ

SEQ ID NO: 226164 - protein, 22 aa, Mycobacterium bovis
EVTTIVVLRHAPPAPWIPVDQR

SEQ ID NO: 226165 - protein, 19 aa, Mycobacterium bovis
EVVTDMWGRPRVRLTGAIA

SEQ ID NO: 226166 - protein, 17 aa, Mycobacterium bovis
EWRIGPGERIGIVGANG

SEQ ID NO: 226167 - protein, 18 aa, Mycobacterium bovis
FAAYGEWMATPPPTWEDI

SEQ ID NO: 226168 - protein, 19 aa, Mycobacterium bovis
FAELSPHPLLTHAVDQIAG

SEQ ID NO: 226169 - protein, 21 aa, Mycobacterium bovis
FAENLVFTEAPKLVRHLQNTQ

SEQ ID NO: 226170 - protein, 37 aa, Mycobacterium bovis
FAQRVPDWLWAAPRKLLARFFVWLTVGLYDPPVRELM

SEQ ID NO: 226171 - protein, 18 aa, Mycobacterium bovis
FARILRPGGLAGITDVTV

SEQ ID NO: 226172 - protein, 23 aa, Mycobacterium bovis
FAVHFFRRELVARLATGWVLEEV

SEQ ID NO: 226173 - protein, 23 aa, Mycobacterium bovis
FDMYTGRLFAVSLLPGSPDRLVL

SEQ ID NO: 226174 - protein, 17 aa, Mycobacterium bovis
FDTAMIVDEPFLAPARI

SEQ ID NO: 226175 - protein, 26 aa, Mycobacterium bovis
FDVLAFPDHLVPSVSPFAGATAAAMA

SEQ ID NO: 226176 - protein, 25 aa, Mycobacterium bovis
FEAGDWHLTAPLTLFGHCMGAIVAF

SEQ ID NO: 226177 - protein, 19 aa, Mycobacterium bovis
FEHLPRGSFGRILSVLNAA

SEQ ID NO: 226178 - protein, 25 aa, Mycobacterium bovis
FERDAIPLLDQLYGGALRMTRNPAD

SEQ ID NO: 226179 - protein, 26 aa, Mycobacterium bovis
FGNAGNINTGFWNAGNLNTGFGSAGN

SEQ ID NO: 226180 - protein, 32 aa, Mycobacterium bovis
FGPNRRPTGQRGFFAWFRVGSDVLVRNAFRVL

SEQ ID NO: 226181 - protein, 29 aa, Mycobacterium bovis
FGSTSGAHGKAGFSAPGGDGGDGGNGGHG

SEQ ID NO: 226182 - protein, 24 aa, Mycobacterium bovis
FGTPDTWVLWNLTGGPRGGCACHR

SEQ ID NO: 226183 - protein, 19 aa, Mycobacterium bovis
FHAFSAAPNFAFELAARRT

SEQ ID NO: 226184 - protein, 17 aa, Mycobacterium bovis
FHATRRLAAAMVASSAT

SEQ ID NO: 226185 - protein, 20 aa, Mycobacterium bovis
FIEHDSQGYRLIFENDFVTE

SEQ ID NO: 226186 - protein, 20 aa, Mycobacterium bovis
FIVNNLTPPAELFLVELRGP

SEQ ID NO: 226187 - protein, 19 aa, Mycobacterium bovis
FLEKEQRIIAALRAAADSP

SEQ ID NO: 226188 - protein, 17 aa, Mycobacterium bovis
FLPAFNIPGIDVPAINV

SEQ ID NO: 226189 - protein, 19 aa, Mycobacterium bovis
FLTPRNSLRQRCVAHRLTI

SEQ ID NO: 226190 - protein, 18 aa, Mycobacterium bovis
FLVHAWDYAVAVGSELKA

SEQ ID NO: 226191 - protein, 36 aa, Mycobacterium bovis
FMGSSYLLNGLFFSLPWYYRSGYDVLLYTLPFHGQR

SEQ ID NO: 226192 - protein, 18 aa, Mycobacterium bovis
FMRNAAGGTLFNFGFAND

SEQ ID NO: 226193 - protein, 28 aa, Mycobacterium bovis
FNSAIVRPLLRFFFKSWFRVEVSGVENI

SEQ ID NO: 226194 - protein, 17 aa, Mycobacterium bovis
FPLALRPNPDAEPDRRG

SEQ ID NO: 226195 - protein, 19 aa, Mycobacterium bovis
FRGIPVRRPGRFFATVDFS

SEQ ID NO: 226196 - protein, 25 aa, Mycobacterium bovis
FSDNLPSCITKYIPLHTPAVVMSIN

SEQ ID NO: 226197 - protein, 22 aa, Mycobacterium bovis
FSTKMKLFGLPYRITSRVTALK

SEQ ID NO: 226198 - protein, 23 aa, Mycobacterium bovis
FSTKMKLFGLPYRITSRVTALKP

SEQ ID NO: 226199 - protein, 24 aa, Mycobacterium bovis
FSTKMKLFGLPYRITSRVTALKPN

SEQ ID NO: 226200 - protein, 18 aa, Mycobacterium bovis
FTGVIRAFAGLYPGRKFG

SEQ ID NO: 226201 - protein, 29 aa, Mycobacterium bovis
FTLTVGLMLPRRAFLPPPHVDSAVLVVRR

SEQ ID NO: 226202 - protein, 28 aa, Mycobacterium bovis
FTVPEPLSLRPHYIKTLRIWGDTLQSNK

SEQ ID NO: 226203 - protein, 24 aa, Mycobacterium bovis
FVELPTYAFQRRRFWLSGDGVAAD

SEQ ID NO: 226204 - protein, 18 aa, Mycobacterium bovis
FVLHEIFGLPYQQIATTI

SEQ ID NO: 226205 - protein, 25 aa, Mycobacterium bovis
GAAGDVTLAINQGAGGAGGNGGNVG

SEQ ID NO: 226206 - protein, 18 aa, Mycobacterium bovis
GAAGLFGIGGAGGAGGAG

SEQ ID NO: 226207 - protein, 19 aa, Mycobacterium bovis
GAEYWLAPSGFTRAPQNSV

SEQ ID NO: 226208 - protein, 24 aa, Mycobacterium bovis
GAGAYAFAEAANASPLQSAMGAVS

SEQ ID NO: 226209 - protein, 22 aa, Mycobacterium bovis
GAGGAALLFGAGGAGGAGGSGG

SEQ ID NO: 226210 - protein, 26 aa, Mycobacterium bovis
GAGGAGGLFGAGGMGGAGGFGDHGTL

SEQ ID NO: 226211 - protein, 17 aa, Mycobacterium bovis
GAGGAGGLVLGRDGQHG

SEQ ID NO: 226212 - protein, 20 aa, Mycobacterium bovis
GAGGILFGAGGAGGAGGAVT

SEQ ID NO: 226213 - protein, 19 aa, Mycobacterium bovis
GAGGLFASGGVGGTGGGAG

SEQ ID NO: 226214 - protein, 26 aa, Mycobacterium bovis
GAGGNAGLLAPGLAGGAGGGGGQGFD

SEQ ID NO: 226215 - protein, 25 aa, Mycobacterium bovis
GAGGNAGVAGVSFGNAVGGDGGNGG

SEQ ID NO: 226216 - protein, 23 aa, Mycobacterium bovis
GAGGNGGWLWGNGGNGGVGGTSV

SEQ ID NO: 226217 - protein, 28 aa, Mycobacterium bovis
GAGGTGGNAAWLLGGGGTGGAGGIGGGN

SEQ ID NO: 226218 - protein, 24 aa, Mycobacterium bovis
GAGSLFNGAPGFGGPGGSGGASLL

SEQ ID NO: 226219 - protein, 24 aa, Mycobacterium bovis
GAHGALGGLTVAGGNGGAGGAGGA

SEQ ID NO: 226220 - protein, 20 aa, Mycobacterium bovis
GAHGFNAVLVSDGGNGGDGG

SEQ ID NO: 226221 - protein, 23 aa, Mycobacterium bovis
GAPVPIPGFPTTVTVFGTPFMGM

SEQ ID NO: 226222 - protein, 18 aa, Mycobacterium bovis
GAQRFFAAIPTWDEAHGP

SEQ ID NO: 226223 - protein, 23 aa, Mycobacterium bovis
GAQYDVRLVSRVSDAPPVPARLV

SEQ ID NO: 226224 - protein, 25 aa, Mycobacterium bovis
GATAFPWRRQSALVQWYVETSGSPS

SEQ ID NO: 226225 - protein, 33 aa, Mycobacterium bovis
GATTTTYLVPVNHLPLTLPLRYLGMSDAEVDQI

SEQ ID NO: 226226 - protein, 27 aa, Mycobacterium bovis
GAVNAPTQTLLGRPLIGDGAHGTAPGQ

SEQ ID NO: 226227 - protein, 20 aa, Mycobacterium bovis
GCNLACKFCQNWDISKSREI

SEQ ID NO: 226228 - protein, 23 aa, Mycobacterium bovis
GCRMDSMFPLGPSLATRASTSPS

SEQ ID NO: 226229 - protein, 22 aa, Mycobacterium bovis
GDAFARIFGGSIVPQEVEALLR

SEQ ID NO: 226230 - protein, 21 aa, Mycobacterium bovis
GDAMPWLMASAKTLSYAVNMA

SEQ ID NO: 226231 - protein, 25 aa, Mycobacterium bovis
GDERHMLWFELMKPMTSTATGREAA

SEQ ID NO: 226232 - protein, 18 aa, Mycobacterium bovis
GDFASGVGGVGGAGGDGG

SEQ ID NO: 226233 - protein, 26 aa, Mycobacterium bovis
GDGGDGGYGGWGGAGGNGGAGGSAPA

SEQ ID NO: 226234 - protein, 19 aa, Mycobacterium bovis
GDGGGGISLGGQGGNGGFG

SEQ ID NO: 226235 - protein, 28 aa, Mycobacterium bovis
GDGGTGGRGGLLMGAGAGGHGGTGGAGG

SEQ ID NO: 226236 - protein, 20 aa, Mycobacterium bovis
GDRDIRLPFHKPVDDMTGLS

SEQ ID NO: 226237 - protein, 22 aa, Mycobacterium bovis
GDRLLTELGWALRRAPLPPTGP

SEQ ID NO: 226238 - protein, 25 aa, Mycobacterium bovis
GDTNTGFGNAGFFNMGIGNAGNEDM

SEQ ID NO: 226239 - protein, 26 aa, Mycobacterium bovis
GDVNTGFWNGGPFNTGFGNGGNTNFG

SEQ ID NO: 226240 - protein, 20 aa, Mycobacterium bovis
GEDFSWYLEEVPGAMARLGV

SEQ ID NO: 226241 - protein, 18 aa, Mycobacterium bovis
GEEMARLFAWCPEAVTAA

SEQ ID NO: 226242 - protein, 21 aa, Mycobacterium bovis
GERADWWWYEPFQPQPPPISN

SEQ ID NO: 226243 - protein, 27 aa, Mycobacterium bovis
GETRFALVLSRLFWDAAIFHRACEAVM

SEQ ID NO: 226244 - protein, 19 aa, Mycobacterium bovis
GETWPLQDTVRPWDSLSDE

SEQ ID NO: 226245 - protein, 22 aa, Mycobacterium bovis
GFERFYGFLGGETDQWYPDLVY

SEQ ID NO: 226246 - protein, 18 aa, Mycobacterium bovis
GFKDARPDRLPLSASVWD

SEQ ID NO: 226247 - protein, 17 aa, Mycobacterium bovis
GFRLRDSMRLPPRMVGR

SEQ ID NO: 226248 - protein, 18 aa, Mycobacterium bovis
GFSSLAYLPRLPVDVVKL

SEQ ID NO: 226249 - protein, 26 aa, Mycobacterium bovis
GFSYDVLHAFNPRIVLAGSSAFGNRG

SEQ ID NO: 226250 - protein, 17 aa, Mycobacterium bovis
GFVAFDVDPGQPGGTTS

SEQ ID NO: 226251 - protein, 28 aa, Mycobacterium bovis
GGAGAGIANFLGFSVLHGGAGGAGGTAT

SEQ ID NO: 226252 - protein, 27 aa, Mycobacterium bovis
GGAGGAGGLFAGGGIGGAGGFGGFRGG

SEQ ID NO: 226253 - protein, 17 aa, Mycobacterium bovis
GGAGGAGGWLIGQSGST

SEQ ID NO: 226254 - protein, 18 aa, Mycobacterium bovis
GGAGGIPGLIGNGGNGGD

SEQ ID NO: 226255 - protein, 22 aa, Mycobacterium bovis
GGAGQITGLRSGFGGAGGAGGA

SEQ ID NO: 226256 - protein, 23 aa, Mycobacterium bovis
GGATPLLVFYHGGGWTLGDLDTH

SEQ ID NO: 226257 - protein, 31 aa, Mycobacterium bovis
GGFGSTSGAHGKAGFGAPGGDGGDGGNGGHG

SEQ ID NO: 226258 - protein, 30 aa, Mycobacterium bovis
GGGAGGAGGSGFFGGKGGFGGDGGQGGPNG

SEQ ID NO: 226259 - protein, 25 aa, Mycobacterium bovis
GGGNPHYDIPKLLSMYKAGKLNLDD

SEQ ID NO: 226260 - protein, 25 aa, Mycobacterium bovis
GGHGGSAAKLFGDGGAGGAGGMGST

SEQ ID NO: 226261 - protein, 26 aa, Mycobacterium bovis
GGKGGTGLMPGINGTGGAGGSRGQIS

SEQ ID NO: 226262 - protein, 30 aa, Mycobacterium bovis
GGLGGDGFTYLADLTESLAATEVTAATAGG

SEQ ID NO: 226263 - protein, 18 aa, Mycobacterium bovis
GGLGSAFGPGGTGGMGGA

SEQ ID NO: 226264 - protein, 17 aa, Mycobacterium bovis
GGLTYVEVSRRLAANLS

SEQ ID NO: 226265 - protein, 20 aa, Mycobacterium bovis
GGMPMMLMPMSISGAGAGMP

SEQ ID NO: 226266 - protein, 25 aa, Mycobacterium bovis
GGNGGSAGWLSGNGGTGGGGGTAGA

SEQ ID NO: 226267 - protein, 20 aa, Mycobacterium bovis
GGNRMLAGAAGAGGAGGFSF

SEQ ID NO: 226268 - protein, 27 aa, Mycobacterium bovis
GGPGGNGGWLLGNGGHGGAGGIGGGSG

SEQ ID NO: 226269 - protein, 27 aa, Mycobacterium bovis
GGQGGAGGAGISFSNGSNGGTGGTGGV

SEQ ID NO: 226270 - protein, 19 aa, Mycobacterium bovis
GGSAGLFYGSGGAGGNGGY

SEQ ID NO: 226271 - protein, 20 aa, Mycobacterium bovis
GGSAGLLGNGGSGGAGGTGA

SEQ ID NO: 226272 - protein, 18 aa, Mycobacterium bovis
GGSAGLWGSGGNGGQGGA

SEQ ID NO: 226273 - protein, 24 aa, Mycobacterium bovis
GGSARGLIFALGGAGAAGGDASTG

SEQ ID NO: 226274 - protein, 28 aa, Mycobacterium bovis
GGTGGFAVAPDFIGFGAAYGGAGGLGGA

SEQ ID NO: 226275 - protein, 21 aa, Mycobacterium bovis
GGTGGIGGTGAPGAMGGTGGN

SEQ ID NO: 226276 - protein, 26 aa, Mycobacterium bovis
GGTGGKGGMGGIAGDGGPGGDGGNAG

SEQ ID NO: 226277 - protein, 19 aa, Mycobacterium bovis
GGTPFPLQLATQVDAPPGS

SEQ ID NO: 226278 - protein, 19 aa, Mycobacterium bovis
GGVLAWESLALSGAEAGTA

SEQ ID NO: 226279 - protein, 18 aa, Mycobacterium bovis
GGVSANPALNGSAGANGT

SEQ ID NO: 226280 - protein, 28 aa, Mycobacterium bovis
GGYRDTEIMRWLFTPDPSLTITRDGSRD

SEQ ID NO: 226281 - protein, 31 aa, Mycobacterium bovis
GHAYAGELLFLYNGVRPRNVMPVHGTWRMLR

SEQ ID NO: 226282 - protein, 25 aa, Mycobacterium bovis
GHFNAVELILCFNQLAYSAFAPAVL

SEQ ID NO: 226283 - protein, 26 aa, Mycobacterium bovis
GHFVPNLTIGLPVVESLLAVTDIPMD

SEQ ID NO: 226284 - protein, 20 aa, Mycobacterium bovis
GHLRLVDLCERLGLAKSTTR

SEQ ID NO: 226285 - protein, 18 aa, Mycobacterium bovis
GHLWQWVGTNIGRYHSYP

SEQ ID NO: 226286 - protein, 25 aa, Mycobacterium bovis
GHVFRRAFSWLPAQFASQSDAPVGA

SEQ ID NO: 226287 - protein, 18 aa, Mycobacterium bovis
GIAQRKAVRPALHAVSRS

SEQ ID NO: 226288 - protein, 18 aa, Mycobacterium bovis
GIDPWEISFGFHGLDSLQ

SEQ ID NO: 226289 - protein, 28 aa, Mycobacterium bovis
GIGGKGGDAFATFAKAGNGGAGGNGGAA

SEQ ID NO: 226290 - protein, 17 aa, Mycobacterium bovis
GIPKSNFYPSPDRESAY

SEQ ID NO: 226291 - protein, 20 aa, Mycobacterium bovis
GISLGGQGGNGGFGGAGGNG

SEQ ID NO: 226292 - protein, 19 aa, Mycobacterium bovis
GISSRLLRTLLAPNSGLVA

SEQ ID NO: 226293 - protein, 26 aa, Mycobacterium bovis
GISVPAFSLPAITLPSLTIPAVTTPA

SEQ ID NO: 226294 - protein, 26 aa, Mycobacterium bovis
GLAAELLRRLPFELTAGQREVLDVLS

SEQ ID NO: 226295 - protein, 20 aa, Mycobacterium bovis
GLAEYFVHRTGHGIGLCVHE

SEQ ID NO: 226296 - protein, 24 aa, Mycobacterium bovis
GLARARWGLLEPPEPWLPEAALAQ

SEQ ID NO: 226297 - protein, 23 aa, Mycobacterium bovis
GLAWRTKRLIVFDVDSTLVQGEV

SEQ ID NO: 226298 - protein, 18 aa, Mycobacterium bovis
GLGNIGSWNLGGGNVGLL

SEQ ID NO: 226299 - protein, 18 aa, Mycobacterium bovis
GLGWRQCQRPTPPFALVL

SEQ ID NO: 226300 - protein, 18 aa, Mycobacterium bovis
GLLAELRRRAEARHPPVV

SEQ ID NO: 226301 - protein, 18 aa, Mycobacterium bovis
GLLALLAGALEGAGAGIV

SEQ ID NO: 226302 - protein, 27 aa, Mycobacterium bovis
GLLDNRPIGVLFKRIFDRPARRPVRRV

SEQ ID NO: 226303 - protein, 17 aa, Mycobacterium bovis
GLLFGSGGSGGAGGFGF

SEQ ID NO: 226304 - protein, 20 aa, Mycobacterium bovis
GLLSTFIAALMGAEADALCG

SEQ ID NO: 226305 - protein, 23 aa, Mycobacterium bovis
GLMRRHIKPYQKPHPPIGVTGFS

SEQ ID NO: 226306 - protein, 17 aa, Mycobacterium bovis
GLRAEFGDRLPVVLLDG

SEQ ID NO: 226307 - protein, 19 aa, Mycobacterium bovis
GLRTKLLAASAYIKAADRV

SEQ ID NO: 226308 - protein, 22 aa, Mycobacterium bovis
GLSSPVILGIGIGGAGGNGGDA

SEQ ID NO: 226309 - protein, 21 aa, Mycobacterium bovis
GLVMDSQFLTQNFGPVIGTGT

SEQ ID NO: 226310 - protein, 23 aa, Mycobacterium bovis
GLVRFIDACHTRRLGVLIDAVFN

SEQ ID NO: 226311 - protein, 19 aa, Mycobacterium bovis
GMFSRITIDYYGAATPITQ

SEQ ID NO: 226312 - protein, 17 aa, Mycobacterium bovis
GMGMGLHAGYPVFAEAF

SEQ ID NO: 226313 - protein, 24 aa, Mycobacterium bovis
GMKKLRTWFAADKTGFHLLHTLFQ

SEQ ID NO: 226314 - protein, 25 aa, Mycobacterium bovis
GMPPMAPLAPLLPAAADIGLHIIVT

SEQ ID NO: 226315 - protein, 26 aa, Mycobacterium bovis
GMVGGVSIPLIKIPAAPGFGNSTTSP

SEQ ID NO: 226316 - protein, 25 aa, Mycobacterium bovis
GNGAHGFNAVLVSDGGNGGDGGAGG

SEQ ID NO: 226317 - protein, 33 aa, Mycobacterium bovis
GNGGPGTPGSPMVAPPPPTPITQVQQGGDGGAG

SEQ ID NO: 226318 - protein, 18 aa, Mycobacterium bovis
GNKIILFGARTGLDGIGG

SEQ ID NO: 226319 - protein, 33 aa, Mycobacterium bovis
GNQILGRALGLSTYKMVFGHRGINIPVVDHATG

SEQ ID NO: 226320 - protein, 20 aa, Mycobacterium bovis
GNQMRSYVLHPYQMVKDLRT

SEQ ID NO: 226321 - protein, 19 aa, Mycobacterium bovis
GPHWRLLSAVKELDPSWAR

SEQ ID NO: 226322 - protein, 22 aa, Mycobacterium bovis
GPLAAFVHALADVGFDVAVLDY

SEQ ID NO: 226323 - protein, 24 aa, Mycobacterium bovis
GPLGRLRNIAYTQLDMRDVKRVKD

SEQ ID NO: 226324 - protein, 17 aa, Mycobacterium bovis
GPPPTVWSRRWRQPWAP

SEQ ID NO: 226325 - protein, 24 aa, Mycobacterium bovis
GPTMTQYYIIRTENLPLLEPLRSV

SEQ ID NO: 226326 - protein, 18 aa, Mycobacterium bovis
GQALLARRMGKTRVIAET

SEQ ID NO: 226327 - protein, 23 aa, Mycobacterium bovis
GQGGIGGAGERGADGAGPNANGA

SEQ ID NO: 226328 - protein, 29 aa, Mycobacterium bovis
GRDGDGGDGGYGGWGGAGGNGGAGGSAPA

SEQ ID NO: 226329 - protein, 23 aa, Mycobacterium bovis
GRLWATILQHRFGGSGVLAGHPI

SEQ ID NO: 226330 - protein, 23 aa, Mycobacterium bovis
GRTERFWVGLSVYRPGGTAEPAP

SEQ ID NO: 226331 - protein, 27 aa, Mycobacterium bovis
GSGAPGGHGGWLFGGGGTGGSGVSGGA

SEQ ID NO: 226332 - protein, 20 aa, Mycobacterium bovis
GSGQRRWRRSPPTGRYRSNS

SEQ ID NO: 226333 - protein, 19 aa, Mycobacterium bovis
GSMVELVPHLFGPNRRPTG

SEQ ID NO: 226334 - protein, 27 aa, Mycobacterium bovis
GSVIARLTGMHWWGPASTSMLAMSAPY

SEQ ID NO: 226335 - protein, 18 aa, Mycobacterium bovis
GTGGAGGLFASGGVGGTG

SEQ ID NO: 226336 - protein, 24 aa, Mycobacterium bovis
GTGPALPTVWPGNAYPLGATYDGA

SEQ ID NO: 226337 - protein, 27 aa, Mycobacterium bovis
GTGVGSPGGLGGAGGTGGLGGAGAGGG

SEQ ID NO: 226338 - protein, 20 aa, Mycobacterium bovis
GTLNVGFANAGSINTGFANS

SEQ ID NO: 226339 - protein, 18 aa, Mycobacterium bovis
GTPALFTLSASSADALRQ

SEQ ID NO: 226340 - protein, 23 aa, Mycobacterium bovis
GTPLALYHTKRLASPAQRIMLFA

SEQ ID NO: 226341 - protein, 25 aa, Mycobacterium bovis
GVAITLTWSQLYRRTLNVARELSRC

SEQ ID NO: 226342 - protein, 23 aa, Mycobacterium bovis
GVKVLPWIPTPAKRILSAGRSVI

SEQ ID NO: 226343 - protein, 25 aa, Mycobacterium bovis
GVLRLRALMESFWSDELDRLVADAA

SEQ ID NO: 226344 - protein, 19 aa, Mycobacterium bovis
GVPPLTMKPDVCWQLPIRR

SEQ ID NO: 226345 - protein, 17 aa, Mycobacterium bovis
GVPRPYWRSKPISVVEL

SEQ ID NO: 226346 - protein, 17 aa, Mycobacterium bovis
GVRRVILIHWDDFFRPL

SEQ ID NO: 226347 - protein, 26 aa, Mycobacterium bovis
GVSRRHLEIRWDGQVALLADLNSTNG

SEQ ID NO: 226348 - protein, 18 aa, Mycobacterium bovis
GVTGARLVAGLVAWKMGC

SEQ ID NO: 226349 - protein, 25 aa, Mycobacterium bovis
GWALRRAPLPPTGPHWRLLSAVKEL

SEQ ID NO: 226350 - protein, 17 aa, Mycobacterium bovis
GWLIGNGGAGGSGAKGA

SEQ ID NO: 226351 - protein, 27 aa, Mycobacterium bovis
GWSPDSDLKGFDGFDGGSGGAGGDGGA

SEQ ID NO: 226352 - protein, 18 aa, Mycobacterium bovis
GWVQGVGFRWWTRCRALE

SEQ ID NO: 226353 - protein, 32 aa, Mycobacterium bovis
GYAINATPELMPLPIALAHRLSRRLTEVRKNG

SEQ ID NO: 226354 - protein, 17 aa, Mycobacterium bovis
GYPPPYEQRPPVSPGPA

SEQ ID NO: 226355 - protein, 18 aa, Mycobacterium bovis
GYRLSVDYAVRITSRGLY

SEQ ID NO: 226356 - protein, 26 aa, Mycobacterium bovis
HAELMPLTWATRTLSWWSVTPRTTIS

SEQ ID NO: 226357 - protein, 17 aa, Mycobacterium bovis
HAFSAAPNFAFELAARR

SEQ ID NO: 226358 - protein, 24 aa, Mycobacterium bovis
HAHKLVFAVLRGVAAVAPVCRLLR

SEQ ID NO: 226359 - protein, 21 aa, Mycobacterium bovis
HAPLDAFVVRKLGAPGHDEFA

SEQ ID NO: 226360 - protein, 28 aa, Mycobacterium bovis
HAQRPGDPTLRRLLPDFYRPDDLDDDDP

SEQ ID NO: 226361 - protein, 30 aa, Mycobacterium bovis
HDLSSNHAILRLLAPLRLDPQNLGAGPQRE

SEQ ID NO: 226362 - protein, 25 aa, Mycobacterium bovis
HDVGLAILGPLRELDEVAYLRFASV

SEQ ID NO: 226363 - protein, 18 aa, Mycobacterium bovis
HFAGLVAAGLHPSPVPHA

SEQ ID NO: 226364 - protein, 35 aa, Mycobacterium bovis
HFTFYASIAHLCVDPMIVGVLFIEIHMMYSALVGG

SEQ ID NO: 226365 - protein, 19 aa, Mycobacterium bovis
HFYRDVLGFRLRDSMRLPP

SEQ ID NO: 226366 - protein, 20 aa, Mycobacterium bovis
HGHTEWLPPPHLDHGQPRTN

SEQ ID NO: 226367 - protein, 19 aa, Mycobacterium bovis
HGLADMYGFIPVDREPGLW

SEQ ID NO: 226368 - protein, 21 aa, Mycobacterium bovis
HGRFALGERLLGFGSVTGAHI

SEQ ID NO: 226369 - protein, 23 aa, Mycobacterium bovis
HGRSYILRAGISSLFRYIEGVHG

SEQ ID NO: 226370 - protein, 28 aa, Mycobacterium bovis
HLGARLFSIIAWRTYLVRDPHALSLLDA

SEQ ID NO: 226371 - protein, 25 aa, Mycobacterium bovis
HLHQGIALQVPPYNYAHPDDLLAAA

SEQ ID NO: 226372 - protein, 20 aa, Mycobacterium bovis
HLLMALLTQNDGIAAPLLEA

SEQ ID NO: 226373 - protein, 33 aa, Mycobacterium bovis
HLSFARDRLGDEFITGVLFYTGARALPFGDRLM

SEQ ID NO: 226374 - protein, 17 aa, Mycobacterium bovis
HMINDLFASDWALQRFA

SEQ ID NO: 226375 - protein, 20 aa, Mycobacterium bovis
HPEPKVAVALKDPSYRLKTT

SEQ ID NO: 226376 - protein, 17 aa, Mycobacterium bovis
HQIQLGVRIAPPATDEA

SEQ ID NO: 226377 - protein, 23 aa, Mycobacterium bovis
HRDEALHLIRKRAKRLRYTAAAT

SEQ ID NO: 226378 - protein, 18 aa, Mycobacterium bovis
HRGRRQLRGLLADVARDR

SEQ ID NO: 226379 - protein, 25 aa, Mycobacterium bovis
HRKVVVFRPLYAVGGQELGYLPGSE

SEQ ID NO: 226380 - protein, 22 aa, Mycobacterium bovis
HRRELRLPPIRVYAMSRGDRGI

SEQ ID NO: 226381 - protein, 25 aa, Mycobacterium bovis
HSEVDTLRRVELLRQLRLGDYDVLV

SEQ ID NO: 226382 - protein, 20 aa, Mycobacterium bovis
HSHALDLRRPPWEVHFIEGL

SEQ ID NO: 226383 - protein, 26 aa, Mycobacterium bovis
HSTFFRERWPRLLRSLYPIGGVVFDG

SEQ ID NO: 226384 - protein, 27 aa, Mycobacterium bovis
HSTFFRERWPRLLRSLYPIGGVVFDGD

SEQ ID NO: 226385 - protein, 26 aa, Mycobacterium bovis
HTLNLTDVHIGWVFTRTVRNNARTHI

SEQ ID NO: 226386 - protein, 17 aa, Mycobacterium bovis
HVVPLVRDVRRIGSAAL

SEQ ID NO: 226387 - protein, 21 aa, Mycobacterium bovis
HVWALMGMPCGKYLVVMHDLW

SEQ ID NO: 226388 - protein, 19 aa, Mycobacterium bovis
HWGPDWVVWDAAKTAQQHG

SEQ ID NO: 226389 - protein, 20 aa, Mycobacterium bovis
HYDLSDAFFALFQDPTRTYS

SEQ ID NO: 226390 - protein, 18 aa, Mycobacterium bovis
HYVDVPLPGPRLLHDMAF

SEQ ID NO: 226391 - protein, 18 aa, Mycobacterium bovis
IAAIKQLKYRYLRALDTK

SEQ ID NO: 226392 - protein, 28 aa, Mycobacterium bovis
IAIGGLYGDITYPVTSPLAITMGFAACE

SEQ ID NO: 226393 - protein, 20 aa, Mycobacterium bovis
IANGSSLAVGGFGLCGIPEA

SEQ ID NO: 226394 - protein, 28 aa, Mycobacterium bovis
IARPDLQVVLLEPLLRRTEFLREMVTDL

SEQ ID NO: 226395 - protein, 18 aa, Mycobacterium bovis
IAVNPLPEAGLIRFKDPQ

SEQ ID NO: 226396 - protein, 18 aa, Mycobacterium bovis
IDDMVAACLKWEGGYVWA

SEQ ID NO: 226397 - protein, 25 aa, Mycobacterium bovis
IDERTVICVLTHDPKFDVPVLEVAL

SEQ ID NO: 226398 - protein, 30 aa, Mycobacterium bovis
IDLVPEYIGNLLLYFQPDATVTMLDAVELE

SEQ ID NO: 226399 - protein, 17 aa, Mycobacterium bovis
IDNAWLGELPPTATVRI

SEQ ID NO: 226400 - protein, 18 aa, Mycobacterium bovis
IDTPVLVAFCARSPHGVS

SEQ ID NO: 226401 - protein, 22 aa, Mycobacterium bovis
IDWVIKRKLFQRYQDRYDMELS

SEQ ID NO: 226402 - protein, 17 aa, Mycobacterium bovis
IELAYYGGLTYVEVSRR

SEQ ID NO: 226403 - protein, 23 aa, Mycobacterium bovis
IEPGIYFPGRWGARIEDIVIVTE

SEQ ID NO: 226404 - protein, 17 aa, Mycobacterium bovis
IERATKILGLLTAAPKS

SEQ ID NO: 226405 - protein, 18 aa, Mycobacterium bovis
IFAALAKRLPKLATGPFP

SEQ ID NO: 226406 - protein, 19 aa, Mycobacterium bovis
IGALPLVMNPDAAVATVVV

SEQ ID NO: 226407 - protein, 17 aa, Mycobacterium bovis
IGLHIIVTCQMSQAYKA

SEQ ID NO: 226408 - protein, 25 aa, Mycobacterium bovis
IGQVPYLLTLPGHGFYWFQLTTHEV

SEQ ID NO: 226409 - protein, 18 aa, Mycobacterium bovis
IGTHFWNPPDLIPVVEVV

SEQ ID NO: 226410 - protein, 29 aa, Mycobacterium bovis
IIACITAQLPEWFRPGDFFPVPCCFPSCR

SEQ ID NO: 226411 - protein, 18 aa, Mycobacterium bovis
IIGAEALLRWEHPTLGTL

SEQ ID NO: 226412 - protein, 26 aa, Mycobacterium bovis
IITEAWMRLQHRPRWQVTVSVVFDDW

SEQ ID NO: 226413 - protein, 22 aa, Mycobacterium bovis
IKAHAIALAETLPTACVLGDVD

SEQ ID NO: 226414 - protein, 20 aa, Mycobacterium bovis
IKGMWTVPVFGNPSGVTYSW

SEQ ID NO: 226415 - protein, 21 aa, Mycobacterium bovis
IKGMWTVPVFGNPSGVTYSWE

SEQ ID NO: 226416 - protein, 20 aa, Mycobacterium bovis
ILASLGTGGAYFFRQLTHDG

SEQ ID NO: 226417 - protein, 17 aa, Mycobacterium bovis
ILEERRFPIRYRARYVN

SEQ ID NO: 226418 - protein, 20 aa, Mycobacterium bovis
ILVAVTRWTVRLQQTGWDHT

SEQ ID NO: 226419 - protein, 18 aa, Mycobacterium bovis
INETTGRDGDGGDGGYGG

SEQ ID NO: 226420 - protein, 21 aa, Mycobacterium bovis
IPTQWRNQPLGWYTQGLAPYL

SEQ ID NO: 226421 - protein, 18 aa, Mycobacterium bovis
IQPVLVAASLLVAELGDV

SEQ ID NO: 226422 - protein, 20 aa, Mycobacterium bovis
IQVLTQCRPELIERTFQACS

SEQ ID NO: 226423 - protein, 21 aa, Mycobacterium bovis
IQVLTQCRPELIERTFQACSG

SEQ ID NO: 226424 - protein, 28 aa, Mycobacterium bovis
IRIDLRKTYLFAFLDDHSRLVPGYRGPC

SEQ ID NO: 226425 - protein, 17 aa, Mycobacterium bovis
IRIPSTLLGLLSEIPRC

SEQ ID NO: 226426 - protein, 18 aa, Mycobacterium bovis
IRRYDVDAAILFSDIVVP

SEQ ID NO: 226427 - protein, 28 aa, Mycobacterium bovis
ISARVITRTLFVVRLLPAIDHFLDLLRK

SEQ ID NO: 226428 - protein, 19 aa, Mycobacterium bovis
ISAVVWRNGHDAQIMAACA

SEQ ID NO: 226429 - protein, 28 aa, Mycobacterium bovis
ITAKMTARYSQWVRSRPLLLAGKSVTGA

SEQ ID NO: 226430 - protein, 20 aa, Mycobacterium bovis
ITDITPYWRPASWAAGVAVV

SEQ ID NO: 226431 - protein, 18 aa, Mycobacterium bovis
ITPGYDLCYLIGSRAETF

SEQ ID NO: 226432 - protein, 29 aa, Mycobacterium bovis
ITSRGLYVHSAPWALPALGLENVSHGCIS

SEQ ID NO: 226433 - protein, 18 aa, Mycobacterium bovis
IVIGPLYAEKTIQLCAPG

SEQ ID NO: 226434 - protein, 31 aa, Mycobacterium bovis
IVISAYVPKHWQKLCYLIGRPDLVEDQRFAE

SEQ ID NO: 226435 - protein, 23 aa, Mycobacterium bovis
IVQLVFALVPFRFRKHPRARAGW

SEQ ID NO: 226436 - protein, 24 aa, Mycobacterium bovis
IVQLVFALVPFRFRKHPRARAGWD

SEQ ID NO: 226437 - protein, 17 aa, Mycobacterium bovis
KAFGHDIGYRIAHHADL

SEQ ID NO: 226438 - protein, 22 aa, Mycobacterium bovis
KAGRTWWVPNEHKPWPLRAAEI

SEQ ID NO: 226439 - protein, 25 aa, Mycobacterium bovis
KCCVQQITPDGRLIPFCAYNSVGYR

SEQ ID NO: 226440 - protein, 17 aa, Mycobacterium bovis
KDLLIVYGRNHSPDDIE

SEQ ID NO: 226441 - protein, 18 aa, Mycobacterium bovis
KELQWLCTMRDDGVRRIA

SEQ ID NO: 226442 - protein, 24 aa, Mycobacterium bovis
KENNVAYIQWAIRLARRGAVIVVD

SEQ ID NO: 226443 - protein, 19 aa, Mycobacterium bovis
KEYRDWFATLPAELTDVVT

SEQ ID NO: 226444 - protein, 21 aa, Mycobacterium bovis
KFEWLDNDVVQWVPDRFWPAH

SEQ ID NO: 226445 - protein, 19 aa, Mycobacterium bovis
KGMWTVPVFGNPSGVTYSW

SEQ ID NO: 226446 - protein, 17 aa, Mycobacterium bovis
KILSPHYSEYQVLEGGK

SEQ ID NO: 226447 - protein, 22 aa, Mycobacterium bovis
KLAPQRLIVVLGHDHQRIAPLV

SEQ ID NO: 226448 - protein, 21 aa, Mycobacterium bovis
KLLETYSVPPLLHNQALAISV

SEQ ID NO: 226449 - protein, 19 aa, Mycobacterium bovis
KPTNALLFPQPRCQVITGV

SEQ ID NO: 226450 - protein, 20 aa, Mycobacterium bovis
KPTNALLFPQPRCQVITGVG

SEQ ID NO: 226451 - protein, 23 aa, Mycobacterium bovis
KQRAVLAMLLLSRNQVVAADALV

SEQ ID NO: 226452 - protein, 25 aa, Mycobacterium bovis
KRFEVAAHEFLLFPTVAHSHAERVR

SEQ ID NO: 226453 - protein, 19 aa, Mycobacterium bovis
KRIVRLPKTHIKAVGTHFV

SEQ ID NO: 226454 - protein, 22 aa, Mycobacterium bovis
KRLDFGLLGPLQMTIDGTPVPS

SEQ ID NO: 226455 - protein, 20 aa, Mycobacterium bovis
KRQLAVLLLENEGPVASATD

SEQ ID NO: 226456 - protein, 22 aa, Mycobacterium bovis
KSHGWGVPGLSWLPGEDPDPFG

SEQ ID NO: 226457 - protein, 24 aa, Mycobacterium bovis
KSLLARIGDAFLALPNGFTAHPRV

SEQ ID NO: 226458 - protein, 28 aa, Mycobacterium bovis
KSRGVRPRVWFGERWITSVLDLFQENIR

SEQ ID NO: 226459 - protein, 23 aa, Mycobacterium bovis
KSRPLWEMYLVEGLEKNRIALYT

SEQ ID NO: 226460 - protein, 25 aa, Mycobacterium bovis
KTTLIEALLVAAKVLSRPGSVTEGT

SEQ ID NO: 226461 - protein, 20 aa, Mycobacterium bovis
LAARGLRRILTEGGPTLLGT

SEQ ID NO: 226462 - protein, 19 aa, Mycobacterium bovis
LADRGMRLTLRVYAYSSCC

SEQ ID NO: 226463 - protein, 42 aa, Mycobacterium bovis
LAEATNVEQNLLNLINAPTQTLLGRPLIGDGANATTPGGAGG

SEQ ID NO: 226464 - protein, 19 aa, Mycobacterium bovis
LAELNRLFTAWVETVYHRS

SEQ ID NO: 226465 - protein, 25 aa, Mycobacterium bovis
LAFVRFRIDGKDWPASPLPSLRMRT

SEQ ID NO: 226466 - protein, 33 aa, Mycobacterium bovis
LAGERPYREFPLDWMLGRLGLAGFRILEERRFP

SEQ ID NO: 226467 - protein, 17 aa, Mycobacterium bovis
LAGFRILEERRFPIRYR

SEQ ID NO: 226468 - protein, 20 aa, Mycobacterium bovis
LAGRVAILDLWPLSVAERSG

SEQ ID NO: 226469 - protein, 20 aa, Mycobacterium bovis
LAIKAALTLGSPYTAMLFMG

SEQ ID NO: 226470 - protein, 27 aa, Mycobacterium bovis
LAKRDSEWMGRVHRFLGLQVGVILATM

SEQ ID NO: 226471 - protein, 19 aa, Mycobacterium bovis
LALLIMLERLGPAERVVFV

SEQ ID NO: 226472 - protein, 20 aa, Mycobacterium bovis
LALLIMLERLGPAERVVFVL

SEQ ID NO: 226473 - protein, 25 aa, Mycobacterium bovis
LAPGARLVFNAFLANGDYAPDQAAR

SEQ ID NO: 226474 - protein, 18 aa, Mycobacterium bovis
LARGGLPVAWEVAAALHA

SEQ ID NO: 226475 - protein, 26 aa, Mycobacterium bovis
LATPSRLMILTQLRNGPLPVTDLAEA

SEQ ID NO: 226476 - protein, 19 aa, Mycobacterium bovis
LAVDIPALNLRRQLRAIWV

SEQ ID NO: 226477 - protein, 19 aa, Mycobacterium bovis
LAVGFWAAPSDLRANWRED

SEQ ID NO: 226478 - protein, 18 aa, Mycobacterium bovis
LAVYAHCARHAPTDPVHW

SEQ ID NO: 226479 - protein, 21 aa, Mycobacterium bovis
LDCADLGHLVFLPSGDAALTR

SEQ ID NO: 226480 - protein, 25 aa, Mycobacterium bovis
LDDVGFLVALAAKLVHDFDIAPGHV

SEQ ID NO: 226481 - protein, 28 aa, Mycobacterium bovis
LDDVLRRAVRLLAQLTRQVAVVQYPTLS

SEQ ID NO: 226482 - protein, 21 aa, Mycobacterium bovis
LDGSPLRYNQLDPYLPDLLMC

SEQ ID NO: 226483 - protein, 20 aa, Mycobacterium bovis
LDHGQPRINRYHHPEKILCE

SEQ ID NO: 226484 - protein, 18 aa, Mycobacterium bovis
LDLTYKEFELLKYLAQHA

SEQ ID NO: 226485 - protein, 23 aa, Mycobacterium bovis
LDRDRPLWEMWVIEGGARSDTVA

SEQ ID NO: 226486 - protein, 21 aa, Mycobacterium bovis
LDRPWRRPGALRYALERVRGV

SEQ ID NO: 226487 - protein, 20 aa, Mycobacterium bovis
LDWMVATTLLTGRRTWVPWT

SEQ ID NO: 226488 - protein, 17 aa, Mycobacterium bovis
LEAFLRISVEHADAAGG

SEQ ID NO: 226489 - protein, 19 aa, Mycobacterium bovis
LEIPGISVPAFSLPAITLP

SEQ ID NO: 226490 - protein, 24 aa, Mycobacterium bovis
LFCPDQFLGAHVRRVTGRKNLHVW

SEQ ID NO: 226491 - protein, 18 aa, Mycobacterium bovis
LFEAWQRWRVQEGVPEIS

SEQ ID NO: 226492 - protein, 20 aa, Mycobacterium bovis
LFQGLAFVVSRRRLLGRFVR

SEQ ID NO: 226493 - protein, 17 aa, Mycobacterium bovis
LGDGRIILPLLGSDSDV

SEQ ID NO: 226494 - protein, 26 aa, Mycobacterium bovis
LGEPTLTWLDSLAPNGPLVITHNSGH

SEQ ID NO: 226495 - protein, 18 aa, Mycobacterium bovis
LGGFTLPQLSIPAITTPA

SEQ ID NO: 226496 - protein, 22 aa, Mycobacterium bovis
LGGIRDLWLDLGALTELLRDPR

SEQ ID NO: 226497 - protein, 17 aa, Mycobacterium bovis
LGGITPEQVLESPFLLL

SEQ ID NO: 226498 - protein, 17 aa, Mycobacterium bovis
LGIGYEIVPGVPAFAAA

SEQ ID NO: 226499 - protein, 21 aa, Mycobacterium bovis
LGLLELRGFEMPPHLHMAMVQ

SEQ ID NO: 226500 - protein, 29 aa, Mycobacterium bovis
LGTPEIPAIPPFFPGFPPDYVTVSGQIGP

SEQ ID NO: 226501 - protein, 19 aa, Mycobacterium bovis
LGTRGIWHEGWFANTIHAA

SEQ ID NO: 226502 - protein, 23 aa, Mycobacterium bovis
LGVALGVIRLLLGADYAPLAVHL

SEQ ID NO: 226503 - protein, 17 aa, Mycobacterium bovis
LGYGAKPWLIVSNNARN

SEQ ID NO: 226504 - protein, 18 aa, Mycobacterium bovis
LHASPYVLVSILITPDLH

SEQ ID NO: 226505 - protein, 25 aa, Mycobacterium bovis
LHGLATQLMDWLHPDGNFSDQERAR

SEQ ID NO: 226506 - protein, 32 aa, Mycobacterium bovis
LIADLMARRLDRGRPLWEVWVIEGLADSKWAI

SEQ ID NO: 226507 - protein, 17 aa, Mycobacterium bovis
LIGMQLTLTELWRSYGV

SEQ ID NO: 226508 - protein, 18 aa, Mycobacterium bovis
LIVSLWLDRLRQRGEITR

SEQ ID NO: 226509 - protein, 23 aa, Mycobacterium bovis
LLAHTFPATRFLGAGAAMSLLPE

SEQ ID NO: 226510 - protein, 17 aa, Mycobacterium bovis
LLAPGILSDRVRGYARE

SEQ ID NO: 226511 - protein, 18 aa, Mycobacterium bovis
LLELARYKRGDLVVIVAG

SEQ ID NO: 226512 - protein, 26 aa, Mycobacterium bovis
LLRAPHTPPLVIDFGGGVLGALQRHA

SEQ ID NO: 226513 - protein, 29 aa, Mycobacterium bovis
LLTDPMLPAELLPADWPGAGLRAAYHDFA

SEQ ID NO: 226514 - protein, 19 aa, Mycobacterium bovis
LPASIRFQQGAYRIHPALL

SEQ ID NO: 226515 - protein, 18 aa, Mycobacterium bovis
LPELAVQMRRRLIETVTA

SEQ ID NO: 226516 - protein, 29 aa, Mycobacterium bovis
LPGGIDSPELLWKALLRGDDLITEVPPDR

SEQ ID NO: 226517 - protein, 28 aa, Mycobacterium bovis
LPPEINSALMFAGAGPGPMLAAASAWTG

SEQ ID NO: 226518 - protein, 19 aa, Mycobacterium bovis
LPQLSIPSVTVPPITIPAG

SEQ ID NO: 226519 - protein, 22 aa, Mycobacterium bovis
LPRIARATKILDLARAYGIEVS

SEQ ID NO: 226520 - protein, 17 aa, Mycobacterium bovis
LPTMPPWHVQENKWRAA

SEQ ID NO: 226521 - protein, 21 aa, Mycobacterium bovis
LPVDQLRYPVFSWQRITLQEM

SEQ ID NO: 226522 - protein, 17 aa, Mycobacterium bovis
LPVHDHMAIADVARVVA

SEQ ID NO: 226523 - protein, 21 aa, Mycobacterium bovis
LQANYAGRPSPLYEATRLSQH

SEQ ID NO: 226524 - protein, 21 aa, Mycobacterium bovis
LRAIAAAHPDLILGSQGLTPQ

SEQ ID NO: 226525 - protein, 20 aa, Mycobacterium bovis
LRGCYRIAVLSLKGGVGKTT

SEQ ID NO: 226526 - protein, 24 aa, Mycobacterium bovis
LRLVNWQRIRHRWNWTDVRRWLTD

SEQ ID NO: 226527 - protein, 20 aa, Mycobacterium bovis
LRMFTGAGSAPMLAASVAWD

SEQ ID NO: 226528 - protein, 32 aa, Mycobacterium bovis
LRNRTWPDRVIDRAPLWCAVDLRDGNQALIDP

SEQ ID NO: 226529 - protein, 17 aa, Mycobacterium bovis
LRNSVMRAARPRSSGIG

SEQ ID NO: 226530 - protein, 29 aa, Mycobacterium bovis
LRRHGARRMVIAPWLLAPGILSDRVRGYA

SEQ ID NO: 226531 - protein, 17 aa, Mycobacterium bovis
LRRILTEGGPTLLGTFV

SEQ ID NO: 226532 - protein, 17 aa, Mycobacterium bovis
LRRRSLLAEVYSGRTGV

SEQ ID NO: 226533 - protein, 17 aa, Mycobacterium bovis
LRSLPADGLKLAPGEPA

SEQ ID NO: 226534 - protein, 18 aa, Mycobacterium bovis
LRTKLLAASAYIKAADRV

SEQ ID NO: 226535 - protein, 23 aa, Mycobacterium bovis
LSAGYTFMGFAEDLPAVGSTVCS

SEQ ID NO: 226536 - protein, 29 aa, Mycobacterium bovis
LSAQLAAYHNQFVRALNAGAGSYASAEAA

SEQ ID NO: 226537 - protein, 28 aa, Mycobacterium bovis
LSDGFRVPGLPMPSLPVIGGDAAAACIA

SEQ ID NO: 226538 - protein, 25 aa, Mycobacterium bovis
LSFSGLLGAVYFPGILSLLQDDMPF

SEQ ID NO: 226539 - protein, 21 aa, Mycobacterium bovis
LSGLRVVELAGIGPGPHAAMI

SEQ ID NO: 226540 - protein, 18 aa, Mycobacterium bovis
LSWRRVRTGDLGLAVWGG

SEQ ID NO: 226541 - protein, 25 aa, Mycobacterium bovis
LSWVDFRALALPSEPAEYLLSKAKV

SEQ ID NO: 226542 - protein, 35 aa, Mycobacterium bovis; identical to SEQ ID NO: 211319

SEQ ID NO: 226543 - protein, 20 aa, Mycobacterium bovis
LTDRVFAIVIQDFQDPYTLN

SEQ ID NO: 226544 - protein, 21 aa, Mycobacterium bovis
LTEIDLLRPHDAPPATRIFEA

SEQ ID NO: 226545 - protein, 19 aa, Mycobacterium bovis
LTHHPLIQVMLAWQDNPVG

SEQ ID NO: 226546 - protein, 17 aa, Mycobacterium bovis
LTKYDDVFYASRHPDIF

SEQ ID NO: 226547 - protein, 19 aa, Mycobacterium bovis
LTVPSLTIPAAMTPANITV

SEQ ID NO: 226548 - protein, 28 aa, Mycobacterium bovis
LVAQRTSAINRLRWLVHELDPERAPAAR

SEQ ID NO: 226549 - protein, 19 aa, Mycobacterium bovis
LVASGLRSLPADGLKLAPG

SEQ ID NO: 226550 - protein, 17 aa, Mycobacterium bovis
LVDRWRAVDGCQGDPSA

SEQ ID NO: 226551 - protein, 29 aa, Mycobacterium bovis
LVERQTRLIRLLHLPTHDAYCLRIAITET

SEQ ID NO: 226552 - protein, 32 aa, Mycobacterium bovis
LVEWSHPLGHRWRWEFESLSPTLTRVTETFDY

SEQ ID NO: 226553 - protein, 27 aa, Mycobacterium bovis
LVHFTKFILAEIFPGGWLPSIPTVHEY

SEQ ID NO: 226554 - protein, 23 aa, Mycobacterium bovis
LVKTFWGWRDQQLPDGTLILTSP

SEQ ID NO: 226555 - protein, 24 aa, Mycobacterium bovis
LVLEAPRRLVVRQYRLPRIGDDDA

SEQ ID NO: 226556 - protein, 18 aa, Mycobacterium bovis
LVLVKEIPMYSTCEHHLV

SEQ ID NO: 226557 - protein, 18 aa, Mycobacterium bovis
LVSGRYPFASLPRRCVRL

SEQ ID NO: 226558 - protein, 17 aa, Mycobacterium bovis
LVSKFAREVPGVAHALL

SEQ ID NO: 226559 - protein, 30 aa, Mycobacterium bovis
LVSLQSQHPDFLRLFYLLSMERSQDPVVAA

SEQ ID NO: 226560 - protein, 25 aa, Mycobacterium bovis
LVTGRLPADAWLVDLGRHPLRGLPR

SEQ ID NO: 226561 - protein, 20 aa, Mycobacterium bovis
LWEHWGKPEIVWYPGGHTGF

SEQ ID NO: 226562 - protein, 17 aa, Mycobacterium bovis
MAKGLRTKLLAASAYIK

SEQ ID NO: 226563 - protein, 18 aa, Mycobacterium bovis
MAKGLRTKLLAASAYIKA

SEQ ID NO: 226564 - protein, 17 aa, Mycobacterium bovis
MALYMDLRLAVPGEVVL

SEQ ID NO: 226565 - protein, 17 aa, Mycobacterium bovis
MASLRGLLKFRTGVRPP

SEQ ID NO: 226566 - protein, 27 aa, Mycobacterium bovis
MASNAHHYLALFDGAKPLALYHTKRLA

SEQ ID NO: 226567 - protein, 27 aa, Mycobacterium bovis
MASNANHYLALFDGAKPLALYHTKRLA

SEQ ID NO: 226568 - protein, 23 aa, Mycobacterium bovis
MASTFTIVAIGTYCPAVIAPLMP

SEQ ID NO: 226569 - protein, 18 aa, Mycobacterium bovis
MDEGLRFAIREGGRTVGA

SEQ ID NO: 226570 - protein, 23 aa, Mycobacterium bovis
MEEATFLTRFARSVTLVHRRDEF

SEQ ID NO: 226571 - protein, 21 aa, Mycobacterium bovis
MFAPGAFRRSIAERGHKLKLL

SEQ ID NO: 226572 - protein, 18 aa, Mycobacterium bovis
MHVGALMPFTPPSGAPPD

SEQ ID NO: 226573 - protein, 18 aa, Mycobacterium bovis
MLTLMGPSDLWTVERAAR

SEQ ID NO: 226574 - protein, 17 aa, Mycobacterium bovis
MNLNHYEAIALVQKIAF

SEQ ID NO: 226575 - protein, 26 aa, Mycobacterium bovis
MQAGGLTVYSGEWWHFDGPGPGAGVD

SEQ ID NO: 226576 - protein, 17 aa, Mycobacterium bovis
MRQLLLDLLANNQDLAG

SEQ ID NO: 226577 - protein, 17 aa, Mycobacterium bovis
MRRLLRDVAENRELGDT

SEQ ID NO: 226578 - protein, 28 aa, Mycobacterium bovis
MTTSEIATVLAWHDALNAADIETLVALS

SEQ ID NO: 226579 - protein, 17 aa, Mycobacterium bovis
MVAATMWDRYRQAVAGR

SEQ ID NO: 226580 - protein, 17 aa, Mycobacterium bovis
MVDPVVVAANRSAFVQL

SEQ ID NO: 226581 - protein, 23 aa, Mycobacterium bovis
NAGDYGFFWITAVTTDGSIVVAN

SEQ ID NO: 226582 - protein, 32 aa, Mycobacterium bovis
NAPAIAAAEAMYEQMWAADVAAMVGYHGGASA

SEQ ID NO: 226583 - protein, 20 aa, Mycobacterium bovis
NAPVQSLTGRPLIGDGANGI

SEQ ID NO: 226584 - protein, 17 aa, Mycobacterium bovis
NATRWLSGQLGRPLSLI

SEQ ID NO: 226585 - protein, 24 aa, Mycobacterium bovis
NDPLALVLIELRHPRTEPPVPSAI

SEQ ID NO: 226586 - protein, 24 aa, Mycobacterium bovis
NGAHGFNAVLVSDGGNGGDGGAGG

SEQ ID NO: 226587 - protein, 21 aa, Mycobacterium bovis
NGAIGGHGPLTDDPGGNGGTG

SEQ ID NO: 226588 - protein, 28 aa, Mycobacterium bovis
NGGAGGFASTGLGGPGGAGGPGGAGDFA

SEQ ID NO: 226589 - protein, 32 aa, Mycobacterium bovis
NGGDGSFGATSGPASIGVTGAPGGNGGKGGAG

SEQ ID NO: 226590 - protein, 30 aa, Mycobacterium bovis
NGGNGGAGMINGGLGGFGGAGGGGAVDVAA

SEQ ID NO: 226591 - protein, 32 aa, Mycobacterium bovis
NGGNGGGALNQAGFFGTGGKGGNGGNGGAGMI

SEQ ID NO: 226592 - protein, 23 aa, Mycobacterium bovis
NGGRGGWLLGNGGAGGVGGVGGA

SEQ ID NO: 226593 - protein, 21 aa, Mycobacterium bovis
NGGSGGRGDMAFKDGDGGAGG

SEQ ID NO: 226594 - protein, 24 aa, Mycobacterium bovis
NGGSGGRGDMAFKDGDGGAGGDGG

SEQ ID NO: 226595 - protein, 30 aa, Mycobacterium bovis
NGVARVIAYRWLRVGRLPVPARRVGRVILV

SEQ ID NO: 226596 - protein, 30 aa, Mycobacterium bovis
NGVARVTVYRWFHAGLLPVPARKAGRLILV

SEQ ID NO: 226597 - protein, 17 aa, Mycobacterium bovis
NGYYGGLQFTAGTWRAN

SEQ ID NO: 226598 - protein, 26 aa, Mycobacterium bovis
NIDDIKAPLLAALGAADLALATVNEL

SEQ ID NO: 226599 - protein, 17 aa, Mycobacterium bovis
NIGSWNLGGGNVGLLNL

SEQ ID NO: 226600 - protein, 24 aa, Mycobacterium bovis
NKTMPSIESLVSDGLPGVKAALTR

SEQ ID NO: 226601 - protein, 17 aa, Mycobacterium bovis
NLALFTEAERRLTEAND

SEQ ID NO: 226602 - protein, 17 aa, Mycobacterium bovis
NLDKRIVRLPKTHIKAV

SEQ ID NO: 226603 - protein, 22 aa, Mycobacterium bovis
NLGLIRAMEKFDYTKGFKFSTY

SEQ ID NO: 226604 - protein, 17 aa, Mycobacterium bovis
NLHQTLQSLQRPLRQLE

SEQ ID NO: 226605 - protein, 17 aa, Mycobacterium bovis
NLLVQLSDEELAAGVVC

SEQ ID NO: 226606 - protein, 20 aa, Mycobacterium bovis
NLPTLSIPSVTVPPITIPAG

SEQ ID NO: 226607 - protein, 28 aa, Mycobacterium bovis
NLTGVMTFGLPLAMTLNAVGSPITTAIA

SEQ ID NO: 226608 - protein, 24 aa, Mycobacterium bovis
NNMVLAVQQIAIAEAFVLAEKLGL

SEQ ID NO: 226609 - protein, 27 aa, Mycobacterium bovis
NPPLRGWQRRALVQYLGTQPRDFLAVA

SEQ ID NO: 226610 - protein, 24 aa, Mycobacterium bovis
NPSGAAIPAFKPLGGRELGAGMSA

SEQ ID NO: 226611 - protein, 23 aa, Mycobacterium bovis
NRHLRRIGHLPILHRYATVCKLI

SEQ ID NO: 226612 - protein, 29 aa, Mycobacterium bovis
NRLAVCLDLDWRPQFRVDLIPSYKAHRVA

SEQ ID NO: 226613 - protein, 26 aa, Mycobacterium bovis
NRNAFVQLVLSNLFGQNAPAIAAAEA

SEQ ID NO: 226614 - protein, 29 aa, Mycobacterium bovis
NRRGNYLYNFWRDAANPRGLWRRTTLDSY

SEQ ID NO: 226615 - protein, 17 aa, Mycobacterium bovis
NRRISLSSLWVALSIRL

SEQ ID NO: 226616 - protein, 17 aa, Mycobacterium bovis
NRRYTFDTFVIGASNRF

SEQ ID NO: 226617 - protein, 20 aa, Mycobacterium bovis
NRTWPDRVIDRAPLWCAVDL

SEQ ID NO: 226618 - protein, 28 aa, Mycobacterium bovis
NRYAPPPPYPAPDPFEPFAVAAVELADE

SEQ ID NO: 226619 - protein, 26 aa, Mycobacterium bovis
NSENSRFMFDYIPPVFKGQYAETEEE

SEQ ID NO: 226620 - protein, 23 aa, Mycobacterium bovis
NSNGLLRQYFPKGTSLSTYTPDH

SEQ ID NO: 226621 - protein, 18 aa, Mycobacterium bovis
NSSMVTNWTVAPAGPGSS

SEQ ID NO: 226622 - protein, 19 aa, Mycobacterium bovis
NVAPAYRSSVSASVSASAA

SEQ ID NO: 226623 - protein, 25 aa, Mycobacterium bovis
NVDALFLFDVLLHQVSPDWDTILDM

SEQ ID NO: 226624 - protein, 17 aa, Mycobacterium bovis
NVQFYCIDLGGGGLIYL

SEQ ID NO: 226625 - protein, 27 aa, Mycobacterium bovis
NVVDVFIGYLRRKLEAGGGPRLLHTVR

SEQ ID NO: 226626 - protein, 17 aa, Mycobacterium bovis
NWHMLIVTSIGTDARTR

SEQ ID NO: 226627 - protein, 18 aa, Mycobacterium bovis
NWTDVRRWLTDPTGRWHP

SEQ ID NO: 226628 - protein, 18 aa, Mycobacterium bovis
NYGSLNWGSGNTGTGNAG

SEQ ID NO: 226629 - protein, 19 aa, Mycobacterium bovis
NYLIVRAGEFSRISDVLLP

SEQ ID NO: 226630 - protein, 30 aa, Mycobacterium bovis
PAALLGLVERLPWLSAVPAYFVGLGVRPEH

SEQ ID NO: 226631 - protein, 25 aa, Mycobacterium bovis
PADGASNWYTEFARLAPLMEKDVHY

SEQ ID NO: 226632 - protein, 17 aa, Mycobacterium bovis
PAELTPLAAWVACIADA

SEQ ID NO: 226633 - protein, 25 aa, Mycobacterium bovis
PAGSGAMGSTGFAGGAGGDGGNGGG

SEQ ID NO: 226634 - protein, 25 aa, Mycobacterium bovis
PAIDPILLKVLDAVPFRLSIDDGIE

SEQ ID NO: 226635 - protein, 17 aa, Mycobacterium bovis
PAMRFERPVLAIAATVA

SEQ ID NO: 226636 - protein, 19 aa, Mycobacterium bovis
PAQRRALTVHSARWRPWRS

SEQ ID NO: 226637 - protein, 25 aa, Mycobacterium bovis
PATLSVPFSAFPKPQNYPGLPTVSF

SEQ ID NO: 226638 - protein, 17 aa, Mycobacterium bovis
PAVLAFVNRALAGVLAL

SEQ ID NO: 226639 - protein, 34 aa, Mycobacterium bovis
PAVLTSPVSFLQRPARWMHLMASDFHAFSAAPNF

SEQ ID NO: 226640 - protein, 35 aa, Mycobacterium bovis
PAVLTSPVSFLQRPARWMHLMASDFHAFSAAPNFA

SEQ ID NO: 226641 - protein, 20 aa, Mycobacterium bovis
PAVVKLHRWLTESLDHLHAS

SEQ ID NO: 226642 - protein, 25 aa, Mycobacterium bovis
PDAANGFILDGYPRSVEQAKALHEM

SEQ ID NO: 226643 - protein, 17 aa, Mycobacterium bovis
PDLLLAQALLRTQQIKL

SEQ ID NO: 226644 - protein, 34 aa, Mycobacterium bovis
PDNGGMYFVPAFSGLFAPYWRSDARGAIVGLSRF

SEQ ID NO: 226645 - protein, 21 aa, Mycobacterium bovis
PDRLRRWMAVAARIELRTGGA

SEQ ID NO: 226646 - protein, 24 aa, Mycobacterium bovis
PDRVDLILPGFRYRAAMADGTVEN

SEQ ID NO: 226647 - protein, 28 aa, Mycobacterium bovis
PDVVHAHDWLVAHPAIALAQFYDVPMVS

SEQ ID NO: 226648 - protein, 21 aa, Mycobacterium bovis
PEAWRWYRDVIGGGRTPLVDT

SEQ ID NO: 226649 - protein, 26 aa, Mycobacterium bovis
PEINSALMFAGAGPGPMLAAASAWTG

SEQ ID NO: 226650 - protein, 20 aa, Mycobacterium bovis
PEIRPAHLLMALLTQNDGIA

SEQ ID NO: 226651 - protein, 24 aa, Mycobacterium bovis
PESLRSLPGCHLLVRPEVMRRDVD

SEQ ID NO: 226652 - protein, 38 aa, Mycobacterium bovis
PFAQRVPDWLWAAPRKLLARFFVWLTVGLYDPPVRELM

SEQ ID NO: 226653 - protein, 39 aa, Mycobacterium bovis
PFAQRVPDWLWAAPRKLLARFFVWLTVGLYDPPVRELMG

SEQ ID NO: 226654 - protein, 24 aa, Mycobacterium bovis
PFDSEHPLFLLYTSGTTGKPKGIM

SEQ ID NO: 226655 - protein, 18 aa, Mycobacterium bovis
PFGLFPEVSPVVIADALA

SEQ ID NO: 226656 - protein, 20 aa, Mycobacterium bovis
PFGTAPMPPGPPPPGTVSPP

SEQ ID NO: 226657 - protein, 17 aa, Mycobacterium bovis
PFHRSPLLIGRPYNWPA

SEQ ID NO: 226658 - protein, 17 aa, Mycobacterium bovis
PFRVVANPPYGISSRLL

SEQ ID NO: 226659 - protein, 27 aa, Mycobacterium bovis
PGCYPTAALLALFPALAADLIEPAVTV

SEQ ID NO: 226660 - protein, 17 aa, Mycobacterium bovis
PGGAGDFASGVGGVGGA

SEQ ID NO: 226661 - protein, 26 aa, Mycobacterium bovis
PGLPRRLRWVSPLVPLVAGPLPVAFF

SEQ ID NO: 226662 - protein, 20 aa, Mycobacterium bovis
PGLRAIFAELLGIAVPNLIA

SEQ ID NO: 226663 - protein, 20 aa, Mycobacterium bovis
PGPLCATTRPRPPQGNQPPA

SEQ ID NO: 226664 - protein, 18 aa, Mycobacterium bovis
PGQMLGGLPVGQMGARAG

SEQ ID NO: 226665 - protein, 18 aa, Mycobacterium bovis
PGSGIPKSNFYPSPDRES

SEQ ID NO: 226666 - protein, 21 aa, Mycobacterium bovis
PGSLAAKWLVTRVPVAGLAEK

SEQ ID NO: 226667 - protein, 20 aa, Mycobacterium bovis
PGVLAGPAPITPPASAAPAV

SEQ ID NO: 226668 - protein, 23 aa, Mycobacterium bovis
PHQPRRTAPAPPWAKMPIGEPPP

SEQ ID NO: 226669 - protein, 18 aa, Mycobacterium bovis
PIGTTIFELDRPQVLDFK

SEQ ID NO: 226670 - protein, 25 aa, Mycobacterium bovis
PILHAQHSLPPWPIAKALQEAGQFS

SEQ ID NO: 226671 - protein, 19 aa, Mycobacterium bovis
PKAPLGYRPARSTAVMSTM

SEQ ID NO: 226672 - protein, 29 aa, Mycobacterium bovis
PKEMWDAFAEEYLAPVRPLERIRQHVDAA

SEQ ID NO: 226673 - protein, 19 aa, Mycobacterium bovis
PKPFALEELLARMRALLRR

SEQ ID NO: 226674 - protein, 24 aa, Mycobacterium bovis
PLAGKPFYVDPASAAMIAARNANP

SEQ ID NO: 226675 - protein, 21 aa, Mycobacterium bovis
PLDPQAIQPVLVAASLLVAEL

SEQ ID NO: 226676 - protein, 19 aa, Mycobacterium bovis
PLDRLIAFGRERMRFVHAH

SEQ ID NO: 226677 - protein, 23 aa, Mycobacterium bovis
PLEPYLDILPHFDTLLVMSVEPG

SEQ ID NO: 226678 - protein, 17 aa, Mycobacterium bovis
PLHASSMYSILGMCQSV

SEQ ID NO: 226679 - protein, 30 aa, Mycobacterium bovis
PLHPAPPRLRSPLVLLDGASMWFRSFFGVP

SEQ ID NO: 226680 - protein, 23 aa, Mycobacterium bovis
PLHSDPWFATQLAGFPKPILHGL

SEQ ID NO: 226681 - protein, 17 aa, Mycobacterium bovis
PLKLTSPEATGLLVALR

SEQ ID NO: 226682 - protein, 17 aa, Mycobacterium bovis
PLVSYLNNALKAKELFS

SEQ ID NO: 226683 - protein, 23 aa, Mycobacterium bovis
PLVVVAGAATRWVWVKDAPGFDI

SEQ ID NO: 226684 - protein, 25 aa, Mycobacterium bovis
PMLAASVAWDGLAAELAVAASSFGS

SEQ ID NO: 226685 - protein, 42 aa, Mycobacterium bovis
PMLTDVKLLARLFGLPYFPITPLFPLAGPVGLVPLPSKWRIA

SEQ ID NO: 226686 - protein, 21 aa, Mycobacterium bovis
PNSMLVAAASWDALAAELASA

SEQ ID NO: 226687 - protein, 31 aa, Mycobacterium bovis
PPAALLGLVERLPWLSAVPAYFVGLGVRPEH

SEQ ID NO: 226688 - protein, 31 aa, Mycobacterium bovis
PPAALLGLVERLPWLSAVPAYFVGVGVRPEH

SEQ ID NO: 226689 - protein, 18 aa, Mycobacterium bovis
PPFWQNLAELGWLGLHID

SEQ ID NO: 226690 - protein, 23 aa, Mycobacterium bovis
PPGQYFHGITLHKNGVTANMSLA

SEQ ID NO: 226691 - protein, 25 aa, Mycobacterium bovis
PPQSFAQVLVGWQNWLRTADRGSWA

SEQ ID NO: 226692 - protein, 18 aa, Mycobacterium bovis
PPTVWSRRWRQPWAPPTS

SEQ ID NO: 226693 - protein, 26 aa, Mycobacterium bovis
PPYQGTVRMAFLLQGDHDAYFQHVRA

SEQ ID NO: 226694 - protein, 24 aa, Mycobacterium bovis
PQSTSWAQRWLAATGSRDYLGAFV

SEQ ID NO: 226695 - protein, 23 aa, Mycobacterium bovis
PRHRQFPLDWRANGPIASTGLAR

SEQ ID NO: 226696 - protein, 29 aa, Mycobacterium bovis
PRLTRMQRFWISLYFPLTMRSLCNAIVVP

SEQ ID NO: 226697 - protein, 17 aa, Mycobacterium bovis
PRRPTLVPVEAIEFLRG

SEQ ID NO: 226698 - protein, 17 aa, Mycobacterium bovis
PRVIKRWRRGKPLADAE

SEQ ID NO: 226699 - protein, 30 aa, Mycobacterium bovis
PRYAELIKRTQWWGRQMLIWGVHVHVGIRS

SEQ ID NO: 226700 - protein, 27 aa, Mycobacterium bovis
PSAFNTIIDKWLPLSWSLNMVNRSMGH

SEQ ID NO: 226701 - protein, 25 aa, Mycobacterium bovis
PSRVPVWFMRQAGRSLPEYRALRER

SEQ ID NO: 226702 - protein, 20 aa, Mycobacterium bovis
PSTVRLFPVDGAVSPTITPA

SEQ ID NO: 226703 - protein, 23 aa, Mycobacterium bovis
PTASRAVSWWSVHEHVAPVLDAA

SEQ ID NO: 226704 - protein, 23 aa, Mycobacterium bovis
PTHIETLLRPSLQPETRLAAPLL

SEQ ID NO: 226705 - protein, 18 aa, Mycobacterium bovis
PTNALLFPQPRCQVITGV

SEQ ID NO: 226706 - protein, 27 aa, Mycobacterium bovis
PTQLRFDRWFLPLAVPLGLGPKNSELW

SEQ ID NO: 226707 - protein, 21 aa, Mycobacterium bovis
PTTFEVFARRLPTGRRYGVVA

SEQ ID NO: 226708 - protein, 24 aa, Mycobacterium bovis
PVCDCGGLIRPDIVWFGEPLPEEP

SEQ ID NO: 226709 - protein, 19 aa, Mycobacterium bovis
PVEGGGNQDWWPNRLNLKV

SEQ ID NO: 226710 - protein, 20 aa, Mycobacterium bovis
PVHIYLQFDGLDEATHRRIR

SEQ ID NO: 226711 - protein, 18 aa, Mycobacterium bovis
PVLYQHFSSKLELYLAVL

SEQ ID NO: 226712 - protein, 19 aa, Mycobacterium bovis
PVRVYWPPVVRDNLPVVVY

SEQ ID NO: 226713 - protein, 19 aa, Mycobacterium bovis
PVTGLVFVTNFDSNTVSVI

SEQ ID NO: 226714 - protein, 19 aa, Mycobacterium bovis
PWTMLGNLAFGLPSRLRLG

SEQ ID NO: 226715 - protein, 25 aa, Mycobacterium bovis
PYEQRPPVSPGPAAGYGAPGYDQGY

SEQ ID NO: 226716 - protein, 19 aa, Mycobacterium bovis
PYGPVVYLDLRHLGADLID

SEQ ID NO: 226717 - protein, 20 aa, Mycobacterium bovis
PYLQVVLQRRLPVVVVDQPK

SEQ ID NO: 226718 - protein, 22 aa, Mycobacterium bovis
QAGGNGGWLWGNGGNGGSGAPG

SEQ ID NO: 226719 - protein, 22 aa, Mycobacterium bovis
QAGGNGGWLWGNGGNSGSGAPG

SEQ ID NO: 226720 - protein, 21 aa, Mycobacterium bovis
QAIFDHGTPLALYHTKRLASP

SEQ ID NO: 226721 - protein, 40 aa, Mycobacterium bovis
QAISAQVAAYHQQFVQTLRTGAASYMLAEATNVEQNLLNL

SEQ ID NO: 226722 - protein, 20 aa, Mycobacterium bovis
QAVLAALLHRERNGVADVVQ

SEQ ID NO: 226723 - protein, 27 aa, Mycobacterium bovis
QCQRPTPPFALVLFLDIDWDETNKQHQ

SEQ ID NO: 226724 - protein, 20 aa, Mycobacterium bovis
QDWGVLPDLVMGHSVGEIAA

SEQ ID NO: 226725 - protein, 20 aa, Mycobacterium bovis
QEISRLISRSLRACIDLAAL

SEQ ID NO: 226726 - protein, 21 aa, Mycobacterium bovis
QEVEALLRREAADRIQSLQGN

SEQ ID NO: 226727 - protein, 25 aa, Mycobacterium bovis
QGGNGAAGGAGWSPDSDLKGFDGFD

SEQ ID NO: 226728 - protein, 62 aa, Mycobacterium bovis
QGQWGAHYAITVPQIPLLNFSLNIPVNIPIHLDFGTLAVNGFQIPAITLRALGVTHFSVGPI

SEQ ID NO: 226729 - protein, 23 aa, Mycobacterium bovis
QGWLADHSVAGVTIFPGAGFVEL

SEQ ID NO: 226730 - protein, 21 aa, Mycobacterium bovis
QIAMYLCRELTDLSLPKIGQA

SEQ ID NO: 226731 - protein, 19 aa, Mycobacterium bovis
QIARAFVSERIGLAAQAYS

SEQ ID NO: 226732 - protein, 21 aa, Mycobacterium bovis
QLAMTPGFLRVFGFRTAKARA

SEQ ID NO: 226733 - protein, 20 aa, Mycobacterium bovis
QLEHWGCPWSRKPDGRVAVR

SEQ ID NO: 226734 - protein, 20 aa, Mycobacterium bovis
QLLSLVLSNLFGQNLPAIAA

SEQ ID NO: 226735 - protein, 24 aa, Mycobacterium bovis
QLRAHLRVVFPGVVGLFADLDSPI

SEQ ID NO: 226736 - protein, 28 aa, Mycobacterium bovis
QMHLSLALNRLPQVAALFLAGHLGARLF

SEQ ID NO: 226737 - protein, 28 aa, Mycobacterium bovis
QMIDDISQLVYLHLRFHGYGDGKWTDSA

SEQ ID NO: 226738 - protein, 19 aa, Mycobacterium bovis
QMRTAAPDFRLFWDNAYAV

SEQ ID NO: 226739 - protein, 25 aa, Mycobacterium bovis
QNATRPPRPGRRLPVYPAAADVDPP

SEQ ID NO: 226740 - protein, 18 aa, Mycobacterium bovis
QNLAELGWLGLHIDERHG

SEQ ID NO: 226741 - protein, 17 aa, Mycobacterium bovis
QNWRGPVLGDLRSFMFV

SEQ ID NO: 226742 - protein, 21 aa, Mycobacterium bovis
QPAVLAFVNRALAGVLALSIE

SEQ ID NO: 226743 - protein, 23 aa, Mycobacterium bovis
QPDVIVLGLARGGLPVAWEVAAA

SEQ ID NO: 226744 - protein, 19 aa, Mycobacterium bovis
QPLIAAFAAALRQLGAHVE

SEQ ID NO: 226745 - protein, 19 aa, Mycobacterium bovis
QQIQQLVVARRLLGLSSSE

SEQ ID NO: 226746 - protein, 18 aa, Mycobacterium bovis
QQRLWRTRESLAEVLGVY

SEQ ID NO: 226747 - protein, 19 aa, Mycobacterium bovis
QQRLWRTRESLAEVLGVYG

SEQ ID NO: 226748 - protein, 19 aa, Mycobacterium bovis
QQYAILDDRLRHLPGGIDE

SEQ ID NO: 226749 - protein, 21 aa, Mycobacterium bovis
QRAVLAMLLLSRNQVVAADAL

SEQ ID NO: 226750 - protein, 20 aa, Mycobacterium bovis
QRGLRPIQIWVPDVNAPEFV

SEQ ID NO: 226751 - protein, 19 aa, Mycobacterium bovis
QRLHVAVQAFFDFIEHDSQ

SEQ ID NO: 226752 - protein, 20 aa, Mycobacterium bovis
QRLRLRPFDLGAPKWVDDPD

SEQ ID NO: 226753 - protein, 19 aa, Mycobacterium bovis
QRRHSVLPMLLASNSQRLQ

SEQ ID NO: 226754 - protein, 19 aa, Mycobacterium bovis
QRYESGALRQAGFYGLDLY

SEQ ID NO: 226755 - protein, 17 aa, Mycobacterium bovis
QRYGWCPRPDWVRVVPD

SEQ ID NO: 226756 - protein, 26 aa, Mycobacterium bovis
QSDAVVVAMWLWRTLCESDTPNKLRA

SEQ ID NO: 226757 - protein, 27 aa, Mycobacterium bovis
QSDTESPLWQAFLTRVLPDEGVRGFVQ

SEQ ID NO: 226758 - protein, 17 aa, Mycobacterium bovis
QSHWPDDAAAREPVLLW

SEQ ID NO: 226759 - protein, 17 aa, Mycobacterium bovis
QSHYLHVRPADQFDAMI

SEQ ID NO: 226760 - protein, 22 aa, Mycobacterium bovis
QSLPLAEMLYARGSGLRASRNQ

SEQ ID NO: 226761 - protein, 33 aa, Mycobacterium bovis
QSLQGNRLLAPNEYIITLGVHDFEKLGADPELK

SEQ ID NO: 226762 - protein, 23 aa, Mycobacterium bovis
QTFDLRRATLTRSLRFRDAGGRV

SEQ ID NO: 226763 - protein, 19 aa, Mycobacterium bovis
QTLLYSYTTTATNTPFVTS

SEQ ID NO: 226764 - protein, 20 aa, Mycobacterium bovis
QTMRANLERWAPLLPEGATL

SEQ ID NO: 226765 - protein, 21 aa, Mycobacterium bovis
QVKIIDRVLASPLVTEAMVLS

SEQ ID NO: 226766 - protein, 21 aa, Mycobacterium bovis
QVLRALDGRFIPAGPSGSPLR

SEQ ID NO: 226767 - protein, 38 aa, Mycobacterium bovis
RAATVHPMLVAANRNAFVQLVLSNLFGQNAPAIAAAEA

SEQ ID NO: 226768 - protein, 39 aa, Mycobacterium bovis
RAATVHPMLVAANRNAFVQLVLSNLFGQNAPAIAAAEAM

SEQ ID NO: 226769 - protein, 17 aa, Mycobacterium bovis
RACRAPSSLPAPLMARP

SEQ ID NO: 226770 - protein, 19 aa, Mycobacterium bovis
RAEFGDRLPVVLLDGREHS

SEQ ID NO: 226771 - protein, 20 aa, Mycobacterium bovis
RAEFQRITQDLLDRTRKPFQ

SEQ ID NO: 226772 - protein, 21 aa, Mycobacterium bovis
RAELMILIATNLLGQNTPAIA

SEQ ID NO: 226773 - protein, 21 aa, Mycobacterium bovis
RAGLGWGMFPEKLAASPLADG

SEQ ID NO: 226774 - protein, 22 aa, Mycobacterium bovis
RAGLGWGMFPEKLAASPLADGS

SEQ ID NO: 226775 - protein, 28 aa, Mycobacterium bovis
RALELGCGTGFFLLNLIQAGVARRGSVT

SEQ ID NO: 226776 - protein, 21 aa, Mycobacterium bovis
RAPFAFEGVFGHLAATAVPGC

SEQ ID NO: 226777 - protein, 17 aa, Mycobacterium bovis
RAPSSLPAPLMARPGRS

SEQ ID NO: 226778 - protein, 21 aa, Mycobacterium bovis
RAQMATLPRLKPRVFYDLVVE

SEQ ID NO: 226779 - protein, 22 aa, Mycobacterium bovis
RAQMATLPRLKPRVFYDLVVEV

SEQ ID NO: 226780 - protein, 17 aa, Mycobacterium bovis
RARARLARLLGYLNTGV

SEQ ID NO: 226781 - protein, 21 aa, Mycobacterium bovis
RARMRPPRPAGLLLGNGGARR

SEQ ID NO: 226782 - protein, 27 aa, Mycobacterium bovis
RASVLAYPRVVWIAGGLLKGASLHAEV

SEQ ID NO: 226783 - protein, 19 aa, Mycobacterium bovis
RAWHGNWHMLIVTSIGTDA

SEQ ID NO: 226784 - protein, 23 aa, Mycobacterium bovis
RCATYPVLAVQAWAAFHDMTLRA

SEQ ID NO: 226785 - protein, 30 aa, Mycobacterium bovis
RCGDTDRVTLFRAWYSRRNFGQLSGSVQIS

SEQ ID NO: 226786 - protein, 26 aa, Mycobacterium bovis
RCIVPKHIPVTWWPKTDSVSPQLGWL

SEQ ID NO: 226787 - protein, 17 aa, Mycobacterium bovis
RCRALELGLTGYAANHA

SEQ ID NO: 226788 - protein, 25 aa, Mycobacterium bovis
RCRGAAVVTPLLLADAYHARVDIPA

SEQ ID NO: 226789 - protein, 20 aa, Mycobacterium bovis
RDANFDAVLAPAAALPGCQT

SEQ ID NO: 226790 - protein, 19 aa, Mycobacterium bovis
RDFARVSFSYGLNAKWPVY

SEQ ID NO: 226791 - protein, 17 aa, Mycobacterium bovis
RDGMAGWYFTKWQRVLN

SEQ ID NO: 226792 - protein, 18 aa, Mycobacterium bovis
RDGWVDRFGLDLPRHDTG

SEQ ID NO: 226793 - protein, 25 aa, Mycobacterium bovis
RDGWVRLHWEFACLRYGAAGVRTCE

SEQ ID NO: 226794 - protein, 18 aa, Mycobacterium bovis
RDIEWRIGPGERIGIVGA

SEQ ID NO: 226795 - protein, 26 aa, Mycobacterium bovis
RDIQVRGYTLRLPLDVLVVASANPED

SEQ ID NO: 226796 - protein, 17 aa, Mycobacterium bovis
RDNPYGFVAFDVDPGQP

SEQ ID NO: 226797 - protein, 17 aa, Mycobacterium bovis
RDSHPIRIPSTLLGLLS

SEQ ID NO: 226798 - protein, 18 aa, Mycobacterium bovis
RDSMRLPPRMVGRPADGP

SEQ ID NO: 226799 - protein, 21 aa, Mycobacterium bovis
REGYFQIAYLGPKGTDAQLRE

SEQ ID NO: 226800 - protein, 19 aa, Mycobacterium bovis
RELIARIRAVLRRGGDDDS

SEQ ID NO: 226801 - protein, 34 aa, Mycobacterium bovis
RELPHQLLRSWYILYFQLPWLPERSASWVVPLLW

SEQ ID NO: 226802 - protein, 35 aa, Mycobacterium bovis
RENHLTLPHPLAHLRAFVLIPWIAVDPTAQLTVAG

SEQ ID NO: 226803 - protein, 26 aa, Mycobacterium bovis
RFAGMWHDFHLQVSLLPEARDAIADL

SEQ ID NO: 226804 - protein, 22 aa, Mycobacterium bovis
RFDAEVYARRLALAAAATADAG

SEQ ID NO: 226805 - protein, 19 aa, Mycobacterium bovis
RFLEKEQRIIAALRAAADS

SEQ ID NO: 226806 - protein, 30 aa, Mycobacterium bovis
RFVSAPPPPPPPPPPPPPTPMPIAAGEPPS

SEQ ID NO: 226807 - protein, 19 aa, Mycobacterium bovis
RGDLAVAIDALRRPERRRG

SEQ ID NO: 226808 - protein, 18 aa, Mycobacterium bovis
RGDMAFKDGDGGAGGDGG

SEQ ID NO: 226809 - protein, 32 aa, Mycobacterium bovis
RGDRMWEFLDRLTSIALPRIRDFRGLSPKQFD

SEQ ID NO: 226810 - protein, 19 aa, Mycobacterium bovis
RGFARFRRLRWRHPLDGQT

SEQ ID NO: 226811 - protein, 17 aa, Mycobacterium bovis
RGFYDRSLRCRDPHARL

SEQ ID NO: 226812 - protein, 24 aa, Mycobacterium bovis
RGGYPPETGGYPPQPGYPRPRHPG

SEQ ID NO: 226813 - protein, 27 aa, Mycobacterium bovis
RGPVLGDLRSFMFVQMFSRALTEDELL

SEQ ID NO: 226814 - protein, 29 aa, Mycobacterium bovis
RGPVLGDLRSFMFVQMFSRALTGDELLVH

SEQ ID NO: 226815 - protein, 18 aa, Mycobacterium bovis
RGRYRQSGIRVDHDRHGL

SEQ ID NO: 226816 - protein, 17 aa, Mycobacterium bovis
RHELTVLAALLGPADAP

SEQ ID NO: 226817 - protein, 19 aa, Mycobacterium bovis
RHGFVKIFCRRSTGVVIGG

SEQ ID NO: 226818 - protein, 17 aa, Mycobacterium bovis
RHVIILPMGPITGAIHQ

SEQ ID NO: 226819 - protein, 21 aa, Mycobacterium bovis
RIAQLCHPNLRNTFPPLRMRI

SEQ ID NO: 226820 - protein, 27 aa, Mycobacterium bovis
RIGELPRGLHRLAGAAGLLGAGFPEAV

SEQ ID NO: 226821 - protein, 18 aa, Mycobacterium bovis
RIISVVPVVLEVRRAEPA

SEQ ID NO: 226822 - protein, 20 aa, Mycobacterium bovis
RISNFPPKRHKTRVLAAAED

SEQ ID NO: 226823 - protein, 29 aa, Mycobacterium bovis
RKNERYKLVWKNRLGFARLAIQHGYPIVP

SEQ ID NO: 226824 - protein, 19 aa, Mycobacterium bovis
RKRRMFDLLVRMGYKEIEV

SEQ ID NO: 226825 - protein, 23 aa, Mycobacterium bovis
RLAGIPYIAIANAYWSPYAQRRF

SEQ ID NO: 226826 - protein, 21 aa, Mycobacterium bovis
RLASTIRKPPIEHAAGPLGST

SEQ ID NO: 226827 - protein, 27 aa, Mycobacterium bovis
RLAVCLDLDWRPQFRVDLIPSYKAHRV

SEQ ID NO: 226828 - protein, 28 aa, Mycobacterium bovis
RLAVCLDLDWRPQFRVDLIPSYKAHRVA

SEQ ID NO: 226829 - protein, 19 aa, Mycobacterium bovis
RLDFRPKHRLAVLVVSAIP

SEQ ID NO: 226830 - protein, 20 aa, Mycobacterium bovis
RLELAALKQSAAAELGLRVC

SEQ ID NO: 226831 - protein, 18 aa, Mycobacterium bovis
RLHMLRHQQILAPKFALV

SEQ ID NO: 226832 - protein, 22 aa, Mycobacterium bovis
RLMRGLGSSIYPRNVDYRAFDE

SEQ ID NO: 226833 - protein, 17 aa, Mycobacterium bovis
RLRLFEITAGLADKYVP

SEQ ID NO: 226834 - protein, 33 aa, Mycobacterium bovis
RLRNRTWPDRVIDRAPLWCAVDLRDGNQALIDP

SEQ ID NO: 226835 - protein, 23 aa, Mycobacterium bovis
RLRRLAGLWLADQEERWAAVRID

SEQ ID NO: 226836 - protein, 22 aa, Mycobacterium bovis
RLRSPLLRLATWNVNSIRTRLD

SEQ ID NO: 226837 - protein, 21 aa, Mycobacterium bovis
RLSWTTPFTEVLDWSEAPFAK

SEQ ID NO: 226838 - protein, 27 aa, Mycobacterium bovis
RMASHANHYLALFDGAKPLALYHTKRL

SEQ ID NO: 226839 - protein, 26 aa, Mycobacterium bovis
RMYTRARFAPYVEKLLLDGARTKLTR

SEQ ID NO: 226840 - protein, 17 aa, Mycobacterium bovis
RNDVMFGPPGRLYTYRS

SEQ ID NO: 226841 - protein, 25 aa, Mycobacterium bovis
RNGIDAARWPFAARRPRTGPAELLY

SEQ ID NO: 226842 - protein, 19 aa, Mycobacterium bovis
RNLLVPLNFHLGYHGMPIG

SEQ ID NO: 226843 - protein, 23 aa, Mycobacterium bovis
RNPRSLRVCTLLRKPDAVHANVE

SEQ ID NO: 226844 - protein, 18 aa, Mycobacterium bovis
RNVQFYCIDLGGGGLIYL

SEQ ID NO: 226845 - protein, 21 aa, Mycobacterium bovis
RPCGPGWTPARIGRRTRARRA

SEQ ID NO: 226846 - protein, 19 aa, Mycobacterium bovis
RPDIVWFGEPLPEEPWRSA

SEQ ID NO: 226847 - protein, 22 aa, Mycobacterium bovis
RPLDAGPYTFLAADALVLKVRE

SEQ ID NO: 226848 - protein, 21 aa, Mycobacterium bovis
RPPMVTSGLRIGTPALATRGF

SEQ ID NO: 226849 - protein, 17 aa, Mycobacterium bovis
RQDFVEFTPSHTPLLIT

SEQ ID NO: 226850 - protein, 27 aa, Mycobacterium bovis
RQGSYFPDWLLQRRKRAERALTSVVAT

SEQ ID NO: 226851 - protein, 21 aa, Mycobacterium bovis
RQRLPRTIQIEAGVFLWCTPG

SEQ ID NO: 226852 - protein, 28 aa, Mycobacterium bovis
RRAAPVLARGPMVWRPATTGRSAAATAA

SEQ ID NO: 226853 - protein, 29 aa, Mycobacterium bovis
RRAHGLPAISLGWGLWDQASAMTSGLATV

SEQ ID NO: 226854 - protein, 23 aa, Mycobacterium bovis
RRAVRQWLVRWAAHPGRATRGFH

SEQ ID NO: 226855 - protein, 19 aa, Mycobacterium bovis
RRFTSMYRRIVGSAGPITD

SEQ ID NO: 226856 - protein, 27 aa, Mycobacterium bovis
RRGRVQSVLLPRLLDWMSYAPDPDGGL

SEQ ID NO: 226857 - protein, 32 aa, Mycobacterium bovis
RRRRKHLTLVHKTNVLTLAGGLWLRTVDEVGE

SEQ ID NO: 226858 - protein, 32 aa, Mycobacterium bovis
RRTRRRWPPNIQLKAYYLPSEDRRIKVRVSAQ

SEQ ID NO: 226859 - protein, 24 aa, Mycobacterium bovis
RSAACWARRLVFVNGHGGNVGALT

SEQ ID NO: 226860 - protein, 22 aa, Mycobacterium bovis
RSAAYAMRWVAKNVVAAGLAER

SEQ ID NO: 226861 - protein, 20 aa, Mycobacterium bovis
RSGKIMRRLLRDVAENRELG

SEQ ID NO: 226862 - protein, 18 aa, Mycobacterium bovis
RSIIVLSEGRLLNLGNAT

SEQ ID NO: 226863 - protein, 23 aa, Mycobacterium bovis
RSLLELAKLDAELTRIAHRATHL

SEQ ID NO: 226864 - protein, 18 aa, Mycobacterium bovis
RSYFWVAKTTAADGLGYL

SEQ ID NO: 226865 - protein, 18 aa, Mycobacterium bovis
RTDEARQILGHRAMIVAG

SEQ ID NO: 226866 - protein, 18 aa, Mycobacterium bovis
RTDFHTEILRMQKAINAV

SEQ ID NO: 226867 - protein, 17 aa, Mycobacterium bovis
RTKLLAASAYIKAADRV

SEQ ID NO: 226868 - protein, 23 aa, Mycobacterium bovis
RTPGFERTLLGRALDFWNEEVYE

SEQ ID NO: 226869 - protein, 19 aa, Mycobacterium bovis
RTVVGQRIVFAPGAAHMSP

SEQ ID NO: 226870 - protein, 22 aa, Mycobacterium bovis
RVIDRAPLWCAVDLRDGNQALI

SEQ ID NO: 226871 - protein, 26 aa, Mycobacterium bovis
RVLAAALRLRRTHPESFLGGAYHPVF

SEQ ID NO: 226872 - protein, 19 aa, Mycobacterium bovis
RVRDPRLRRALTPDYEPMC

SEQ ID NO: 226873 - protein, 20 aa, Mycobacterium bovis
RVRDPRLRRALTPDYEPMCK

SEQ ID NO: 226874 - protein, 31 aa, Mycobacterium bovis
RVRRCGMVSPTVFWPIPRVYSGLVRIDRYET

SEQ ID NO: 226875 - protein, 24 aa, Mycobacterium bovis
RVTAPAHWKVISNGAPLAAANGVH

SEQ ID NO: 226876 - protein, 17 aa, Mycobacterium bovis
RVTPTHIETLLRPSLQP

SEQ ID NO: 226877 - protein, 22 aa, Mycobacterium bovis
RVVATVPQLVQLAPHAVQMSQN

SEQ ID NO: 226878 - protein, 17 aa, Mycobacterium bovis
RVWLGVAGLPAPGCRTI

SEQ ID NO: 226879 - protein, 17 aa, Mycobacterium bovis
RVWVMNRLREKMPHVYV

SEQ ID NO: 226880 - protein, 20 aa, Mycobacterium bovis
RWRRRRALWVGVTLGGAVDS

SEQ ID NO: 226881 - protein, 20 aa, Mycobacterium bovis
RWRRSPPTGRYRSNSQIQVW

SEQ ID NO: 226882 - protein, 27 aa, Mycobacterium bovis
RWSAVLVGAWWPAPSAALRAAAQHWAT

SEQ ID NO: 226883 - protein, 18 aa, Mycobacterium bovis
RWVDWFNHRRLYQYCGDV

SEQ ID NO: 226884 - protein, 17 aa, Mycobacterium bovis
RYLVHFTQSGIGLPDES

SEQ ID NO: 226885 - protein, 24 aa, Mycobacterium bovis
RYNPDYLPGALLPPSIHATADAEE

SEQ ID NO: 226886 - protein, 27 aa, Mycobacterium bovis
RYRDRGRPFLAFLYGIAAHKVADAHRA

SEQ ID NO: 226887 - protein, 29 aa, Mycobacterium bovis
SAAAAKLAGLVFPQPPAPIAVSGTDSVVA

SEQ ID NO: 226888 - protein, 17 aa, Mycobacterium bovis
SAHAVHTRLRRLTADRD

SEQ ID NO: 226889 - protein, 19 aa, Mycobacterium bovis
SAHTRCWFIDADWTPLLAA

SEQ ID NO: 226890 - protein, 19 aa, Mycobacterium bovis
SAPPTPFNGPLGRLRNIAY

SEQ ID NO: 226891 - protein, 22 aa, Mycobacterium bovis
SAQAAAFHTRFIRARSRHPQQE

SEQ ID NO: 226892 - protein, 17 aa, Mycobacterium bovis
SAQAALFHDRFVQILQE

SEQ ID NO: 226893 - protein, 26 aa, Mycobacterium bovis
SAQQGKFLCLLAGAIQARRVLEIGTL

SEQ ID NO: 226894 - protein, 22 aa, Mycobacterium bovis
SDEVDAIRWLSWEQFVRDVTAG

SEQ ID NO: 226895 - protein, 23 aa, Mycobacterium bovis
SDGTLRVGYLPVTITRWPPGERV

SEQ ID NO: 226896 - protein, 29 aa, Mycobacterium bovis
SDMTRTFVLGKAADWQLEIYQLVAEAQQA

SEQ ID NO: 226897 - protein, 18 aa, Mycobacterium bovis
SDPFITIDAFQVVAGVLF

SEQ ID NO: 226898 - protein, 27 aa, Mycobacterium bovis
SDSDMFTFGYKFRPWRDVKVLADGASI

SEQ ID NO: 226899 - protein, 28 aa, Mycobacterium bovis
SDTTTDPVLAWLYVLDAWEGGLPSARYL

SEQ ID NO: 226900 - protein, 21 aa, Mycobacterium bovis
SEHLVAWMKAVVYGAAERWTD

SEQ ID NO: 226901 - protein, 18 aa, Mycobacterium bovis
SFDAAAARKFGCGFAPSG

SEQ ID NO: 226902 - protein, 25 aa, Mycobacterium bovis
SFLLDHALVDIGVGVRWLREVQGVE

SEQ ID NO: 226903 - protein, 18 aa, Mycobacterium bovis
SFTPVLIPASRGILATCT

SEQ ID NO: 226904 - protein, 22 aa, Mycobacterium bovis
SGAPPVGGLHLQFGRNASTEMV

SEQ ID NO: 226905 - protein, 37 aa, Mycobacterium bovis
SGDTVRRLARLHTPLPLLAFTAWPEVRSQLAMTWGTE

SEQ ID NO: 226906 - protein, 23 aa, Mycobacterium bovis
SGGVGGAGGFGLTTGGPGAAGGD

SEQ ID NO: 226907 - protein, 17 aa, Mycobacterium bovis
SGIPYVGRILVNVQVVP

SEQ ID NO: 226908 - protein, 17 aa, Mycobacterium bovis
SHCYPHFRRFLAEVVRV

SEQ ID NO: 226909 - protein, 18 aa, Mycobacterium bovis
SHWCGLHPGVSVDHSCLS

SEQ ID NO: 226910 - protein, 26 aa, Mycobacterium bovis
SIERFLDTAWWVSDLPSARAFAAVWT

SEQ ID NO: 226911 - protein, 18 aa, Mycobacterium bovis
SIEWMSRNLANRESVILS

SEQ ID NO: 226912 - protein, 21 aa, Mycobacterium bovis
SIGAPPIVIGPLYAEKTIQLC

SEQ ID NO: 226913 - protein, 25 aa, Mycobacterium bovis
SIGVRSVCYLPLTYDHRLIDGADAG

SEQ ID NO: 226914 - protein, 21 aa, Mycobacterium bovis
SIPSVTVPPITIPAGTALGAF

SEQ ID NO: 226915 - protein, 25 aa, Mycobacterium bovis
SIQAGIINLLLDLQEQFGLSYLFVS

SEQ ID NO: 226916 - protein, 25 aa, Mycobacterium bovis
SITVGRISYLLGLRGPAVAVDTACS

SEQ ID NO: 226917 - protein, 23 aa, Mycobacterium bovis
SLARLPLILSDGHLRELALTGKN

SEQ ID NO: 226918 - protein, 22 aa, Mycobacterium bovis
SLAYLPRLPVDVVKLGGKFIEC

SEQ ID NO: 226919 - protein, 21 aa, Mycobacterium bovis
SLFFRQHINYVLARPKLRPIT

SEQ ID NO: 226920 - protein, 24 aa, Mycobacterium bovis
SLGDELMRRFNGAALETLLTRLNL

SEQ ID NO: 226921 - protein, 17 aa, Mycobacterium bovis
SLRLSHPELLYHPTQSW

SEQ ID NO: 226922 - protein, 20 aa, Mycobacterium bovis
SLRMYLGAGSGPMLAAAAAW

SEQ ID NO: 226923 - protein, 21 aa, Mycobacterium bovis
SLSAALSAQLGDALNAYVDAA

SEQ ID NO: 226924 - protein, 20 aa, Mycobacterium bovis
SLSQYAFGSSGEGLAGVASV

SEQ ID NO: 226925 - protein, 20 aa, Mycobacterium bovis
SLTGLDGTDGITPNGGNGGN

SEQ ID NO: 226926 - protein, 25 aa, Mycobacterium bovis
SLVKFACAWTYIALDPAVVQSVPVF

SEQ ID NO: 226927 - protein, 25 aa, Mycobacterium bovis
SNAGPAMLPGFNSGFANIGSFNAGI

SEQ ID NO: 226928 - protein, 24 aa, Mycobacterium bovis
SNEGFFNTGMFNNGIYNSGVASTG

SEQ ID NO: 226929 - protein, 23 aa, Mycobacterium bovis
SNFNADRWELFHIAADRSQCHDL

SEQ ID NO: 226930 - protein, 22 aa, Mycobacterium bovis
SNGLLWRGDNQGLIDLAIGVDI

SEQ ID NO: 226931 - protein, 23 aa, Mycobacterium bovis
SPAEGFGWPWSVCRWVAGENPSA

SEQ ID NO: 226932 - protein, 17 aa, Mycobacterium bovis
SPLLRNSITIHTCSDEA

SEQ ID NO: 226933 - protein, 18 aa, Mycobacterium bovis
SPYSHWAFQHVEDFMPTT

SEQ ID NO: 226934 - protein, 20 aa, Mycobacterium bovis
SQDEIVWAKEFFAEFARDGG

SEQ ID NO: 226935 - protein, 23 aa, Mycobacterium bovis
SQGLTPQLYPQLAAIAPTVFTAA

SEQ ID NO: 226936 - protein, 17 aa, Mycobacterium bovis
SRGLIGWRTDFLTETRG

SEQ ID NO: 226937 - protein, 17 aa, Mycobacterium bovis
SRGLTAQTPRQNPMWSA

SEQ ID NO: 226938 - protein, 24 aa, Mycobacterium bovis
SRLAHVHLSRRLAHWTRLYPEVRV

SEQ ID NO: 226939 - protein, 25 aa, Mycobacterium bovis
SRLHTSLLDRHRPLWELHVVEGLND

SEQ ID NO: 226940 - protein, 18 aa, Mycobacterium bovis
SRLRLFEITAGLADKYVP

SEQ ID NO: 226941 - protein, 31 aa, Mycobacterium bovis
SRTLMDSHPFTWLPLLSRVLGSAQLVSEAVG

SEQ ID NO: 226942 - protein, 21 aa, Mycobacterium bovis
SSASFPLAFEPSFLPFTKGTA

SEQ ID NO: 226943 - protein, 18 aa, Mycobacterium bovis
SSQFVSGLLLSAASFTDG

SEQ ID NO: 226944 - protein, 17 aa, Mycobacterium bovis
SSRDWAAKGTLLLGVRA

SEQ ID NO: 226945 - protein, 24 aa, Mycobacterium bovis
SSSLWRSSFSWWWKVLVRGWPWTA

SEQ ID NO: 226946 - protein, 24 aa, Mycobacterium bovis
STAGSLQGQWRGAAGTAAQAAVVR

SEQ ID NO: 226947 - protein, 24 aa, Mycobacterium bovis
STEYDVERYFRDAPLMILGEGTNE

SEQ ID NO: 226948 - protein, 18 aa, Mycobacterium bovis
STFIGVMPAGQALAIITF

SEQ ID NO: 226949 - protein, 25 aa, Mycobacterium bovis
STGKDVYFNLSLWSAYNVMLMHTVL

SEQ ID NO: 226950 - protein, 25 aa, Mycobacterium bovis
STSMLAMSAPYVEWLERTAAQTKQT

SEQ ID NO: 226951 - protein, 18 aa, Mycobacterium bovis
STSRPCGPGWTPARIGRR

SEQ ID NO: 226952 - protein, 25 aa, Mycobacterium bovis
STWARQLPWLTLLGAVYTYDAPWHR

SEQ ID NO: 226953 - protein, 18 aa, Mycobacterium bovis
STYLNDFAQLLAALGRRY

SEQ ID NO: 226954 - protein, 18 aa, Mycobacterium bovis
SVDYAVRITSRGLYVHSA

SEQ ID NO: 226955 - protein, 39 aa, Mycobacterium bovis
SVFRDYGYRRLRAKARLKFLIKDWGIAKFREVLETEYLK

SEQ ID NO: 226956 - protein, 17 aa, Mycobacterium bovis
SVPPAWAAANQAVTPAA

SEQ ID NO: 226957 - protein, 20 aa, Mycobacterium bovis
SVRAYLKQIGKVALLNAEEE

SEQ ID NO: 226958 - protein, 27 aa, Mycobacterium bovis
SVSDALDILRWAPQAASGPVAKVIASA

SEQ ID NO: 226959 - protein, 19 aa, Mycobacterium bovis
SVVIAYEPVWAIGTGRVAS

SEQ ID NO: 226960 - protein, 19 aa, Mycobacterium bovis
SWTTPFTEVLDWSGAPFAK

SEQ ID NO: 226961 - protein, 17 aa, Mycobacterium bovis
SYMLPRSPIVRIVDSDT

SEQ ID NO: 226962 - protein, 20 aa, Mycobacterium bovis
TAARWNLKTIADLAPHSADV

SEQ ID NO: 226963 - protein, 19 aa, Mycobacterium bovis
TACAYDHLIPGRGVGVLLD

SEQ ID NO: 226964 - protein, 24 aa, Mycobacterium bovis
TAGGDLPLPLRWGEYRAGGLARAR

SEQ ID NO: 226965 - protein, 17 aa, Mycobacterium bovis
TAPGLVVPGRPAVMVLP

SEQ ID NO: 226966 - protein, 26 aa, Mycobacterium bovis
TAPRRTLKGTYWHQGPTRHPVTSCAD

SEQ ID NO: 226967 - protein, 26 aa, Mycobacterium bovis
TAQLRSRSWWSGFDVVLLVDDWHMIV

SEQ ID NO: 226968 - protein, 23 aa, Mycobacterium bovis
TARRGPPTRGLPKAVRAAKMGAR

SEQ ID NO: 226969 - protein, 23 aa, Mycobacterium bovis
TASRHAHWLNPEPKHLWGSGDSA

SEQ ID NO: 226970 - protein, 21 aa, Mycobacterium bovis
TASSPFGIAIAIGGAGAQGGA

SEQ ID NO: 226971 - protein, 28 aa, Mycobacterium bovis
TATSPMDPALYLVWAQANAAAGYRYSVE

SEQ ID NO: 226972 - protein, 23 aa, Mycobacterium bovis
TATTARAVAVARSGMDCVAGDAS

SEQ ID NO: 226973 - protein, 74 aa, Mycobacterium bovis
TAVTVGTATAALLMQATAGRVATAATAAWVGPGETVAPPVVTEATAGPAAPAASAPLRLAASAAVTAGTAGAEV

SEQ ID NO: 226974 - protein, 25 aa, Mycobacterium bovis
TAWATQLRIMQAQLLAKIAAAVGND

SEQ ID NO: 226975 - protein, 25 aa, Mycobacterium bovis
TCAPLTWPEGWRRWPQRVYGDTRLE

SEQ ID NO: 226976 - protein, 19 aa, Mycobacterium bovis
TCDFGPQHQPRIALRADMD

SEQ ID NO: 226977 - protein, 18 aa, Mycobacterium bovis
TCGAWQTGFPRRSKSCWS

SEQ ID NO: 226978 - protein, 17 aa, Mycobacterium bovis
TCHGRVRRLVDLGVIRG

SEQ ID NO: 226979 - protein, 20 aa, Mycobacterium bovis
TDAHRAILASLGTGGAYFFR

SEQ ID NO: 226980 - protein, 24 aa, Mycobacterium bovis
TDDALTVLWHSITWQYLPADERAA

SEQ ID NO: 226981 - protein, 23 aa, Mycobacterium bovis
TDKRASGVIPRYGVRLTVMSRPP

SEQ ID NO: 226982 - protein, 21 aa, Mycobacterium bovis
TDQRLLDLLPPAPVDVNPPGD

SEQ ID NO: 226983 - protein, 24 aa, Mycobacterium bovis
TETTLRRILYDHIYLRHFRPKPDY

SEQ ID NO: 226984 - protein, 21 aa, Mycobacterium bovis
TFIGAPAMNLIDAAVAHGVVR

SEQ ID NO: 226985 - protein, 23 aa, Mycobacterium bovis
TGEAGGPGGWLLGNGGNGGSGAP

SEQ ID NO: 226986 - protein, 21 aa, Mycobacterium bovis
TGELPTWQWESLISKSTRLVA

SEQ ID NO: 226987 - protein, 18 aa, Mycobacterium bovis
TGGAYFFRQLTHDGLTEA

SEQ ID NO: 226988 - protein, 19 aa, Mycobacterium bovis
TGGLLFGNGGAGGQGGLGL

SEQ ID NO: 226989 - protein, 18 aa, Mycobacterium bovis
TGLLPHLNPGVMSWSEMS

SEQ ID NO: 226990 - protein, 23 aa, Mycobacterium bovis
TGRRYLDMFTFVASSALGMNPPA

SEQ ID NO: 226991 - protein, 27 aa, Mycobacterium bovis
TGVGGIGGLLLGLDGANAPASTNPLHT

SEQ ID NO: 226992 - protein, 31 aa, Mycobacterium bovis
THARVGLLPTWGLSVRLPQKVGIGLARRMSL

SEQ ID NO: 226993 - protein, 29 aa, Mycobacterium bovis
THFSVGPIIVPRIAGTLPVIDINIGDPGG

SEQ ID NO: 226994 - protein, 19 aa, Mycobacterium bovis
TIAAVFPDGPQRYFDTIYN

SEQ ID NO: 226995 - protein, 18 aa, Mycobacterium bovis
TIAIERIAPLFNLINGDL

SEQ ID NO: 226996 - protein, 19 aa, Mycobacterium bovis
TICVTIAIDRWRRTRPPVY

SEQ ID NO: 226997 - protein, 17 aa, Mycobacterium bovis
TIDQALGGVLFIDEAYA

SEQ ID NO: 226998 - protein, 21 aa, Mycobacterium bovis
TIGAGLALALVLDGCGKRVEV

SEQ ID NO: 226999 - protein, 23 aa, Mycobacterium bovis
TIPGFAINPFDLNVPLSGGTNAV

SEQ ID NO: 227000 - protein, 17 aa, Mycobacterium bovis
TIPGFSVPAQPLPLSID

SEQ ID NO: 227001 - protein, 19 aa, Mycobacterium bovis
TIPQFRTLVILSNHGPINL

SEQ ID NO: 227002 - protein, 22 aa, Mycobacterium bovis
TIQVLTQCRPELIERTFQACSG

SEQ ID NO: 227003 - protein, 17 aa, Mycobacterium bovis
TIRLPVHLVEQVNKLAR

SEQ ID NO: 227004 - protein, 23 aa, Mycobacterium bovis
TITRSVLIARLFVGAVPALARDG

SEQ ID NO: 227005 - protein, 18 aa, Mycobacterium bovis
TIYSFTGASPRFLLDFSR

SEQ ID NO: 227006 - protein, 19 aa, Mycobacterium bovis
TKKLLAADGLPVGAYAVLR

SEQ ID NO: 227007 - protein, 20 aa, Mycobacterium bovis
TLDRSILRQLGMGRRTVVVT

SEQ ID NO: 227008 - protein, 19 aa, Mycobacterium bovis
TLGRRVVYRRDEVSRWISK

SEQ ID NO: 227009 - protein, 19 aa, Mycobacterium bovis
TLHSVKVIPSRGAWLEFDV

SEQ ID NO: 227010 - protein, 21 aa, Mycobacterium bovis
TMEIGIFLMPAHPPERTLYDA

SEQ ID NO: 227011 - protein, 17 aa, Mycobacterium bovis
TNTLALATSPYLRQHAD

SEQ ID NO: 227012 - protein, 17 aa, Mycobacterium bovis
TNVLTHPGTFGLAGAAI

SEQ ID NO: 227013 - protein, 18 aa, Mycobacterium bovis
TNVLTHPGTFGLAGAAIS

SEQ ID NO: 227014 - protein, 19 aa, Mycobacterium bovis
TNYAVLLPTVDIALALVTT

SEQ ID NO: 227015 - protein, 23 aa, Mycobacterium bovis
TPAPGLPADLLIHNRWHRDPHGS

SEQ ID NO: 227016 - protein, 17 aa, Mycobacterium bovis
TPFNGPLGRLRNIAYTQ

SEQ ID NO: 227017 - protein, 29 aa, Mycobacterium bovis
TPGGAGGDGGLLFGSGGNGAPGAPGQAGG

SEQ ID NO: 227018 - protein, 30 aa, Mycobacterium bovis
TPGGAGGDGGLLFGSGGNGAPGAPGQAGGA

SEQ ID NO: 227019 - protein, 31 aa, Mycobacterium bovis
TPGRAQFHYLESWLLPSLGLRATVFHFNPSH

SEQ ID NO: 227020 - protein, 26 aa, Mycobacterium bovis
TPNGRPFFCGTYYPKAAFLQLLSAIS

SEQ ID NO: 227021 - protein, 18 aa, Mycobacterium bovis
TPPAELFLVELRGPSGDT

SEQ ID NO: 227022 - protein, 18 aa, Mycobacterium bovis
TPPFAIDPIGLSGFTLPQ

SEQ ID NO: 227023 - protein, 18 aa, Mycobacterium bovis
TPPLTVPGIHLPSTTIGA

SEQ ID NO: 227024 - protein, 24 aa, Mycobacterium bovis
TPSSKLGGLWKTVSPHLSPISNIV

SEQ ID NO: 227025 - protein, 27 aa, Mycobacterium bovis
TQETFLRAIGAIPRFSARSSARTWLLA

SEQ ID NO: 227026 - protein, 33 aa, Mycobacterium bovis
TQGWLRNPERVWGWYLWRHYLVANVEPNDGHRA

SEQ ID NO: 227027 - protein, 19 aa, Mycobacterium bovis
TRAALRTCMHHKRFGELRE

SEQ ID NO: 227028 - protein, 17 aa, Mycobacterium bovis
TRDRLLIVTLADVASRV

SEQ ID NO: 227029 - protein, 17 aa, Mycobacterium bovis
TRHGLSSLLAERGRAAT

SEQ ID NO: 227030 - protein, 25 aa, Mycobacterium bovis
TRIGLTYPALFGFLRIATSARVLAA

SEQ ID NO: 227031 - protein, 18 aa, Mycobacterium bovis
TRIQPWMQAIADATGRPV

SEQ ID NO: 227032 - protein, 29 aa, Mycobacterium bovis
TRSLAWELSWKDTAAPLWTFPRVAWEREL

SEQ ID NO: 227033 - protein, 19 aa, Mycobacterium bovis
TSVHTLQQAALNVVNEPFQ

SEQ ID NO: 227034 - protein, 26 aa, Mycobacterium bovis
TTLDDPFGYGRILRTQDHGVMAIVEQ

SEQ ID NO: 227035 - protein, 31 aa, Mycobacterium bovis
TTPGGAGGDGGLLFGSGGNGAPGAPGQAGGA

SEQ ID NO: 227036 - protein, 25 aa, Mycobacterium bovis
TTPSSKLGGLWKTVSPHLSPISNMV

SEQ ID NO: 227037 - protein, 42 aa, Mycobacterium bovis
TTQVLAAGADEVSARIAALFGMYGLEYQAISAQVAAYHQQFV

SEQ ID NO: 227038 - protein, 18 aa, Mycobacterium bovis
TTTLSKFLRKPRNAGLRA

SEQ ID NO: 227039 - protein, 18 aa, Mycobacterium bovis
TVATIVRRHWPTPSLARV

SEQ ID NO: 227040 - protein, 25 aa, Mycobacterium bovis
TVEPSAPLPAFWVNIARKKILHAAT

SEQ ID NO: 227041 - protein, 19 aa, Mycobacterium bovis
TVHAALRAALRASAARSLM

SEQ ID NO: 227042 - protein, 25 aa, Mycobacterium bovis
TVPGPLQGINFGFGNIGSLNLGSGN

SEQ ID NO: 227043 - protein, 25 aa, Mycobacterium bovis
TVPGVPISRIPLTINIRIPVNITLN

SEQ ID NO: 227044 - protein, 26 aa, Mycobacterium bovis
TVPGVPISRIPLTINIRIPVNITLNE

SEQ ID NO: 227045 - protein, 37 aa, Mycobacterium bovis
TVPGVPISRIPLTINIRIPVNITLNELPFNVAGIFTG

SEQ ID NO: 227046 - protein, 32 aa, Mycobacterium bovis
TVSAQVATFHDRFVQTLSAAASSYVAAEAVNV

SEQ ID NO: 227047 - protein, 23 aa, Mycobacterium bovis
TVVPATVLTLVRTLLRAREGRTM

SEQ ID NO: 227048 - protein, 23 aa, Mycobacterium bovis
TWPGGRQYLPKAVIGATTRAFDG

SEQ ID NO: 227049 - protein, 19 aa, Mycobacterium bovis
VAALFSRRGFNIESLAVGA

SEQ ID NO: 227050 - protein, 17 aa, Mycobacterium bovis
VAELAHRFAQSSTVLFL

SEQ ID NO: 227051 - protein, 21 aa, Mycobacterium bovis
VAVARLVLGPGMRIQAPPNLV

SEQ ID NO: 227052 - protein, 25 aa, Mycobacterium bovis
VAVRRISMSFVNVAPQLVSTAAADA

SEQ ID NO: 227053 - protein, 26 aa, Mycobacterium bovis
VAVRRISMSFVNVAPQLVSTAAADAA

SEQ ID NO: 227054 - protein, 17 aa, Mycobacterium bovis
VCKACHGVAILADNIEP

SEQ ID NO: 227055 - protein, 24 aa, Mycobacterium bovis
VCTLGYVDPALKIAFTAGHCRGGG

SEQ ID NO: 227056 - protein, 22 aa, Mycobacterium bovis
VDDALWRRFKAAQDSFFTARNA

SEQ ID NO: 227057 - protein, 20 aa, Mycobacterium bovis
VDGDLLRLGDLALPVAPGSG

SEQ ID NO: 227058 - protein, 25 aa, Mycobacterium bovis
VDSYADDWTQLWWVRADGVAAIHRD

SEQ ID NO: 227059 - protein, 27 aa, Mycobacterium bovis
VDTQGGFLIPAALDPAILLSGDGSTNP

SEQ ID NO: 227060 - protein, 26 aa, Mycobacterium bovis
VEDVFPLPRELVGEGTLFLLKVIGDS

SEQ ID NO: 227061 - protein, 17 aa, Mycobacterium bovis
VELPRLEDIEPGAHTDV

SEQ ID NO: 227062 - protein, 31 aa, Mycobacterium bovis
VELSPSLRRPQPLFSLVNFFDAQVGPLSAVT

SEQ ID NO: 227063 - protein, 25 aa, Mycobacterium bovis
VEPAPTIRALYHKILRQLPMDDLVG

SEQ ID NO: 227064 - protein, 19 aa, Mycobacterium bovis
VEVICAELLRLRDWFVSAA

SEQ ID NO: 227065 - protein, 19 aa, Mycobacterium bovis
VFSVEFLVHAWDYAVAVGS

SEQ ID NO: 227066 - protein, 24 aa, Mycobacterium bovis
VFTRAALPAIRPVNHLVVDGRVIV

SEQ ID NO: 227067 - protein, 18 aa, Mycobacterium bovis
VFTTAYYAFIHLADVQPG

SEQ ID NO: 227068 - protein, 34 aa, Mycobacterium bovis
VGFGGYVALPAYLAARGLPLPPRRRRRIPVVIHE

SEQ ID NO: 227069 - protein, 26 aa, Mycobacterium bovis
VGGRGGDGVFAGAGGQGGLGGQGGNG

SEQ ID NO: 227070 - protein, 29 aa, Mycobacterium bovis
VGKPEQNAWWWDVLKFGRSSAYAEFFDID

SEQ ID NO: 227071 - protein, 20 aa, Mycobacterium bovis
VGLVPLPSKWRIAFGEPICT

SEQ ID NO: 227072 - protein, 17 aa, Mycobacterium bovis
VGRLSVPAAWSTAAPAT

SEQ ID NO: 227073 - protein, 17 aa, Mycobacterium bovis
VGSYQRMATITDSFQQL

SEQ ID NO: 227074 - protein, 35 aa, Mycobacterium bovis
VGTHLFNAMPPLDHRAPGPVLALLCDPRVTVEIIA

SEQ ID NO: 227075 - protein, 33 aa, Mycobacterium bovis
VGVAGQGGAGGKGAIPAMKGATGADGTAPTSGG

SEQ ID NO: 227076 - protein, 30 aa, Mycobacterium bovis
VGVRRAIGMVFQRPNPFPAMSIRNNVVAGL

SEQ ID NO: 227077 - protein, 27 aa, Mycobacterium bovis
VHIQGISPPLFRRPLEPAVQAAVASCR

SEQ ID NO: 227078 - protein, 19 aa, Mycobacterium bovis
VHPWGLYLARPTPGRAQFH

SEQ ID NO: 227079 - protein, 27 aa, Mycobacterium bovis
VIAPTPERPIIFNLPATVEMTTPNVYA

SEQ ID NO: 227080 - protein, 22 aa, Mycobacterium bovis
VITEQEWLAHWPTAVNDSRGGS

SEQ ID NO: 227081 - protein, 22 aa, Mycobacterium bovis
VITRVRLRVHRIPESTRYEAWS

SEQ ID NO: 227082 - protein, 17 aa, Mycobacterium bovis
VIVRDWYSIRHYALTED

SEQ ID NO: 227083 - protein, 28 aa, Mycobacterium bovis
VKDGYGRNFLLPRGLAIVASRGAQKQAD

SEQ ID NO: 227084 - protein, 18 aa, Mycobacterium bovis
VLAFVNRALAGVLALSIE

SEQ ID NO: 227085 - protein, 17 aa, Mycobacterium bovis
VLARDRVLSARGLDVLL

SEQ ID NO: 227086 - protein, 17 aa, Mycobacterium bovis
VLGGAVALLRDLLNPDE

SEQ ID NO: 227087 - protein, 18 aa, Mycobacterium bovis
VLGPGMRIQAPPNLVSGD

SEQ ID NO: 227088 - protein, 17 aa, Mycobacterium bovis
VLGQALLARRMGKTRVI

SEQ ID NO: 227089 - protein, 17 aa, Mycobacterium bovis
VLVCPYHHRAHHRGLIT

SEQ ID NO: 227090 - protein, 34 aa, Mycobacterium bovis
VMNFSVLPPEINSALMFAGAGPGPMLAAASAWTG

SEQ ID NO: 227091 - protein, 24 aa, Mycobacterium bovis
VPALLRVRFPWPPFEPDVRLSPYL

SEQ ID NO: 227092 - protein, 18 aa, Mycobacterium bovis
VPGAYVAGWIKRGPTGFI

SEQ ID NO: 227093 - protein, 33 aa, Mycobacterium bovis
VPIAVTDWFGDQPFAVWPWAAPKLGGARPAVLN

SEQ ID NO: 227094 - protein, 19 aa, Mycobacterium bovis
VPNAIPLAGLLADAPHGSK

SEQ ID NO: 227095 - protein, 17 aa, Mycobacterium bovis
VPNDYGLKIERAIDAYL

SEQ ID NO: 227096 - protein, 25 aa, Mycobacterium bovis
VPNYRGSCWIPFSIELEGDAASFVG

SEQ ID NO: 227097 - protein, 18 aa, Mycobacterium bovis
VQDPARLPEALVSARREA

SEQ ID NO: 227098 - protein, 18 aa, Mycobacterium bovis
VQFDPLTRLTNSDIIACI

SEQ ID NO: 227099 - protein, 22 aa, Mycobacterium bovis
VQLVFALVPFRFRKHPRARAGW

SEQ ID NO: 227100 - protein, 18 aa, Mycobacterium bovis
VQTLPAGPAGRWPAYDMR

SEQ ID NO: 227101 - protein, 27 aa, Mycobacterium bovis
VRAPADLLSGYYHAVHKLTLEYIAGMT

SEQ ID NO: 227102 - protein, 20 aa, Mycobacterium bovis
VRDWYSIRHYALTEDGRCQA

SEQ ID NO: 227103 - protein, 18 aa, Mycobacterium bovis
VRGAEVVDLLAALNTGHE

SEQ ID NO: 227104 - protein, 25 aa, Mycobacterium bovis
VRGGKQPRILFATQATARPPTFVLF

SEQ ID NO: 227105 - protein, 20 aa, Mycobacterium bovis
VRMFDVVPNPAWVARPGKYA

SEQ ID NO: 227106 - protein, 25 aa, Mycobacterium bovis
VRQPPPRLANLLPLIRPHEHMPDSV

SEQ ID NO: 227107 - protein, 22 aa, Mycobacterium bovis
VRVIRTLRRLGIRSVAVYSDPD

SEQ ID NO: 227108 - protein, 20 aa, Mycobacterium bovis
VRYLSGFSGSNGALLVFADE

SEQ ID NO: 227109 - protein, 24 aa, Mycobacterium bovis
VSDEFFSLFLDPTMAYTCAYFERE

SEQ ID NO: 227110 - protein, 21 aa, Mycobacterium bovis
VSLAILPRSVTALIGPSGCGK

SEQ ID NO: 227111 - protein, 17 aa, Mycobacterium bovis
VSLTLMARLAEAVRPGA

SEQ ID NO: 227112 - protein, 19 aa, Mycobacterium bovis
VSNALRMPPRAYVMPRVPA

SEQ ID NO: 227113 - protein, 18 aa, Mycobacterium bovis
VSNLRKLLGGAGIDPRVV

SEQ ID NO: 227114 - protein, 39 aa, Mycobacterium bovis
VSYSLIREVLRLYHRTGEKLIITFAMPAYAKMVMNFGRF

SEQ ID NO: 227115 - protein, 32 aa, Mycobacterium bovis
VTATNHPLVLGDWKQFLIVDRVGSMVELVPHL

SEQ ID NO: 227116 - protein, 27 aa, Mycobacterium bovis
VTDSMPALHMLPLADALGVLPVLATDV

SEQ ID NO: 227117 - protein, 19 aa, Mycobacterium bovis
VTHDRWFLDEVATTTWEVH

SEQ ID NO: 227118 - protein, 18 aa, Mycobacterium bovis
VTPILPMIRAAEQRGIDW

SEQ ID NO: 227119 - protein, 18 aa, Mycobacterium bovis
VTSPLAITMGFAACEAAQ

SEQ ID NO: 227120 - protein, 24 aa, Mycobacterium bovis
VTVVDPQWVWPISPALTELAGRHR

SEQ ID NO: 227121 - protein, 20 aa, Mycobacterium bovis
VVAGVLFLENIIVPGLTVSG

SEQ ID NO: 227122 - protein, 29 aa, Mycobacterium bovis
VVPDITIPGIPLSLNALGGVGPITVPGVP

SEQ ID NO: 227123 - protein, 18 aa, Mycobacterium bovis
VVPPGDLRMALAALASDS

SEQ ID NO: 227124 - protein, 23 aa, Mycobacterium bovis
VVRAFFNVVPFAVRARQSQPTGM

SEQ ID NO: 227125 - protein, 17 aa, Mycobacterium bovis
VVRVLGAIEIPVVAQEL

SEQ ID NO: 227126 - protein, 23 aa, Mycobacterium bovis
VVSKPAALVHGMFVALPAATADA

SEQ ID NO: 227127 - protein, 26 aa, Mycobacterium bovis
VVSQRGWRHWVHALTRINLGLSPDEK

SEQ ID NO: 227128 - protein, 31 aa, Mycobacterium bovis
VVVIGRGVTVGRPLGLLLTRRSENATVTLCH

SEQ ID NO: 227129 - protein, 17 aa, Mycobacterium bovis
VVYPRHGAALVEAIETR

SEQ ID NO: 227130 - protein, 19 aa, Mycobacterium bovis
VVYWWRGSGGGPRVGLIIA

SEQ ID NO: 227131 - protein, 19 aa, Mycobacterium bovis
VWGGFPAAVSWRSTSEQVH

SEQ ID NO: 227132 - protein, 20 aa, Mycobacterium bovis
WAEDLLAEPLQFSIVLGVRG

SEQ ID NO: 227133 - protein, 17 aa, Mycobacterium bovis
WAYWVAESLLGPGTQLA

SEQ ID NO: 227134 - protein, 18 aa, Mycobacterium bovis
WDGLADELAVAASWFGSV

SEQ ID NO: 227135 - protein, 19 aa, Mycobacterium bovis
WFIDADWTPLLAAELRYHG

SEQ ID NO: 227136 - protein, 18 aa, Mycobacterium bovis
WHRLQATDEIYFVLSGRG

SEQ ID NO: 227137 - protein, 17 aa, Mycobacterium bovis
WLGMGIELLDTAPAFAQ

SEQ ID NO: 227138 - protein, 19 aa, Mycobacterium bovis
WPYGLPELPGARDQLRGTR

SEQ ID NO: 227139 - protein, 17 aa, Mycobacterium bovis
WQCTIPLGPDPDDEGDI

SEQ ID NO: 227140 - protein, 19 aa, Mycobacterium bovis
WTQRLVSLLVFDGPDLPGP

SEQ ID NO: 227141 - protein, 20 aa, Mycobacterium bovis
WTQRLVSLLVFDGPDLPGPL

SEQ ID NO: 227142 - protein, 21 aa, Mycobacterium bovis
WVDDYPVMLINANAAPDRKRL

SEQ ID NO: 227143 - protein, 18 aa, Mycobacterium bovis
WVMQLCHPDIREKFPPLR

SEQ ID NO: 227144 - protein, 19 aa, Mycobacterium bovis
YAEMWAQDALAMYGYAAAS

SEQ ID NO: 227145 - protein, 19 aa, Mycobacterium bovis
YAPMMHPWSTGKDVYFSLS

SEQ ID NO: 227146 - protein, 21 aa, Mycobacterium bovis
YASVEAANASPLQVALDVINA

SEQ ID NO: 227147 - protein, 19 aa, Mycobacterium bovis
YCRTHHLVKTFWGWRDQQL

SEQ ID NO: 227148 - protein, 17 aa, Mycobacterium bovis
YEPFGLVALEAAAAGTP

SEQ ID NO: 227149 - protein, 24 aa, Mycobacterium bovis
YETAYGLTVPPPVIAENRAELMIL

SEQ ID NO: 227150 - protein, 24 aa, Mycobacterium bovis
YFAGYAMWNYLTTPYLLTREGVAV

SEQ ID NO: 227151 - protein, 18 aa, Mycobacterium bovis
YFPGWLLQRRKRAERALT

SEQ ID NO: 227152 - protein, 17 aa, Mycobacterium bovis
YFRLLTRWVGGGFRVPG

SEQ ID NO: 227153 - protein, 29 aa, Mycobacterium bovis
YFSRQRLRDLGLWGLTNFDRVDFVYTDVH

SEQ ID NO: 227154 - protein, 25 aa, Mycobacterium bovis
YGEQRDFLFALWDTLDLGDHVVLVL

SEQ ID NO: 227155 - protein, 18 aa, Mycobacterium bovis
YGSFHAVADVSLAILPRS

SEQ ID NO: 227156 - protein, 29 aa, Mycobacterium bovis
YNHYPIGWAMAFNTPYKLFKRYASHEGGI

SEQ ID NO: 227157 - protein, 18 aa, Mycobacterium bovis
YNLILSNVPGPQAQLYFL

SEQ ID NO: 227158 - protein, 23 aa, Mycobacterium bovis
YQDKLLHVAGIGWHSWDGRRWAA

SEQ ID NO: 227159 - protein, 19 aa, Mycobacterium bovis
YRTFQTREMLRWLRGEYND

SEQ ID NO: 227160 - protein, 17 aa, Mycobacterium bovis
YRVGAAYEAARGPLLSA

SEQ ID NO: 227161 - protein, 27 aa, Mycobacterium bovis
YTLTGPIVIGSFFLPAFNIPGIDVPAI

SEQ ID NO: 227162 - protein, 18 aa, Mycobacterium bovis
YTVQAFRERLGVGGLRDL

SEQ ID NO: 227163 - protein, 20 aa, Mycobacterium bovis
YVRVPYRARVPMTRAALMHR

SEQ ID NO: 227164 - protein, 21 aa, Mycobacterium bovis
YVSPFHQLAGYYLIRAPRPDR

SEQ ID NO: 227165 - protein, 21 aa, Mycobacterium bovis
YYGGLQFTAGTWRANGGSGSA

SEQ ID NO: 227166 - protein, 20 aa, Mycobacterium bovis
EMQRLGREPLLPALEAELPL

SEQ ID NO: 227167 - protein, 20 aa, Mycobacterium bovis
PRLFGALFAPLGWCAKYTPG

SEQ ID NO: 227168 - protein, 19 aa, Mycobacterium bovis
RQLYDLDALPDHLIVVGSG

SEQ ID NO: 227169 - protein, 23 aa, Mycobacterium bovis
AAMVVAAAPYAGWLAAAAARAGG

SEQ ID NO: 227170 - protein, 19 aa, Mycobacterium bovis
AFNFPVAVWAWNTAVALVC

SEQ ID NO: 227171 - protein, 27 aa, Mycobacterium bovis
APHLVKPLPFLFPLTKRWWERPYIAAG

SEQ ID NO: 227172 - protein, 18 aa, Mycobacterium bovis
AQPWSLRYPLVDGQGNFG

SEQ ID NO: 227173 - protein, 31 aa, Mycobacterium bovis
EAAATSPLLAPINEFFLANTGRPLIGNGANG

SEQ ID NO: 227174 - protein, 19 aa, Mycobacterium bovis
FLARRQLFDPALLAQARAI

SEQ ID NO: 227175 - protein, 31 aa, Mycobacterium bovis
GQHISTLLLTLLFRFMRPLIENGHVFLAQPP

SEQ ID NO: 227176 - protein, 17 aa, Mycobacterium bovis
LADLSFADYLMWVRRND

SEQ ID NO: 227177 - protein, 19 aa, Mycobacterium bovis
LDIARWRRRRREELAALAD

SEQ ID NO: 227178 - protein, 26 aa, Mycobacterium bovis
LRTEKSVMFVIPWGSHWIIGTTDTDW

SEQ ID NO: 227179 - protein, 18 aa, Mycobacterium bovis
PEINSGRMFFGAGSGPML

SEQ ID NO: 227180 - protein, 29 aa, Mycobacterium bovis
PHILTLSPPILLEKKWLRPTAYMMAKYGM

SEQ ID NO: 227181 - protein, 24 aa, Mycobacterium bovis
QVVSIPTLILFKDGQPVKRIVGAK

SEQ ID NO: 227182 - protein, 18 aa, Mycobacterium bovis
SMFQAILPLRGKIINVEK

SEQ ID NO: 227183 - protein, 20 aa, Mycobacterium bovis
TDPVLAWLYVLDAWEGGLPS

SEQ ID NO: 227184 - protein, 24 aa, Mycobacterium bovis
VERDLRVIIHGWLAFTFELCRQRI

SEQ ID NO: 227185 - protein, 18 aa, Mycobacterium bovis
WPLGWGFDHFWGFPSGAA

SEQ ID NO: 227186 - protein, 24 aa, Mycobacterium bovis
WSNPNDWWLVRLLGSITPTERTTI

SEQ ID NO: 227187 - protein, 21 aa, Mycobacterium bovis
AAAAAPYAGWLGSVAAAAEAV

SEQ ID NO: 227188 - protein, 25 aa, Mycobacterium bovis
AAAALAPWQQAVPGLLGLLDSAQSS

SEQ ID NO: 227189 - protein, 19 aa, Mycobacterium bovis
AAAAPYAGWLSAAAARAAG

SEQ ID NO: 227190 - protein, 23 aa, Mycobacterium bovis
AAALAFPSLSSSVPILGPYEDLI

SEQ ID NO: 227191 - protein, 19 aa, Mycobacterium bovis
AAATPYVGWLAATAALAKE

SEQ ID NO: 227192 - protein, 25 aa, Mycobacterium bovis
AAAVPVVFLTAWYGLADLAEIKAGE

SEQ ID NO: 227193 - protein, 24 aa, Mycobacterium bovis
AADWAEMLMRMYIRWAEQHKYPVE

SEQ ID NO: 227194 - protein, 20 aa, Mycobacterium bovis
AAFHQQFVRALSSAAGSYAA

SEQ ID NO: 227195 - protein, 17 aa, Mycobacterium bovis
AAFLEYLDMFYNLGIAG

SEQ ID NO: 227196 - protein, 20 aa, Mycobacterium bovis
AAGDGFARYWLHNGWVTMGG

SEQ ID NO: 227197 - protein, 21 aa, Mycobacterium bovis
AAHFLEHLLFKSTPTRSAVDI

SEQ ID NO: 227198 - protein, 17 aa, Mycobacterium bovis
AAILGLLPAGGRITAGR

SEQ ID NO: 227199 - protein, 25 aa, Mycobacterium bovis
AAINAPTQALLGRPLIGNGADGAPG

SEQ ID NO: 227200 - protein, 17 aa, Mycobacterium bovis
AAKDWLCLLEAFDAPQR

SEQ ID NO: 227201 - protein, 17 aa, Mycobacterium bovis
AANPPMIRYPIPPMIHG

SEQ ID NO: 227202 - protein, 17 aa, Mycobacterium bovis
AAQFIRYEKPRSWLNSG

SEQ ID NO: 227203 - protein, 29 aa, Mycobacterium bovis
AAQVAAFHSRFVQALTAGAGAYAFAEAAN

SEQ ID NO: 227204 - protein, 23 aa, Mycobacterium bovis
AARDVDWWLTFSSAAALLGTPGQ

SEQ ID NO: 227205 - protein, 23 aa, Mycobacterium bovis
AARLDLAAVFLYAGSILPGRAKL

SEQ ID NO: 227206 - protein, 22 aa, Mycobacterium bovis
AASAFAMWFPIEGGSKYGGYGR

SEQ ID NO: 227207 - protein, 21 aa, Mycobacterium bovis
AATVHPLLVAANRNAFAQLVM

SEQ ID NO: 227208 - protein, 20 aa, Mycobacterium bovis
AAVAPYLGWLAAAAAQAQRS

SEQ ID NO: 227209 - protein, 24 aa, Mycobacterium bovis
AAVHRLVTRLGLVTRLGLVERVDA

SEQ ID NO: 227210 - protein, 20 aa, Mycobacterium bovis
AAVPVLVHPAPRGVLGGLAA

SEQ ID NO: 227211 - protein, 19 aa, Mycobacterium bovis
AAVSGLVTALFGAPGQPGD

SEQ ID NO: 227212 - protein, 19 aa, Mycobacterium bovis
AAWPATLDRVLAIGGPDAS

SEQ ID NO: 227213 - protein, 22 aa, Mycobacterium bovis
ACELYDLPTLWQIAAHNPWLSV

SEQ ID NO: 227214 - protein, 24 aa, Mycobacterium bovis
ADCELDWWLGFSSAASLLGSPGQA

SEQ ID NO: 227215 - protein, 23 aa, Mycobacterium bovis
ADDVFITYPLWIGTRQADRLRQL

SEQ ID NO: 227216 - protein, 22 aa, Mycobacterium bovis
ADLPAFAELLARLPWPLNKTTS

SEQ ID NO: 227217 - protein, 20 aa, Mycobacterium bovis
ADLTWLLSRWACVFGTPACQ

SEQ ID NO: 227218 - protein, 24 aa, Mycobacterium bovis
ADMPPPFRSLTPIPVHWVAAAVLD

SEQ ID NO: 227219 - protein, 21 aa, Mycobacterium bovis
ADVIRYLRWFTFLSADELAEL

SEQ ID NO: 227220 - protein, 21 aa, Mycobacterium bovis
ADYSGFIWFPKLPALDRWLDL

SEQ ID NO: 227221 - protein, 20 aa, Mycobacterium bovis
AEALRWAMMRGEPLVVLADA

SEQ ID NO: 227222 - protein, 19 aa, Mycobacterium bovis
AEGLRALYLYTATFQDAAV

SEQ ID NO: 227223 - protein, 23 aa, Mycobacterium bovis
AELDRVWGHLPFGAQWYSANELA

SEQ ID NO: 227224 - protein, 27 aa, Mycobacterium bovis
AESPRETWLRLLLIRAGFPRPQTQIPV

SEQ ID NO: 227225 - protein, 22 aa, Mycobacterium bovis
AEVHPHWIVLRTVIDVINPIEL

SEQ ID NO: 227226 - protein, 24 aa, Mycobacterium bovis
AEYSLDLFALLPLGELWVAAARMR

SEQ ID NO: 227227 - protein, 19 aa, Mycobacterium bovis
AFHDRFVQLLNAGGGSYAS

SEQ ID NO: 227228 - protein, 21 aa, Mycobacterium bovis
AFHERFIQALSTAAGAYGSAE

SEQ ID NO: 227229 - protein, 19 aa, Mycobacterium bovis
AFHSRFVQALTTAAASYAS

SEQ ID NO: 227230 - protein, 17 aa, Mycobacterium bovis
AFLQKRPPRWVQPATMR

SEQ ID NO: 227231 - protein, 18 aa, Mycobacterium bovis
AFPQWFGRSWRRVAMLRY

SEQ ID NO: 227232 - protein, 20 aa, Mycobacterium bovis
AFTASPFRWLSWLSDSGATM

SEQ ID NO: 227233 - protein, 20 aa, Mycobacterium bovis
AGAPVLFAAGLFLGADRAAG

SEQ ID NO: 227234 - protein, 24 aa, Mycobacterium bovis
AGGQAALLFGRGGTGGAGGYGGDG

SEQ ID NO: 227235 - protein, 18 aa, Mycobacterium bovis
AGPIWPLDTCLFVRDFKG

SEQ ID NO: 227236 - protein, 18 aa, Mycobacterium bovis
AGQLLPRRAAQKFADFAN

SEQ ID NO: 227237 - protein, 21 aa, Mycobacterium bovis
AGSIGLFLEPFRLSDPFITID

SEQ ID NO: 227238 - protein, 19 aa, Mycobacterium bovis
AGSLWRLEFLLQSTQDPSL

SEQ ID NO: 227239 - protein, 20 aa, Mycobacterium bovis
AHGTLFSSLAGTGGTGGNGG

SEQ ID NO: 227240 - protein, 22 aa, Mycobacterium bovis
AHHRLFSHVPWLASQLLGAVEA

SEQ ID NO: 227241 - protein, 29 aa, Mycobacterium bovis
AHYAITVPQIPLLNFSLNIPVNIPIHLDF

SEQ ID NO: 227242 - protein, 23 aa, Mycobacterium bovis
AIDPVLLDLLRLGTYQLLRTRVD

SEQ ID NO: 227243 - protein, 17 aa, Mycobacterium bovis
AIKALWDTILPFADYAF

SEQ ID NO: 227244 - protein, 18 aa, Mycobacterium bovis
AILPLYYLRRAGIAESDL

SEQ ID NO: 227245 - protein, 24 aa, Mycobacterium bovis
AKAAPLWRVLVALSIRHVGPTAAR

SEQ ID NO: 227246 - protein, 25 aa, Mycobacterium bovis
AKHPGYVHSFPPMPLQPKGFMTPDE

SEQ ID NO: 227247 - protein, 23 aa, Mycobacterium bovis
ALAGAMRPPAPPAAPPGAPGMPG

SEQ ID NO: 227248 - protein, 27 aa, Mycobacterium bovis
ALDIDLVFSPFFNALPIRRLGLHERAE

SEQ ID NO: 227249 - protein, 18 aa, Mycobacterium bovis
ALDPLAGSIGLFLEPFRL

SEQ ID NO: 227250 - protein, 23 aa, Mycobacterium bovis
ALDRALIDLATYFRDALLVAAHA

SEQ ID NO: 227251 - protein, 22 aa, Mycobacterium bovis
ALEDWCHQLAWPIRPAVSADPP

SEQ ID NO: 227252 - protein, 19 aa, Mycobacterium bovis
ALFRMWLRDAVRRVATGVL

SEQ ID NO: 227253 - protein, 21 aa, Mycobacterium bovis
ALFVFRPLLNLALRRFLRNLR

SEQ ID NO: 227254 - protein, 23 aa, Mycobacterium bovis
ALPFGDRLMALPINLLWNGQSVS

SEQ ID NO: 227255 - protein, 21 aa, Mycobacterium bovis
ALRDRLIVELLYATGIRVSEL

SEQ ID NO: 227256 - protein, 18 aa, Mycobacterium bovis
ALRLGIARALILVSPEDR

SEQ ID NO: 227257 - protein, 18 aa, Mycobacterium bovis
ALRPIIDRAYQPGPAPAV

SEQ ID NO: 227258 - protein, 19 aa, Mycobacterium bovis
ALTAHLLPLLRAAQRARVV

SEQ ID NO: 227259 - protein, 18 aa, Mycobacterium bovis
ALTALWRSYGVTPDAVIG

SEQ ID NO: 227260 - protein, 19 aa, Mycobacterium bovis
ALVNLVRRLATPAWLSYTI

SEQ ID NO: 227261 - protein, 18 aa, Mycobacterium bovis
AMRPLRHTLSQLRLHELL

SEQ ID NO: 227262 - protein, 23 aa, Mycobacterium bovis
ANAMSWFWYLMALNPQARDHMLT

SEQ ID NO: 227263 - protein, 21 aa, Mycobacterium bovis
ANELLLYEALGLCGPGEAPEL

SEQ ID NO: 227264 - protein, 18 aa, Mycobacterium bovis
APGLWRYWAEHLDPDRAR

SEQ ID NO: 227265 - protein, 21 aa, Mycobacterium bovis
APGRWTLIRWGPAGSLVLRIT

SEQ ID NO: 227266 - protein, 25 aa, Mycobacterium bovis
APKGWGWVAPYIGMIWPNGDSTKLR

SEQ ID NO: 227267 - protein, 33 aa, Mycobacterium bovis
APLEGLLNIVNTPTQLLLGRPLIGNGANGAPGT

SEQ ID NO: 227268 - protein, 17 aa, Mycobacterium bovis
APLFKHYRHIYLRPFRY

SEQ ID NO: 227269 - protein, 18 aa, Mycobacterium bovis
APPRILWLDTAAPAKLIL

SEQ ID NO: 227270 - protein, 24 aa, Mycobacterium bovis
APVRYRFHFPRQQRGRFLCIADFI

SEQ ID NO: 227271 - protein, 20 aa, Mycobacterium bovis
AQLVGWLEGLFHGIQTALFA

SEQ ID NO: 227272 - protein, 23 aa, Mycobacterium bovis
ARFPGFYIPFLDVPFNGATPANS

SEQ ID NO: 227273 - protein, 18 aa, Mycobacterium bovis
ARLWALVRRQSLSRFERL

SEQ ID NO: 227274 - protein, 18 aa, Mycobacterium bovis
ARPQLKKFYGERLERLYT

SEQ ID NO: 227275 - protein, 22 aa, Mycobacterium bovis
ARQRLMCRLPKRPDPHAWLGDA

SEQ ID NO: 227276 - protein, 25 aa, Mycobacterium bovis
ARRLALLLTFPRFLPTTGPITMRST

SEQ ID NO: 227277 - protein, 25 aa, Mycobacterium bovis
ARTVFIELLAWQFASPVRWIETQDL

SEQ ID NO: 227278 - protein, 20 aa, Mycobacterium bovis
ASATLIWRRPRWARRLQPAP

SEQ ID NO: 227279 - protein, 22 aa, Mycobacterium bovis
ASCKYMKMITPAALLRCLVEGA

SEQ ID NO: 227280 - protein, 27 aa, Mycobacterium bovis
ASDLSNILLLGPVGDLFPILSIPGAMS

SEQ ID NO: 227281 - protein, 21 aa, Mycobacterium bovis
ASIGFPPYHPPMRTFLGVPVR

SEQ ID NO: 227282 - protein, 22 aa, Mycobacterium bovis
ASLRDFYIAYRAVVRAKVECVR

SEQ ID NO: 227283 - protein, 24 aa, Mycobacterium bovis
ASPPVKWPCFYGIDFPSPAELIAN

SEQ ID NO: 227284 - protein, 25 aa, Mycobacterium bovis
ASRRIKLAWFLLNAARYMPAQVFAA

SEQ ID NO: 227285 - protein, 18 aa, Mycobacterium bovis
ATGLIGSGGFGGAGGAAA

SEQ ID NO: 227286 - protein, 17 aa, Mycobacterium bovis
ATLLDYFPEDFLLVIDE

SEQ ID NO: 227287 - protein, 38 aa, Mycobacterium bovis
ATNVEQNLLNLINAPTQTLLGRPLIGDGANATTPGGAG

SEQ ID NO: 227288 - protein, 17 aa, Mycobacterium bovis
ATNYDVMFVPQGIGADL

SEQ ID NO: 227289 - protein, 28 aa, Mycobacterium bovis
ATPGWLEWFINWYLPISQLFYNTVGLPY

SEQ ID NO: 227290 - protein, 25 aa, Mycobacterium bovis
AVALPAFALPLRLPAGLAAGPAAVV

SEQ ID NO: 227291 - protein, 22 aa, Mycobacterium bovis
AVAMLVAIFRARPSPFYIMDEV

SEQ ID NO: 227292 - protein, 18 aa, Mycobacterium bovis
AVATQYLAWLSTAAAQAE

SEQ ID NO: 227293 - protein, 17 aa, Mycobacterium bovis
AVDPLLPEVAWSWLVDA

SEQ ID NO: 227294 - protein, 20 aa, Mycobacterium bovis
AVFNGFLPAVARMRALDPVT

SEQ ID NO: 227295 - protein, 18 aa, Mycobacterium bovis
AVGQLPLDFGASGLSAMS

SEQ ID NO: 227296 - protein, 19 aa, Mycobacterium bovis
AVGYLMPALGRPNLTLLAR

SEQ ID NO: 227297 - protein, 20 aa, Mycobacterium bovis
AVRLVRQIPYTLACDLLLTG

SEQ ID NO: 227298 - protein, 18 aa, Mycobacterium bovis
AVSALDLGLPLAAGNVVS

SEQ ID NO: 227299 - protein, 19 aa, Mycobacterium bovis
AVVMTYWNPVLRYGVDAFA

SEQ ID NO: 227300 - protein, 22 aa, Mycobacterium bovis
AWLDALVGWRRASGLPAAVINW

SEQ ID NO: 227301 - protein, 17 aa, Mycobacterium bovis
AWRGFSRWLMRAYDVLV

SEQ ID NO: 227302 - protein, 17 aa, Mycobacterium bovis
AWTTGLIRWEDDPQPGW

SEQ ID NO: 227303 - protein, 24 aa, Mycobacterium bovis
CAEDLFAGWWRLIEALGAVPRVLV

SEQ ID NO: 227304 - protein, 18 aa, Mycobacterium bovis
CAELLYRAGLPRALYAIV

SEQ ID NO: 227305 - protein, 21 aa, Mycobacterium bovis
CALPLHRRFGLAATARASFAV

SEQ ID NO: 227306 - protein, 18 aa, Mycobacterium bovis
CEEAPFYTLGPLATDIAP

SEQ ID NO: 227307 - protein, 19 aa, Mycobacterium bovis
CGALRRYHEALGVPISTLP

SEQ ID NO: 227308 - protein, 24 aa, Mycobacterium bovis
CGKYLVVMLELWLPLVAAAGDLDK

SEQ ID NO: 227309 - protein, 23 aa, Mycobacterium bovis
CGMFGNIIRLLPPLTIGDELLSE

SEQ ID NO: 227310 - protein, 17 aa, Mycobacterium bovis
CSSRFPYYLETYGFHSI

SEQ ID NO: 227311 - protein, 17 aa, Mycobacterium bovis
DALGRWLLARTAEIVAG

SEQ ID NO: 227312 - protein, 19 aa, Mycobacterium bovis
DAQTPTLLFPFAAPRVVGD

SEQ ID NO: 227313 - protein, 21 aa, Mycobacterium bovis
DAVNVVFMPTEPQAATGTAGS

SEQ ID NO: 227314 - protein, 22 aa, Mycobacterium bovis
DCARLLLQIPAVLGLAFDGGWW

SEQ ID NO: 227315 - protein, 23 aa, Mycobacterium bovis
DDALNLPWLAMGATGFISVIAHL

SEQ ID NO: 227316 - protein, 25 aa, Mycobacterium bovis
DDARWDAVLAVNLLAPLRLTEGLVG

SEQ ID NO: 227317 - protein, 23 aa, Mycobacterium bovis
DDELFFFAVLLLVAGYESTAHMI

SEQ ID NO: 227318 - protein, 18 aa, Mycobacterium bovis
DDFAKHPFLVKGYIGPKA

SEQ ID NO: 227319 - protein, 20 aa, Mycobacterium bovis
DDVFRAWWDLAGNRAGPPSM

SEQ ID NO: 227320 - protein, 19 aa, Mycobacterium bovis
DDYGPDLRRWLVARLGLTE

SEQ ID NO: 227321 - protein, 25 aa, Mycobacterium bovis
DDYLPCLVSIQFRLLPDGKDYVFHT

SEQ ID NO: 227322 - protein, 18 aa, Mycobacterium bovis
DECRIFLSMLGIGPAKLE

SEQ ID NO: 227323 - protein, 17 aa, Mycobacterium bovis
DELALPFAWQGVSLHAT

SEQ ID NO: 227324 - protein, 20 aa, Mycobacterium bovis
DFFALFLDPTWVYTCAYFER

SEQ ID NO: 227325 - protein, 25 aa, Mycobacterium bovis
DFLRTIHELLLSDGFWDEVFRELSI

SEQ ID NO: 227326 - protein, 23 aa, Mycobacterium bovis
DFTNIYFYTVLYHALRASNRIAI

SEQ ID NO: 227327 - protein, 17 aa, Mycobacterium bovis
DGTPFPTLYYLTHPVLT

SEQ ID NO: 227328 - protein, 21 aa, Mycobacterium bovis
DGVGHPFWFSRTVFGELARLH

SEQ ID NO: 227329 - protein, 17 aa, Mycobacterium bovis
DGYRWLRLLGYEPEQIV

SEQ ID NO: 227330 - protein, 21 aa, Mycobacterium bovis
DIDGLRYLDWLAAYSAVNLGH

SEQ ID NO: 227331 - protein, 18 aa, Mycobacterium bovis
DIDLYLRIAPELFLKRCI

SEQ ID NO: 227332 - protein, 22 aa, Mycobacterium bovis
DIFYYVYGLLHDPAYRTKYAAD

SEQ ID NO: 227333 - protein, 23 aa, Mycobacterium bovis
DIGWLRELWGGPFMLKGVMRVDD

SEQ ID NO: 227334 - protein, 17 aa, Mycobacterium bovis
DIQLAQLGKRLAQRRLQ

SEQ ID NO: 227335 - protein, 22 aa, Mycobacterium bovis
DIRINWVWNPPWGPDKITEDGR

SEQ ID NO: 227336 - protein, 17 aa, Mycobacterium bovis
DKRSLVFPVKRLADLGF

SEQ ID NO: 227337 - protein, 24 aa, Mycobacterium bovis
DKYARLFAWLGLWERHTDLAVIPV

SEQ ID NO: 227338 - protein, 20 aa, Mycobacterium bovis
DLAWSRITYWRALLTSAVDQ

SEQ ID NO: 227339 - protein, 20 aa, Mycobacterium bovis
DLAWTYHYPLPAVAPIAGLV

SEQ ID NO: 227340 - protein, 24 aa, Mycobacterium bovis
DLSTLRLIPWLPGTALVIADLVWA

SEQ ID NO: 227341 - protein, 19 aa, Mycobacterium bovis
DLTIGFFLHIPFPPVELFM

SEQ ID NO: 227342 - protein, 21 aa, Mycobacterium bovis
DLTIRWDTPPITLFPNGISAP

SEQ ID NO: 227343 - protein, 17 aa, Mycobacterium bovis
DMLLLIVAALEQSVLVS

SEQ ID NO: 227344 - protein, 21 aa, Mycobacterium bovis
DNALGFLYDTGLYLRFRATGP

SEQ ID NO: 227345 - protein, 19 aa, Mycobacterium bovis
DNEAKWFWFEGNFGAYEEN

SEQ ID NO: 227346 - protein, 22 aa, Mycobacterium bovis
DNPHPLLLLTHPVPNTGAVVVQ

SEQ ID NO: 227347 - protein, 25 aa, Mycobacterium bovis
DNPLHPLALPLLRPQQVIMLGRPTL

SEQ ID NO: 227348 - protein, 23 aa, Mycobacterium bovis
DNSTLAHLLKFDSILGRLPCDVG

SEQ ID NO: 227349 - protein, 24 aa, Mycobacterium bovis
DPHKVAMLGLTFDDVLLLPAASDV

SEQ ID NO: 227350 - protein, 22 aa, Mycobacterium bovis
DPHRYTFQYALDLQLQSLVRVI

SEQ ID NO: 227351 - protein, 26 aa, Mycobacterium bovis
DPPFEGMWWLYVPLAFDDFAVVLIIQ

SEQ ID NO: 227352 - protein, 22 aa, Mycobacterium bovis
DPRLWYYRFQTSAIGWNPGVNV

SEQ ID NO: 227353 - protein, 26 aa, Mycobacterium bovis
DPRNPSPVYLFAYDPMAFGGKGRAAI

SEQ ID NO: 227354 - protein, 27 aa, Mycobacterium bovis
DPWTVPKFYWTVLGLSALISGARALVP

SEQ ID NO: 227355 - protein, 22 aa, Mycobacterium bovis
DQFMTLAKMRALRQLWARVAEV

SEQ ID NO: 227356 - protein, 21 aa, Mycobacterium bovis
DQLGLPTAPFWFVGSLGELQA

SEQ ID NO: 227357 - protein, 22 aa, Mycobacterium bovis
DRDWLARQFDLAAGAPVGCGFI

SEQ ID NO: 227358 - protein, 17 aa, Mycobacterium bovis
DRFGTELPPLEGIYLAA

SEQ ID NO: 227359 - protein, 25 aa, Mycobacterium bovis
DRHSGWWRAPLRWTLRGSLALRSHL

SEQ ID NO: 227360 - protein, 24 aa, Mycobacterium bovis
DRIHQGWILTVLWVIDTGVTAATL

SEQ ID NO: 227361 - protein, 19 aa, Mycobacterium bovis
DRLPGVRLWLYTNFHCNLC

SEQ ID NO: 227362 - protein, 17 aa, Mycobacterium bovis
DRRKAFLEDLAVVTGGQ

SEQ ID NO: 227363 - protein, 21 aa, Mycobacterium bovis
DSRLPYLIRLPVGAGLVFATS

SEQ ID NO: 227364 - protein, 20 aa, Mycobacterium bovis
DSWIQIEQFRLLVLRTAWLI

SEQ ID NO: 227365 - protein, 21 aa, Mycobacterium bovis
DTFASYIAALLWFGEFSGCGI

SEQ ID NO: 227366 - protein, 24 aa, Mycobacterium bovis
DTKLGLFPFRRNLSFYAVDLGLLS

SEQ ID NO: 227367 - protein, 20 aa, Mycobacterium bovis
DTRAYFRGECLRRFGADIAA

SEQ ID NO: 227368 - protein, 25 aa, Mycobacterium bovis
DTRVEFWAFDLLYLDGRALLGTRYQ

SEQ ID NO: 227369 - protein, 23 aa, Mycobacterium bovis
DVANLAMFLLSDAASWITGQVIN

SEQ ID NO: 227370 - protein, 20 aa, Mycobacterium bovis
DVCLWLLRNDVCPDKLTWIM

SEQ ID NO: 227371 - protein, 25 aa, Mycobacterium bovis
DVERPHYMPLFVAPQPIPEPLADDE

SEQ ID NO: 227372 - protein, 20 aa, Mycobacterium bovis
DVFIGYLRRKLEAGGGPRLL

SEQ ID NO: 227373 - protein, 19 aa, Mycobacterium bovis
DVLDTWFSSALWPFSTLGW

SEQ ID NO: 227374 - protein, 18 aa, Mycobacterium bovis
DVLLFIDNIFRFTQAGSE

SEQ ID NO: 227375 - protein, 19 aa, Mycobacterium bovis
DVLLPFLVTRQLICGAGKV

SEQ ID NO: 227376 - protein, 24 aa, Mycobacterium bovis
DVMPEDLIKFGLIPEFIGRLPVVA

SEQ ID NO: 227377 - protein, 23 aa, Mycobacterium bovis
DVPTGVVVPYFWSDQYDVKIQCL

SEQ ID NO: 227378 - protein, 25 aa, Mycobacterium bovis
DVSLLPTLQSFLPPPFDAIPNPIED

SEQ ID NO: 227379 - protein, 17 aa, Mycobacterium bovis
DVTIVEFLPRALPNEDA

SEQ ID NO: 227380 - protein, 26 aa, Mycobacterium bovis
DWKCWARWRLIRARAPWLTRALVAED

SEQ ID NO: 227381 - protein, 17 aa, Mycobacterium bovis
DWRWRRRGFFGDHGGRW

SEQ ID NO: 227382 - protein, 19 aa, Mycobacterium bovis
DYVYPGHAIWWLARGLEFF

SEQ ID NO: 227383 - protein, 24 aa, Mycobacterium bovis
EAGPDALIVVLLPDGGRGYMSKIF

SEQ ID NO: 227384 - protein, 21 aa, Mycobacterium bovis
EAHIKVIRALFRPPARRGGCV

SEQ ID NO: 227385 - protein, 19 aa, Mycobacterium bovis
EALARVFDYTLAIGKTPIV

SEQ ID NO: 227386 - protein, 20 aa, Mycobacterium bovis
EALLALYRWRGPLINAGVGG

SEQ ID NO: 227387 - protein, 23 aa, Mycobacterium bovis
EAMALLRLPLVLPAVQIAGRIVG

SEQ ID NO: 227388 - protein, 31 aa, Mycobacterium bovis
EASTVFPQTFYLSGLFFFGPVNLSASTLTVP

SEQ ID NO: 227389 - protein, 19 aa, Mycobacterium bovis
EATRPLVICDLGMPRDVDP

SEQ ID NO: 227390 - protein, 23 aa, Mycobacterium bovis
EAYFAALLGLPFIAVMPAATSAS

SEQ ID NO: 227391 - protein, 20 aa, Mycobacterium bovis
EDRLLRLRWPCPVPGAMPIS

SEQ ID NO: 227392 - protein, 25 aa, Mycobacterium bovis
EERAHLLPVFRLRYLPTPLGLHHPI

SEQ ID NO: 227393 - protein, 23 aa, Mycobacterium bovis
EERSLWLHRALLSPLLTEPDTVV

SEQ ID NO: 227394 - protein, 22 aa, Mycobacterium bovis
EETRYWYYALLGFGLNRYRAGS

SEQ ID NO: 227395 - protein, 23 aa, Mycobacterium bovis
EEWLYQSWAAAYLPLLQVLAALA

SEQ ID NO: 227396 - protein, 18 aa, Mycobacterium bovis
EFAEVYPLLDWAAPYQEM

SEQ ID NO: 227397 - protein, 23 aa, Mycobacterium bovis
EFERRFFPIYPASTKVQSWDIFK

SEQ ID NO: 227398 - protein, 21 aa, Mycobacterium bovis
EFKAMFQMKFYAVALFRSRGV

SEQ ID NO: 227399 - protein, 23 aa, Mycobacterium bovis
EGHEVLIFRLFHAPPPSVCSRRR

SEQ ID NO: 227400 - protein, 24 aa, Mycobacterium bovis
EGPLPQTRFVLRKALAAHLPVILV

SEQ ID NO: 227401 - protein, 23 aa, Mycobacterium bovis
EHAVLHLLYSRFWHKVLYDLGHV

SEQ ID NO: 227402 - protein, 25 aa, Mycobacterium bovis
EHPGKWRVVFFWPKDFTFVCPTEIA

SEQ ID NO: 227403 - protein, 25 aa, Mycobacterium bovis
EIMGFYGLSYWYPFQVTALGLGPIW

SEQ ID NO: 227404 - protein, 20 aa, Mycobacterium bovis
EINSALMFAGAGPGPMLAAA

SEQ ID NO: 227405 - protein, 24 aa, Mycobacterium bovis
EIPIKLRVSVCVIYIPFKGCVKHV

SEQ ID NO: 227406 - protein, 20 aa, Mycobacterium bovis
EIRAIWRINELLNWQVASAG

SEQ ID NO: 227407 - protein, 17 aa, Mycobacterium bovis
EIRALFRSSKVGLIAGC

SEQ ID NO: 227408 - protein, 21 aa, Mycobacterium bovis
EIRHWLQIFVQRFYSFSQFKR

SEQ ID NO: 227409 - protein, 22 aa, Mycobacterium bovis
EIRTLFGVLFQDGALFGSMNLY

SEQ ID NO: 227410 - protein, 26 aa, Mycobacterium bovis
EITGDIFLIGIPFNAATLDAFSFPNI

SEQ ID NO: 227411 - protein, 20 aa, Mycobacterium bovis
EKAIWWQRAVAVWPDYASYQ

SEQ ID NO: 227412 - protein, 20 aa, Mycobacterium bovis
EKLVPDFLWISTEHTARVSL

SEQ ID NO: 227413 - protein, 28 aa, Mycobacterium bovis
ELAAPVTHIWYFKGVPSRLGYLLDLAPK

SEQ ID NO: 227414 - protein, 17 aa, Mycobacterium bovis
ELFAAFPSFAGLRPTFD

SEQ ID NO: 227415 - protein, 20 aa, Mycobacterium bovis
ELIRLLLNRALTTAGDDLAS

SEQ ID NO: 227416 - protein, 18 aa, Mycobacterium bovis
ELLFLYNGVRPRNVMPVH

SEQ ID NO: 227417 - protein, 18 aa, Mycobacterium bovis
ELLRLLAFSRIGALPITK

SEQ ID NO: 227418 - protein, 18 aa, Mycobacterium bovis
ELNSLRMFTGAGSAPMLA

SEQ ID NO: 227419 - protein, 20 aa, Mycobacterium bovis
ELRAIFINSVWAPRLRIVES

SEQ ID NO: 227420 - protein, 23 aa, Mycobacterium bovis
ELRRLIPPWVTLGSRLAALPKPK

SEQ ID NO: 227421 - protein, 20 aa, Mycobacterium bovis
ELSSFQLHWAPSLRPEAGAV

SEQ ID NO: 227422 - protein, 20 aa, Mycobacterium bovis
ELVYDGLWYSPLKAALEAFV

SEQ ID NO: 227423 - protein, 17 aa, Mycobacterium bovis
ENLFFKEKRYDLARVGR

SEQ ID NO: 227424 - protein, 20 aa, Mycobacterium bovis
EPITDSWYLTSIRAGLEPWS

SEQ ID NO: 227425 - protein, 27 aa, Mycobacterium bovis
EPWVRDYLLLRGLLGTSILWFEQDRDC

SEQ ID NO: 227426 - protein, 22 aa, Mycobacterium bovis
EQKRFFLPRIAAGDLHFSIGYS

SEQ ID NO: 227427 - protein, 21 aa, Mycobacterium bovis
EQLMPHWMLSLRAADMRRGGT

SEQ ID NO: 227428 - protein, 24 aa, Mycobacterium bovis
EQQRAQWLRPLLDGKIRSAFSMTE

SEQ ID NO: 227429 - protein, 24 aa, Mycobacterium bovis
ERDIRFVRLWFTDVLGFLKSVAIA

SEQ ID NO: 227430 - protein, 22 aa, Mycobacterium bovis
ERLGLWGLMPRTVYDTLIWCIY

SEQ ID NO: 227431 - protein, 20 aa, Mycobacterium bovis
ERPLWAWLVLEPGDISVCLH

SEQ ID NO: 227432 - protein, 21 aa, Mycobacterium bovis
ESRARLFPRGLAAFIELRDQR

SEQ ID NO: 227433 - protein, 21 aa, Mycobacterium bovis
ESTLGLIFHWADQRGLPLLDL

SEQ ID NO: 227434 - protein, 22 aa, Mycobacterium bovis
ESYEFWREFLASLKARGLTGVH

SEQ ID NO: 227435 - protein, 21 aa, Mycobacterium bovis
ETELMAWAIPRAANRFWMLNE

SEQ ID NO: 227436 - protein, 19 aa, Mycobacterium bovis
EVALFRLLGSWGVRPDFVM

SEQ ID NO: 227437 - protein, 24 aa, Mycobacterium bovis
EVGKLADLVLWEPAFFGVRPHVVL

SEQ ID NO: 227438 - protein, 18 aa, Mycobacterium bovis
EVGWSMLPVARSVLRRIG

SEQ ID NO: 227439 - protein, 21 aa, Mycobacterium bovis
EVRYFIDRLAGWYVITSSDRM

SEQ ID NO: 227440 - protein, 20 aa, Mycobacterium bovis
EVSTAVAALFSQHAQGYQAA

SEQ ID NO: 227441 - protein, 20 aa, Mycobacterium bovis
EVYRLRQPVLLIWGREDRVN

SEQ ID NO: 227442 - protein, 17 aa, Mycobacterium bovis
EWPLPLLDLARIASDRG

SEQ ID NO: 227443 - protein, 18 aa, Mycobacterium bovis
EYQPLWEPKIPLGRLGRP

SEQ ID NO: 227444 - protein, 18 aa, Mycobacterium bovis
FAAFPSFAGLRPTFDTRL

SEQ ID NO: 227445 - protein, 20 aa, Mycobacterium bovis
FAAFYRRCRLVTARLWPTLI

SEQ ID NO: 227446 - protein, 22 aa, Mycobacterium bovis
FAGDLLFIGCTPIVWAGPIANW

SEQ ID NO: 227447 - protein, 19 aa, Mycobacterium bovis
FALPIALPRRTVVTFTPEH

SEQ ID NO: 227448 - protein, 17 aa, Mycobacterium bovis
FAPFLWQEIEEGILPAL

SEQ ID NO: 227449 - protein, 21 aa, Mycobacterium bovis
FDDLVSPFLGLYRDDNLRPNS

SEQ ID NO: 227450 - protein, 24 aa, Mycobacterium bovis
FDPRLKRPIPYLPNMIGLITGRAS

SEQ ID NO: 227451 - protein, 22 aa, Mycobacterium bovis
FEHLGRLLIIDCGVLFPGHDEP

SEQ ID NO: 227452 - protein, 19 aa, Mycobacterium bovis
FGGFGGLLLGADGYNAPES

SEQ ID NO: 227453 - protein, 30 aa, Mycobacterium bovis
FGMVQFQKFFNPVTPFNPDLIPKSALGAGL

SEQ ID NO: 227454 - protein, 32 aa, Mycobacterium bovis
FGPLQPLFDVINAPTLALLNRPLIGNGADGTA

SEQ ID NO: 227455 - protein, 17 aa, Mycobacterium bovis
FHDMGMVGFLTIPMFFG

SEQ ID NO: 227456 - protein, 18 aa, Mycobacterium bovis
FHWVLAFADSGLLTSAVY

SEQ ID NO: 227457 - protein, 18 aa, Mycobacterium bovis
FIMLIAENHWRVAEEPVE

SEQ ID NO: 227458 - protein, 24 aa, Mycobacterium bovis
FLDTGAMYRIVTLAVLRAGADPSD

SEQ ID NO: 227459 - protein, 18 aa, Mycobacterium bovis
FLEPFRLSDPFITIDAFQ

SEQ ID NO: 227460 - protein, 17 aa, Mycobacterium bovis
FLEYLDMFYNLGIAGRA

SEQ ID NO: 227461 - protein, 17 aa, Mycobacterium bovis
FLGWIHPAATATAPART

SEQ ID NO: 227462 - protein, 17 aa, Mycobacterium bovis
FLLNLPLFSRQALHPDV

SEQ ID NO: 227463 - protein, 17 aa, Mycobacterium bovis
FLPFPFDSVIAGGASMA

SEQ ID NO: 227464 - protein, 17 aa, Mycobacterium bovis
FLQQYLANQFGYGQLTL

SEQ ID NO: 227465 - protein, 21 aa, Mycobacterium bovis
FLSLPVRRWPLKPFTQRAYQL

SEQ ID NO: 227466 - protein, 17 aa, Mycobacterium bovis
FMRPFRADEWLLYDQSS

SEQ ID NO: 227467 - protein, 23 aa, Mycobacterium bovis
FMVRNTYIYPPKPSMRIISDIFA

SEQ ID NO: 227468 - protein, 17 aa, Mycobacterium bovis
FNELLPLGYPFVNKQMH

SEQ ID NO: 227469 - protein, 17 aa, Mycobacterium bovis
FPGVLPPSGVPYLLGIQ

SEQ ID NO: 227470 - protein, 17 aa, Mycobacterium bovis
FSELFAAFPSFAGLRPT

SEQ ID NO: 227471 - protein, 18 aa, Mycobacterium bovis
FSFPNISIVLPNIGINLG

SEQ ID NO: 227472 - protein, 18 aa, Mycobacterium bovis
FTYWSMRPRGAQLGAWAS

SEQ ID NO: 227473 - protein, 19 aa, Mycobacterium bovis
FVDDFVLYWGFLALAQVRS

SEQ ID NO: 227474 - protein, 17 aa, Mycobacterium bovis
FVDGLIGATLGFGGEES

SEQ ID NO: 227475 - protein, 18 aa, Mycobacterium bovis
FVRLEGPAVFRWAAFKMG

SEQ ID NO: 227476 - protein, 23 aa, Mycobacterium bovis
FVRRQRAWLRTRASRQPRETPAT

SEQ ID NO: 227477 - protein, 18 aa, Mycobacterium bovis
FWCQLFSEPGAGSDLASL

SEQ ID NO: 227478 - protein, 17 aa, Mycobacterium bovis
FWFADAPDRVPGLSSPV

SEQ ID NO: 227479 - protein, 17 aa, Mycobacterium bovis
FYLKLYPRPATCGTSVY

SEQ ID NO: 227480 - protein, 25 aa, Mycobacterium bovis
FYRWTQWIFLQIYNAWFDTTANKAR

SEQ ID NO: 227481 - protein, 19 aa, Mycobacterium bovis
FYSGFYLPMYWSSRAKLTN

SEQ ID NO: 227482 - protein, 18 aa, Mycobacterium bovis
GAAALWFALDTDLPVLVD

SEQ ID NO: 227483 - protein, 26 aa, Mycobacterium bovis
GAGGTAGWFFGFGGNGGAGGIGVAGI

SEQ ID NO: 227484 - protein, 24 aa, Mycobacterium bovis
GAGPVVIPLLDIPPAPGFGNSTTG

SEQ ID NO: 227485 - protein, 23 aa, Mycobacterium bovis
GAGRGLFLGLGGDGGAGGTSNNN

SEQ ID NO: 227486 - protein, 25 aa, Mycobacterium bovis
GAINAPTMALLGRPLIGHGADGAPG

SEQ ID NO: 227487 - protein, 20 aa, Mycobacterium bovis
GARVWPGVFLPDGGIRYSSD

SEQ ID NO: 227488 - protein, 21 aa, Mycobacterium bovis
GASGFYAKWLPKLVFGEGQLP

SEQ ID NO: 227489 - protein, 25 aa, Mycobacterium bovis
GAVIYFLRKVIWFLPDFTVEGYHDR

SEQ ID NO: 227490 - protein, 29 aa, Mycobacterium bovis
GAVSASAQTLLSRPLIGNGANATTPGGNG

SEQ ID NO: 227491 - protein, 18 aa, Mycobacterium bovis
GDITLGERLILSSGFVAV

SEQ ID NO: 227492 - protein, 18 aa, Mycobacterium bovis
GDMGLALPILAPGGVASA

SEQ ID NO: 227493 - protein, 18 aa, Mycobacterium bovis
GDPTLRRLLPDFYRPDDL

SEQ ID NO: 227494 - protein, 21 aa, Mycobacterium bovis
GDRWYWHWDPQFIGGIAAFPP

SEQ ID NO: 227495 - protein, 24 aa, Mycobacterium bovis
GETLEEYWWAAEQMLTWPDPDKPA

SEQ ID NO: 227496 - protein, 19 aa, Mycobacterium bovis
GFGELRWALSGAAPIPKET

SEQ ID NO: 227497 - protein, 18 aa, Mycobacterium bovis
GFHTLKLQTFLTAGPKEA

SEQ ID NO: 227498 - protein, 25 aa, Mycobacterium bovis
GGAGGNGGWLLGNGGIGGAGGTGGG

SEQ ID NO: 227499 - protein, 21 aa, Mycobacterium bovis
GGAIRIPLISIPAAPGFGNST

SEQ ID NO: 227500 - protein, 17 aa, Mycobacterium bovis
GGCAPDLIYIDLHLVHE

SEQ ID NO: 227501 - protein, 22 aa, Mycobacterium bovis
GGDGGWLFGSGGNGAPGAAGQS

SEQ ID NO: 227502 - protein, 24 aa, Mycobacterium bovis
GGGGWVGAVNFGPISVQGFGLFGH

SEQ ID NO: 227503 - protein, 24 aa, Mycobacterium bovis
GGGKRLRPLFAYWGWHAVASREPD

SEQ ID NO: 227504 - protein, 21 aa, Mycobacterium bovis
GGNGALLIGAGGVGGAGGIGG

SEQ ID NO: 227505 - protein, 26 aa, Mycobacterium bovis
GGNNNWFAAYAYWYFKLYGHEKVKLL

SEQ ID NO: 227506 - protein, 26 aa, Mycobacterium bovis
GGPGSWLLAVPPYHIAGLAVLVRSVI

SEQ ID NO: 227507 - protein, 24 aa, Mycobacterium bovis
GGQEILFPALLPRAPYETTNRWTQ

SEQ ID NO: 227508 - protein, 26 aa, Mycobacterium bovis
GGRDEQLLLLPLTSLRGLRHTLKKLS

SEQ ID NO: 227509 - protein, 24 aa, Mycobacterium bovis
GGSYYVEWLTHRLARRARAHIAEV

SEQ ID NO: 227510 - protein, 24 aa, Mycobacterium bovis
GHGGNGGWLLGNGGNGGLGGDGDG

SEQ ID NO: 227511 - protein, 20 aa, Mycobacterium bovis
GHGGWLWGNGGVGGSGGAGV

SEQ ID NO: 227512 - protein, 19 aa, Mycobacterium bovis
GHMPVRRLDLIWISARNAA

SEQ ID NO: 227513 - protein, 20 aa, Mycobacterium bovis
GIANFLGFSVLHGGAGGAGG

SEQ ID NO: 227514 - protein, 23 aa, Mycobacterium bovis
GIDDALAVIYLLASPDADLVGIA

SEQ ID NO: 227515 - protein, 24 aa, Mycobacterium bovis
GISRPTFYFYFPSKEAVLLTLLDR

SEQ ID NO: 227516 - protein, 26 aa, Mycobacterium bovis
GKGADPGGLFPIPGAGGKGGTGGTGG

SEQ ID NO: 227517 - protein, 23 aa, Mycobacterium bovis
GLAYGLIYWYFDSKDDLFHALMA

SEQ ID NO: 227518 - protein, 17 aa, Mycobacterium bovis
GLDSRAWRLPWPDGTVV

SEQ ID NO: 227519 - protein, 17 aa, Mycobacterium bovis
GLFEVLAAGGAGGTGGL

SEQ ID NO: 227520 - protein, 22 aa, Mycobacterium bovis
GLIGLPLLGIPVTPGYFNLTGG

SEQ ID NO: 227521 - protein, 17 aa, Mycobacterium bovis
GLLGFSYRPAVLPQTPF

SEQ ID NO: 227522 - protein, 20 aa, Mycobacterium bovis
GLLRFTVGLAQITSLLLAGD

SEQ ID NO: 227523 - protein, 19 aa, Mycobacterium bovis
GLMQLLAATNWFGQNAPAL

SEQ ID NO: 227524 - protein, 21 aa, Mycobacterium bovis
GLNQLVFLGLRPPPPQRYPLS

SEQ ID NO: 227525 - protein, 27 aa, Mycobacterium bovis
GLRRSLIALRSQRYFRLLDALDALVSE

SEQ ID NO: 227526 - protein, 19 aa, Mycobacterium bovis
GLSLPLLRSLVQRCGLSVA

SEQ ID NO: 227527 - protein, 18 aa, Mycobacterium bovis
GLTPLRHWRSALATALAA

SEQ ID NO: 227528 - protein, 17 aa, Mycobacterium bovis
GMPFPLFVKAVAGGGGR

SEQ ID NO: 227529 - protein, 24 aa, Mycobacterium bovis
GMTEFKVFWQPPPAPEIPKSSLGA

SEQ ID NO: 227530 - protein, 24 aa, Mycobacterium bovis
GNGGNGGWLFGAGGTGGIGGTGAP

SEQ ID NO: 227531 - protein, 24 aa, Mycobacterium bovis
GNNNWFAAYAYWYFKLYGHEKVKL

SEQ ID NO: 227532 - protein, 19 aa, Mycobacterium bovis
GNSLFITVNCWGRLVTGVG

SEQ ID NO: 227533 - protein, 25 aa, Mycobacterium bovis
GNYSNGFFWRGDYQGLIGLSTTITI

SEQ ID NO: 227534 - protein, 20 aa, Mycobacterium bovis
GPALLLPLRARGTVAGVVVV

SEQ ID NO: 227535 - protein, 18 aa, Mycobacterium bovis
GPGGILYGNGGNGGSGAP

SEQ ID NO: 227536 - protein, 18 aa, Mycobacterium bovis
GPISIPIIDLRPAPGFFN

SEQ ID NO: 227537 - protein, 30 aa, Mycobacterium bovis
GPIVDRPLYRFPVFGFFALSIGAAALGNAR

SEQ ID NO: 227538 - protein, 17 aa, Mycobacterium bovis
GPRYWLMNAIEKAPQGP

SEQ ID NO: 227539 - protein, 22 aa, Mycobacterium bovis
GPTLIDLLMALFGLSTNADLGG

SEQ ID NO: 227540 - protein, 17 aa, Mycobacterium bovis
GPWRLDPLPLVISAADW

SEQ ID NO: 227541 - protein, 23 aa, Mycobacterium bovis
GQMPIHMRLPKLKGFRNRFRTEY

SEQ ID NO: 227542 - protein, 22 aa, Mycobacterium bovis
GRCRVPLILRLDPKIGLPDIRA

SEQ ID NO: 227543 - protein, 25 aa, Mycobacterium bovis
GRDAPLLHWIVFEEEYFRAGAPGRA

SEQ ID NO: 227544 - protein, 23 aa, Mycobacterium bovis
GREDVFFLHVSLVPYLAPSGELK

SEQ ID NO: 227545 - protein, 23 aa, Mycobacterium bovis
GRGPLIRFLLIELPDECWHLVIV

SEQ ID NO: 227546 - protein, 18 aa, Mycobacterium bovis
GRSGLFEVLAAGGAGGTG

SEQ ID NO: 227547 - protein, 19 aa, Mycobacterium bovis
GRYRPFYLRNLLDAVQGRN

SEQ ID NO: 227548 - protein, 25 aa, Mycobacterium bovis
GSACRPLYYLEMPPALFAPIVENLA

SEQ ID NO: 227549 - protein, 22 aa, Mycobacterium bovis
GSDAMRWFLMASPILRGGNLIV

SEQ ID NO: 227550 - protein, 26 aa, Mycobacterium bovis
GSDGSIFLRPFLKYQIITVVAPNSPL

SEQ ID NO: 227551 - protein, 23 aa, Mycobacterium bovis
GSDPLLAVPFSYPASLPTPFGPV

SEQ ID NO: 227552 - protein, 23 aa, Mycobacterium bovis
GSNALGLFLGLGGSGGQGGDSAM

SEQ ID NO: 227553 - protein, 17 aa, Mycobacterium bovis
GTDPWPWVLSGGEDHAL

SEQ ID NO: 227554 - protein, 26 aa, Mycobacterium bovis
GTGGLLPIKIPLIDIPAAPGFGNSTT

SEQ ID NO: 227555 - protein, 24 aa, Mycobacterium bovis
GTLGYFPLWGYATPPAIELAERLA

SEQ ID NO: 227556 - protein, 26 aa, Mycobacterium bovis
GTPGSPMVAPPPPTPITQVQQGGDGG

SEQ ID NO: 227557 - protein, 22 aa, Mycobacterium bovis
GTRWYGYFLRRLAERPANLAFF

SEQ ID NO: 227558 - protein, 20 aa, Mycobacterium bovis
GTVLRFVPPLAALGSVPVTF

SEQ ID NO: 227559 - protein, 22 aa, Mycobacterium bovis
GVAFDILRRWLLARGYDVAFIR

SEQ ID NO: 227560 - protein, 23 aa, Mycobacterium bovis
GVAWVIAYRWFRAGLLPVPAQRV

SEQ ID NO: 227561 - protein, 18 aa, Mycobacterium bovis
GVDTFFVATAPRYSFVSS

SEQ ID NO: 227562 - protein, 27 aa, Mycobacterium bovis
GVILAVMPWNFPLWQAVRFAAPALMAG

SEQ ID NO: 227563 - protein, 24 aa, Mycobacterium bovis
GVITPWNFPMVIASWAIAPALAAG

SEQ ID NO: 227564 - protein, 25 aa, Mycobacterium bovis
GVKNYPFYFGFLKSKLRTGGLLLNH

SEQ ID NO: 227565 - protein, 19 aa, Mycobacterium bovis
GVMWACVFMRTGARRVHFG

SEQ ID NO: 227566 - protein, 25 aa, Mycobacterium bovis
GVQLFSPAFLLAVPTALGGVGSLAI

SEQ ID NO: 227567 - protein, 19 aa, Mycobacterium bovis
GVTAYDYMLTLAGRLRPVD

SEQ ID NO: 227568 - protein, 21 aa, Mycobacterium bovis
GVWSRLMLDIARWRRRRREEL

SEQ ID NO: 227569 - protein, 18 aa, Mycobacterium bovis
GWRISLPAMVCYWSELAR

SEQ ID NO: 227570 - protein, 23 aa, Mycobacterium bovis
GYCGYLLYNLTTSGFRPATFAAI

SEQ ID NO: 227571 - protein, 24 aa, Mycobacterium bovis
GYIPILGAPWLADLVRRSPWGEMF

SEQ ID NO: 227572 - protein, 20 aa, Mycobacterium bovis
GYSWGPLSLMLLATAIAQQG

SEQ ID NO: 227573 - protein, 19 aa, Mycobacterium bovis
GYVLRRLLRRVIRSAKLLG

SEQ ID NO: 227574 - protein, 21 aa, Mycobacterium bovis
HAVRILARAWLYAIWHCWQDG

SEQ ID NO: 227575 - protein, 20 aa, Mycobacterium bovis
HDFYLLDEFTYPLKWGWLDV

SEQ ID NO: 227576 - protein, 23 aa, Mycobacterium bovis
HELQRLWLIEATRYNVLPLDDDT

SEQ ID NO: 227577 - protein, 19 aa, Mycobacterium bovis
HFIARLVLVLLDETFLPGG

SEQ ID NO: 227578 - protein, 20 aa, Mycobacterium bovis
HFTPFTLIQLEELGFCGKGE

SEQ ID NO: 227579 - protein, 21 aa, Mycobacterium bovis
HGARRMVIAPWLLAPGILSDR

SEQ ID NO: 227580 - protein, 21 aa, Mycobacterium bovis
HGFRFPEITGDIFLIGIPFNA

SEQ ID NO: 227581 - protein, 22 aa, Mycobacterium bovis
HGGAGGWLYGNGGAGGFGGAGA

SEQ ID NO: 227582 - protein, 23 aa, Mycobacterium bovis
HGLPLTLWLARFLKFIATEIFPG

SEQ ID NO: 227583 - protein, 21 aa, Mycobacterium bovis
HGQVLVFWDCYRPHDVQVRMF

SEQ ID NO: 227584 - protein, 17 aa, Mycobacterium bovis
HGRDEIWRFTPLRRLRG

SEQ ID NO: 227585 - protein, 19 aa, Mycobacterium bovis
HIDKWNFTVPFVCGATNLG

SEQ ID NO: 227586 - protein, 18 aa, Mycobacterium bovis
HLVCDLPDLLVAPAAPLT

SEQ ID NO: 227587 - protein, 21 aa, Mycobacterium bovis
HMQGHWLLARLGKRVLRPGGV

SEQ ID NO: 227588 - protein, 30 aa, Mycobacterium bovis
HMWFGDLVTMTWWDDLWLNESFATFASVLC

SEQ ID NO: 227589 - protein, 18 aa, Mycobacterium bovis
HPLMIALISYAVGGPIRM

SEQ ID NO: 227590 - protein, 18 aa, Mycobacterium bovis
HPRWAWWLTSVPVLREFL

SEQ ID NO: 227591 - protein, 20 aa, Mycobacterium bovis
HQAYLALRAWGLPVSEHTTL

SEQ ID NO: 227592 - protein, 18 aa, Mycobacterium bovis
HQVDPAHLWWIRSQLRSM

SEQ ID NO: 227593 - protein, 17 aa, Mycobacterium bovis
HREEAMARYWRAVPARD

SEQ ID NO: 227594 - protein, 23 aa, Mycobacterium bovis
HSRRGLLLLVGRRRRLIKYISQI

SEQ ID NO: 227595 - protein, 17 aa, Mycobacterium bovis
HTKLFYQPLLESIGPTG

SEQ ID NO: 227596 - protein, 18 aa, Mycobacterium bovis
HWPAFRHVDFLRALRDYS

SEQ ID NO: 227597 - protein, 17 aa, Mycobacterium bovis
HYQRYLDILRPLGFRPA

SEQ ID NO: 227598 - protein, 18 aa, Mycobacterium bovis
IADQLARRRLGYGRGARM

SEQ ID NO: 227599 - protein, 24 aa, Mycobacterium bovis
IAEEYYLSFLLDRANRTYLAMCSV

SEQ ID NO: 227600 - protein, 25 aa, Mycobacterium bovis
IAEGGWVLPYLPKPWGRAASPVEQI

SEQ ID NO: 227601 - protein, 19 aa, Mycobacterium bovis
IAGIPLLAGAISKAVLPPI

SEQ ID NO: 227602 - protein, 17 aa, Mycobacterium bovis
IAPTWPLGAHPKPLRPG

SEQ ID NO: 227603 - protein, 20 aa, Mycobacterium bovis
IARRVFATCRRLGLGTVAVY

SEQ ID NO: 227604 - protein, 22 aa, Mycobacterium bovis
IATPGSWRREPLSGIPAATNTV

SEQ ID NO: 227605 - protein, 17 aa, Mycobacterium bovis
IDAVKFTPALTGPHARL

SEQ ID NO: 227606 - protein, 19 aa, Mycobacterium bovis
IDGPYYLFGVLAKLAVLPS

SEQ ID NO: 227607 - protein, 26 aa, Mycobacterium bovis
IDHIIGLFRLWWIPDGAPPTQGTYVR

SEQ ID NO: 227608 - protein, 19 aa, Mycobacterium bovis
IDPYLRPLYDALYDMMDPE

SEQ ID NO: 227609 - protein, 20 aa, Mycobacterium bovis
IDSPELLWKALLRGDDLITE

SEQ ID NO: 227610 - protein, 20 aa, Mycobacterium bovis
IEPSPYLPTSRRFVNPLYLR

SEQ ID NO: 227611 - protein, 25 aa, Mycobacterium bovis
IFDVNLWAPLMWTSLVVTAWMGEHG

SEQ ID NO: 227612 - protein, 19 aa, Mycobacterium bovis
IFMGPLFTLLGRPKVEGLE

SEQ ID NO: 227613 - protein, 18 aa, Mycobacterium bovis
IFVYQLYLWDMRFRARHG

SEQ ID NO: 227614 - protein, 28 aa, Mycobacterium bovis
IGIDPAAVSPWWLQRRLLLCGIRATCPA

SEQ ID NO: 227615 - protein, 17 aa, Mycobacterium bovis
IGLPYLGFTQWALLHDP

SEQ ID NO: 227616 - protein, 17 aa, Mycobacterium bovis
IGWPVIDVKLPALAPMV

SEQ ID NO: 227617 - protein, 17 aa, Mycobacterium bovis
IGWTCRDVWWAATQDPR

SEQ ID NO: 227618 - protein, 21 aa, Mycobacterium bovis
IHDYFWRWDTDWFWCSRSFGA

SEQ ID NO: 227619 - protein, 18 aa, Mycobacterium bovis
IHFQEWWVRYRAQVPTHS

SEQ ID NO: 227620 - protein, 17 aa, Mycobacterium bovis
IITGYRLSPRDATVAVM

SEQ ID NO: 227621 - protein, 18 aa, Mycobacterium bovis
IKWTIVRYKPPEGMTLNG

SEQ ID NO: 227622 - protein, 18 aa, Mycobacterium bovis
ILGLLPAGGRITAGRVVF

SEQ ID NO: 227623 - protein, 17 aa, Mycobacterium bovis
ILPITWAYIRMMGAEGL

SEQ ID NO: 227624 - protein, 17 aa, Mycobacterium bovis
ILRDYLTDLFPILELGT

SEQ ID NO: 227625 - protein, 19 aa, Mycobacterium bovis
ILTVLALRDQVIPPTLNLV

SEQ ID NO: 227626 - protein, 21 aa, Mycobacterium bovis
INRILAYVAPILLGGPVTAVD

SEQ ID NO: 227627 - protein, 19 aa, Mycobacterium bovis
INRSLLLDGLRRIGIDRLA

SEQ ID NO: 227628 - protein, 17 aa, Mycobacterium bovis
IPIVYAVSRIVEVPYAE

SEQ ID NO: 227629 - protein, 18 aa, Mycobacterium bovis
IPPLSWFLGNSPPPLLNS

SEQ ID NO: 227630 - protein, 17 aa, Mycobacterium bovis
IRCFGFSPLRLPPDLDF

SEQ ID NO: 227631 - protein, 22 aa, Mycobacterium bovis
IREPLWVPSPTDRRLRHACALI

SEQ ID NO: 227632 - protein, 22 aa, Mycobacterium bovis
IRGPQEVLPFSPRSQYLVGHLA

SEQ ID NO: 227633 - protein, 24 aa, Mycobacterium bovis
IRSAGAIFVGPWSPVSLGDYCAGS

SEQ ID NO: 227634 - protein, 33 aa, Mycobacterium bovis
ISPTPFNLLGIYRWIRNFFYLTYYDSFEGEHSR

SEQ ID NO: 227635 - protein, 24 aa, Mycobacterium bovis
ITIQPIPILPTIPLSIHQTVNLGP

SEQ ID NO: 227636 - protein, 26 aa, Mycobacterium bovis
ITPFNFPAMIPLWKAGPALACGNAFV

SEQ ID NO: 227637 - protein, 20 aa, Mycobacterium bovis
ITVLPPIHIPPIPVGFAAVG

SEQ ID NO: 227638 - protein, 19 aa, Mycobacterium bovis
IYDKWLTLGPLIDQFGMTT

SEQ ID NO: 227639 - protein, 17 aa, Mycobacterium bovis
IYLAGRTADWMRVDGEN

SEQ ID NO: 227640 - protein, 22 aa, Mycobacterium bovis
KASVMTHHRWLRALAVFGGMGL

SEQ ID NO: 227641 - protein, 24 aa, Mycobacterium bovis
KAVAAFRLALPRTMLRFAGGREIT

SEQ ID NO: 227642 - protein, 19 aa, Mycobacterium bovis
KDELASCPPILVLTGRPDD

SEQ ID NO: 227643 - protein, 24 aa, Mycobacterium bovis
KDGEALFLRCNIWREAAENVAESL

SEQ ID NO: 227644 - protein, 23 aa, Mycobacterium bovis
KDLLPLLEKVIGAGKPLLIIAED

SEQ ID NO: 227645 - protein, 18 aa, Mycobacterium bovis
KETLIRYIDRFLIYYIRT

SEQ ID NO: 227646 - protein, 17 aa, Mycobacterium bovis
KETLRLHPPLIILMRVA

SEQ ID NO: 227647 - protein, 17 aa, Mycobacterium bovis
KGGGRLPITLWIVDTNA

SEQ ID NO: 227648 - protein, 19 aa, Mycobacterium bovis
KHRLARSLFLYALCNGWIN

SEQ ID NO: 227649 - protein, 18 aa, Mycobacterium bovis
KIPLLFLQNIAGFMVGRD

SEQ ID NO: 227650 - protein, 23 aa, Mycobacterium bovis
KKRPFYFGVLTWYMDRVLELVHD

SEQ ID NO: 227651 - protein, 19 aa, Mycobacterium bovis
KLEQWTLLARARALDSMSY

SEQ ID NO: 227652 - protein, 17 aa, Mycobacterium bovis
KLFNAVGVVFKGTGFYR

SEQ ID NO: 227653 - protein, 18 aa, Mycobacterium bovis
KLFYQPLLESIGPTGLEI

SEQ ID NO: 227654 - protein, 22 aa, Mycobacterium bovis
KLLRLWRPPLRPGEWRTLGLFA

SEQ ID NO: 227655 - protein, 19 aa, Mycobacterium bovis
KLRIVKYLAYGWSSLRSRP

SEQ ID NO: 227656 - protein, 17 aa, Mycobacterium bovis
KLYLLPGYHGTGAAAAL

SEQ ID NO: 227657 - protein, 22 aa, Mycobacterium bovis
KNMFALGLLSWMYGRELEHSEA

SEQ ID NO: 227658 - protein, 22 aa, Mycobacterium bovis
KNPVLQLFIDILMRLTKRYVQK

SEQ ID NO: 227659 - protein, 20 aa, Mycobacterium bovis
KPAPLVPLYLRRPDAKPLAV

SEQ ID NO: 227660 - protein, 24 aa, Mycobacterium bovis
KQLFGYLVWRDTKAAILLFIRNKD

SEQ ID NO: 227661 - protein, 21 aa, Mycobacterium bovis
KQLLLKIGWPAEDLAGYVDGE

SEQ ID NO: 227662 - protein, 17 aa, Mycobacterium bovis
KRKIPLLFLQNIAGFMV

SEQ ID NO: 227663 - protein, 26 aa, Mycobacterium bovis
KRLGSFMDSRLWRLLLAPGRGIGRLI

SEQ ID NO: 227664 - protein, 23 aa, Mycobacterium bovis
KRWFPGFMTFRFLECGLLTMVSN

SEQ ID NO: 227665 - protein, 23 aa, Mycobacterium bovis
KVIAQLRFPGYFLVVHDITRFCR

SEQ ID NO: 227666 - protein, 21 aa, Mycobacterium bovis
KVVRFILGLVQRYGPGLFGAN

SEQ ID NO: 227667 - protein, 21 aa, Mycobacterium bovis
KWEKLFRFLALDRLQSRLHRW

SEQ ID NO: 227668 - protein, 17 aa, Mycobacterium bovis
LAALYRPMLLRTTNRHH

SEQ ID NO: 227669 - protein, 23 aa, Mycobacterium bovis
LAAMGFKFQFITLAGFHALNYSM

SEQ ID NO: 227670 - protein, 27 aa, Mycobacterium bovis
LAAVNAPAQALLGRPLIGNGANGAPGT

SEQ ID NO: 227671 - protein, 23 aa, Mycobacterium bovis
LADGRELLFFSLPGPRTSGTAAE

SEQ ID NO: 227672 - protein, 19 aa, Mycobacterium bovis
LAEMKLLRPLLSAGDYLVV

SEQ ID NO: 227673 - protein, 24 aa, Mycobacterium bovis
LAPDRPFFVYFAPGATHAPHHVPR

SEQ ID NO: 227674 - protein, 24 aa, Mycobacterium bovis
LAQEWLRFGWFFLVTRRDPKGLWE

SEQ ID NO: 227675 - protein, 18 aa, Mycobacterium bovis
LASLRRLIESPSHDVIAV

SEQ ID NO: 227676 - protein, 23 aa, Mycobacterium bovis
LATRRKIFIPILRVAAIEPHAVT

SEQ ID NO: 227677 - protein, 18 aa, Mycobacterium bovis
LAVELSSFQLHWAPSLRP

SEQ ID NO: 227678 - protein, 25 aa, Mycobacterium bovis
LAVINAPAQALFGRPLIGNGANGTA

SEQ ID NO: 227679 - protein, 20 aa, Mycobacterium bovis
LCYAGPFFRYERPQAGRYRQ

SEQ ID NO: 227680 - protein, 24 aa, Mycobacterium bovis
LDALALLHRLSLKSPVRHFVLFSS

SEQ ID NO: 227681 - protein, 18 aa, Mycobacterium bovis
LDGWPVNFALLGKGNTVN

SEQ ID NO: 227682 - protein, 20 aa, Mycobacterium bovis
LDHAMWFMRPFRADEWLLYD

SEQ ID NO: 227683 - protein, 19 aa, Mycobacterium bovis
LDLLPRLLFRNGELDISVV

SEQ ID NO: 227684 - protein, 17 aa, Mycobacterium bovis
LDMKRYHLLLAGASWMA

SEQ ID NO: 227685 - protein, 18 aa, Mycobacterium bovis
LDPHWLLDTLGLTEAART

SEQ ID NO: 227686 - protein, 18 aa, Mycobacterium bovis
LDRLYVVALPMRVRFRGI

SEQ ID NO: 227687 - protein, 19 aa, Mycobacterium bovis
LDTLLRLLHPVIPFLTEAL

SEQ ID NO: 227688 - protein, 17 aa, Mycobacterium bovis
LDVAFAHDIRLIASALG

SEQ ID NO: 227689 - protein, 19 aa, Mycobacterium bovis
LEHWRWMWDTNVLGTLRVT

SEQ ID NO: 227690 - protein, 18 aa, Mycobacterium bovis
LELLPFRRNLAFYGLDLG

SEQ ID NO: 227691 - protein, 23 aa, Mycobacterium bovis
LENPGLLRFLPQLSERLLDESPL

SEQ ID NO: 227692 - protein, 23 aa, Mycobacterium bovis
LESRTITFLKIDPAPGIGNSTTN

SEQ ID NO: 227693 - protein, 18 aa, Mycobacterium bovis
LEWLDRMDLVNGKLICLV

SEQ ID NO: 227694 - protein, 28 aa, Mycobacterium bovis
LFAVEVALYRLLMSWGVRPGLVLGHSVG

SEQ ID NO: 227695 - protein, 19 aa, Mycobacterium bovis
LFDIDGVLVLSWRAIPGAA

SEQ ID NO: 227696 - protein, 24 aa, Mycobacterium bovis
LFGSWHYWWQAHLLDCLVDAQLRD

SEQ ID NO: 227697 - protein, 17 aa, Mycobacterium bovis
LFIMGRIKDLLIVDGRN

SEQ ID NO: 227698 - protein, 17 aa, Mycobacterium bovis
LFSLFYSLDVPRITIVD

SEQ ID NO: 227699 - protein, 25 aa, Mycobacterium bovis
LGAIPGGWWLTFGQILGLAQNAPGV

SEQ ID NO: 227700 - protein, 18 aa, Mycobacterium bovis
LGARLFQVGSRGGDGGVG

SEQ ID NO: 227701 - protein, 20 aa, Mycobacterium bovis
LGIDCIWLPPFYDSPLRDGG

SEQ ID NO: 227702 - protein, 24 aa, Mycobacterium bovis
LGLAQMIELWPLRPDVRTLLCSSV

SEQ ID NO: 227703 - protein, 20 aa, Mycobacterium bovis
LGLHFFNPVPVLPLVELVRT

SEQ ID NO: 227704 - protein, 26 aa, Mycobacterium bovis
LGLINGPAQTLLGRPLIGNGADGAPG

SEQ ID NO: 227705 - protein, 28 aa, Mycobacterium bovis
LGLTSPMSLLRFIKFILTEIFPGGRLPR

SEQ ID NO: 227706 - protein, 19 aa, Mycobacterium bovis
LGPRRTLTGQPLPPLLTAT

SEQ ID NO: 227707 - protein, 24 aa, Mycobacterium bovis
LGQPLDWFCLFSSGAALLGSPGQG

SEQ ID NO: 227708 - protein, 24 aa, Mycobacterium bovis
LGRGYRWLQLFDAAGLPVRDIEQV

SEQ ID NO: 227709 - protein, 17 aa, Mycobacterium bovis
LGVPTFRMLRALRGFDP

SEQ ID NO: 227710 - protein, 26 aa, Mycobacterium bovis
LGVVNAPAQALLGRPLIGNGANGADG

SEQ ID NO: 227711 - protein, 18 aa, Mycobacterium bovis
LHFLGATLWRSGIQRVLR

SEQ ID NO: 227712 - protein, 25 aa, Mycobacterium bovis
LHGRSRLWLFRYQGTPIAFFLNVWG

SEQ ID NO: 227713 - protein, 18 aa, Mycobacterium bovis
LHIHPIRRTIQHADLLVV

SEQ ID NO: 227714 - protein, 25 aa, Mycobacterium bovis
LHSCSPDLPWDLLQRSRISAVSVDA

SEQ ID NO: 227715 - protein, 18 aa, Mycobacterium bovis
LIAWLPTLLGLGGADLVV

SEQ ID NO: 227716 - protein, 25 aa, Mycobacterium bovis
LIIGAWNYPFYLTLGPAVGAIAAGN

SEQ ID NO: 227717 - protein, 24 aa, Mycobacterium bovis
LINPHPLFVPWLVGPLLTGEGIQL

SEQ ID NO: 227718 - protein, 25 aa, Mycobacterium bovis
LIRYIDRFLIYYIRTADRLQRTAPW

SEQ ID NO: 227719 - protein, 18 aa, Mycobacterium bovis
LIVIPNDRLLQMGDAAVS

SEQ ID NO: 227720 - protein, 24 aa, Mycobacterium bovis
LIVVRPIGFEPLQWVRALAAEDPV

SEQ ID NO: 227721 - protein, 28 aa, Mycobacterium bovis
LLAAVNAPTQALFGRPLIGNGADGSPGT

SEQ ID NO: 227722 - protein, 18 aa, Mycobacterium bovis
LLAPILTPVIYRAAMAAR

SEQ ID NO: 227723 - protein, 17 aa, Mycobacterium bovis
LLGLRLRRLRYLRTAAA

SEQ ID NO: 227724 - protein, 18 aa, Mycobacterium bovis
LLGQIPLDPALVAAGDSG

SEQ ID NO: 227725 - protein, 20 aa, Mycobacterium bovis
LLKGLTAHYLLKSVYPVKRG

SEQ ID NO: 227726 - protein, 17 aa, Mycobacterium bovis
LLKVRLRQGLPLARLGA

SEQ ID NO: 227727 - protein, 19 aa, Mycobacterium bovis
LLPEVAWSWLVDALTARTD

SEQ ID NO: 227728 - protein, 19 aa, Mycobacterium bovis
LLRDYGLLLPLEPDTRLLS

SEQ ID NO: 227729 - protein, 20 aa, Mycobacterium bovis
LLRFCRYMEALAAYKKYLDP

SEQ ID NO: 227730 - protein, 18 aa, Mycobacterium bovis
LLRNLEFLPNSPTLMNSG

SEQ ID NO: 227731 - protein, 22 aa, Mycobacterium bovis
LLRSDFPVLWPVGTRWADNDMF

SEQ ID NO: 227732 - protein, 25 aa, Mycobacterium bovis
LLSDGPVVLFFYPAAMTPGCTKEAC

SEQ ID NO: 227733 - protein, 19 aa, Mycobacterium bovis
LLTLLLFDIGSFAGLAALL

SEQ ID NO: 227734 - protein, 17 aa, Mycobacterium bovis
LMSPMAFLQRPARWMQL

SEQ ID NO: 227735 - protein, 20 aa, Mycobacterium bovis
LMSPMSFLRRPARWMQLLAT

SEQ ID NO: 227736 - protein, 28 aa, Mycobacterium bovis
LNVINAPTQTLLGRPLIGNGTNGAPGTG

SEQ ID NO: 227737 - protein, 17 aa, Mycobacterium bovis
LPAFSPPAQALGGGVGA

SEQ ID NO: 227738 - protein, 24 aa, Mycobacterium bovis
LPATHIGGLWWILTCLMHGGLCVT

SEQ ID NO: 227739 - protein, 21 aa, Mycobacterium bovis
LPCAPFLHLFVAYGRLTLEGG

SEQ ID NO: 227740 - protein, 21 aa, Mycobacterium bovis
LPDLELIFAPAPFYDEALVPP

SEQ ID NO: 227741 - protein, 20 aa, Mycobacterium bovis
LPEQGAWLQPFRPLSSLLTS

SEQ ID NO: 227742 - protein, 17 aa, Mycobacterium bovis
LPETRRYLGWRLSLLDL

SEQ ID NO: 227743 - protein, 18 aa, Mycobacterium bovis
LPLGLRRLLTDLHNAGAA

SEQ ID NO: 227744 - protein, 17 aa, Mycobacterium bovis
LPLLIKVVKHPSAWRGW

SEQ ID NO: 227745 - protein, 17 aa, Mycobacterium bovis
LPPTFRGDIFWCQLFSE

SEQ ID NO: 227746 - protein, 21 aa, Mycobacterium bovis
LPQQALLYRLCGDRNPLHSDP

SEQ ID NO: 227747 - protein, 20 aa, Mycobacterium bovis
LPTPAVAYLTGAYDADFGVM

SEQ ID NO: 227748 - protein, 17 aa, Mycobacterium bovis
LQEFLFGLDLDEDTRRR

SEQ ID NO: 227749 - protein, 18 aa, Mycobacterium bovis
LQHRWAQTPWRRFKRRLS

SEQ ID NO: 227750 - protein, 18 aa, Mycobacterium bovis
LQLGLLQLALKLAVDNGF

SEQ ID NO: 227751 - protein, 22 aa, Mycobacterium bovis
LQLRWPLRMLLGGKPLQHIAAD

SEQ ID NO: 227752 - protein, 19 aa, Mycobacterium bovis
LRDMLPDWPALAHGPLTLK

SEQ ID NO: 227753 - protein, 18 aa, Mycobacterium bovis
LRERLRYRRGQWAHGPKL

SEQ ID NO: 227754 - protein, 19 aa, Mycobacterium bovis
LRHEKLLFKKGIHLLDCGT

SEQ ID NO: 227755 - protein, 26 aa, Mycobacterium bovis
LRPVADRLWYPLWDANIRLDHSVRTV

SEQ ID NO: 227756 - protein, 19 aa, Mycobacterium bovis
LRRPLFPPLPGTLPEPEIW

SEQ ID NO: 227757 - protein, 20 aa, Mycobacterium bovis
LRRRHLVPQPPYGHGAAAAA

SEQ ID NO: 227758 - protein, 18 aa, Mycobacterium bovis
LRRRSVRFFGTYDVLLTP

SEQ ID NO: 227759 - protein, 20 aa, Mycobacterium bovis
LRRTGLLDKLLLLAGQPEES

SEQ ID NO: 227760 - protein, 25 aa, Mycobacterium bovis
LSAAIRLIYPREALWRPPVLTMSAV

SEQ ID NO: 227761 - protein, 24 aa, Mycobacterium bovis
LSAQAALFHEQFVRALTAGAGSYA

SEQ ID NO: 227762 - protein, 22 aa, Mycobacterium bovis
LSAVVMAPMYLGLRVWSRATIG

SEQ ID NO: 227763 - protein, 27 aa, Mycobacterium bovis
LSDAELYLFFHLLFSAGAETTRNSIAG

SEQ ID NO: 227764 - protein, 23 aa, Mycobacterium bovis
LSDYPYVVPLIDLEMRRPTYVFA

SEQ ID NO: 227765 - protein, 27 aa, Mycobacterium bovis
LSFASLVFYSAWFKLHHPAAFCAALLR

SEQ ID NO: 227766 - protein, 24 aa, Mycobacterium bovis
LSHPYLDTVLFLLGVTRGEIEAAD

SEQ ID NO: 227767 - protein, 20 aa, Mycobacterium bovis
LSRNTFHWVLAFADSGLLTS

SEQ ID NO: 227768 - protein, 17 aa, Mycobacterium bovis
LTAFAQHSPFAEKFQSL

SEQ ID NO: 227769 - protein, 20 aa, Mycobacterium bovis
LTLPAKFRDALAGGLMVTKS

SEQ ID NO: 227770 - protein, 18 aa, Mycobacterium bovis
LTREVLGAGIPLFGICFG

SEQ ID NO: 227771 - protein, 20 aa, Mycobacterium bovis
LTVSRLLAPILTPVIYRAAM

SEQ ID NO: 227772 - protein, 23 aa, Mycobacterium bovis
LTVTPVMLLLWIRGVRFMYSVDP

SEQ ID NO: 227773 - protein, 20 aa, Mycobacterium bovis
LTVVLKLLQIVRPDRVFFGE

SEQ ID NO: 227774 - protein, 17 aa, Mycobacterium bovis
LVHHPLLLRGVDTVAAN

SEQ ID NO: 227775 - protein, 19 aa, Mycobacterium bovis
LVIDMPLPISLGVNIPIDI

SEQ ID NO: 227776 - protein, 21 aa, Mycobacterium bovis
LVPQHLMRRLFFTAATVDAAT

SEQ ID NO: 227777 - protein, 17 aa, Mycobacterium bovis
LVRHHLLLPITATRRDL

SEQ ID NO: 227778 - protein, 17 aa, Mycobacterium bovis
LVSYVRGVLYFRTKRWP

SEQ ID NO: 227779 - protein, 17 aa, Mycobacterium bovis
LVWRLCQRYPRAARRLI

SEQ ID NO: 227780 - protein, 17 aa, Mycobacterium bovis
LWRWYPGLRAGGKLMHN

SEQ ID NO: 227781 - protein, 19 aa, Mycobacterium bovis
LWSVWKSYRSAPPLLSCTV

SEQ ID NO: 227782 - protein, 19 aa, Mycobacterium bovis
LWYCGPWTLWVMAGRGVAS

SEQ ID NO: 227783 - protein, 19 aa, Mycobacterium bovis
LYKTSWRFAPFLWQEIEEG

SEQ ID NO: 227784 - protein, 18 aa, Mycobacterium bovis
LYPKLLPIARNWWAKLGR

SEQ ID NO: 227785 - protein, 20 aa, Mycobacterium bovis
LYPTGRLINAPLPTWNHRRL

SEQ ID NO: 227786 - protein, 17 aa, Mycobacterium bovis
MADWWAYLNGVRKTYPL

SEQ ID NO: 227787 - protein, 20 aa, Mycobacterium bovis
MAHFFYIHFGLPTYFKNVFE

SEQ ID NO: 227788 - protein, 18 aa, Mycobacterium bovis
MCGVEYFGHPWEFGPRKT

SEQ ID NO: 227789 - protein, 23 aa, Mycobacterium bovis
MELLDDVILMLRRLHQPVIAAVN

SEQ ID NO: 227790 - protein, 27 aa, Mycobacterium bovis
MGGPPIVFQLLWYPSTLWDQSLPSLAE

SEQ ID NO: 227791 - protein, 24 aa, Mycobacterium bovis
MGHPRWWFDLLTTEPLAFASLDRW

SEQ ID NO: 227792 - protein, 17 aa, Mycobacterium bovis
MGPLLDAMGLTVGWITA

SEQ ID NO: 227793 - protein, 18 aa, Mycobacterium bovis
MHLLRDKQLWWRVGRKHG

SEQ ID NO: 227794 - protein, 17 aa, Mycobacterium bovis
MIYYPLTTLMMAGIRDI

SEQ ID NO: 227795 - protein, 22 aa, Mycobacterium bovis
MLFESLLPRYLTTRVYAALLES

SEQ ID NO: 227796 - protein, 17 aa, Mycobacterium bovis
MLLERLPRYLVPHHIVV

SEQ ID NO: 227797 - protein, 19 aa, Mycobacterium bovis
MLLVHFLRDQLRLTGTHWG

SEQ ID NO: 227798 - protein, 18 aa, Mycobacterium bovis
MMINLFWLGLKGAPVDRL

SEQ ID NO: 227799 - protein, 18 aa, Mycobacterium bovis
MMLSLPYQGLGNAAISAV

SEQ ID NO: 227800 - protein, 18 aa, Mycobacterium bovis
MPRDSWLIDRATLQPGPT

SEQ ID NO: 227801 - protein, 22 aa, Mycobacterium bovis
MQRVFFGWAQIWRTKSRAAEAI

SEQ ID NO: 227802 - protein, 20 aa, Mycobacterium bovis
MQTVLPWFNLGNAAVSLGLA

SEQ ID NO: 227803 - protein, 21 aa, Mycobacterium bovis
MRLDMPLVDFFSHGGALKSSW

SEQ ID NO: 227804 - protein, 20 aa, Mycobacterium bovis
MSDLRFLKFLRESIFPGGEL

SEQ ID NO: 227805 - protein, 21 aa, Mycobacterium bovis
MSHLLLDLDLLGPLRARLADG

SEQ ID NO: 227806 - protein, 20 aa, Mycobacterium bovis
MSLLLLIFPHLALAPYMRGL

SEQ ID NO: 227807 - protein, 23 aa, Mycobacterium bovis
MTGAAAPYLGWLSAAAAQAQQAA

SEQ ID NO: 227808 - protein, 23 aa, Mycobacterium bovis
MVAAAQPYLAWLTYTAEAAAHAG

SEQ ID NO: 227809 - protein, 17 aa, Mycobacterium bovis
MVFKLHRDFDIAEALKH

SEQ ID NO: 227810 - protein, 18 aa, Mycobacterium bovis
MVGFLTIPMFFGAELVKV

SEQ ID NO: 227811 - protein, 22 aa, Mycobacterium bovis
MVQFVPFFLGQRTPPYPTATSI

SEQ ID NO: 227812 - protein, 17 aa, Mycobacterium bovis
MWALSIPVPFTKPVGAG

SEQ ID NO: 227813 - protein, 17 aa, Mycobacterium bovis
MWFHGDLSRFNILTAQG

SEQ ID NO: 227814 - protein, 27 aa, Mycobacterium bovis
NAFAQLVMSNWFGLNAPLIAAVEGAYE

SEQ ID NO: 227815 - protein, 24 aa, Mycobacterium bovis
NAINAPTQTLLGRPLIGNGADGGP

SEQ ID NO: 227816 - protein, 18 aa, Mycobacterium bovis
NAMPPLDHRAPGPVLALL

SEQ ID NO: 227817 - protein, 17 aa, Mycobacterium bovis
NAPVLAATGRPLIGNGA

SEQ ID NO: 227818 - protein, 20 aa, Mycobacterium bovis
NAPVLLGLIGLWYSNFFGAQ

SEQ ID NO: 227819 - protein, 23 aa, Mycobacterium bovis
NCEIVPWCRFARKNYFYPDMPKN

SEQ ID NO: 227820 - protein, 24 aa, Mycobacterium bovis
NDHNFFVMTTPDDPIRYPARLAPL

SEQ ID NO: 227821 - protein, 17 aa, Mycobacterium bovis
NFTIPIIGFESFAFSFH

SEQ ID NO: 227822 - protein, 23 aa, Mycobacterium bovis
NGGNAGWLYGRGGVGGAGGIGGG

SEQ ID NO: 227823 - protein, 23 aa, Mycobacterium bovis
NGPLSWLWQILFGTPNFPTSISA

SEQ ID NO: 227824 - protein, 21 aa, Mycobacterium bovis
NLASLIVAPYFRAPSNRRSTV

SEQ ID NO: 227825 - protein, 22 aa, Mycobacterium bovis
NLPITLWPGMKIGQLCMLRLTS

SEQ ID NO: 227826 - protein, 19 aa, Mycobacterium bovis
NLRRRGDRWYWHWDPQFIG

SEQ ID NO: 227827 - protein, 17 aa, Mycobacterium bovis
NNTMPLYFISPTPFNLL

SEQ ID NO: 227828 - protein, 20 aa, Mycobacterium bovis
NNVEFFFLRPKDIAIYVGSG

SEQ ID NO: 227829 - protein, 20 aa, Mycobacterium bovis
NPPMIRYPIPPMIHGATQSA

SEQ ID NO: 227830 - protein, 23 aa, Mycobacterium bovis
NRGSQFYLAMYWAQELAAQTDDQ

SEQ ID NO: 227831 - protein, 24 aa, Mycobacterium bovis
NRVKTWLQFPQWFYLNIPVNTMVA

SEQ ID NO: 227832 - protein, 26 aa, Mycobacterium bovis
NSFTIPGFQIRVLLGPAAVLVNEMIG

SEQ ID NO: 227833 - protein, 25 aa, Mycobacterium bovis
NTMLDLFLLILVELFRRHLSSTEQA

SEQ ID NO: 227834 - protein, 30 aa, Mycobacterium bovis
NTRLGLFPFRRGLTFYYLDLALMSVTQPDR

SEQ ID NO: 227835 - protein, 20 aa, Mycobacterium bovis
NTVGPPLLPPILGGGMPAAP

SEQ ID NO: 227836 - protein, 18 aa, Mycobacterium bovis
NVYYRRALMLAACFGRGS

SEQ ID NO: 227837 - protein, 19 aa, Mycobacterium bovis
NWRPGWFPTMHSRCLSNLI

SEQ ID NO: 227838 - protein, 19 aa, Mycobacterium bovis
NYDMSMARLLYWGCDVWLN

SEQ ID NO: 227839 - protein, 23 aa, Mycobacterium bovis
NYSNGFWWRGDYQGLAGISQTIT

SEQ ID NO: 227840 - protein, 19 aa, Mycobacterium bovis
PADRPALPAALTILRDITA

SEQ ID NO: 227841 - protein, 23 aa, Mycobacterium bovis
PAGPADWALLGAALLGVGGSGAA

SEQ ID NO: 227842 - protein, 18 aa, Mycobacterium bovis
PAKLAIPMRVIASVGAIL

SEQ ID NO: 227843 - protein, 17 aa, Mycobacterium bovis
PAPPRGLSAVPLEPGQQ

SEQ ID NO: 227844 - protein, 19 aa, Mycobacterium bovis
PARWPLPVLPSSRSGPAPQ

SEQ ID NO: 227845 - protein, 18 aa, Mycobacterium bovis
PDAWAFVWVVDPPLFEPA

SEQ ID NO: 227846 - protein, 21 aa, Mycobacterium bovis
PDEFGLSRYLAAGLAALQTVD

SEQ ID NO: 227847 - protein, 18 aa, Mycobacterium bovis
PDFATGLMPLRWGTGFML

SEQ ID NO: 227848 - protein, 24 aa, Mycobacterium bovis
PDGLPVWIYQFKISPHPTIPLAPT

SEQ ID NO: 227849 - protein, 21 aa, Mycobacterium bovis
PDGLSCFLLPRVLPDGTRNRM

SEQ ID NO: 227850 - protein, 18 aa, Mycobacterium bovis
PDLIYIDLHLVHEVTSPQ

SEQ ID NO: 227851 - protein, 22 aa, Mycobacterium bovis
PDLLPLLEKVAGTGKPLLIVAE

SEQ ID NO: 227852 - protein, 23 aa, Mycobacterium bovis
PDTTIVSWLPFYHDMGLVLGIIA

SEQ ID NO: 227853 - protein, 25 aa, Mycobacterium bovis
PEAITRPRWLWKFAKTLRPPDLRVP

SEQ ID NO: 227854 - protein, 20 aa, Mycobacterium bovis
PEFLPLLRRLGRFLPADVRI

SEQ ID NO: 227855 - protein, 20 aa, Mycobacterium bovis
PEINSLRMYLGAGSAPMLQA

SEQ ID NO: 227856 - protein, 24 aa, Mycobacterium bovis
PENVSPLVVWLGSAESRDVTGKVF

SEQ ID NO: 227857 - protein, 24 aa, Mycobacterium bovis
PEREIHLTLIPFALRPTAEVPTTT

SEQ ID NO: 227858 - protein, 27 aa, Mycobacterium bovis
PETNSLRMYLGAGSRPLLAAAGAWDGL

SEQ ID NO: 227859 - protein, 24 aa, Mycobacterium bovis
PEVATWLEVPLPPGVLRWQQDHGR

SEQ ID NO: 227860 - protein, 21 aa, Mycobacterium bovis
PEVHRWWTSLTSEERQRLIAE

SEQ ID NO: 227861 - protein, 26 aa, Mycobacterium bovis
PEYRTMPMVWYIPPLSPVVDAVSRDG

SEQ ID NO: 227862 - protein, 20 aa, Mycobacterium bovis
PFDSPMYWHLFEPALRDAVD

SEQ ID NO: 227863 - protein, 18 aa, Mycobacterium bovis
PFFGSLLEFITSGPVVAA

SEQ ID NO: 227864 - protein, 22 aa, Mycobacterium bovis
PGGGHGLLGLGGSHGAGGAGGS

SEQ ID NO: 227865 - protein, 20 aa, Mycobacterium bovis
PGGPGGLLWGNGGNGGSGVA

SEQ ID NO: 227866 - protein, 21 aa, Mycobacterium bovis
PGGPGGLLYGNGGHGGAGAAG

SEQ ID NO: 227867 - protein, 17 aa, Mycobacterium bovis
PGIALPEGVRLLAPARR

SEQ ID NO: 227868 - protein, 20 aa, Mycobacterium bovis
PGIPVLAWALPQPIADRLNA

SEQ ID NO: 227869 - protein, 18 aa, Mycobacterium bovis
PGMKIGQLCMLRLTSPSE

SEQ ID NO: 227870 - protein, 17 aa, Mycobacterium bovis
PGPLRRLIATLPALEVP

SEQ ID NO: 227871 - protein, 25 aa, Mycobacterium bovis
PHDIVLFPAWVWRSPLKPSPLDPPH

SEQ ID NO: 227872 - protein, 22 aa, Mycobacterium bovis
PHHTRPTRFVWLQTPAIRARLL

SEQ ID NO: 227873 - protein, 19 aa, Mycobacterium bovis
PHRTVLPLEFARLAGYYLA

SEQ ID NO: 227874 - protein, 20 aa, Mycobacterium bovis
PIRVLTLAALAPRPGQRLWD

SEQ ID NO: 227875 - protein, 19 aa, Mycobacterium bovis
PITLLHIVAPVVVGWPVGQ

SEQ ID NO: 227876 - protein, 23 aa, Mycobacterium bovis
PKETWLRLLLIDAGLPVPTTQIP

SEQ ID NO: 227877 - protein, 23 aa, Mycobacterium bovis
PKETWLRLLLINAGFPRPSTQIP

SEQ ID NO: 227878 - protein, 23 aa, Mycobacterium bovis
PKETWLRLLLIRAGFPRPQTQIA

SEQ ID NO: 227879 - protein, 17 aa, Mycobacterium bovis
PKGLGVIGLLIEDPKPL

SEQ ID NO: 227880 - protein, 17 aa, Mycobacterium bovis
PLLAYLRKMVFWSMVTP

SEQ ID NO: 227881 - protein, 18 aa, Mycobacterium bovis
PLLPPILGGGMPAAPGPA

SEQ ID NO: 227882 - protein, 17 aa, Mycobacterium bovis
PLPGTLPEPEIWARLVR

SEQ ID NO: 227883 - protein, 23 aa, Mycobacterium bovis
PLPRWQIALYWRTDGRPLWTNDA

SEQ ID NO: 227884 - protein, 17 aa, Mycobacterium bovis
PLRRLIATLPALEVPRP

SEQ ID NO: 227885 - protein, 17 aa, Mycobacterium bovis
PLSLMLLATAIAQQGHI

SEQ ID NO: 227886 - protein, 17 aa, Mycobacterium bovis
PLTFICVFGYKAQAAFF

SEQ ID NO: 227887 - protein, 22 aa, Mycobacterium bovis
PLVLKPWTMPEPLLPIAIAAHA

SEQ ID NO: 227888 - protein, 17 aa, Mycobacterium bovis
PLYFISPTPFNLLGIYR

SEQ ID NO: 227889 - protein, 19 aa, Mycobacterium bovis
PLYLLDFLRQSGNTPIVLL

SEQ ID NO: 227890 - protein, 19 aa, Mycobacterium bovis
PMVFPLWLERLQVKYINRA

SEQ ID NO: 227891 - protein, 17 aa, Mycobacterium bovis
PNLDFPTGPAYYLMGFD

SEQ ID NO: 227892 - protein, 17 aa, Mycobacterium bovis
PNYFFITGPDTAAQARC

SEQ ID NO: 227893 - protein, 23 aa, Mycobacterium bovis
PPDLTVVSWLPLYHDMGLLLGAI

SEQ ID NO: 227894 - protein, 27 aa, Mycobacterium bovis
PPHGWVNLHFSLLPAWRGAAPVQAAIA

SEQ ID NO: 227895 - protein, 23 aa, Mycobacterium bovis
PPHPAHFLWLNWGPCPPRQDMAY

SEQ ID NO: 227896 - protein, 24 aa, Mycobacterium bovis
PPNSALVSWLPFYHDMGLVIGICA

SEQ ID NO: 227897 - protein, 20 aa, Mycobacterium bovis
PPRWSISVPVLYALGALGSL

SEQ ID NO: 227898 - protein, 20 aa, Mycobacterium bovis
PPSWAWPKPAVAPPVLFGCR

SEQ ID NO: 227899 - protein, 20 aa, Mycobacterium bovis
PPTFVLFTTGFLEAGYRRFL

SEQ ID NO: 227900 - protein, 18 aa, Mycobacterium bovis
PPTHFVITLGVRGARYVG

SEQ ID NO: 227901 - protein, 22 aa, Mycobacterium bovis
PPYAGPPMWFHGDLSRFNILTA

SEQ ID NO: 227902 - protein, 18 aa, Mycobacterium bovis
PPYVVRWLVNGHETTVYP

SEQ ID NO: 227903 - protein, 19 aa, Mycobacterium bovis
PQEQGLIPGFLMPPSDGSG

SEQ ID NO: 227904 - protein, 17 aa, Mycobacterium bovis
PRGLSAVPLEPGQQTVG

SEQ ID NO: 227905 - protein, 23 aa, Mycobacterium bovis
PSFAKELFLGRFPLGLIHPFPKP

SEQ ID NO: 227906 - protein, 18 aa, Mycobacterium bovis
PSGFLRRTPTRRFRDRRD

SEQ ID NO: 227907 - protein, 23 aa, Mycobacterium bovis
PSTWPWNLLGWPSINVPAGFTSD

SEQ ID NO: 227908 - protein, 17 aa, Mycobacterium bovis
PTDTRAYFRGECLRRFG

SEQ ID NO: 227909 - protein, 24 aa, Mycobacterium bovis
PTEFTLLRYFVINAGTVLSKPKIL

SEQ ID NO: 227910 - protein, 22 aa, Mycobacterium bovis
PTIDAVLPMFFEFAGDSVLVAH

SEQ ID NO: 227911 - protein, 17 aa, Mycobacterium bovis
PTLIDLYLQGRLPLQRF

SEQ ID NO: 227912 - protein, 17 aa, Mycobacterium bovis
PTRVWGVPAAGLWAHRL

SEQ ID NO: 227913 - protein, 20 aa, Mycobacterium bovis
PTSVPAFRPGAQFKAVVSGA

SEQ ID NO: 227914 - protein, 17 aa, Mycobacterium bovis
PVARRLFAVRAVVGLSL

SEQ ID NO: 227915 - protein, 19 aa, Mycobacterium bovis
PVIDQDVRRWWRSDSLWQA

SEQ ID NO: 227916 - protein, 23 aa, Mycobacterium bovis
PVIGAPWLVAFAERSRFFEVFSS

SEQ ID NO: 227917 - protein, 18 aa, Mycobacterium bovis
PVLLAWVTPIVTALADVV

SEQ ID NO: 227918 - protein, 17 aa, Mycobacterium bovis
PVNNVEFFFLRPKDIAI

SEQ ID NO: 227919 - protein, 17 aa, Mycobacterium bovis
PVNPWDPTAWAGVSSSG

SEQ ID NO: 227920 - protein, 21 aa, Mycobacterium bovis
PVWTFLGPRPAGWWVRRRLHE

SEQ ID NO: 227921 - protein, 20 aa, Mycobacterium bovis
PWEHPDFWDIWKASLQGVLA

SEQ ID NO: 227922 - protein, 27 aa, Mycobacterium bovis
PWPPRVATLPHWPLIYAGALEGLDHLE

SEQ ID NO: 227923 - protein, 21 aa, Mycobacterium bovis
PYFSLAMLPGGRRRALLTGTV

SEQ ID NO: 227924 - protein, 20 aa, Mycobacterium bovis
PYGGVWLHSWLDRDLGISGR

SEQ ID NO: 227925 - protein, 17 aa, Mycobacterium bovis
PYPVTVGYMYIMKLHHL

SEQ ID NO: 227926 - protein, 23 aa, Mycobacterium bovis
PYQQRGLAWLAFLSSLGLGSCLA

SEQ ID NO: 227927 - protein, 22 aa, Mycobacterium bovis
QAATMLPFSWQGVSLHAAGASR

SEQ ID NO: 227928 - protein, 24 aa, Mycobacterium bovis
QEDFIGIHFFSPVDKMPLVEIIKG

SEQ ID NO: 227929 - protein, 18 aa, Mycobacterium bovis
QETLYWLAQPGIRESIAE

SEQ ID NO: 227930 - protein, 26 aa, Mycobacterium bovis
QFLGRRRFVYPWVAWLVQRGAAPGDV

SEQ ID NO: 227931 - protein, 24 aa, Mycobacterium bovis
QFNALFLDPYLWKLQVGGKRLVQK

SEQ ID NO: 227932 - protein, 19 aa, Mycobacterium bovis
QFPFDIIPTLLQGLATLST

SEQ ID NO: 227933 - protein, 19 aa, Mycobacterium bovis
QFSVTLPRTLPGSGAGIIE

SEQ ID NO: 227934 - protein, 17 aa, Mycobacterium bovis
QGILTYMRAIWTGSIAF

SEQ ID NO: 227935 - protein, 20 aa, Mycobacterium bovis
QGWFTGLIPITVPIAGSAFG

SEQ ID NO: 227936 - protein, 20 aa, Mycobacterium bovis
QIGYSLLFRLASGSLLGPDR

SEQ ID NO: 227937 - protein, 23 aa, Mycobacterium bovis
QIHDWILLTPWGLLSWPQINQQL

SEQ ID NO: 227938 - protein, 19 aa, Mycobacterium bovis
QILNMTLSQRWGRLFVAVC

SEQ ID NO: 227939 - protein, 23 aa, Mycobacterium bovis
QISKPMLYLYYGSKEDLFGACLN

SEQ ID NO: 227940 - protein, 17 aa, Mycobacterium bovis
QLARRRLGYGRGARMTF

SEQ ID NO: 227941 - protein, 19 aa, Mycobacterium bovis
QLGMPPWRVQKAQKQARRW

SEQ ID NO: 227942 - protein, 22 aa, Mycobacterium bovis
QLTPWQQLLSVLPPVVTAAPAG

SEQ ID NO: 227943 - protein, 19 aa, Mycobacterium bovis
QNAQWLTPVLVAAGIDLLV

SEQ ID NO: 227944 - protein, 19 aa, Mycobacterium bovis
QPHLTAMWYAVIDGEIWLE

SEQ ID NO: 227945 - protein, 19 aa, Mycobacterium bovis
QPILAPLTPAAIFLVATIG

SEQ ID NO: 227946 - protein, 17 aa, Mycobacterium bovis
QPRLRPPFPAVAGLYGC

SEQ ID NO: 227947 - protein, 22 aa, Mycobacterium bovis
QQGKFLCLLAGAIQARRVLEIG

SEQ ID NO: 227948 - protein, 19 aa, Mycobacterium bovis
QRIVLTRNPRWWGARPRLD

SEQ ID NO: 227949 - protein, 21 aa, Mycobacterium bovis
QRLRLPWWHLWRAAEAAGAAT

SEQ ID NO: 227950 - protein, 19 aa, Mycobacterium bovis
QRPITVPVLLLLTERFDLS

SEQ ID NO: 227951 - protein, 20 aa, Mycobacterium bovis
QRYLDILRPLGFRPALGFSR

SEQ ID NO: 227952 - protein, 21 aa, Mycobacterium bovis
QRYMGWFDGNPGWLWPHPPEA

SEQ ID NO: 227953 - protein, 21 aa, Mycobacterium bovis
QSVLYLRFREWFLPAMHRKYG

SEQ ID NO: 227954 - protein, 23 aa, Mycobacterium bovis
QTAAVLFGVWWIGAQAILDDSPA

SEQ ID NO: 227955 - protein, 20 aa, Mycobacterium bovis
QVALFLRHLWSAGGSVRWDP

SEQ ID NO: 227956 - protein, 18 aa, Mycobacterium bovis
QVPLLLDEYTRNASTGSF

SEQ ID NO: 227957 - protein, 19 aa, Mycobacterium bovis
QVRLPGFRPGKAPAKLLEA

SEQ ID NO: 227958 - protein, 22 aa, Mycobacterium bovis
QVVPIRVYRWKPAPLGGVFDHL

SEQ ID NO: 227959 - protein, 24 aa, Mycobacterium bovis
QWHQLARAFLMYVTQRWPDVLSTA

SEQ ID NO: 227960 - protein, 20 aa, Mycobacterium bovis
QWSIRQVPLHILLDGLDLRD

SEQ ID NO: 227961 - protein, 21 aa, Mycobacterium bovis
QYVAQLHVWARREHPTYEDIV

SEQ ID NO: 227962 - protein, 32 aa, Mycobacterium bovis
RADRYRMYPLVRRLLFLIPPEHAHKLVFAVLR

SEQ ID NO: 227963 - protein, 28 aa, Mycobacterium bovis
RAFLADKVVRWWLPERWAFVDEIPRTSV

SEQ ID NO: 227964 - protein, 23 aa, Mycobacterium bovis
RAGKLPVTLFTAGGIATPADAAM

SEQ ID NO: 227965 - protein, 18 aa, Mycobacterium bovis
RALMAKRAPLYRRVATMR

SEQ ID NO: 227966 - protein, 23 aa, Mycobacterium bovis
RALYAFKRYAWWPYTLVMRRVNV

SEQ ID NO: 227967 - protein, 19 aa, Mycobacterium bovis
RARFNLRYPLAHLRPFLST

SEQ ID NO: 227968 - protein, 24 aa, Mycobacterium bovis
RARISGMPVLFWLDPYRPHENELI

SEQ ID NO: 227969 - protein, 17 aa, Mycobacterium bovis
RAWRLPWPDGTVVYELD

SEQ ID NO: 227970 - protein, 20 aa, Mycobacterium bovis
RAYKMWLPPLTNPVPLNELI

SEQ ID NO: 227971 - protein, 25 aa, Mycobacterium bovis
RAYSPRFLWMWPNARISVMGGEQAA

SEQ ID NO: 227972 - protein, 20 aa, Mycobacterium bovis
RDLLKFDFYFADSTAFRANI

SEQ ID NO: 227973 - protein, 24 aa, Mycobacterium bovis
RDPYHAYTIDWLPEGWFIEVSEVA

SEQ ID NO: 227974 - protein, 23 aa, Mycobacterium bovis
RDQIGIVFQFFNLIPTLTVLENI

SEQ ID NO: 227975 - protein, 25 aa, Mycobacterium bovis
RDTYDAMFDLWFPAALGARAVITTE

SEQ ID NO: 227976 - protein, 17 aa, Mycobacterium bovis
RDYILELLLAHTSAGLP

SEQ ID NO: 227977 - protein, 19 aa, Mycobacterium bovis
RDYLTDLFPILELGTSAKM

SEQ ID NO: 227978 - protein, 28 aa, Mycobacterium bovis
REAFLALIRSNWLGLNAPWIAAVESLYE

SEQ ID NO: 227979 - protein, 27 aa, Mycobacterium bovis
REHGVLKRILLIYREGIRRLQADDQSP

SEQ ID NO: 227980 - protein, 19 aa, Mycobacterium bovis
RERLGFGELRWALSGAAPI

SEQ ID NO: 227981 - protein, 22 aa, Mycobacterium bovis
RERPGRLLGFHWTKVHPDHPGL

SEQ ID NO: 227982 - protein, 18 aa, Mycobacterium bovis
RFAAPYLRDSLLAAGALC

SEQ ID NO: 227983 - protein, 17 aa, Mycobacterium bovis
RFALTHFGLFGFAVMSC

SEQ ID NO: 227984 - protein, 19 aa, Mycobacterium bovis
RFHAVYWPAFLMSAGIELP

SEQ ID NO: 227985 - protein, 18 aa, Mycobacterium bovis
RFRRSIQTILLAALGRTI

SEQ ID NO: 227986 - protein, 24 aa, Mycobacterium bovis
RGAKNVLLVFFPLAFTGICQGELD

SEQ ID NO: 227987 - protein, 17 aa, Mycobacterium bovis
RGALLQLGLLQLALKLA

SEQ ID NO: 227988 - protein, 20 aa, Mycobacterium bovis
RGDHEGLFSLFYSLDVPRIT

SEQ ID NO: 227989 - protein, 17 aa, Mycobacterium bovis
RGLLVLLDALRSTICGQ

SEQ ID NO: 227990 - protein, 21 aa, Mycobacterium bovis
RGLPMSFTFARFLKFIVTEIF

SEQ ID NO: 227991 - protein, 17 aa, Mycobacterium bovis
RGQGFLALVDYAHKPEA

SEQ ID NO: 227992 - protein, 19 aa, Mycobacterium bovis
RGRFRWWGLYTQREQGYDG

SEQ ID NO: 227993 - protein, 22 aa, Mycobacterium bovis
RGTAYRWFRAGLLSVMARRVGR

SEQ ID NO: 227994 - protein, 19 aa, Mycobacterium bovis
RGYTLRLPLDVLVVASANP

SEQ ID NO: 227995 - protein, 17 aa, Mycobacterium bovis
RHEILQLELLKPKIAIL

SEQ ID NO: 227996 - protein, 20 aa, Mycobacterium bovis
RHLRLPLRDVIWGADADLLD

SEQ ID NO: 227997 - protein, 25 aa, Mycobacterium bovis
RIEFKLRDWLFARQRYWGEPFPIVY

SEQ ID NO: 227998 - protein, 22 aa, Mycobacterium bovis
RIEGWMPFGRVFETLAWGRRHV

SEQ ID NO: 227999 - protein, 20 aa, Mycobacterium bovis
RIERGLWLTALLQATLSTVR

SEQ ID NO: 228000 - protein, 18 aa, Mycobacterium bovis
RIGRLYLIGIPGEPTIVA

SEQ ID NO: 228001 - protein, 20 aa, Mycobacterium bovis
RIHKLLRIFANPKLPTIGDY

SEQ ID NO: 228002 - protein, 22 aa, Mycobacterium bovis
RIPLPVDWRWPWGEALAVLENT

SEQ ID NO: 228003 - protein, 31 aa, Mycobacterium bovis
RIQPLPPKRAGLLIRALYRIAKRRFGEVPEP

SEQ ID NO: 228004 - protein, 17 aa, Mycobacterium bovis
RIVLFRKPIERRAKDTE

SEQ ID NO: 228005 - protein, 23 aa, Mycobacterium bovis
RKHIAWYLHGFPAGSALRRALAM

SEQ ID NO: 228006 - protein, 24 aa, Mycobacterium bovis
RKRGHWMWFVFPQLRGLGSSPLAV

SEQ ID NO: 228007 - protein, 22 aa, Mycobacterium bovis
RLADAWVWDMYRPARFVKQVRV

SEQ ID NO: 228008 - protein, 18 aa, Mycobacterium bovis
RLGDEFITGVLFYTGARA

SEQ ID NO: 228009 - protein, 18 aa, Mycobacterium bovis
RLVAMLARRGYGQTLACE

SEQ ID NO: 228010 - protein, 21 aa, Mycobacterium bovis
RLVRLHLLHLLQTISPHTAEL

SEQ ID NO: 228011 - protein, 29 aa, Mycobacterium bovis
RMYNALLEAVFWFLSRKTPVFVKWLLRRT

SEQ ID NO: 228012 - protein, 17 aa, Mycobacterium bovis
RNLLRPNQFPYQSKTGW

SEQ ID NO: 228013 - protein, 26 aa, Mycobacterium bovis
RPAMFSTFLMWVLADLFTFLPEVGDL

SEQ ID NO: 228014 - protein, 19 aa, Mycobacterium bovis
RPAQYLPWHPGRCAQVFVG

SEQ ID NO: 228015 - protein, 22 aa, Mycobacterium bovis
RPGLVYLLWPVALGYLRVVTHP

SEQ ID NO: 228016 - protein, 18 aa, Mycobacterium bovis
RPGYLRFDFNWQGPLTDD

SEQ ID NO: 228017 - protein, 19 aa, Mycobacterium bovis
RPLIRLSLGKRHPMRRIVS

SEQ ID NO: 228018 - protein, 18 aa, Mycobacterium bovis
RPLPLYCASLRTAEPRLL

SEQ ID NO: 228019 - protein, 17 aa, Mycobacterium bovis
RPVARIVPLKRRRQWLP

SEQ ID NO: 228020 - protein, 17 aa, Mycobacterium bovis
RPWHIGLYGNAGGLGPT

SEQ ID NO: 228021 - protein, 20 aa, Mycobacterium bovis
RQDIPIHYLLADAFTVCDRY

SEQ ID NO: 228022 - protein, 25 aa, Mycobacterium bovis
RQKRLMTLIHLWLVHRFKAQAVHYV

SEQ ID NO: 228023 - protein, 26 aa, Mycobacterium bovis
RQLVDDRWVWLPTLLAGRVFTHRLGA

SEQ ID NO: 228024 - protein, 24 aa, Mycobacterium bovis
RQRHETAILLGWFNAILLGWFNER

SEQ ID NO: 228025 - protein, 21 aa, Mycobacterium bovis
RQVLLPLWNTYSFLALYAPKV

SEQ ID NO: 228026 - protein, 19 aa, Mycobacterium bovis
RRCRLVTARLWPTLIEPLR

SEQ ID NO: 228027 - protein, 20 aa, Mycobacterium bovis
RREIGVPTVFNLLGPLTNPA

SEQ ID NO: 228028 - protein, 18 aa, Mycobacterium bovis
RRELLAQMPPFLTGGSMI

SEQ ID NO: 228029 - protein, 23 aa, Mycobacterium bovis
RREWAFPAWVPLPVSELALGRAH

SEQ ID NO: 228030 - protein, 17 aa, Mycobacterium bovis
RRPDLLVSLLTYWQRHP

SEQ ID NO: 228031 - protein, 20 aa, Mycobacterium bovis
RRRCGWFDAVIARYAARVNG

SEQ ID NO: 228032 - protein, 19 aa, Mycobacterium bovis
RRRLDDLPVLYELAAEEAG

SEQ ID NO: 228033 - protein, 24 aa, Mycobacterium bovis
RRVGRPRIRLAYRLTPRRVLGQRR

SEQ ID NO: 228034 - protein, 23 aa, Mycobacterium bovis
RRVRLMRWGLIPSWIKAGPGGAP

SEQ ID NO: 228035 - protein, 18 aa, Mycobacterium bovis
RSEMAWAFPAVPMVARAP

SEQ ID NO: 228036 - protein, 26 aa, Mycobacterium bovis
RSLQRWRPFGLPPHRWRLAPWYWRGL

SEQ ID NO: 228037 - protein, 18 aa, Mycobacterium bovis
RSLVFPVKRLADLGFRVL

SEQ ID NO: 228038 - protein, 26 aa, Mycobacterium bovis
RSRTHHYPFRLLPPRTMRALLARICE

SEQ ID NO: 228039 - protein, 18 aa, Mycobacterium bovis
RSRWRFTFKRLAAEAQDA

SEQ ID NO: 228040 - protein, 17 aa, Mycobacterium bovis
RSTGIPVCLWFFAKDKA

SEQ ID NO: 228041 - protein, 20 aa, Mycobacterium bovis
RTKLLRLFPTIFKGAHVELD

SEQ ID NO: 228042 - protein, 24 aa, Mycobacterium bovis
RTRIRPHFFPFTEPSAEVDVWFAN

SEQ ID NO: 228043 - protein, 22 aa, Mycobacterium bovis
RVGWRWRLVWYRAVAELLTGDY

SEQ ID NO: 228044 - protein, 24 aa, Mycobacterium bovis
RVKCALLGWMAFKDALAQASEAFE

SEQ ID NO: 228045 - protein, 17 aa, Mycobacterium bovis
RVLFFRWGQHPVALTAF

SEQ ID NO: 228046 - protein, 22 aa, Mycobacterium bovis
RVTAYRWFHAGLLPVPARKVGR

SEQ ID NO: 228047 - protein, 17 aa, Mycobacterium bovis
RVVTIAPGLFDTPLLAS

SEQ ID NO: 228048 - protein, 17 aa, Mycobacterium bovis
RVWGVPAAGLWAHRLGD

SEQ ID NO: 228049 - protein, 26 aa, Mycobacterium bovis
RVYCPGWVALFRWLKPLLSTRVGQRP

SEQ ID NO: 228050 - protein, 20 aa, Mycobacterium bovis
RVYGTLPWHPDLWLDSEDAL

SEQ ID NO: 228051 - protein, 21 aa, Mycobacterium bovis
RWNPPLLFPAIYLADSAQACM

SEQ ID NO: 228052 - protein, 17 aa, Mycobacterium bovis
RWRLAPWYWRGLQVTLE

SEQ ID NO: 228053 - protein, 19 aa, Mycobacterium bovis
RYGVRWHYRLPVWSDFVEV

SEQ ID NO: 228054 - protein, 20 aa, Mycobacterium bovis
RYMHHYNFPPFSTGETGRVG

SEQ ID NO: 228055 - protein, 20 aa, Mycobacterium bovis
RYTWPRFVCALPKEFFAAVR

SEQ ID NO: 228056 - protein, 21 aa, Mycobacterium bovis
SAELPLFRYVGGPNAHILPVP

SEQ ID NO: 228057 - protein, 24 aa, Mycobacterium bovis
SAHAPFAPVPWLADVLRAGVPDGP

SEQ ID NO: 228058 - protein, 25 aa, Mycobacterium bovis
SALVVFEVMVRPLIRLSLGKRHPMR

SEQ ID NO: 228059 - protein, 17 aa, Mycobacterium bovis
SARGLIFALGGAGAAGG

SEQ ID NO: 228060 - protein, 23 aa, Mycobacterium bovis
SAVTVFIPAFLRYDLRPVTGEWQ

SEQ ID NO: 228061 - protein, 23 aa, Mycobacterium bovis
SDALDILRWAPQAASGPVAKVIA

SEQ ID NO: 228062 - protein, 23 aa, Mycobacterium bovis
SDFLGPINWMRPLRAIAARHEVL

SEQ ID NO: 228063 - protein, 22 aa, Mycobacterium bovis
SDRLLNLLIYIKGYLDGTLTFR

SEQ ID NO: 228064 - protein, 22 aa, Mycobacterium bovis
SEALAAPLFWIAANAGLDGSVV

SEQ ID NO: 228065 - protein, 19 aa, Mycobacterium bovis
SEGLLYERRLFHSAFATED

SEQ ID NO: 228066 - protein, 20 aa, Mycobacterium bovis
SEGWRRLLYLLSGRLINAGE

SEQ ID NO: 228067 - protein, 17 aa, Mycobacterium bovis
SELFRRYWPADLHMIGK

SEQ ID NO: 228068 - protein, 26 aa, Mycobacterium bovis
SEQLAHQIHWLLLRFGVGSTVRDYDP

SEQ ID NO: 228069 - protein, 20 aa, Mycobacterium bovis
SFYLRPIVRPVILVAGGTGL

SEQ ID NO: 228070 - protein, 21 aa, Mycobacterium bovis
SGCVLLPGLPYLGLEHRAAWV

SEQ ID NO: 228071 - protein, 25 aa, Mycobacterium bovis
SGDGPPIFLLSLKAGGTGLNLTAAN

SEQ ID NO: 228072 - protein, 20 aa, Mycobacterium bovis
SGGAGGLIGWAGAAGGTGAG

SEQ ID NO: 228073 - protein, 24 aa, Mycobacterium bovis
SGQPLDWFCLFSSAAALTGSPGQS

SEQ ID NO: 228074 - protein, 20 aa, Mycobacterium bovis
SGRPWDRDQLLRALGLRPPG

SEQ ID NO: 228075 - protein, 24 aa, Mycobacterium bovis
SGSGPAYFFLLVEALVDAGVGVGL

SEQ ID NO: 228076 - protein, 17 aa, Mycobacterium bovis
SHKLLIRAGYIRPVAPG

SEQ ID NO: 228077 - protein, 17 aa, Mycobacterium bovis
SHRGRALALLLPALRSL

SEQ ID NO: 228078 - protein, 21 aa, Mycobacterium bovis
SIGAYLWVPDILECLASVMAD

SEQ ID NO: 228079 - protein, 21 aa, Mycobacterium bovis
SKGLPGLGRLGNPGLDGGTGG

SEQ ID NO: 228080 - protein, 19 aa, Mycobacterium bovis
SLGWLRDFLRLHTGGLVVI

SEQ ID NO: 228081 - protein, 27 aa, Mycobacterium bovis
SLLGKPAVLWFWAPWCPTCQGEAPVVG

SEQ ID NO: 228082 - protein, 17 aa, Mycobacterium bovis
SLLQRFPGLGAGATGAT

SEQ ID NO: 228083 - protein, 22 aa, Mycobacterium bovis
SLLVRSLVAWFWDQPLRAPLIR

SEQ ID NO: 228084 - protein, 22 aa, Mycobacterium bovis
SLPDGALMRRAAFGLATEIGRE

SEQ ID NO: 228085 - protein, 17 aa, Mycobacterium bovis
SLTLLPKLSPRAAARYY

SEQ ID NO: 228086 - protein, 21 aa, Mycobacterium bovis
SMNNGLLWRADRQGLLAANYT

SEQ ID NO: 228087 - protein, 23 aa, Mycobacterium bovis
SMVAAVLPFVGWLSTTATLAEQA

SEQ ID NO: 228088 - protein, 24 aa, Mycobacterium bovis
SPAGLLYLVGPIAWTLGFPIVPML

SEQ ID NO: 228089 - protein, 24 aa, Mycobacterium bovis
SPAMNFFPARLTAIGLTLPFGEVT

SEQ ID NO: 228090 - protein, 18 aa, Mycobacterium bovis
SPAPALLALPAAESAWRL

SEQ ID NO: 228091 - protein, 19 aa, Mycobacterium bovis
SPIVGIWHSGGARLAEGVR

SEQ ID NO: 228092 - protein, 18 aa, Mycobacterium bovis
SQHPDFLRLFYLLSMERS

SEQ ID NO: 228093 - protein, 20 aa, Mycobacterium bovis
SQLLYWTQVLMISRGLSLDD

SEQ ID NO: 228094 - protein, 25 aa, Mycobacterium bovis
SRERGYAYFLYPPQVPLTETAYDRL

SEQ ID NO: 228095 - protein, 17 aa, Mycobacterium bovis
SRFLLNLPLFSRQALHP

SEQ ID NO: 228096 - protein, 23 aa, Mycobacterium bovis
SRLTFLAVRRWYGWSAGRILNLD

SEQ ID NO: 228097 - protein, 18 aa, Mycobacterium bovis
SRRHAFLASLLGIRHLVL

SEQ ID NO: 228098 - protein, 18 aa, Mycobacterium bovis
SRVPALPRLGPTDALPRC

SEQ ID NO: 228099 - protein, 24 aa, Mycobacterium bovis
SSVLIQMMWAMRATGMWTDTRGAN

SEQ ID NO: 228100 - protein, 26 aa, Mycobacterium bovis
SSYLLNGLFFSLPWYYRSGYDVLLYT

SEQ ID NO: 228101 - protein, 21 aa, Mycobacterium bovis
STDYLFWRDDDGDYWLAGGRG

SEQ ID NO: 228102 - protein, 23 aa, Mycobacterium bovis
STETRLPFCWRGVSLHAGGAGRV

SEQ ID NO: 228103 - protein, 21 aa, Mycobacterium bovis
STGVAYIRWLLRARPADYMLA

SEQ ID NO: 228104 - protein, 21 aa, Mycobacterium bovis
STPLFFAQAIGRFVRSRRPGE

SEQ ID NO: 228105 - protein, 17 aa, Mycobacterium bovis
SVIPHVLVPGLAAALRA

SEQ ID NO: 228106 - protein, 31 aa, Mycobacterium bovis; identical to SEQ ID NO: 206766

SEQ ID NO: 228107 - protein, 24 aa, Mycobacterium bovis
SVPMYKLRRYFPPDNRPGQPPVGP

SEQ ID NO: 228108 - protein, 24 aa, Mycobacterium bovis
SVVAPLLSRSLILQLRPLTAEDTR

SEQ ID NO: 228109 - protein, 21 aa, Mycobacterium bovis
SWINRLYWNLADYAGSPVRII

SEQ ID NO: 228110 - protein, 20 aa, Mycobacterium bovis
TAAPIERILLRYKAINRVAV

SEQ ID NO: 228111 - protein, 20 aa, Mycobacterium bovis
TAARNFYYGIRLLPREKRAA

SEQ ID NO: 228112 - protein, 20 aa, Mycobacterium bovis
TAFVRRPLRWIQALSEGSRT

SEQ ID NO: 228113 - protein, 23 aa, Mycobacterium bovis
TAKEPWFLDAYQRAWEWADAVHW

SEQ ID NO: 228114 - protein, 20 aa, Mycobacterium bovis
TALRFLPMEELIAAFLPVLF

SEQ ID NO: 228115 - protein, 23 aa, Mycobacterium bovis
TARDLHLLLPDPYTFPSNLLIEH

SEQ ID NO: 228116 - protein, 22 aa, Mycobacterium bovis
TATILAQALIKGGLRLVAAGVN

SEQ ID NO: 228117 - protein, 24 aa, Mycobacterium bovis
TAVFEIFFRKLPPGRSYIMAAGLA

SEQ ID NO: 228118 - protein, 24 aa, Mycobacterium bovis
TDEAPLLATYAFLPIVRAFAEPAG

SEQ ID NO: 228119 - protein, 24 aa, Mycobacterium bovis
TEAEQTFLLRLLGGELRQGAKGGI

SEQ ID NO: 228120 - protein, 20 aa, Mycobacterium bovis
TEIDNWRWAGVPIFVRAGKE

SEQ ID NO: 228121 - protein, 23 aa, Mycobacterium bovis
TEITRLVPFIEWLRGAYPDQLIS

SEQ ID NO: 228122 - protein, 25 aa, Mycobacterium bovis
TERGLLLTTLWYIREVDPTTLLLTG

SEQ ID NO: 228123 - protein, 23 aa, Mycobacterium bovis
TEVRLFLRRVPALAFLPNRRPAE

SEQ ID NO: 228124 - protein, 17 aa, Mycobacterium bovis
TFDFLGIRDLTAGKPII

SEQ ID NO: 228125 - protein, 21 aa, Mycobacterium bovis
TFEYQALLFIPSHAPFDLFDR

SEQ ID NO: 228126 - protein, 19 aa, Mycobacterium bovis
TFFVATAPRYSFVSSSLAK

SEQ ID NO: 228127 - protein, 18 aa, Mycobacterium bovis
TFHIAQLLPWIEANFRTY

SEQ ID NO: 228128 - protein, 20 aa, Mycobacterium bovis
TFPSWPLAHPFRRIAHNGEI

SEQ ID NO: 228129 - protein, 23 aa, Mycobacterium bovis
TGARWLCETFPTCLERGAGIPAV

SEQ ID NO: 228130 - protein, 22 aa, Mycobacterium bovis
TGGNGALLFGFGGAGGAGGHGG

SEQ ID NO: 228131 - protein, 28 aa, Mycobacterium bovis
TGGTAHLGPLAIIGQSGQPGQFGSPGAD

SEQ ID NO: 228132 - protein, 18 aa, Mycobacterium bovis
TGLLIDRLLPVAGSRVVT

SEQ ID NO: 228133 - protein, 18 aa, Mycobacterium bovis
TGLWGRLLPEWEPIRDLP

SEQ ID NO: 228134 - protein, 24 aa, Mycobacterium bovis
TGNTQYYMFLTQDLPLLQPIRDIP

SEQ ID NO: 228135 - protein, 17 aa, Mycobacterium bovis
TGRRVYGTLPWHPDLWL

SEQ ID NO: 228136 - protein, 18 aa, Mycobacterium bovis
TGRSWPLADVRLLAPILA

SEQ ID NO: 228137 - protein, 25 aa, Mycobacterium bovis
THNEPMIPIYIFYSMFGFQRTGDSF

SEQ ID NO: 228138 - protein, 21 aa, Mycobacterium bovis
THYYMFLTQDLPLLQPIRAIP

SEQ ID NO: 228139 - protein, 17 aa, Mycobacterium bovis
TIDPLPLHLALNLTVPD

SEQ ID NO: 228140 - protein, 20 aa, Mycobacterium bovis
TIIPPIHIPSIPLGFAAIGH

SEQ ID NO: 228141 - protein, 23 aa, Mycobacterium bovis
TIPSFIPEDFTFLDAIFAGYATV

SEQ ID NO: 228142 - protein, 21 aa, Mycobacterium bovis
TKAGFDLALLRAVRAAVTVPV

SEQ ID NO: 228143 - protein, 18 aa, Mycobacterium bovis
TLENGLLTGIRKLARPQL

SEQ ID NO: 228144 - protein, 17 aa, Mycobacterium bovis
TLLFPFAAPRVVGDLSE

SEQ ID NO: 228145 - protein, 26 aa, Mycobacterium bovis
TLLRKGERLLVFLPLAHVLARAISMA

SEQ ID NO: 228146 - protein, 26 aa, Mycobacterium bovis
TLPHPLAHLRAFVLIPWIAVDPTAQL

SEQ ID NO: 228147 - protein, 18 aa, Mycobacterium bovis
TLTELWRSYGVQPDLVIG

SEQ ID NO: 228148 - protein, 21 aa, Mycobacterium bovis
TMPRRAPALTAPLLVLHGTDD

SEQ ID NO: 228149 - protein, 24 aa, Mycobacterium bovis
TNLKAWLYRILTNTYINSYRKKQR

SEQ ID NO: 228150 - protein, 22 aa, Mycobacterium bovis
TNPGTLMWWIARSLELLQDFQE

SEQ ID NO: 228151 - protein, 22 aa, Mycobacterium bovis
TNPSPYMYLLQVPNSDGAVDFS

SEQ ID NO: 228152 - protein, 19 aa, Mycobacterium bovis
TNTARPWHIGLYGNAGGLG

SEQ ID NO: 228153 - protein, 24 aa, Mycobacterium bovis
TPAMWAWWFGWHGSDTRRYKLWHP

SEQ ID NO: 228154 - protein, 22 aa, Mycobacterium bovis
TPAQVLLRWNLQLGNAVVVRSA

SEQ ID NO: 228155 - protein, 20 aa, Mycobacterium bovis
TPFMGMAPLLINYIPQQLAL

SEQ ID NO: 228156 - protein, 18 aa, Mycobacterium bovis
TPMDFLRDTLLWAKLIDK

SEQ ID NO: 228157 - protein, 25 aa, Mycobacterium bovis
TPPPPPPLPPVPFPKECPAPGVMQG

SEQ ID NO: 228158 - protein, 23 aa, Mycobacterium bovis
TPVFVKWLLRRTAIKNLPEGYDI

SEQ ID NO: 228159 - protein, 18 aa, Mycobacterium bovis
TPVVAMPLLRRGNKEVHG

SEQ ID NO: 228160 - protein, 20 aa, Mycobacterium bovis
TPWNFPHQINLAKLGPALAA

SEQ ID NO: 228161 - protein, 20 aa, Mycobacterium bovis
TPYPPARLEKLWLPGPDRLL
